United States Patent
O'Malley et al.

(10) Patent No.: US 10,717,768 B2
(45) Date of Patent: Jul. 21, 2020

(54) PROTEINS FROM ANAEROBIC FUNGI AND USES THEREOF

(71) Applicant: The Regents of the University of California, Oakland, CA (US)

(72) Inventors: Michelle O'Malley, Santa Barbara, CA (US); Kevin Solomon, Santa Barbara, CA (US); Charles Haitjema, Santa Barbara, CA (US)

(73) Assignee: The Regents of the University of California, Oakland, CA (US)

( * ) Notice: Subject to any disclaimer, the term of this patent is extended or adjusted under 35 U.S.C. 154(b) by 204 days.

(21) Appl. No.: 15/782,016

(22) PCT Filed: Dec. 8, 2016

(86) PCT No.: PCT/US2016/065579
§ 371 (c)(1),
(2) Date: Jun. 6, 2018

(87) PCT Pub. No.: WO2017/100429
PCT Pub. Date: Jun. 15, 2017

(65) Prior Publication Data
US 2018/0362597 A1 Dec. 20, 2018

Related U.S. Application Data

(60) Provisional application No. 62/296,064, filed on Feb. 16, 2016, provisional application No. 62/265,397, filed on Dec. 9, 2015.

(51) Int. Cl.
| | | |
|---|---|---|
| *C12N 1/20* | (2006.01) | |
| *C07K 14/37* | (2006.01) | |
| *C12N 15/52* | (2006.01) | |
| *C12N 9/00* | (2006.01) | |
| *C12N 9/24* | (2006.01) | |
| *C12P 7/10* | (2006.01) | |
| *C12P 21/02* | (2006.01) | |
| *C12P 39/00* | (2006.01) | |
| *C12N 9/04* | (2006.01) | |
| *C12N 15/70* | (2006.01) | |
| *C12N 15/81* | (2006.01) | |

(52) U.S. Cl.
CPC .............. *C07K 14/37* (2013.01); *C12N 9/00* (2013.01); *C12N 9/24* (2013.01); *C12N 15/52* (2013.01); *C12P 7/10* (2013.01); *C12P 21/02* (2013.01); *C12P 39/00* (2013.01); *C12N 9/0006* (2013.01); *C12N 15/70* (2013.01); *C12N 15/81* (2013.01)

(58) Field of Classification Search
CPC .................................................... C07K 14/37
See application file for complete search history.

(56) References Cited

U.S. PATENT DOCUMENTS 8,361,752 B2   1/2013  Kohda et al.
2011/0306105 A1  12/2011  Chen et al.

FOREIGN PATENT DOCUMENTS

EP      2410061 A1    1/2012
WO   2015-019346 A1   2/2015

OTHER PUBLICATIONS

Rincon, Marco T. et al., "A Novel Cell Surface-Anchored 1-22,30,32-33 Cellulose-Binding Protein Encoded by the sea Gene Cluster of Ruminococcus flavefaciens", Journal of Bacteriology, [E-pub] Apr. 27, 2007, vol. 189, No. 13, pp. 4774-4783. See abstract.

*Primary Examiner* — Albert M Navarro

(57) ABSTRACT

Provided herein are novel proteins and protein domains from newly discovered anaerobic fungal species. The anaerobic fungal species have unique enzymatic capabilities, including the ability to digest diverse lignocellulosic biomass feedstocks and to synthesize secondary metabolites. The scope of the invention encompasses novel engineered proteins comprising glycoside hydrolase enzymes, dockerin domains, carbohydrate binding domains, and polyketide synthase enzymes. The invention further encompasses artificial cellulosomes comprising novel proteins and domains of the invention. The scope of the invention further includes novel nucleic acid sequences coding for the engineered proteins of the invention, and methods of using such engineered organisms to degrade lignocellulosic biomass and to create polyketides.

9 Claims, 1 Drawing Sheet
Specification includes a Sequence Listing.

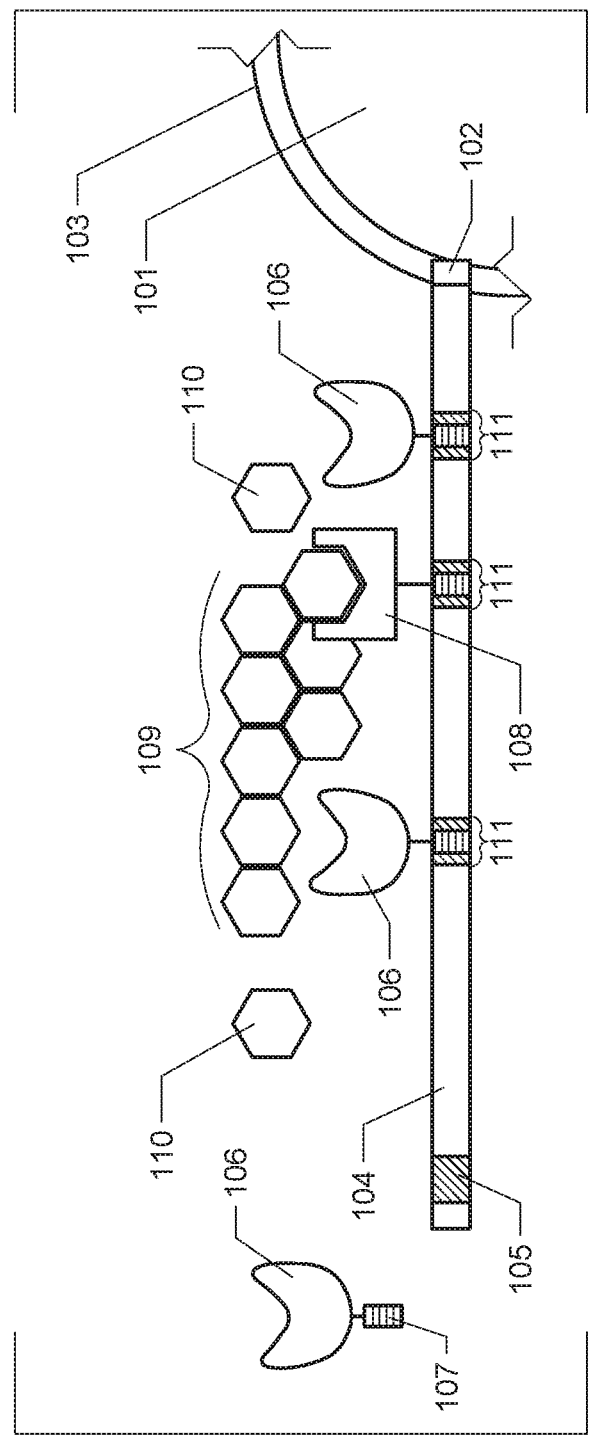

PROTEINS FROM ANAEROBIC FUNGI AND USES THEREOF

CROSS-REFERENCE TO RELATED APPLICATIONS

This application claims priority to International Patent Application Number PCT/US2016/065579, entitled "Novel Proteins from Anaerobic Fungi and Uses Thereof" filed on Dec. 8, 2016, which claims priority to U.S. Provisional Patent Application No. 62/265,397 entitled "Novel Polyketide Synthase Domains from Fungal Organisms," filed Dec. 9, 2015 and U.S. Provisional Application Ser. No. 62/296,064 entitled "Production of Biofuels from Novel Fungal Strains and Enzymes Derived Therefrom," filed Feb. 16, 2016, the contents which are hereby incorporated by reference.

STATEMENT REGARDING FEDERALLY SPONSORED RESEARCH OR DEVELOPMENT

This invention was made with government support under grant number W911NF-09-D-0001 awarded by the United States Army. The government has certain rights in the invention.

REFERENCE TO SEQUENCE LISTING, A TABLE, OR A COMPUTER PROGRAM LISTING COMPACT DISK APPENDIX

The instant application contains a Sequence Listing which has been filed electronically in ASCII format and is hereby incorporated by reference in its entirety. Said ASCII copy, created on Dec. 6, 2016, is named UCSB007PCT_SL.txt and is 21,694,502 bytes in size.

BACKGROUND OF THE INVENTION

Microbial communities have evolved immense enzymatic capabilities. In particular, anaerobic fungi perform metabolic feats which potentially could be adapted for great benefit. For example, the efficient conversion of biomass into fuels could provide humankind with an inexpensive, unlimited, and environmentally sustainable source of energy. However, current biomass conversion technologies are not economically scalable due to the recalcitrance of woody biomass. While humans have struggled to effectively capture energy from biomass, anaerobic fungi efficiently convert such material into many billions of joules of energy each day, in the digestive tracts of herbivores. These organisms have evolved efficient enzymatic machinery to break down cellulosic material in lignin rich plant material.

In addition to efficiently breaking down biomolecules, anaerobic fungi are able to synthesize complex natural products which are difficult or impossible to make using synthetic chemistry. Fungi have rich enzymatic abilities which create a diversity of biologically active molecules. Roughly 40% of drugs in use today were derived from fungi, for example, including antibiotics such as penicillin, chemotherapeutics such as vincristine or vinblastine, and cholesterol-lowering drugs such as statins. The prevalence of useful biomolecules produced by fungi is enabled by their unique enzymatic capabilities.

While the potential of fungi to improve bioproduction technologies is huge, large numbers of fungal species cannot contribute because they are not amenable to culture, isolation, and study. Anaerobic fungi in particular are very difficult to culture compared to model organisms such as aerobic bacteria or yeast. The anaerobic fungi have therefore been severely underrepresented in bioprospecting efforts due to the bottlenecks associated with their study.

Advantageously, the inventors of the present disclosure have developed methodologies for the culture of anaerobic fungi. This development has enable the isolation and characterization of organisms which were never previously studied. From this work, novel species of gut fungi have been isolated and their transcriptomes have been sequenced, revealing a multitude of new genes and proteins that can be used in energy production, in the synthesis of novel compounds, and in other applications.

SUMMARY OF THE INVENTION

The inventors of the present disclosure have identified four novel species of anaerobic fungi and have identified numerous useful protein domains and nucleic acid sequences coding therefor. These novel sequences provide the art with new enzymatic tools. In one aspect, the invention is directed to methods and compositions of matter utilized in the production of biofuels from lignocellulosic biomass utilizing the novel domains of the invention. In one aspect, the scope of the invention encompasses novel catalytic domains applied in the digestion of lignocellulosic biomass. In another aspect, the scope of the invention encompasses structural components which are incorporated into enzyme complexes, such as cellulosomes. Disclosed herein are novel engineered scaffoldins, glycoside hydrolase enzymes, dockerins, cohesins, and domains therefrom, as well as other catalytic proteins and protein domains involved in the breakdown of plant material. In another aspect, the scope of the invention encompasses methods of producing biofuels utilizing the novel organisms described herein in bioreactors or like processes.

In yet another aspect, the scope of the invention encompasses methods and compositions of matter which are utilized in the production of secondary compounds, such as polyketides. In one aspect, the compositions of the invention encompass engineered polyketide synthase complexes comprising one or more novel domains of the invention. In another aspect, the scope of the invention encompasses methods of using the domains of the invention in the production of secondary compounds.

BRIEF DESCRIPTION OF THE DRAWING

FIG. 1 is a conceptual diagram of a cellulosome. The cellulosome complex comprises a scaffoldin (104), comprising a plurality of cohesins (105). Enzymatic moieties comprising catalytic domains (106) are attached to the scaffold by the docking of dockerins (107) to complementary cohesion molecules in dockerin-cohesin complexes (111). The docked proteins further include carbohydrate binding entities (108). The cellulosome is anchored in the cell membrane (103) of a host cell (101) by an anchoring moiety such as a transmembrane helix (102). The cellulosome can digest a complex polymer (109) such as cellulose into monomers (110).

DETAILED DESCRIPTION OF THE INVENTION

Four novel anaerobic gut fungi were isolated and cultured. The organisms include *Piromyces finnis* isolated from horse feces, *Neocallimastix californiae*, isolated from goat feces, *Anaeromyces robustus*, isolated from sheep feces, and *Neocallimastix* sp S4, isolated from sheep feces.

Utilizing novel culture methods, the organisms were isolated and pure cultures were attained, enabling the performance of sequencing efforts. Next-generation sequencing techniques were then utilized identify sequences expressed by the fungal cells. DNA analysis tools were then used to identify domains present in the expressed proteins. By their homology to known sequences, numerous types of useful domains were identified, including catalytic domains and structural domains.

The several domains identified are provided in the sequence listing submitted herewith. Table 1 lists domain names and a description for each domain name which identifies a gene or gene family associated with the sequence, as assigned by bioinformatic tools.

Each domain is represented as a novel polypeptide sequence having a domain description based on its similarity to known proteins from other organisms. Each domain is also provided as a nucleic acid sequence coding for the disclosed polypeptides. The listed protein sequences are provided in standard one-letter amino acid code, as known in the art. The listed nucleic acid sequences comprise fungal cDNA sequences. In the nucleic acids sequence listings, A is adenine; C is cytosine; G is guanine; T is thymine; and N is any of the four bases. The codon preferences of the anaerobic fungi are generally in line with those of model organisms, although fungal sequences tend to have a higher A-T content.

It will be noted that in some cases, multiple variants of a domain are listed, having been derived from the same transcript sequence. This is due to the use of multiple genetic identification tools, which in some cases use diverging models to recognize, define, and annotate protein domains. These models recognize a number of unique features, such as the N- or C-termini of catalytic domains, key catalytic residues, etc., each with their own start and stop sites, resulting in overlapping domain annotations for some transcripts.

The present disclosure provides the art with a large number of novel protein domains and corresponding nucleic acid sequences that may be applied in various contexts. Domains which are applicable to the various compositions and methods described herein can be readily selected from the sequence listing submitted based on the domain labels and descriptions provided in Table 1.

TABLE 1

Domain labels, descriptions, and SEQ ID NO.'s.

| Domain Label | Domain Description | Protein Seq ID No.'s | Nucleic Acid Seq. ID No.'s |
| --- | --- | --- | --- |
| (Trans)glycosidases | Glycosidase | 1-155 | 13663-13818 |
| 1-PHOSPHATIDYLINOSITOL PHOSPHODIESTERASE-RELATED PROTEIN | 1-Phosphatidylinositol phosophodiesterase | 156-157 | 13819-13820 |
| 4-PPantetheinyl_Trfase_SF | 4'-phosphopantetheinyl transferase | 158-165 | 13821-13827 |
| 4'-phosphopantetheinyl transferase | 4'-phosphopantetheinyl transferase | 166-173 | 13828-13835 |
| 6-blade_b-propeller_TolB-like | six-bladed beta-propeller domain found in TolB protein | 174 | 13836 |
| 6hp_glycosidase | Glycosidase-six hairpin type | 175-322 | 13837-13984 |
| 9-O-ACETYL-N-ACETYLNEURAMINIC ACID DEACETYLASE-RELATED | 9-O-acetyl-N-acetylneuraminic acid deacetylase | 323-333 | 13885-13995 |
| AAC-RICH MRNA CLONE AAC4 PROTEIN-RELATED | AAC-RICH MRNA CLONE AAC4 PROTEIN-RELATED | 334 | 13996 |
| AB_hydrolase | Alpha-beta hydrolase fold domain found in hydrolytic enzymes | 335-450 | 13997-14112 |
| Abhydrolase_5 | Alpha-beta hydrolase fold domain 5 found in hydrolytic enzymes | 451-464 | 14113-14126 |
| Ac_transferase_dom | Acyl Transferase Domain | 465-578 | 14127-14240 |
| ACCESSORY GLAND PROTEIN ACP76A-RELATED | Accessory Gland Protein domain with similarity to that found in flies | 579-583 | 14241-14245 |
| Acetyl-CoA synthetase-like | Acetyl CoA Synthetase | 584-603 | 14246-14265 |
| ACID PHOSPHATASE RELATED | Acid phosphatase | 604-623 | 14266-14285 |
| ACP_DOMAIN | Acyl Carrier Protein | 624-668 | 14286-14330 |
| ACP-like | Acyl Carrier Protein | 669-714 | 14331-14376 |
| ACPS | Acyl Carrier Protein Synthase, a phosphopantetheinyl transferase | 715-722 | 14377-14384 |
| Acyl_carrier_prot-like | Acyl Carrier Protein | 723-767 | 14385-14429 |
| Acyl_transf_1 | Acyl Transferase | 768-798 | 14430-14460 |
| ACYL-COA THIOESTERASE I | Acyl CoA Thioesterase I | 799 | 14461 |
| ADH_N | Catalytic domain of alcohol dehydrogenase | 800-807 | 14462-14469 |
| adh_short | Domain from short chain dehydrogenase family | 808-823 | 14470-14485 |

TABLE 1-continued

Domain labels, descriptions, and SEQ ID NO.'s.

| Domain Label | Domain Description | Protein Seq ID No.'s | Nucleic Acid Seq. ID No.'s |
|---|---|---|---|
| adh_short_C2 | Domain from short chain dehydrogenase C2 family | 824-832 | 14486-14494 |
| ADH_ZINC | Domain from alcohol dehydrogenase, zinc type | 833-835 | 14495-14497 |
| ADH_zinc_N | Domain from alcohol dehydrogenase, zinc type | 836-851 | 14498-14513 |
| ALCOHOL DEHYDROGENASE RELATED | Domain from alcohol dehydrogenase | 852-862 | 14514-14524 |
| Aldolase_TIM | beta/alpha barrel domain found in aldolases | 863-870 | 14525-14532 |
| ALPHA-L-FUCOSIDASE 2 | Alpha-L-fucosidase | 871-874 | 14533-14536 |
| alpha/beta-Hydrolases | Alpha-beta hydrolase fold domain found in hydrolytic enzymes | 875-972 | 14537-14634 |
| Aminotran_1_2 | Class I/Class II Aminotransferase | 973-982 | 14635-14644 |
| AMP_BINDING | AMP binding domain | 983-999 | 14645-14661 |
| AMP-binding_C | C terminal domain of AMP binding enzyme | 1000-1001 | 14662-14663 |
| Arabinanase/levansucrase/invertase | Member of Arabinanase/levansucrase/invertase superfamily | 1002-1058 | 14664-14720 |
| ARF/SAR SUPERFAMILY PROTEIN-RELATED | Member of small GTPASE superfamily | 1059-1060 | 14721-14722 |
| AT18611P-RELATED | Carbohydrate binding domain | 1061-1062 | 14723-14724 |
| B_KETOACYL_SYNTHASE | Beta-ketoacyl-ACP synthase | 1063-1094 | 14725-14756 |
| Barwin-like endoglucanases | Endoglocanase | 1095-1204 | 14757-14866 |
| Beta_cellobiohydrolase | 1,4-beta cellobiohydrolase | 1205-1286 | 14867-14948 |
| Beta-D-glucan exohydrolase, C-terminal domain | Beta-D-glucan exohydrolase, C-terminal domain | 1287-1297 | 14949-14959 |
| BETA-GALACTOSIDASE | Glycoside hydrolase Beta-Galasctosidase | 1298-1303 | 14960-14965 |
| beta-Galactosidase/glucuronidase domain | beta-Galactosidase/glucuronidase domain | 1304-1309 | 14966-14971 |
| BETA/GAMMA CRYSTALLIN | Beta-Gamma Crystallin Structural Protein | 1310-1316 | 14972-14978 |
| Bgal_small_N | Beta-galactosidase small chain | 1317-1322 | 14979-14984 |
| BNR | BNR repeat sequence | 1323-1324 | 14985-14986 |
| Carb_bind | Carbohydrate Binding Domain | 1325-1327 | 14987-14989 |
| Carbohydrate-binding domain | Carbohydrate Binding Domain | 1328-1333 | 14990-14995 |
| CarboxyPept_regulatory_dom | Regulatory domain of carboxypeptidase | 1334-1337 | 14996-14999 |
| CBD_carb-bd_dom | Carbohydrate Binding Domain | 1338-1344 | 15000-15006 |
| CBD_IV | Cellulose binding domain, Type IV | 1345-1370 | 15007-15032 |
| CBM_1 | Fungal cellulose binding domain | 1371-1419 | 15033-15081 |
| CBM_10 | Dockerin and Carbohydrate Binding Domain, Type 10 | 1420-3705 | 15082-17367 |
| CBM_2 | Carbohydrate Binding Domain, Type 2 | 3706-3709 | 17368-17371 |
| CBM_4_9 | Carbohydrate Binding Domain | 3710-3714 | 17372-17376 |
| CBM_6 | Carbohydrate Binding Domain, family 6 | 3715-3736 | 17377-17398 |
| CBM-like | Carbohydrate Binding Domain | 3737-3740 | 17399-17402 |
| CBM1_1 | Carbohydrate Binding Domain | 3740-3758 | 17403-17420 |
| CBM1_2 | Carbohydrate Binding Domain | 3759-3841 | 17421-17503 |
| CBM6 | Carbohydrate Binding Domain, family 6 | 3842-3850 | 17504-17512 |
| Cellulase | Cellulase | 3851-3962 | 17513-17624 |
| CELLULASE (GLYCOSYL HYDROLASE FAMILY 5) PROTEIN-RELATED | Cellulase-glycosyl hydrolase family 5 | 3963-3972 | 17625-17634 |
| Cellulose docking domain, dockering | Carbohydrate Binding Domain | 3973-6217 | 17635-19879 |
| Cellulose-binding domain | Carbohydrate Binding Domain | 6218-6254 | 19880-19916 |
| CHB_HEX_C | Chitinase-Chitobiase, C terminal domain | 6255-6262 | 19917-19924 |
| CHIT_BIND_I_1 | Chitin Binding Site, Type 1, may bind N-acetylglucosamine | 6263-6265 | 19923-19927 |
| CHIT_BIND_I_2 | Chitin Binding Site, Type 1, may bind N-acetylglucosamine | 6266-6270 | 19928-19932 |

TABLE 1-continued

Domain labels, descriptions, and SEQ ID NO.'s.

| Domain Label | Domain Description | Protein Seq ID No.'s | Nucleic Acid Seq. ID No.'s |
|---|---|---|---|
| CHITIN DEACETYLASE 1-RELATED | allantoinase/chitin deacetylase 1 | 6271 | 19933 |
| Chitin_bind_1 | Chitin Binding Site, Type 1, may bind N-acetylglucosamine | 6272-6275 | 19934-19937 |
| Chitin-bd_1 | Chitin Binding Site, Type 1, may bind N-acetylglucosamine | 6276-6282 | 19938-19944 |
| CHITINASE | Chitinase | 6283-6291 | 19945-19953 |
| Chitinase insertion domain | Chitinase insertion domain | 6292-6300 | 19954-19962 |
| CHITINASE_18 | Chitinase, family 18 | 6301-6303 | 19963-19965 |
| Chitinase_insertion | Chitinase insertion domain | 6304-6312 | 19966-19974 |
| Chitobiase/Hex_dom_2-like | domain 2 of bacterial chitobiases and beta-hexosaminidases | 6313-6314 | 19975-19976 |
| ChtBD1 | Chitin Binding Site, Type 1, may bind N-acetylglucosamine | 6315-6318 | 19977-19980 |
| CINNAMYL ALCOHOL DEHYDROGENASE 2-RELATED | cinnamyl-alcohol dehydrogenase | 6319-6322 | 19981-19984 |
| ClpP/crotonase | Crotonase like domain | 6323-6333 | 19985-19995 |
| ClpP/crotonase-like_dom | Crotonase like domain | 6334-6344 | 19996-20006 |
| CoA-dependent acyltransferases | CoA-dependent acyltransferases | 6345-6349 | 20007-20011 |
| ConA-like_subgrp | Concanavalin A-like lectins/glucanases | 6350-6375 | 20012-20037 |
| Concanavalin A-like lectins/glucanases | Concanavalin A-like lectins/glucanases | 6376-6433 | 20038-20095 |
| Condensation | Condensation domain | 6434-6436 | 20096-20098 |
| CotH | spore coat protein, involved in plant cell wall binding | 6437-6584 | 20099-20246 |
| Cystine-knot_cytokine | Cystine-knot_cytokine | 6585 | 20247 |
| CYTH-like phosphatases | Phosphatase-acts on triphosphorylated substrates | 6586-6587 | 20248-20249 |
| CYTH-like_domain | Phosphatase-acts on triphosphorylated substrates | 6588-6589 | 20250-20251 |
| Dockerin_dom | Dockerin domain | 6590-7679 | 20252-21341 |
| Dockerin_dom_fun | Dockerin domain | 7680-8910 | 21342-22572 |
| DPBB_1 | Lytic transglycolase | 8911-8919 | 22573-22581 |
| DUF1729 | Domain of unknown function-Found in acyl transferase domains | 8920-8930 | 22582-22592 |
| DUF303 | Domain of unknown function DUF303, acetylesterase | 8931-8946 | 22593-22608 |
| DUF4353 | Domain of unknown function | 8947-8949 | 22609-22611 |
| ECH | Enoyl-CoA hydratase | 8950-8959 | 22612-22621 |
| EGGSHELL | eggshell | 8960-8963 | 22622-22625 |
| Endo-1-4-beta-glucanase_dom2 | Endo-1-4-beta-glucanase, domain 2 | 8964 | 22626 |
| ENDO-1,4-BETA-GLUCANASE | Endo-1-4-beta-glucanase | 8965-8998 | 22627-22660 |
| ENDOGLUCANASE | Endoglucanse | 8999-9022 | 22661-22684 |
| Endoglucanase_F_dom3 | Endoglucase F, domain 3 | 9023-9055 | 22685-22717 |
| ENTEROBACTIN SYNTHASE COMPONENT F | Entorbactin Synthase Component F | 9056 | 22718 |
| Esterase | Esterase | 9057-9080 | 22719-22742 |
| Expansin_CBD | C-terminal carbohydrate binding domain of expansin | 9081-9106 | 22743-22768 |
| EXPANSIN_EG45 | N terminal domain of expansin | 9107-9127 | 22769-22789 |
| EXTRACELLULAR MATRIX GLYCOPROTEIN RELATED | Extracellular matrix glycoprotein related domain | 9128-9129 | 22790-22791 |
| FabD/lysophospholipase-like | FabD/lysophospholipase-like domain-found in hydrolases | 9130-9240 | 22792-22902 |
| FAMILY NOT NAMED | Not associated with known sequences | 9240-9338 | 22903-23600 |
| FASYNTHASE | Fatty Acid Synthase | 9339-9468 | 23601-23130 |
| FATTY ACID SYNTHASE SUBUNIT BETA | Fatty Acid Synthase-subunit beta | 9469-9479 | 23131-23141 |
| fCBD | Cellulose binding domain | 9480-9605 | 23142-23267 |
| fn3_3 | domain II of rhamnogalacturonan lyase | 9606-9609 | 23268-23271 |
| Fn3_assoc | domain II of rhamnogalacturonan lyase | 9610 | 23272 |
| Fn3-like | domain II of rhamnogalacturonan lyase | 9611-9619 | 23273-23281 |

TABLE 1-continued

Domain labels, descriptions, and SEQ ID NO.'s

| Domain Label | Domain Description | Protein Seq ID No.'s | Nucleic Acid Seq. ID No.'s |
|---|---|---|---|
| Galactose mutarotase-like | Galactose mutarotase-like domain-binds carbohydrates | 9620-9626 | 23282-23288 |
| Galactose-bd-like | Galactose binding domain-like fold | 9627-9668 | 23289-23330 |
| Galactose-binding domain-like | Galactose binding domain-like fold | 9669-9727 | 23331-23389 |
| GDHRDH | short-chain dehydrogenases/reductase family | 9728-9748 | 23390-23410 |
| GH_fam_N_dom | domain is found towards the N terminus of some glycosyl hydrolase family members, including alpha-L-fucosidases | 9749-9753 | 23411-23415 |
| GH04125P-RELATED | Serine protease inhibitor related | 9754 | 23416 |
| GH97_C | Glycosyl-hydrolase 97, C-terminal oligomerisation domain | 9755 | 23417 |
| GH97_N | Glycosyl-hydrolase 97, N-terminal domain | 9756 | 23418 |
| GLHYDRLASE10 | Glycoside hydrolase family 10 domain | 9757-9889 | 23419-23551 |
| GLHYDRLASE11 | Glycoside hydrolase family 11 | 9890-9998 | 23552-23660 |
| GLHYDRLASE16 | Glycoside hydrolase family 16 | 9999-10013 | 23661-23675 |
| GLHYDRLASE2 | Glycoside hydrolase family 2 | 10014-10028 | 23676-23690 |
| GLHYDRLASE26 | Glycoside hydrolase family 26 | 10029-10054 | 23691-23716 |
| GLHYDRLASE3 | Glycoside hydrolase, family 3, N-terminal | 10055-10094 | 23717-23756 |
| GLHYDRLASE48 | Glycoside hydrolase family 48 | 10095-10308 | 23757-23970 |
| GLHYDRLASE6 | Glycoside hydrolase family 6 | 10309-10791 | 23971-24453 |
| GLHYDRLASE8 | Glycoside hydrolase family 8 | 10792-10818 | 24454-24480 |
| GLUCOSE-METHANOL-CHOLINE (GMC) OXIDOREDUCTASE | Glucose-methanol-choline oxidoreductase | 10819-10820 | 24481-24482 |
| GLUCOSYLCERAMIDASE | Glucosylceramidase | 10821-10823 | 24483-24485 |
| Glyco_10 | Glycoside hydrolase family 10 | 10824-10858 | 24486-24520 |
| Glyco_18 | Glycoside hydrolase family 18 | 10859-10865 | 24520-24572 |
| Glyco_hyd_65N_2 | N-terminus of the glycosyl hydrolase 65 family catalytic domain | 10866-10870 | 24573-24532 |
| Glyco_hydr_30_2 | Glycoside hydrolase family 30 | 10871-10873 | 24533-24535 |
| Glyco_hydro_10 | Glycoside hydrolase family 10 | 10874-10913 | 24536-24575 |
| Glyco_hydro_11 | Glycoside hydrolase family 11 | 10914-10949 | 24576-24611 |
| Glyco_hydro_11/12 | Glycoside hydrolase family 11/12 | 10950-10986 | 24612-24684 |
| Glyco_hydro_114 | Glycosyl-hydrolase family, number 114potential endo-alpha-1,4-polygalactosaminidase | 10987-10989 | 24685-24651 |
| Glyco_hydro_13_b | Glycoside hydrolase family 13 | 10990-10991 | 24652-24653 |
| Glyco_hydro_16 | Glycoside hydrolase family 16 | 10992-11001 | 24654-24663 |
| Glyco_hydro_18 | Glycoside hydrolase family 18 | 11002-11010 | 24664-24672 |
| Glyco_hydro_2 | Glycoside hydrolase family 2 | 11011-11013 | 24673-24675 |
| Glyco_hydro_2_C | Glycoside hydrolase family 2 | 11014-11016 | 24676-24678 |
| Glyco_hydro_2_N | Glycoside hydrolase family 2-N terminal domain | 11017-11019 | 24679-24681 |
| Glyco_hydro_2/20_Ig-like | Glycoside hydrolase, family 2/20, immunoglobulin-like beta-sandwich domain | 11020-11025 | 24682-24687 |
| Glyco_hydro_26 | Glycoside hydrolase family 26 | 11026-11032 | 24688-24694 |
| Glyco_hydro_3 | Glycoside hydrolase family 3 | 11033-11041 | 24695-24703 |
| Glyco_hydro_3_C | Glycoside hydrolase family 3-C terminal domain | 11042-11059 | 24704-24721 |
| Glyco_hydro_3_N | Glycoside hydrolase family 3-N terminal domain | 11060-11068 | 24722-24730 |
| Glyco_hydro_39 | Glycoside hydrolase family 39 | 11069-11081 | 24731-24743 |
| Glyco_hydro_43 | Glycoside hydrolase family 43 | 11082-11129 | 24744-24791 |
| Glyco_hydro_45 | Glycoside hydrolase family 45 | 11130-11153 | 24792-24815 |
| Glyco_hydro_48 | Glycoside hydrolase family 48 | 11154-11186 | 24816-24848 |
| Glyco_hydro_53 | Glycoside hydrolase family 53 | 11187-11189 | 24849-24851 |
| Glyco_hydro_6 | Glycoside hydrolase family 6 | 11190-11270 | 24852-24932 |
| Glyco_hydro_8 | Glycoside hydrolase family 8 | 11271-11276 | 24933-24938 |
| Glyco_hydro_88 | Glycoside hydrolase family 88 | 11277-11278 | 24939-24940 |
| Glyco_hydro_9 | Glycoside hydrolase family 9 | 11279-11312 | 24941-24974 |
| Glyco_hydro_97 | Glycoside hydrolase family 97 | 11313 | 24975 |
| Glyco_hydro_beta-prop | five-bladed beta-propellor domain found in some glycosyl hydrolases | 11314-11361 | 24976-25023 |

TABLE 1-continued

Domain labels, descriptions, and SEQ ID NO.'s.

| Domain Label | Domain Description | Protein Seq ID No.'s | Nucleic Acid Seq. ID No.'s |
|---|---|---|---|
| Glyco_hydro_catalytic_dom | catalytic TIM beta/alpha barrel common to many different families of glycosyl hydrolases | 11362-11510 | 25024-25172 |
| Glyco_hydro-type_carb-bd_sub | Carbohydrate binding domain from glycoside hydrolases | 11511-11517 | 25173-25179 |
| Glycoside hydrolase/deacetylase | Glycoside hydrolase/deacetylase family | 11518-11521 | 25180-25183 |
| GLYCOSYL HYDROLASE 43 FAMILY MEMBER | Glycoside hydrolase family 43 | 11522-11560 | 25184-25222 |
| Glycosyl hydrolase domain | catalytic TIM beta/alpha barrel common to many different families of glycosyl hydrolases | 11561-11562 | 25223-25224 |
| GLYCOSYL HYDROLASE-RELATED | related to known glycosyl hydrolase domains | 11563-11564 | 25225-25226 |
| Glycosyl hydrolases family 6, cellulases | Glycosyl hydrolases family 6, cellulases | 11565-11648 | 25227-25310 |
| GLYCOSYL TRANSFERASE-RELATED | Glycosyl transferase related domain | 11649-11669 | 25311-25331 |
| GLYCOSYL_HYDROL_F10 | Glycoside hydrolase family 10 | 11670-11688 | 25332-25350 |
| GLYCOSYL_HYDROL_F11_1 | Glycoside hydrolase family 11 | 11689-11719 | 25351-25381 |
| GLYCOSYL_HYDROL_F11_2 | Glycoside hydrolase family 11 | 11720-11721 | 25382-25383 |
| GLYCOSYL_HYDROL_F3 | Glycoside hydrolase family 3 | 11722 | 25384 |
| GLYCOSYL_HYDROL_F45 | Glycoside hydrolase family 45 | 11723-11742 | 25385-25404 |
| GLYCOSYL_HYDROL_F5 | Glycoside hydrolase family 5 | 11743-11765 | 25405-25427 |
| GLYCOSYL_HYDROL_F6_2 | Glycoside hydrolase family 6 | 11766-11816 | 25428-25478 |
| GLYCOSYL_HYDROL_F9_2 | Glycoside hydrolase family 9-signature found in endglucanases and other glycoside hydrolases | 11817-11844 | 25479-25506 |
| GroES-like | Similarity to GroES (chaperonin 10), an oligomeric molecular chaperone | 11845-11882 | 25507-25544 |
| HMG_CoA_synt_C | Hydroxymethylglutaryl-coenzyme A synthase C-terminal domain | 11883-11888 | 245545-25550 |
| HMG_CoA_synt_N | Hydroxymethylglutaryl-coenzyme A synthase N-terminal domain | 11889-11891 | 25551-25553 |
| HotDog_dom | domain found in thioesterases and thiol ester dehydratase-isomerases | 11892-11921 | 25554-25583 |
| HxxPF_rpt | HxxPF-repeat domain. This family is found in non-ribosomal peptide synthetase proteins. | 11922 | 25584 |
| ICP-like | ICP-like domain | 11923 | 25585 |
| Inhibitor_I42 | Protease inhibitor | 11924 | 25586 |
| Inosine monophosphate dehydrogenase (IMPDH) | Inosine monophosphate dehydrogenase | 11925-11933 | 25587-25595 |
| Integrin alpha N-terminal domain | Integrin alpha N-terminal domain | 11934-11937 | 25596-25599 |
| KAZAL_1 | serine proteinase inhibitor | 11938 | 25600 |
| ketoacyl-synt | Beta-ketoacyl synthase | 11939-11983 | 25601-25645 |
| Ketoacyl-synt_C | Beta-ketoacyl synthase, C-terminal domain | 11984-12027 | 25646-25689 |
| KR | Ketoreductase | 12028-12043 | 25690-25705 |
| L domain-like | Leucine rich repeat domain | 12044-12047 | 25706-25709 |
| LamGL | LamG-like jellyroll fold | 12048-12050 | 25710-25712 |
| Laminin_G_3 | This domain belongs to the Concanavalin A-like lectin/glucanases superfamily | 12051-12053 | 25713-25715 |
| LEUCINE-RICH REPEAT RECEPTOR-LIKE PROTEIN KINASE | Leucine-Rich Repeat Receptor-Like Kinase1 | 12054-12057 | 25716-25719 |
| Lipase_GDSL | Domain from GDSL esterases and lipases | 12058-12067 | 25720-25729 |
| Lipase_GDSL_2 | Domain from family of presumed lipases and related enzymes | 12068-12070 | 25730-25732 |
| LRR | Leucine rich repeat | 12071-12082 | 25733-25744 |
| LRR_1 | Leucine rich repeat | 12083-12090 | 25745-25752 |
| LRR_4 | Leucine rich repeat | 12091-12093 | 25753-25755 |
| LRR_6 | Leucine rich repeat | 12094 | 25756 |
| LRR_8 | Leucine rich repeat | 12095-12098 | 25757-25760 |
| LRR_SD22 | Leucine rich repeat | 12099-12101 | 25761-25763 |

TABLE 1-continued

Domain labels, descriptions, and SEQ ID NO.'s.

| Domain Label | Domain Description | Protein Seq ID No.'s | Nucleic Acid Seq. ID No.'s |
|---|---|---|---|
| LRR_TYP | Leucine rich repeat-typical subtype | 12102-12116 | 25764-25778 |
| LYSOPHOSPHOLIPASE-RELATED | Lysophospholipase related domain | 12117 | 25779 |
| MALONYL COA-ACYL CARRIER PROTEIN TRANSACYLASE | Malonyl-CoA: acyl carrier protein transacylase | 12118-12128 | 25780-25790 |
| MaoC_dehydrat_N | N-terminal domain of MaoC dehydratase | 12129-12137 | 25791-25799 |
| MaoC_dehydratas | C-terminal doamin of MaoC dehydratase | 12138-12152 | 257800-25814 |
| Metallo-dependent phosphatases | Metallo-dependent phosphatases | 12153-12202 | 25815-25864 |
| Metallo-depent_PP-like | Metallo-dependent phosphatases | 12203-12245 | 25865-25907 |
| Metallophos | Metallo-dependent phosphatases | 12246-12281 | 25908-25943 |
| Mucin | Mucins, high molecular weight glycoconjugates | 12282-12283 | 25944-25945 |
| NAD(P)-bd_dom | NADP binding domain | 12284-12334 | 25946-25996 |
| NAD(P)-binding Rossmann-fold domains | NAD(P)-binding Rossmann-fold domains | 12335-12384 | 25997-26046 |
| NODB | catalytic domain found in members of carbohydrate esterase family 4 | 12385 | 26047 |
| Oligoxyloglucan reducing end-specific cellobiohydrolase | Oligoxyloglucan reducing end-specific cellobiohydrolase | 12386-12397 | 26048-26059 |
| Pectin lyase-like | Pectin-lyase like domain | 12398-12408 | 26060-26070 |
| Pectin_lyas_fold | Pectin lyase fold domain | 12409-12417 | 26071-26079 |
| Peptidase_S8 | Peptidase_S8 | 12418-12421 | 26080-26083 |
| Peptidase_S8/S53_dom | domain found in serine peptidases | 12422-12427 | 26084-26089 |
| PERIPLASMIC BETA-GLUCOSIDASE-RELATED | Periplasmic Beta-glucosidase related domain | 12428-12437 | 26090-26099 |
| PERIPLASMIC BROAD-SPECIFICITY ESTERASE/LIPASE/PROTEASE | Periplasmic broad specificity esterase/lipase/protease | 12438-12441 | 26100-26103 |
| PEROXISOMAL MULTIFUNCTIONAL ENZYME TYPE 2 | Peroxisomal multifunctional enzyme type 2 | 12442-12445 | 2614-26107 |
| PHL pollen allergen | PHL pollen allergen | 12446-12462 | 26108-26124 |
| PHOSPHOPANTETHEINE | Prosthetic group of acyl carrier protein | 12463-12473 | 26125-26135 |
| PI-PLC-X | PI-PLC X domain | 12474 12475 | 26136-26137 |
| PIPLC_X_DOMAIN | PI-PLC X domain | 12476-12478 | 26138-26140 |
| PKS_AT | Acyl Transferase domain | 12479-12509 | 26141-26171 |
| PKS_ER | Enoyl Reductase | 12510-12525 | 26172-26178 |
| PKS_KR | Ketoreductase | 12526-12545 | 26179-26198 |
| PKS_KS | Ketosynthase | 12546-12579 | 26199-26241 |
| PKS_PP | phosphopantetheine-binding domain | 12580-12607 | 26242-26269 |
| Plant lectins/antimicrobial peptides | Plant lectins/antimicrobial peptides | 12608-12612 | 26270-26274 |
| PLC-like phosphodiesterases | PLC-like phosphodiesterases | 12613-12618 | 26275-26280 |
| PLC-like_Pdiesterase_TIM-brl | domain consisting of a TIM beta/alpha-barrel, found in several phospholipase C like phosphodiesterases | 12619-12622 | 26281-26284 |
| PLCXc | Phosphatidylinositol-specific phospholipase C, X domain | 12623-12624 | 26285-26286 |
| PLP-dependent transferases | PLP-dependent transferases | 12625-12634 | 26287-26296 |
| POLYKETIDE SYNTHASE-RELATED | Related to sequences found in PKS domains | 12635-12679 | 26297-26314 |
| Polysac_deacetylase | Polysaccharide deacetylase | 12680-12683 | 26314-26345 |
| Polysacc_deac_1 | domain found in polysaccharide deacetylase | 12684-12687 | 26346-26349 |
| PP-binding | phosphopantetheine-binding domain | 12688-12727 | 26350-26389 |
| Probable ACP-binding domain of malonyl-CoA ACP transacylase | Probable ACP-binding domain of malonyl-CoA ACP transacylase | 12728-12740 | 26390-26402 |
| PROKAR_LIPOPROTEIN | Prokaryotic lipoprotein domain | 12741-12761 | 26403-26423 |
| PROPROTEIN CONVERTASE | Proprotein convertase subtilisin/kexin type 9 | 12762-12764 | 26424-26426 |

TABLE 1-continued

Domain labels, descriptions, and SEQ ID NO.'s.

| Domain Label | Domain Description | Protein Seq ID No.'s | Nucleic Acid Seq. ID No.'s |
|---|---|---|---|
| SUBTILISIN/KEXIN PROSTAGLANDIN REDUCTASE 1 | Prostaglandin reductase 1 domain | 12765-12767 | 26427-26429 |
| PROTEIN C41A3.1 | Protein C41A3.1 | 12768-12770 | 26430-26432 |
| PS-DH | Polyketide synthase, dehydratase domain | 12771-12785 | 26433-26447 |
| PT | Polyketide product template domain | 12786-12787 | 26448-26449 |
| PURPLE ACID PHOSPHATASE 23 | purple acid phosphatase 23 | 12788-12797 | 26450-26459 |
| Purple acid phosphatase, N-terminal domain | Purple acid phosphatase, N-terminal domain | 12898-12829 | 26460-26491 |
| Purple_acid_Pase_N | Purple acid phosphatase, N-terminal domain | 12830-12861 | 26492-26523 |
| PyrdxlP-dep_Trfase_major_sub1 | Pyridoxal phosphate-dependent transferase, major region, subdomain 1 | 12862-12871 | 26524-26533 |
| PyrdxlP-dep_Trfase_major_sub2 | Pyridoxal phosphate-dependent transferase, major region, subdomain 2 | 12872-12879 | 26534-26541 |
| Rhamnogal_lyase | Rhamnogalacturonate lyase | 12880-12883 | 26542-26545 |
| RhgB_N | Rhamnogalacturonase B, N-terminal domain | 12884-12885 | 26546-26547 |
| RICIN | Ricin | 12886-12950 | 26548-26612 |
| Ricin B-like lectins | Ricin B-like lectins | 12951-13037 | 26613-26699 |
| RICIN_B_LECTIN | Ricin B-like lectins | 13038-13108 | 26699-26770 |
| RicinB_lectin_2 | Ricin B-like lectins | 13109-13186 | 26771-26848 |
| SCP-like | Spore coat protein like domain | 13187-13189 | 26849-26851 |
| SCP2 | Spore coat protein 2 | 13190-13192 | 26852-26854 |
| SCP2_sterol-bd_dom | SCP2 sterol-binding domain | 13193-13195 | 26855-26857 |
| SDRFAMILY | Short-chain dehydrogenase/reductase | 13196-13207 | 26858-26869 |
| SERINE PROTEASE INHIBITOR, SERPIN | Serine protease inhibitor | 13208-13215 | 26870-26877 |
| SERINE/THREONINE PROTEIN KINASE | Serine/threonine protein kinase | 13216 | 26878-26878 |
| SERPIN | Serine protease inhibitor | 13217-13242 | 26879-26904 |
| Serpins | Serine protease inhibitor | 13243-13253 | 26905-26915 |
| SGNH hydrolase | SGNH hydrolase domain | 13252-13294 | 26916-26956 |
| SGNH_hydro-type_esterase_dom | SGNHhydro-type esterase domain | 13295-13307 | 26957-26969 |
| Six-hairpin glycosidases | six-hairpin glycoside domain | 13308-13389 | 26970-27051 |
| Starch-binding domain-like | Starch-binding domain-like | 13392-13393 | 27052-27055 |
| SUBTILASE_ASP | Serine proteases, subtilase family, aspartic acid active site | 13394-13395 | 27056-27057 |
| SUBTILASE_HIS | Serine proteases, subtilase family, histidine active site. | 13396-13397 | 27058-27059 |
| SUBTILASE_SER | Serine proteases, subtilase family, serine active site. | 13398-13399 | 27060-27061 |
| SUBTILISIN | Protease domain | 13400-13407 | 27062-27069 |
| Subtilisin-like | Subtilisin-like protease domain | 13408-13416 | 27070-27078 |
| Thioesterase | Thioesterase | 13417-13419 | 27079-27081 |
| Thioesterase/thiol ester dehydrase-isomerase | Thioesterase/thiol ester dehydrase-isomerase | 13420-13449 | 27082-27111 |
| Thiolase-like | Thiolase-like domain | 13450-13544 | 27112-27206 |
| Thiolase-like_subgr | Thiolase-like_subgr | 13545-13637 | 27207-27299 |
| Thioredoxin-like | Thioredoxin-like | 13638 | 27300 |
| Thioredoxin-like_fold | Thioredoxin-like fold domain | 13639 | 27301 |
| TIGR00556 | phosphopantethiene--protein transferase domain | 13640-13647 | 27302-27309 |
| TIGR01733 | amino acid adenylation domain | 13648 | 27310 |
| TIGR01833 | hydroxymethylglutaryl-CoA synthase | 13649-13650 | 27311-27312 |
| TRANS-2-ENOYL-COA REDUCTASE, MITOCHONDRIAL | Enoyl-CoA reductase | 13651-13654 | 27313-27316 |
| UNCHARACTERIZED | Uncharacterized | 13655-13656 | 27317-27318 |
| VCBS | VCBS repeat domain | 13657 | 27319 |
| ZINC FINGER FYVE DOMAIN CONTAINING PROTEIN | Zinc finger FYVE domain-containing protein | 13658-13659 | 27320-27321 |
| ZINC FINGER-CONTAINING PROTEIN | Zinc finger containing protein | 13660-13662 | 27322-27324 |

Engineered Proteins.

The domains disclosed herein may be utilized in the creation of "engineered proteins." As used herein, a "protein of the invention," or an "engineered protein" will refer to a non-naturally occurring protein, wherein such protein comprises one or more domains selected from SEQ. ID NO: 1-13662. A non-naturally occurring protein means the protein is not found in any wild-type species, having been engineered by molecular biological techniques known in the art. For example, the engineered protein may comprise heterologous elements, i.e. elements from different species. Alternatively, the engineered protein may comprise an anaerobic fungal protein lacking heterologous elements, but wherein the elements of the protein have been modified in some way such that they differ from those of the native protein, for example by rearrangement, duplication, or deletion of elements.

The domains disclosed herein will impart various properties to the engineered proteins in which they are incorporated. In some cases, the domain will comprise a structural element and will impart a structural property to the engineered protein. In another embodiment, the domain will comprise a binding domain and will impart a binding affinity for specific binding partners. In other embodiments, the domain will comprise a catalytic domain and will impart an enzymatic activity to the engineered protein.

The various domains of SEQ ID NO: 1-13662 encompass a wide variety of domains having diverse properties. One of skill in the art may readily select a domain of the invention for incorporation into an engineered protein based on the putative functions assigned to the domain. The putative functions of various domains of SEQ ID NO: 1-13662 are listed as "domain descriptions" in Table 1. Methods of using the engineered proteins of the invention will be readily ascertained by the skilled practitioner based upon the properties of the one or more domains of SEQ ID NO: 1-13662 and any additional properties imparted by accessory elements in the engineered proteins.

The proteins of the invention may include chemically synthesized polypeptides and recombinantly produced polypeptides comprising the domain sequences disclosed herein. The scope of the invention will be understood to extend to derivatives of the disclosed domain sequences. The term "derivative," as used herein with reference to the polypeptides of the invention refers to various modifications, analogs, and products based on the polypeptide sequences disclosed herein, as described below.

Protein derivatives of the invention include substantial equivalents of the disclosed amino acid sequences, for example polypeptides having at least 65%, at least 70%, at least 75%, at least 80%, at least 85%, at least 90%, at least 95%, or at least 99% amino acid sequence identity to a disclosed domain and/or which retain the biological activity of the unmodified sequences.

Protein derivatives of the invention further include polypeptides disclosed herein which have been modified by such techniques as ubiquitination, labeling (e.g., with radioactive or fluorescent moieties), covalent polymer attachment, etc. Derivative proteins of the invention include post-translational modifications of the polypeptide including, but not limited to, acetylation, carboxylation, glycosylation, phosphorylation, lipidation and acylation, etc.

Proteins derivatives of the invention further include polypeptides differing from the sequences disclosed herein by amino acid substitutions. For example, amino acid substitutions that largely preserve the secondary or tertiary structure of the original polypeptide may be selected on the basis of similarity in polarity, charge, solubility, hydrophobicity, hydrophilicity, and/or the amphipathic properties of specific residues. Determination of which amino acid substitutions may be made while maintaining enzymatic and other activities of interest is within ability of one of ordinary skill in the art of protein engineering. The invention also comprises substitutions with non-naturally occurring amino acids, amino acid analogs, etc.

Proteins derivatives of the invention further include mutations in the disclosed polynucleotide sequence intentionally introduced to enhance or modify characteristics of the polypeptide, such as to alter post-translational processing, binding affinities (e.g. introduction of specific epitopes for antibody binding), degradation/turnover rate, industrial processing compatibility (e.g. optimized expression, purification, etc.) or other properties.

The invention further comprises truncated versions of the protein domains disclosed herein, for example C-terminal, N-terminal, or internal deletions encompassing, for example, 1-20 amino acids. The invention further comprises isolated functional units from the disclosed domain sequences, for example isolated binding domains, catalytic domains, and other motifs having useful structures or functions which may be used in isolation from the remainder of the protein.

The invention further comprises any of the disclosed polypeptides sequences which have been augmented with additional amino acids. For example, the invention also includes fusion proteins and chimeric proteins in which a disclosed polypeptide sequences or sub-sequences thereof is combined with other peptides, proteins, or amino acid sequences. Exemplary fusion or chimeric proteins include the disclosed domain polypeptide sequences, or sub-sequences thereof, which have been combined with functional sequences from different proteins. Such proteins may further include secondary polypeptide sequences that impart desired properties such as enhanced secretion, or which enable purification (e.g. His-Tags), immobilization, and other desirable properties.

The invention further includes antibodies that specifically recognize one or more epitopes present on the disclosed polypeptides, as well as hybridomas producing such antibodies.

Polynucleotide Constructs.

The scope of the invention further encompasses any nucleic acid construct which codes for an engineered protein of the invention or codes for an engineered multiple enzyme complex of the invention. For example, the nucleic acid constructs of the invention may include any non-naturally occurring nucleic acid construct which comprises one or more nucleic sequences selected from SEQ ID NO: 13362-27324 or SEQ ID NO: 27328-27330, (corresponding to the proteins of SEQ ID NO: 1-13662 and SEQ ID NO: 27325-27327). However, it will be understood that, due to the redundancy of the genetic code and the diverging codon preferences in different species, that nucleic acid sequences coding for the proteins of SEQ ID NO: 1-13662 and SEQ ID NO: 27325-27327 are not limited to the fungal derived sequences disclosed in SEQ ID NO: 13663-27324 and SEQ ID NO: 27328-27330, and may comprise any nucleic acid construct comprising a sequence coding for the selected domain.

The polynucleotide sequences of the invention encompass DNA, RNA, DNA-RNA hybrids, peptide nucleic acid (PNA) or any other DNA-like or RNA-like material. For clarity, the polynucleotide sequences disclosed herein do not encompass genomic DNA sequences as present in their natural source (e.g. native organism). The polynucleotide sequences of the invention do not contain introns or untranslated 3-prime and 5-prime sequences. The polynucleotide sequences encompass translated sequences only.

The nucleic acid constructs of the invention encompass sequences which are the reverse or direct complement of any of the disclosed nucleic acid sequences (or their derivatives, as described below). Polynucleotide constructs of the invention may comprise single-stranded or double-stranded polynucleotides and may represent the sense or the antisense strand. The nucleic acid constructs of the present invention also include nucleic acid sequences that hybridize to the disclosed nucleotide sequences or their complements under stringent conditions. Polynucleotide constructs of the invention include sequences having high sequence similarity to the disclosed sequences (and their derivatives), for example, sequences having at least 80% homology, at least 85% homology, at least 90% homology, at least 95% homology, or at least 99% homology.

The polynucleotide constructs of the invention further encompass constructs comprising sequences which are derivatives of the disclosed domain polynucleotide sequences. As used herein, with reference to domain polynucleotide sequences, the term "derivative" refers to complementary sequences, degenerate sequences, truncated or augmented sequences, modified sequences, and other polynucleotides based upon the disclosed sequences. One form of polynucleotide derivative contemplated within the scope of the invention is a polynucleotide comprising nucleotide substitutions. For example, utilizing the redundancy in the genetic code, various substitutions may be made within a given polynucleotide sequence that result in a codon which codes for the identical amino acid as coded for in the original sequence, and which such change does not alter the composition of the polypeptide coded by a polynucleotide. Such "silent" substitutions may be selected by one of skill in the art. Likewise, nucleotide substitutions are contemplated which result in an amino acid substitution, wherein the amino acid is of similar polarity, charge, size, aromaticity, etc., such that the resulting polypeptide is of identical or substantially similar structure and function as a polypeptide resulting from an unmodified sequence. Further, the invention also comprises nucleotide substitutions which result in amino acid substitutions which create a polypeptide derivative, as described above.

It is also understood by one of skill in the art that various nucleotide analogs, modified nucleotides, and other compositions may be substituted for the nucleotides of the disclosed DNA sequences and their derivatives, for example modified or non-naturally occurring nucleotides such as 5-propynyl pyrimidines (i.e., 5-propynyl-dTTP and 5-propynyl-dTCP), 7-deaza purines (i.e., 7-deaza-dATP and 7-deaza-dGTP). Nucleotide analogs include base analogs and comprise modified forms of deoxyribonucleotides as well as ribonucleotides.

Additionally, substitutions in a disclosed polynucleotide sequence may be made which enable the translation of polypeptides from the polynucleotide sequence within a specific expression system. For example, as the polynucleotides of the invention are isolated from fungal species, it is contemplated that the disclosed sequences may be modified as necessary to enable or optimize expression of proteins in eukaryotic, yeast, insect, plant, mammalian, or in other expression systems such as cell-free and chemical systems. The selection of proper substitutions for proper expression within a given expression system is within the skill of one in the art of molecular biology.

Polynucleotide derivatives of the invention also comprise augmented or chimeric sequences, wherein a disclosed polynucleotide sequence has been modified to include additional nucleotides. For example, a disclosed polynucleotide sequence, or subsequences thereof, may be ligated with additional polypeptide sequences which enhance expression (for example, promoter sequences), or which alter the properties of the resulting polypeptide, such as sequences which enhance secretion, enable isolation (e.g. sequences which code for His-Tags or like moieties), enable immobilization, or other useful sequences as known in the art.

The scope of the invention additionally includes vectors, comprising the polynucleotide constructs of the invention integrated into vectors. Exemplary vectors include plasmids, phages, and viral constructs which promote efficient maintenance, amplification, and transcription of the polynucleotide sequences in an expression system. The nucleic acid constructs may comprise sequences integrated into the genome of an organism by transduction techniques known in the art.

Engineered Organisms.

In one aspect, the scope of the invention encompasses organisms which have been genetically engineered to express one or more engineered protein of the invention, i.e. proteins comprising the protein domains selected from SEQ. ID NO: 1-13662. The engineered organisms of the invention further encompass organisms which express any of the ScaA full proteins of SEQ ID NO: 27325-27327, or portions thereof. Likewise, engineered organisms may comprise the nucleic acid constructs of the invention, for example, with the nucleic acid sequences being transiently expressed by the organism or being stably integrated into the genome of the organism. In one implementation of the invention, the engineered organism is an organism expressing one or more of nucleic acid sequences selected from SEQ ID NO: 13663-27324 or SEQ ID NO: 27328-27330.

Engineered organisms of the invention may comprise any species, for example, fungal species, yeast, bacteria, plants, and other organisms genetically modified to produce one or more engineered proteins of the invention. The engineered organisms of the invention may further comprise cell lines, such as insect cell cultures, CHO cells, and other cell culture systems used in the production of recombinant proteins.

Engineered Enzymes for Bioprocessing.

The various inventions described herein may be applied in numerous bioprocessing methods. The present description is largely directed to bioprocessing methods for the digestion of lignocellulosic biomass into fermentable monomers. However, it will be understood that the engineered proteins and organisms described herein may be applied in other bioprocessing methods, for example, for the synthesis of chemicals from feedstocks, including polymers, biofuels, and others.

In one aspect, the engineered proteins of the invention encompass proteins which participate in the breakdown of lignocellulosic biomass. In one embodiment, the engineered proteins of the invention comprise a glycoside hydrolase or other enzyme capable of digesting a component of lignocellulosic materials. For example, the engineered enzyme of the invention may comprise a cellulase, glycosidase, esterase, SGNH hydrolase, endoglucanase, cellobiohydrolase, Beta-D-glucan exohydrolase, beta-glucanase, phosphatidylinositol phosphodiesterase, pectin lyase, fucosidase, glycoside hydrolase, glycosyl hydrolase, hemicellulsase, xyanlase, galactosaminoglycan glycanohydrolase, amylase, chitinase, β-glucuronyl hydrolase, trehalase, glucoamylase, β-glucuronyl hydrolase, or acid phosphatase. In one embodiment, the engineered protein of the invention is a glycoside hydrolase comprising one or more domains selected from the group consisting of SEQ ID NO: 1-155; SEQ ID NO: 1095-1309; and SEQ ID NO: 3851-3972; and SEQ ID NO: 9755-11844. In one embodiment, the invention comprises an organism comprising a polynucleotide sequence which codes for a domain selected from the sequences of SEQ ID NO: 1-155; SEQ ID NO: 1095-1309; and SEQ ID NO: 3851-3972; and SEQ ID NO: 9755-11844.

The scope of the invention encompasses methods of using engineered proteins comprising lignocellulose degrading enzymes to facilitate the breakdown of lignocellulosic biomass. In one such method, an engineered protein comprising a lignocellulose-degrading enzyme is produced in an engineered organism. Exemplary engineered organisms include *Saccharomyces cerevisiae, Zymomonas mobilis, Escherichia coli*, and *Clostridium thermocellum*. Systems which utilize such organisms in biofuel production are known in the art. For example, the successful heterologous expression of functional saccharization enzymes from a fungal organism in yeast has been previously demonstrated, as described in O'Malley et al., Evaluating expression and catalytic activity of anaerobic fungal fibrolytic enzymes native to*piromyces* sp E2 in *Saccharomyces cerevisiae*. Environmental Progress and Sustainable Energy 31:37-46, 2012.

In one such method, the engineered protein is produced by and is subsequently extracted from the organism. Purification or modification steps may be applied to the extracted enzyme. The enzyme may then be used in any applicable lignocellulosic bioprocessing system by contacting it with an appropriate substrate under suitable conditions for enzymatic action to occur. In one embodiment, the extracted enzyme is used as a component of an enzymatic cocktail, for example, an enzymatic cocktail used in the saccharification of cellulosic materials.

In an alternative implementation, an engineered protein comprising a lignocellulose degrading enzyme of the invention is expressed in an engineered organism, and the engineered organism is cultured with an appropriate lignocellulosic substrate to promote breakdown of the substrate.

Methods of using proteins comprising a lignocellulose degrading enzyme of the invention may be performed in any bioprocessing method, for example, in ethanol production from biomass.

Multiple Enzyme Catabolic Complexes.

In another embodiment, the invention encompasses engineered enzymatic complexes. An engineered enzyme complex is a complex comprising multiple enzymes bound to a carrier or scaffold and further comprising one or more substrate binding moieties. Such multiple enzyme complexes may be used to process a substrate with high efficiency due to the presence of multiple complementary enzymatic moieties being held in proximity to the substrate by the substrate binding moieties.

The engineered enzyme complexes of the invention are based on the bacterial cellulosome. In anaerobic microorganisms, cellulolytic enzymes are not secreted freely into the extracellular medium, as is generally the case for aerobic microbes, but instead these enzymes assemble into large (MDa) multi-protein cellulolytic complexes called cellulosomes. Cellulosomes comprise various components. A first component is a non-catalytic protein that is anchored to the cell membrane of the host cell expressing the cellulosome, typically a scaffoldin or its equivalent. The scaffoldin comprises multiple domains called cohesins, which are sites to which functional moieties will attach. The functional moieties may comprise enzymes which comprise one or more dockerin domains. The dockerin domain will selectively bind complementary cohesion domains on the scaffoldin protein with high affinity. The celluolytic complex will typically further comprise one or more carbohydrate binding moieties which bind lignocellulosic substrate. This binding keeps the substrate in proximity to the catalytic enzymes present on the cellulosome, facilitating degradation of the substrate. A conceptual depiction of a cellulosome is depicted in FIG. 1.

In one aspect, the scope of the invention encompasses what will be referred to as an engineered enzyme complex. The engineered enzyme complex comprises: a scaffold protein; one or more catalytic proteins; and one or more substrate-binding proteins. In one embodiment, the one or more catalytic proteins and one or more substrate-binding proteins are bound to the scaffold protein by cohesion-dockerin interactions with complementary dockerin and cohesion elements being present on the scaffold and on the bound moieties. An engineered enzyme complex of the invention is any enzyme complex wherein one or more component is an engineered protein of the invention. Alternatively, the engineered enzyme complex of the invention is one comprising a scaffoldin protein selected from SEQ ID NO: 27325-27327 (for example, being coded for by nucleic acid sequences SEQ ID NO: 27328-27330).

Tools and methodologies for the creation of multiple enzyme complexes and organisms expressing them are known in the art. Cellulosomes and like enzyme complexes have been successfully produced wherein the type and precise placement of enzymes is possible, for example as described in Fujita et al., Synergistic saccharification, and direct fermentation to ethanol, of amorphous cellulose by use of an engineered yeast strain codisplaying three types of cellulolytic enzyme. *Appl Environ Microbiol*. 2004 February; 70(2):1207-12. Additional methods of producing engineered cellulosomes are described in United States Patent Application Publication Number 20150167030, entitled "Recombinant cellulosome complex and uses thereof," by Mazolli; United States Patent Application Publication Number 20130189745, entitled "Artificial cellulosome and the use of the same for enzymatic breakdown of resilient substrates," by Schwarz; and U.S. Pat. No. 9,315,833, entitled "Yeast cells expressing an exogenous cellulosome and methods of using the same," by McBride.

In one implementation of the invention, the engineered multiple enzyme complex is an artificial cellulosome designed for the efficient digestion of lignocellulosic biomass, wherein the one or more catalytic proteins comprise a plurality of proteins which degrade lignocellulosic material, e.g. glycoside hydrolase proteins, and the one or more substrate-binding proteins comprise carbohydrate binding domains.

In one embodiment, the scaffold protein of the engineered enzyme complex is a scaffoldin protein comprising multiple cohesion domains. For example, the scaffoldin protein may comprise a scaffoldin protein selected from the group consisting of SEQ ID NO: 27325-27327. In another embodiment, the artificial cellulosome comprises a dockerin domain. In one embodiment, the dockerin domain comprises a dockerin domain selected from the group consisting of: SEQ ID NO: 1420-3705 and SEQ ID NO: 6590-8910. In another embodiment, the artificial cellulosome comprises one or more carbohydrate binding domains. For example, the carbohydrate binding domain may comprise a carbohydrate binding domain selected from the sequences of: SEQ ID NO: 1061-1062; SEQ ID NO: 1325-1333; SEQ ID NO: 1378-1419; SEQ ID NO: 3706-3850; SEQ ID NO: 3973-

6254; and SEQ ID NO: 9480-9605. In one embodiment, the artificial cellulosome of the invention comprises one or more glycoside hydrolase proteins comprising one or more domains selected from the sequences of SEQ ID NO: 1-155; SEQ ID NO: 1095-1309; and SEQ ID NO: 3851-3972; and SEQ ID NO: 9755-11844.

The scope of the invention further extends to nucleic acid sequences which code for the various elements of the artificial cellulosomes. The scope of the invention further encompasses engineered organisms which express the various elements of the artificial cellulosome. The scope of the invention further encompasses methods of using such engineered organisms in the digestion of lignocellulosic biomass. It will be understood that the artificial cellulosomes of the invention comprise or are expressed in combination with anchoring moieties, secretory signals and other elements required for the expression, secretion, and assembly of cellulosomes, as known in the art.

The artificial cellulosomes of the invention enable components from two or more species to be advantageously combined. Enzymes from non-fungal species can be utilized in anaerobic fungal cellulosomes, or enzymes from anaerobic fungi can be used in non-fungal cellulosomes. For example, in one implementation, the novel dockerin domains of the invention derived from anaerobic fungi may be fused with enzymes or carbohydrate-binding moieties from other species, such as from yeast or aerobic bacteria, and these combined elements can be bound to scaffoldins from anaerobic fungi. In another implementation, dockerins from other species could be fused to catalytic proteins or carbohydrate binding domains from anaerobic fungi, facilitating the inclusion of these anaerobic fungal proteins in synthetic cellulosomes of other species. This exchange of enzymatic elements from divergent species aids in the creation of novel artificial cellulosomes having extended enzymatic capabilities beyond those of wild type enzymatic complexes. Such hybrid systems can, with a single organism, recapitulate digestive processes in the complex environment of the rumen, where fungal, yeast, and bacterial strains work in concert to digest complex biomass.

It will be understood that the engineered enzyme complexes of the invention are not limited to multiple enzyme complexes which degrade lignocellulosic material, and may be designed for efficient enzymatic action of any kind on any substrate, as determined by the selection of suitable catalytic enzymes and substrate-binding moieties.

Polyketide Synthases

A very large number of important drugs and biologically active compounds are from the group called polyketides. Polyketides are structurally diverse compounds created by multi-domain enzymes or enzyme complexes called polyketide synthases (PKSs). PKSs proteins are composed of various peptide domains, each of which has a defined function. Various classes of PKSs are known, including Type I, Type II, and Type III PKSs. The Type I PKSs may be classified as either iterative or modular.

The iterative PKSs comprise a single module. The creation of a polyketide is initiated by binding a starting material to the acyl-transferase (AT) domain, the starting material typically being Acetyl-CoA or malonyl-CoA. The bound starting material is then shuttled to the KS domain by an acyl carrier protein (ACP). An extender material, typically malonyl-CoA is then loaded into the complex by the AT domain and is added to the starter material by a condensation reaction catalyzed by the ketosynthase (KS domain). Additional domains may introduce modifications to the bound chain by catalytic action. Additional extension reactions and modification reactions occur until the polyketide chain has reached its final length, which is specific for each type of iterative PKS. The mechanisms by which final length is controlled are not known. When the polyketide has reached its final length, a thioesterase (TE) domain releases the completed polyketide. Thus, such PKSs are called "iterative" because the final product polyketide is produced in an iterative fashion by the repeated action of the domains to lengthen and modify the growing polyketide chain. The various enzymatic domains of the iterative PKSs are not always used in each cycle, allowing for more variability in final product composition.

In contrast, modular PKSs have multiple repeating modules, arranged from the N-terminal end of the PKS towards the C-terminal end. In each module, the AT, ACP, and KS domains are repeated, and each module also contains its own combination of catalytic domains. Chain elongation is initiated at the N-terminal end in the first module, and the growing chain is passed from module to module towards the C-terminal end, undergoing a single elongation and one or more enzymatic modifications at each step. At the C-terminal module, a thioesterase (TE) domain releases the completed polyketide.

Just as PKS domains can interact with one another, PKSs can interact, or form hybrid complexes, with non-ribosomal peptide synthases to form active compounds (e.g. the anti-cancer compound epothilone).

Various classes of enzymatic PKS domain are known, including:
  keto reductase (KR) domains, which reduces ketone groups to hydroxyl groups;
  dehydratase domains (DH), which reduces hydroxyl groups to enoyl groups;
  enoyl reductase (ER) domains, which reduce enoyl groups to alkyl groups;
  methyltransferase (MT) domains, which transfer methyl groups to the growing polyketide;
  sulfohydrase domains (SH); and
  product template domains, which determine the folding pattern of the polyketide backbone.

Additional non-PKS catalytic domains that work in tandem with PKS domains include aminotransferases, pyridoxal-phosphate transferases and HMG-CoA synthases.

The specificity of substrates and products for the domains varies, as well as their order within PKSs. Accordingly, the different combinations the order of enzymatic domains within the PKS modules, and the different arrangements of modules within modular PKSs means that these enzymes can be configured to produce an immense range of final products.

The released polyketide may then be further modified by the action of additional enzymes, for example the addition of carbohydrate moieties or methyl groups. The further complexity of PKS systems enables even greater diversity of products, for example, two iterative PKSs can interact to form a common product (for example as in the synthesis of zearalenone). A PKS may also be fused with another enzyme to form a single enzyme (for example as known in the synthesis of fusarin C).

Accordingly, PKSs, due to their modular nature, including multiple domains arranged within a module, and multiple modules within an enzyme, present a potential platform for the synthesis of myriad biological products.

Engineered PKS's.

Engineered PKS systems are known in the art and have been successfully utilized to create various novel end products, some of which have never been observed in nature.

Various strategies exist for utilizing novel PKS enzymes, PKS modules, or PKS domains in the creation of diverse, potentially bioactive molecules. Exemplary PKS engineering techniques are described in U.S. Pat. No. 9,334,514, entitled "Hybrid polyketide synthases," by Fortman et al.; U.S. Pat. No. 8,709,781, entitled "System and method for the heterologous expression of polyketide synthase gene clusters," by Boddy et al.; and United States Patent Application Publication Number 20130067619, entitled "Genes and proteins for aromatic polyketide synthesis," by Page and Gagne.

The current state of PKS engineering allows for the recombination and swapping of various PKS enzymes, modules, and domains, enabling novel means of synthesizing compounds using engineered enzyme systems. Accordingly, there is a need in the art for PKS enzymes, modules, and domains with novel functions, which such elements may be employed in engineered PKS systems. The novel PKS gene and protein sequences provide the art with novel tools for the creation of engineered PKS synthesis systems and enable the creation of novel compounds.

In one aspect, the scope of the invention encompasses engineered proteins comprising engineered PKS enzymes. The engineered PKS enzyme of the invention may comprise a modular PKS or an iterative PKS. In one embodiment, the engineered PKS enzyme of the invention comprises an acyl transferase domain. For example the engineered PKS may comprise an acyl transferase domain selected from the sequences of SEQ ID NO: 465-578; SEQ ID NO: 768-798; and SEQ ID NO: 12479-12509. In one embodiment, the engineered PKS comprises an acyl carrier protein domain. For example, the acyl carrier protein domain may comprise an acyl carrier domain selected from the sequences of SEQ ID NO: 604-767 and SEQ ID NO: 12463-12473. In one embodiment, the engineered PKS comprises a ketosynthase domain. For example, the ketosynthase domain may comprise a ketosynthase domain selected from the sequences of SEQ ID NO: 12546-12579. In one embodiment, the engineered PKS comprises a thioesterase domain. For example, the thioesterase domain may comprise a thioesterase domain selected from the sequences of SEQ ID NO: 13417-13449. In one embodiment, the engineered PKS comprises a ketoredudctase domain. For example, the ketoredudctase domain may comprise a ketoreductase domain selected from the sequences of SEQ ID NO: 12028-12043 and SEQ ID NO: 12526-12545. In one embodiment, the engineered PKS comprises a dehydratase domain. For example, the dehydratase domain may comprise a dehydratase domain selected from the sequences of SEQ ID NO: 12129-12152 and SEQ ID NO: 12771-12785. In one embodiment, the engineered PKS comprises an enoyl reductase domain. For example, the enoly reductase domain may comprise an enoyle reductase domain selected from the sequences of SEQ ID NO: 12510-12525 and SEQ ID NO: 13651-13654. In one embodiment, the engineered PKS of the invention comprises a product template domain. For example, the product template domain may comprise a product template domain selected from the sequences of SEQ ID NO: 12786-12787. The scope of the invention further encompasses engineered proteins which are not PKS enzymes, but which contain any of the aforementioned PKS domains.

The scope of the invention further includes engineered accessory enzymes, which, as used herein, are engineered proteins with functions accessory to PKS enzymes. In one embodiment, the engineered protein comprises an aminotransferase domain selected from SEQ. ID NO: 973-982. In one embodiment, the engineered protein comprises a pyridoxal-phosphate transferase domain selected from SEQ. ID NO 12862-12879. In one embodiment, the engineered protein comprises a HMG-CoA synthase domain selected from SEQ. ID NO 11883-11891.

The scope of the invention further encompasses nucleic acid constructs which code for any of the aforementioned engineered PKS enzymes or engineered accessory enzymes. Furthermore, the scope of the invention encompasses engineered organisms which express any of the aforementioned engineered PKS enzymes or which comprise a nucleic acid construct coding therefor. Exemplary engineered PKS organisms include fungal species, bacterial species, yeast species, or plant species. The scope of the invention further encompasses methods of creating complex molecules, including polyketides, utilizing the engineered PKS enzymes and/or organism expressing such engineered PKS enzymes, wherein suitable substrates are exposed to such engineered PKS enzymes and/or organism expressing such engineered PKS enzymes under conditions which facilitate the synthesis of desired end-products.

Biofuel Production Using Novel Anaerobic Fungal Strains

Lignocellulosic material, or biomass, is a renewable and abundant material and represents a potential feedstock for energy and chemical production. However, the sugars contained in lignocellulosic materials are locked in a complex of lignin, hemicellulose and cellulose and other plant cell wall components. Currently, to extract fermentable sugars from these recalcitrant feedstocks, lignin and hemicellulose must be separated from the biomass prior to converting cellulose into monosaccharides. As a result, bioprocessing of crude biomass entails energy-intensive pretreatment steps, and the addition of an expensive and often inefficient cocktails of cellulolytic enzymes.

In contrast, anaerobic gut fungi that are resident in the gut of herbivores routinely and efficiently degrade cellulose in complex, lignin-rich biomass. This is achieved through both mechanical and enzymatic processes: colonizing fungi develop a highly branched rhizoidal network, or rhizomycelium, that penetrates and exposes the substrate to attack by secreted cellulases. Importantly, this unique invasive strategy for plant cell wall degradation enables gut fungi to colonize and decompose complex cellulosic feedstocks. Anaerobic gut fungi degrade plant particulates of dissimilar sizes at nearly the same rate, whereas the degradation rates of eubacterial populations steadily decrease with increasing particle size. Therefore, anaerobic gut fungi may serve as a means to degrade diverse biomass feedstocks to useful bioenergy compounds, without the need for expensive pretreatment, greatly reducing the cost and increasing the efficiency of biomass conversion to useful products.

Accordingly, there is a need in the art for novel organisms capable of efficient conversion of biomass to usable fuel materials, and for methods of culturing such organisms. The four previously undescribed species of anaerobic fungal gut organisms described herein fulfill this need in the art, being capable of breaking down plant material to produce ethanol, hydrogen, and other useful materials. Grown under anaerobic culture conditions, each of the four organisms is capable of degrading a wide range of lignocellulosic materials. For example, the organisms can metabolize reed canary grass, glucose, fructose, avicel, and filter paper, demonstrating an ability to break down a wide range of biomass materials.

In addition to cellulosomes, which convert plant material into fermentable sugars, anaerobic fungi possess hydrogenosomes that convert the released sugars to hydrogen gas following glycolysis. Hydrogenosomes are intracellular membrane-bound organelles that are analogous to the mitochondria of aerobic microbes. In general, they metabolize malate and pyruvate to $H_2$, $CO_2$, formate, and acetate, generating energy in the form of ATP. The four novel organisms described herein are each capable of hydrogen production from a range of feedstocks.

Accordingly, in one aspect, the invention comprises the use of *Piromyces finnis, Neocallimastix californiae, Anaeromyces robustus*, and/or *Neocallimastix* sp S4 in the conversion of biomass feedstocks into ethanol, hydrogen, and other useful materials. The basic process of the invention comprises introducing biomass feedstocks into a bioreactor vessel wherein culture conditions amenable to organism growth and metabolism are maintained, allowing colonization and digestion of biomass by the organisms, and ongoing or subsequent harvesting of end-products.

Anaerobic bioreactors and fungal bioreactors are known in the art. For example, exemplary fungal and/or anaerobic bioreactors are described in: Moreira et al., Fungal Bioreactors: Applications to White-Rot Fungi, Reviews in Environmental Science and Biotechnology, 2003, Volume 2, Issue 2-4, pp 247-259; Martin, An Optimization Study of a Fungal Bioreactor System for the Treatment of Kraft Mill Effluents and Its Application for the Treatment of TNT-containing Wastewater, in Bioreactors, Auburn University Press, 2000; Palma et al., Use of a fungal bioreactor as a pretreatment or post-treatment step for continuous decolorisation of dyes, 1999, WATER SCIENCE AND TECHNOLOGY; 40, 8; 131-136; US Patent Publication Number US 20100159539 A1, Methods and systems for producing biofuels and bioenergy products from xenobiotic compounds, by Ascon; China Patent Publication 101374773, Method and bioreactor for producing synfuel from carbonaceous material, by Khor; and US Patent Publication Number 20100196994 A1, Fungi cultivation on alcohol fermentation stillage for useful products and energy savings, by van Leeuwen. Bioreactor designs amenable to the growth of the gut fungi described herein may be readily developed utilizing knowledge of the growth conditions optimal for anaerobic gut fungi growth and activity. The invention encompasses the use of any type of bioreactor design, including batch reactors, flow-through reactors, and other bioreactor designs known in the art.

Anaerobic fungi are may be grown under substantially anaerobic conditions. Optimal temperatures for the growth and biomass digestive activity of such organisms is in the range of 25-40 C, preferably in the range of 30-40 C. Cultures may be grown without agitation, on soluble or insoluble carbon sources, under a head space of 100% $CO_2$ gas. Liquid culture medium is preferred for growth and maintenance of the anaerobic fungi.

The culture media used to grow anaerobic fungi may be any known in the art, for example formulations based on those used for the cultivation of rumen bacteria. For the most part, they are complex, non-defined media (pH 6.5-6.8) and contain up to 15% (v/v) clarified rumen fluid, but chemically defined media can be used as well, as described in Marvin-Sikkema, F. D., Lahpor, G. A., Kraak, M. N., Gottschal, J. C., Prins, R. A., Characterization of an anaerobic fungus from llama faeces. *J. Gen. Microbiol.* 1992, 138, 2235-2241. Although phosphate buffers may be used, a preferred buffer is bicarbonate with $CO_2$ in the head space contributing to the buffering system. Chemical reducing agents (e.g., sodium sulfide and/or L-cysteine hydrochloride) are added to culture media pre- or post-autoclaving, after the majority of the $O_2$ has been removed from culture solutions by boiling and gassing with $CO_2$. These procedures ensure that low oxygen levels of the culture medium are maintained such that anaerobic fungal growth can be supported.

The methods of the invention encompass various steps. In a first step, biomass is fed into the bioreactor. Any form of cellulosic or lignocellulosic material may be utilized in the bioreactors and methods of the invention. Biomass includes, but is not limited to, herbaceous material, agricultural residues, forestry residues, municipal solid wastes, waste paper, and pulp and paper mill residues. Exemplary feedstocks include corn stover, canary reed grass, swtichgrass, *Miscanthus*, hemp, poplar, willow, sorgum, sugarcane, bamboo, *eucalyptus*. Additional feedstocks include byproducts of industrial processes, such as pulping liquor (a byproduct of paper production).

Generally, it is preferred that the biomass feedstocks utilized in the processes of the invention be pre-processed to some degree prior to digestion by the fungal organisms. Preprocessing steps include grinding or other mechanical treatments which break the biomass into small particulates that may be more easily colonized and digested by the fungal organisms. Particulates in the range of 0.1 to 10 mm diameter, for example, may be used.

The biomass material is then inoculated with one or more fungal strains selected from the group consisting of *Piromyces finnis, Neocallimastix californiae, Anaeromyces robustus*, and *Neocallimastix* sp S4. Exemplary inoculant material includes particulate material which has been colonized by the fungal organism(s). As opposed to free zoospores, using such material as the starting inoculum leads to more vigorous growth and a substantial reduction in culture lag. The inoculated biomass is then allowed time to digest. The precise digestion time will vary depending on (1) the composition and lability of the feedstock; (2) the particulate size of the feedstock; (3) the concentration of inoculant; and (4) the specific bioreactor design. End-products of the digestion may be removed from the bioreactor at set intervals, continuously, or at the end of the digestion process. Removal of ethanol may be accomplished using methods known in the art for separation of ethanol from fermentation broth. Likewise, evacuation of hydrogen gas produced by the digestion may be accomplished utilizing means known in the art.

Working cultures of anaerobic fungi may require frequent sub-culturing in order to retain their viability. Most batch cultures remain viable for 5 or 15 days in media containing soluble (glucose) or particulate (reed canary grass) substrates, respectively. Frequent sub-culturing intervals of 2-7 days with growth on particulate substrates are generally employed to ensure the continued production of viable cultures.

The processes of the invention may optionally further encompass the co-culture of the described anaerobic gut fungi with other organisms to promote optimal production of bioenergy materials. For example, co-culture of anaerobic gut fungi with highly effective anaerobic fermenting organism, yeast or bacterial strains can result in an optimized system with efficient saccharization and fermentation. Similarly, production of specific end-products can be enabled by co-inoculation with organisms that convert the products of fungal digestion to other materials. For example, production of hydrogen through fungal hydrogenosome activity allows other microbes to reduce $H_2$ to the more energetically favorable methane gas. Co-culture with methane-producing organisms such as Archaea shifts end-product formation towards increased methane and acetate production, with a corresponding decrease in lactate, succinate, hydrogen and ethanol accumulation. In another embodiment, co-culture of anaerobic gut fungi with methanogens can be performed, which can significantly enhance the cellulose hydrolysis activity of the anaerobic fungi.

EXAMPLES

Example 1. Sequence Identification

Fresh fecal material was collected from farm animals. Specimens were isolated from 5×10-fold serial dilutions of fecal matter in anaerobic buffer medium. Each dilution was then supplemented with 30 µg/ml chloramphenicol and grown in anaerobic medium containing milled reed canary grass at 39° C. to enrich for gut fungi. Enrichment cultures that were positive for fungal, but not bacterial or protist, growth after 5-10 days as determined by the generation of fermentation gases without an increase in culture turbidity were further subcultured. To generate unique fungal isolates, actively growing enrichment cultures were diluted up to 50-fold in serial dilutions with each dilution being subcultured for ~4 days. This isolation procedure was repeated five times until a uniform fungal morphology was observed from each specimen and a unique ITS sequence of the isolate was obtained. Subsequent phylogenetic analysis of this ITS sequence confirmed the presence of a single novel fungal isolate in each culture. The new species were named *Neocallimastix californiae*, isolated from goat feces, *Anaeromyces robustus*, isolated from sheep feces, and *Neocallimastix* sp S4, isolated from sheep feces, and *Piromyces* sp. finn, isolated from horse feces.

To identify novel sequences of interest, each strain was grown in anaerobic medium supplemented with either glucose or milled reed canary grass at 39° C. After 2 days, the biomass was harvested and the total RNA extracted using the Qiagen RNeasy kit. This RNA was then enriched for mRNA by selecting for polyadenylated RNA and made into a strand specific cDNA library (single stranded). This cDNA library was then sequenced using an Illumina HiSeq next generation sequencing platform, using a standard workflow, and the resulting data was assembled into a de novo transcriptome using the TRINITY bioinformatics platform. The assembled sequences were then annotated with the BLAST2GO package by BLAST sequence alignment against known protein sequences and protein domain hidden Markov model (HMM) scans on Interpro of all possible translations of each transcript. The results were analyzed for statistical significance and sequences of interest were noted.

Example 2. Identification and Characterization of Scaffoldin Proteins

Genomic analysis of 5 unique anaerobic fungi revealed the presence of 1600 total dockerin domain proteins (DDPs) across genera with diverse functionality, primarily related to plant carbohydrate binding and biomass degradation. These include 15 glycoside hydrolase (GH) families, 5 distinct carbohydrate-binding domains, and other functions implicated in plant cell wall modification and deconstruction including pectin modifying enzymes and expansins. 20.2% of DDPs belong to spore coat protein CotH, which are also present in bacterial cellulosomes and are speculated to also be involved in plant cell wall binding. Conversely, 12.6% represent additional GH activities that are not present in bacterial cellulosomes (GH3, GH6, and GH45). The additional β-glucosidase conferred by GH3 in particular enables fungal cellulosomes to convert cellulose directly to fermentable monosaccharides, whereas Clostridial cellulosomes produce low molecular weight oligosaccharides.

To find structural proteins that mediate assembly of DDPs, we isolated the supernatant and cellulosome fractions from three of these isolates growing on reed canary grass as a sole carbon substrate. Size-exclusion chromatography (SEC) of the cellulosome fraction showed complex formation well within the MDa range, and SDS-PAGE revealed the presence of many glycosylated proteins. Each fraction was subjected to tandem mass spectrometry and peptide sequences were mapped to their respective genomic and transcriptomic databases. Many of the proteins associated with these complexes were identified as GHs and other plant cell wall degrading enzymes. Proteins found in the cellulosome fraction were particularly enriched with NCDDs, indicating modular complex formation. Unexpectedly, all fractions also contained very large uncharacterized proteins (hereafter named ScaA) with molecular weights (MW) of approximately 700 kDa. These ScaA proteins share 32% sequence identity over at least 92% sequence length (E value=0.0) between fungal genera. ScaA orthologs were also detected in the only other sequenced gut fungal genomes, *Piromyces* sp. E2 and *Orpinomyces* sp. C1A, though the ortholog detected in *O* sp. CIA was incomplete likely due to fragmented genome assembly.

Sequence analysis of these proteins across all 5 sequenced genomes showed a predicted N-terminal signal sequence followed by a large extracellular repeat-rich domain, and ending with C-terminal membrane anchor. Some of these proteins also encode predicted choline binding repeats (CBRs), which are known to bind glucan in prokaryotic glucosyltransferases. Thus, one possibility is that CBRs help mediate fungal cellulosome assembly, as many cellulosome proteins are glycosylated. Closer examination of the sequences revealed the presence of a repeating amino acid sequence motif that is conserved among all of these homologues, and that occurs many times throughout these proteins. This motif is 20-30 amino acids long, typically includes with a Gly residue immediately followed by two large hydrophobic residues (most often Tyr residues) and two non-consecutive downstream Cys residues.

Because these proteins are highly represented in secretome and cellulosome fractions from these diverse species of gut fungi, we hypothesized that they share a common role in these systems, possibly in DDP assembly. We hypothesized that these proteins function as scaffolds whereby the repeating motifs act as dockerin-binding cohesins. To investigate this, we recombinantly expressed fragments of the ScaA homologues in *Escherichia coli* and performed enzyme linked immunosorbent assay (ELISA) using purified dockerin and anti-dockerin chemiluminescent secondary antibody. These results showed a strong dockerin binding signal in wells containing the scaffoldin fragment cells compared to those containing the empty vector control. As an additional control, a phenylalanine substitution to dockerin residue W28, previously identified to be critical for binding, showed significantly reduced binding activity. To determine the binding affinity of dockerin-ScaA interaction, we purified *Piromyces* ScaA fragments and performed equilibrium analysis by surface plasmon resonance (SPR) against purified fungal dockerin. This analysis revealed that a single dockerin domain interacts with the scaffoldin fragment with an approximate dissociation constant ($K_d$) of 0.7 µM and a maximum response ($R_{max}$) of 80 RU. Additionally, the W28F dockerin mutant showed significantly reduced binding affinity ($K_d$, =2.0 µM, $R_{max}$=40 RU). Taken together, these results suggest that fungal scaffoldin proteins likely mediate assembly of DDPs in fungal cellulosomes.

Though limited, previous studies have shown that fungal cellulosomes are quite divergent from their bacterial counterparts. For example, NCDDs occur as tandem repeats at the N- and/or C-terminus, with the most common form being a double tandem repeat (i.e. double dockerin) at the C-terminus. Though the functional role of this motif repetition is not known, it has been previously noted that double dockerins bind to native cellulosomes more efficiently than single domains[5]. Thus, we hypothesized that increasing the number of NCDD from one to two could enhance binding affinity to the scaffoldin fragment. By ELISA, we found that the *P. finnis* single dockerin domain had higher binding affinity than the double dockerin domain. However, by SPR, the double dockerin had a comparable $K_d$, but a higher $R_{max}$ 120 RU, suggesting that the double dockerin is indeed capable of binding to more sites on the ScaA fragment than the single dockerin, which suggests that site specificity may be more subtly encoded in the different dockerin domains and cohesin repeats. Though the minimum sequence that defines a single cohesin remains to be determined, it is clear from our study that fragments of the scaffoldin encoding as few as four repeats are sufficient for dockerin assembly. Additionally, we cannot rule out that additional binding factors (e.g. glycosylation) found in native cellulosomes likely further modulate the fungal dockerin-cohesin interaction, which are lacking in this recombinant system.

It has previously been reported that dockerins are capable of binding to cellulosome fractions from other species of gut fungi, which is a marked departure from bacterial cellulosomes. In agreement with this observation, a *Piromyces* dockerin is capable of binding to intact cellulosome fractions harvested from *Anaeromyces* and *Neocallimastix* species. Thus, we tested whether this cross-species binding activity is encoded specifically within ScaA homologues. To test this, we purified single dockerin domains from all three genera of gut fungi and tested their ability to bind to all combinations of ScaA fragments. Indeed, we observed binding for all combinations tested and the binding signal was within standard error for almost all cases. Taken together, these results demonstrate that the fungal scaffoldin system is broadly conserved across the anaerobic fungal phylum, allowing for high interspecies infidelity. Therefore, it is not unreasonable to speculate that in their native environments, for example the dense microbial community of the herbivore rumen, fungal cellulosomes are a composite of enzymes from several species of gut fungi. This is in stark contrast to bacterial cellulosomes, which have high species specificity. This promiscuity may confer a selective advantage of fungi over bacteria in these environments.

In addition to the ScaA orthologs, other scaffoldin-like proteins were also detected through proteomic analysis of cellulosome-associated proteins. We tested three of these scaffoldins for dockerin binding activity and each tested positive over an empty vector control, suggesting that multiple scaffoldins likely exist in fungal cellulosomes. To search for scaffoldin-like proteins more broadly within anaerobic fungi, we developed a Hidden Markov Model (HMM) based on the repeating motif from all 6 scaffoldins biochemically verified to interact with dockerins. We found 95 unique loci in the genomes of *A. robustus*, *P. finnis*, and *N. californiae*, that bear a signal peptide and at least 10 cohesin repeats. Fewer loci (14) were detected in *P.* sp. E2 and *O.* sp. CIA due to fragmented genome assemblies. Significantly, no loci were found in prokaryotes (~2000 genomes) and only 1 or 2 weak hits in other fungi (~400 genomes), demonstrating this HMM is highly specific to fungal scaffoldins. These results indicate that gut fungi likely produce multiple scaffoldins for cellulosome assembly, and these scaffoldins represent a new family of genes that is unique to the early branching anaerobic fungi.

While fungal scaffoldins and their NCDD ligands are specific to gut fungi, many plant biomass degrading enzymes that encode NCDDs are of bacterial origin, which has been noted previously for a limited subset of enzymes. Indeed, all five gut fungal genomes sequenced to date have large numbers of genes that are more similar to bacterial than to eukaryotic genes (9-13%). We aligned 1600 DDPs of the 5 anaerobic fungal genomes with the 394 fungi currently deposited in JGI MycoCosm (excluding Neocallimastigomycota) and the 1774 bacteria and archaea in JGI Integrated Microbial Genomes (IMG). Of these proteins, 611 aligned better with bacterial than fungal proteins and 158 aligned exclusively with bacteria. Conversely, only 38 aligned exclusively with fungi, and 372 aligned better to fungi than to bacteria. The remaining DDPs aligned equally with IMG and MycoCosm protein (3) or did not align with either (418). To determine whether this bacterial resemblance is the result of inter-kingdom horizontal gene transfer (HGT), we queried the domains that are fused to NCDDs to extract homologous sequences from the same bacterial and fungal genomes. When possible, we built phylogenetic trees of the domain sequences. Out of 35 non-dockerin domains analyzed, 10 (29%) passed our 2 criteria of 1) greater amino acid similarity to bacterial than to fungal sequences and 2) branching with bacterial rather than fungal sequences in its phylogenetic tree with >70% bootstrap support. The list of domains with an HGT signature includes 9 CAZyme domains as well as the spore coat domain. However, this analysis does not inform us as to the direction of any possible HGT events. Subjecting NCDDs to the same analysis showed that there are no similar sequences in IMG at all, suggesting that many DDPs may be fusions between native fungal and horizontally transferred bacterial components. Intriguingly, we found 12 fungal-bacterial homolog pairs where the bacterial protein is also a bacterial dockerin-domain protein. However, the sequence similarity between each pair of homologs encompasses only the catalytic domain and does not extend into the respective dockerin domains.

Over the past several decades, characterization of cellulosomes in fungi has been elusive, with multiple studies suggesting conflicting scaffolding schemes. Here, next-generation sequencing combined with functional proteomics uncovered a new family of genes that likely serve as scaffoldins in the cellulosomes of anaerobic fungi. The evidence for this is 3-fold: (1) scaffoldins appear among the most represented proteins in supernatant and cellulosome fractions in three diverse isolates of gut fungi, and their amino acids sequences encode hallmarks of a membrane-anchored scaffoldin molecule, including an N-terminal secretion motif, a C-terminal membrane anchor, and repeating amino acid motif in between. These scaffoldins are encoded in all sequenced Neocallimastigomycota (representing 4 of the 8 genera of gut fungi identified to date) and absent in other fungi. (2) Expression of repeat-containing scaffoldin fragments shows robust interaction with purified dockerins by ELISA. (3) This dockerin-scaffoldin interaction is biologically significant ($K_d$~0.7 uM) as measured by SPR, whereas a mutated dockerin derivative significantly reduced binding activity. Taken together, the identification of a new dockerin-binding protein scaffold from fungi opens the way for exploitation of this modular interaction for synthetic biology and substrate channeling. Finally, the powerful degradation activity of gut fungi is provided by the diverse functionality of its constituents, with 50 unique protein families of bacterial and fungal origin, and the assembly of these constituents onto scaffoldin molecules into cellulosome-like complexes. Perhaps the most intriguing observation from this study is that fungal dockerins and their scaffoldin ligands have no sequence similarity to their bacterial counterparts. Thus, it is possible that the cellulosome-based strategy for plant cell wall degradation evolved in anaerobic gut fungi independently of bacteria. This suggests that co-localizing plant cell wall degrading enzymes is so effective that nature has evolved it on more than one occasion.

Example 3. Characterizing the Production of Secondary Metabolites in Anaerobic Fungi In order to better understand the production of secondary metabolites by the anaerobic fungi of the invention, bioinformatics tools and analytical tools were employed. It was determined that numerous genes involved in the production of secondary metabolites were actively transcribed in *Piromyces finnis*, *Anaeromyces robustus*, and *Neocallimastix californiae*. Genes involved in secondary metabolite production included PKS genes as well as genes involved in the synthesis of nonribosomal peptides, terpenes, fatty acids, bacteriocins, and others.

Additionally, LC-MS/MS analysis of fungal products was performed, and a large number of peaks were observed, each corresponding to a composition having unique mass and charge. These results provide promising experimental evidence that secondary metabolites are produced in abundance by these anaerobic fungi.

All patents, patent applications, and publications cited in this specification are herein incorporated by reference to the same extent as if each independent patent application, or publication was specifically and individually indicated to be incorporated by reference. The disclosed embodiments are presented for purposes of illustration and not limitation. While the invention has been described with reference to the described embodiments thereof, it will be appreciated by those of skill in the art that modifications can be made to the structure and elements of the invention without departing from the spirit and scope of the invention as a whole.

SEQUENCE LISTING (27330 sequences)

SEQ ID NO: 1 - protein, 221 aa, Neocallimastix californiae
  (Trans)glycosidases
KKILVAIWKQIAAEFADYDEHLIFEGMNEPRKVGDPAEWNGGDYEGWNFVNEMNDLFVKTIRSTGGNNALRHLMIPTYAACINDGAINNFKFPRGDDKVIVSLHSYSPYNFALNNGAGAVSNFYDGSEIDWAMNTINSNFISKGIPVIIGEFGAMNRNNENDRERWAEYYIKKATSIGVPCVIWDNGYFEGEGERFGLINRSTLQVVFPKLINGLIKGLGN

SEQ ID NO: 2 - protein, 302 aa, Neocallimastix californiae
  (Trans)glycosidases
KNQYTGVNESGAEFGQGEYPGTYNKHYIYPDVKAIQASIDQGMNIFRVGFAWERLQRSLNAEFDATEFGRLDEVINYITSNGAVAIINPHNFARYKNAVIGTSQVPNSAFSNLWKRLAQKYKNNQKVWFGLVNEPHDMPTAQWFAAARDAVDTIRATGANNNVLVPGNAYTGAWNWKETFYGESNASVALRYFSSADKNIIFETHQYFDSDYSGTHEQCVQRPCNKLFVNFVEWLKANNLKGFIGEFGAAINRDCKACVEEAINYLEQNSANIVGWAWWAAGPWWGNYMYSLEPKGNKFPEQ

SEQ ID NO: 3 - protein, 323 aa, Neocallimastix californiae
  (Trans)glycosidases
RLWSESEDLAKALVEEMTLDEKIGMVTGSQNSFGPCVGYIEPIERLGFKGMCFQDGPAGVRSAKHTTTLPSGLNIASTFDPEIMKKIGVVLGEESRAKGVNAILGPAMNMYRSPAAGRNWEGYGEDTYLASVASKNVVAGIASQGVLATIKHFAGNEQETNRETSNSEIDERVLQEVYFPPFKAGIVSGAGGVMAAYNDLNGIPSANNTWLLNKVLKKQMLFHGFVTSDWWGTKDKYEIMNGLDINMPGGKQWGPTVTESYWGEELKEAVESGEIDVSYVDEACTRILTMLYKYRQFDDYPEINLDADATEGHAEVVREAAAA

SEQ ID NO: 4 - protein, 120 aa, Neocallimastix californiae
  (Trans)glycosidases
LRYFSSEDENILFEVHQYFDTDYSGSHDTCVQRPCQNNLKEFVEWLKTNNLKGWVGEIGGLANDECKECIEEVLEYLQENRDVIKGVQWWAAGPWWGHNALSIEPNAEKAFPGQMAWLKP

SEQ ID NO: 5 - protein, 207 aa, Neocallimastix californiae
  (Trans)glycosidases
GYLSTKGHNIVDSKGRKVQLSGLSWFGGETTNLSPHGLWTNSLANFIKIVKDNGYNHLRYPWTNEMFFEGAKTQSIDQMNNPDLVDLSPLEVMDAVINECGKAGLKVYLDRHRPLSGGQSELWYVDEVDEAKWIEDWQFLAKRYKGNPTVIGADLHNEPHGKACWGCGEEERDWRLAAERCGNAIHEVNPDWLIIVEGNDHYGEEGW

SEQ ID NO: 6 - protein, 344 aa, Neocallimastix californiae
  (Trans)glycosidases
GFLSTKGHNIVDSKGRKVQLSGLSWFGGETTNLSPHGLWANSLANFIKIVKDNGYNHLRYPWTNEMFFEGAKTQSVDQVNNPDLADLSPLEIMDAVINECGKAGLKVYLDRHRPLSGGQSELWYVDEVDEAKWIEDWQFLAKRYKGNPTVIGADLHNEPHGKACWGCGEEERDWRLAAERCGNAIHEVNPDWLIIVEGNDHYGEEGWQKGESYWWGGMLKGVKEFPVRLNTPNKLVYSAHDYDKNVHMQDWFKEADFPDNMPPIWDDKWGYIVKEDIAPVLIGEFGSLLRDATDVKWLSNLIDYMKENEVHWTFWCLNPNSGDTEGILGYDWKTVNTKKDGILT

SEQ ID NO: 7 - protein, 316 aa, Neocallimastix californiae
  (Trans)glycosidases
PTLVNPKAIPAAKKLYDFLKSNYGKRILSGQVGAAGQAGDEGEEFKRIMNATGKKPAVWNMDFIFESNDCTWRPTNPDITEMAINWWKKYQGKGIMSAQWHWNIAGRTGNFAFYKKDTTFDLEKAVTEGTWEYEKIIKDIDRVSGLIKKLQAINMPLIWRPLHENNGDWFWWGNNPKACAKLWKILYERMVNYHGLNNLIWLWNGNNDEYTPIEYIDIIGVDIYANDHGPQTTAYNTHFDFYGGKKMVVLSENGRIPDIQQCVDQGAWWGYFQTWNNEFILQNHYHTDAQLKEYFNHKIVMNMDELPSFNVNSYDY

SEQ ID NO: 8 - protein, 244 aa, Neocallimastix californiae
  (Trans)glycosidases
EMAINWWKKYQGKGIMSAQWHWNIAGKTGNFAFYKKDTTFDLEKAVTEGTWEYKKIIKDIDRVSGFIKKLQAINMPLIWRPLHENNGDWFWWGNNPKACAKLWKILYERMVNYHGLNNLIWLWNGNNDEYTPIEYIDIIGVDIYANDHGPQTTAYNTHFDFYGGKKMVVLSENGRIPDIQQCVDQGAWWGYFQTWNSEFILQNSYHTDAQLKEYFNHKIVMNMDELPSFNVNSYDYQSSGSNEN

SEQ ID NO: 9 - protein, 327 aa, Neocallimastix californiae
  (Trans)glycosidases
VFATTWEEADQKAKTFMSDLTESEKIDIVTGYMNNQGSCVGNVKPLSRKNFKGICLQDGPAGVRFNDGTSTTWQVGINNAATFNKELLYKIGKDQGAEFKAKGINIALAPSMNILRAPASGRVWENFGEDPYLSGVCGTEMTKGYQDSGCIVSAKHYVANDVEHNREASTSNMDEQTLMEIHVEPFYRTVTEGQAGSVMASYNAVNDVYVVQNKKVLTEILKEKMNFQGFVMSDWWAIHDLEGSFNAGVDLNMPGGKAWGPDYINDSFWGNNISTAIRNGKVSSARLDDAVRRIIRTLYRFDQMSGYPNVNIRAQSMHAETNRQAAI

SEQ ID NO: 10 - protein, 362 aa, Neocallimastix californiae
  (Trans)glycosidases
MKILNTLSLLSLAVIGSKAMKNISSKELVKDLTIGWSLGNTLDATCFETLDYNKNPIASETCWGNVKTTQELYYKLSDLGFNTFRIPTTWSGHFGDAPDYKINDQWMKRVREIVDYALNTGGYAILNIHHETWNHAFQKNLDSAKKILVAIWKQIAAEFADYDEHLIFEGMNEPRKVGDANEWNGGDYEGWSFVNEMNDLFVKTIRATGGNNALRHLMIPTYAACVMDNAVNNFKFPSGDDKVIVSLHSYSPYNFALNNGAGAISNFNDGSEIDWVMNIINSNFISKGIPVIIGEFGAMNRNNEDDRERWAEYYIKKATSLGIPCVIWDNGYFEGEGERFGLINRSTLQVVYPKLVNGLIKG

SEQ ID NO: 11 - protein, 342 aa, Neocallimastix californiae
  (Trans)glycosidases
GYLSTKGRHIVDEKGRKVRLAGISWFGGETTNLSPHGLWAKPLDHFIKVIKDHGYNHIRYPWTNEMLFPGAKTESINAMENPDLVDLTPLEVMDAVIDACGKAGLKVYLDRHRPLSGGQSELWYISKVDEKKWIEDWQFLAKRYKGNPTVIGADLHNEPHGTACWGCGETQRDWRLAAERCGNAIHEVNPDWLIIVEGNDHYGEEGWQKGEGYWWGGMLKGVKENPVRLKKPNKLVYSAHDYDKNVHMQDWFKVSSFPDNMPEIWDDKWGYIVKEDIAPVLIGEFGSLLRDKTDVKWLQNLISYMNKNTVHWTFWCLNPNSGDTEGILGYDWETVNTQKDGI

SEQ ID NO: 12 - protein, 132 aa, Neocallimastix californiae
  (Trans)glycosidases
FNNFIFPEDDDKVIASVHAYAPYNFALNNGEGAVDKFDAAGKRDLEWNINLMKKRFVDQGIPMILGEYGAMNRDNEEDRATWAEFYMEKVTAMGVPQIWWDNGVFEGTGERFGLLDRKNLKIVYPTIVAALQ

SEQ ID NO: 13 - protein, 308 aa, Neocallimastix californiae
  (Trans)glycosidases
KNYSKGFRIGAATNTIHYNNANYVNAMKAFNYMVAENACKFVSIQGTKGRFNFNDCDAHYNKAKELGMDFRGHALIWHSMAPKWLEYEDSNTMRNSIVNHITTVLKHYEGKIDTWDVVNEAIDDDSNGNGWKYRNSFLYQKNRDFIDLAFKTARQVAPKVKLFYNDYNTEGIWGKSESVYQFVADLKKRNIPIDGVGLQYHVSVQNQPQFNKINDLIGRYCKLGLEVHITELDVSCVNSCNAGDVESRQSQVFTNALKACLNNSCCTAFLVWGIGDPDSWLGNDKKGLLFNGNYQPKSQYNALLNVLK

SEQ ID NO: 14 - protein, 326 aa, Neocallimastix californiae
  (Trans)glycosidases
WIKMSDVIQQVRPDFYFGVSTASHFFANPKYNDIISTYNLQVAGNECKFYTFNGSQTFNTKPCDDTVAFAKKYGAKFRGHNLFWPAYSPQWFQDAHDGSDPEAVKEYILDYVAKVLDHYKDEEDIIYWDVINESVTDDSTAKNIKLRTGSDNSNEFEGWDTYTEDIFKVAREHTNENVKLFYNDYNAEANNGNFDGKTGAVFEYIRSMREKGVPIDGVGLQMHVSCNWTPNYEQLTKLISQYEEIGVEVHITEIDVKRTQCKSAEAQKEVFMNVFKACFDHENCKVFTVWGSYDEESWVGVENEPVLFDVDMYPKDIYFDMLDYVL

SEQ ID NO: 15 - protein, 54 aa, Neocallimastix californiae
  (Trans)glycosidases
IRDISSKELIKEMNFGWNLGNTMDAQCIEYLNYEKDQTASETCWGNPKTTEDMF

SEQ ID NO: 16 - protein, 311 aa, Neocallimastix californiae
  (Trans)glycosidases
DLLKDYSNGFRIGAATNTRFYNNGNYVNAMKAFNYMVAENACKFVSIQGTKGKFNFNDCDNHLKKAKELGMDFRGHALVWHSMAPDWLKNEDSKTMRQSIVNHITKVLQHYDGKIDTWDVVNEAIDDDSNGNGWKYRNSFLYQKNRDFIDLAFKTARQVAPKVKLFYNDYNTEGIWGKSESVYQFIADLKKRNIPIDGVGIQYHVSVKNQPQLNKITDLIGRYCKLGLEVHITEIDVSCEGACNNGDVQNRQAQVFTNALKACLANSCCTAYLVWGIGDNDSWLGADKKGLLFDGSYKPKAQYTALLNTLK

SEQ ID NO: 17 - protein, 347 aa, Neocallimastix californiae
  (Trans)glycosidases
AKAAPFRMGVGLNGSDKSTSTVLSKKMREIIAYQFNSVTYSNLMKAENILDKAASQANAKKGDDMPVLKFDTIVDGLEFCKENNIKMRGHTLVWHVQTPEWFFRTDFSDSGSYVNAAKMEKRMESYIKQMLEFVQYYYPGIVDVWDVVNEAVEIEGGSYDASTGWNTRTRYNGSPNPWYTTMGADYVIKAFRIARKYADKNVKLIYNDYNTFMSQKTTAICNLIKKLKAENLVDGVGLQSYLNADWPNRNDYKTAIQKFAALGVEVQATELTIRTDGTANKYNTQAKHYEEVFKIYKDLKKSGVNITSVTVFGLQDGYLFYNNDSTDTRLWDHNLKKKPVYNSIMKV

SEQ ID NO: 18 - protein, 345 aa, Neocallimastix californiae
  (Trans)glycosidases
PFRMGVGLYGTNKSSSPVFSKKMREIIKYQFNSVTFTNLMKAEFMLDKSASQANARNGNDMPVLKFDTIVDGLEFCKENNIKMRGHTLVWHTQAPEWFFRTGFNDNGSYVDKNKMEKRMESYIKQMLEFIQYYYPGVIDVWDVVNEAVEIANGSYDASSGWNTRTKFDNNKTNPWYATMGPDYVFKAFRFARKYADKNVKLIYNDFNTFQYPKTDNICNLVKKLKAENLIDGVGLQSYLGPSWPNRNDYKNAIQKFGALGVEVQITELTISVENGNNKFTTQANQYRDVFKIYKDLKKSGVNITSVTVFGLQDHYLFYDNDNTETRLWDGNLKKKPVYNAIMNVL

SEQ ID NO: 19 - protein, 337 aa, Neocallimastix californiae
  (Trans)glycosidases
GFVQTDGTNFVVDGCKRYFSGSNTYYLMVSSHERVDLALEAYARHNLNVVRAWAFCDECEDATRLVDFSGPEVKLNSLNMEKVDYYLAAAAQRNIRVVLTLTNNWTDYGGMDVWVKKFGGKYHDEFYTNRKIIEGYKQYIKAMINRVNTYTGQLYKDDPTIFSWQLANEARCNNGPHGLPVKNCNTDTITKWMDEIATFIHKEDPNHLVSSGIEGIGLTPPAGVDPYTYVYTYTEGTDYEAISALDSIDYNTVHMYPVGWGLKDYAKDGVTWIQAHADVDKKFNKPTVVEEWGLSTSVDNVPIKERDPIYTQWMNAVLANDNIGMNMFWYVCGEDYY

SEQ ID NO: 20 - protein, 308 aa, Neocallimastix californiae
  (Trans)glycosidases
DAAKGFRIGAATNTIHYNNPNYINAMKAFNYMVAENACKFVSIQYTKGKFNFDDCDNHLKKAKELGMAFRGHALIWHAMAPGWLEREDGNTMKQSIINHITTVLKHYEGKIDTWDVVNEALDDSSNGNGWKLRNSFLYQKVPDFIDIAFQTARKVSPNTKLFYNDYNTEGIWGKSESCYQFIADMKKRNIPIDGVGIQYHVGINVQPKFEKINNLISRYCKLGVEVHITELDVSCDDNCRDADGGESKQGQVYTNALKACLNNSCCTGFLVWGIGDKDSWRGVESKPLLFDANYQPKGQYTAILNTLK

SEQ ID NO: 21 - protein, 231 aa, Neocallimastix californiae
  (Trans)glycosidases
AMAPGWLEREDGNTMKQSIINHITTVLKHYEGKIDTWDVVNEAIDDGSNGNGWKLRNSFLYQKVPDFIDIAFQTARKVSPNTKLFYNDYNTEGIWGKSESCYQFIADMKKRNIPIDGVGIQYHVGINVQPKFEKINDLISRYCKLGVEVHITELDVSCDDNCRDADGGDSKQGQVYTNALKACLNNSCCTGFLVWGIGDNDSWRGAENKPLLFNTNYQPKGQYTAVLNTLK

SEQ ID NO: 22 - protein, 308 aa, Neocallimastix californiae
  (Trans)glycosidases
DAANGFRIGAATNTIHYNNPNYINAMKAFNYMVAENACKFVSIQYNKGRYNFDDCDNHLKKAQELGMAFRGHALIWHAMAPGWLEREDGNTMKQSIIDHITTVLKHYEGKIDTWDVVNEAIDDGSNGNGWKLRNSFLYQKVPNFIDIAFQTARKVSPKTKLFYNDYNTEGIWAKSESVYQFVADMKRRNIPIDGVGIQYHVGINVQPQFQKINDLIGRYCKLGVEVHITELDVSCDDNCRDWDGGESKQGQVYTNALKACLGNSCCTGFLVWGIGDKDSWRGEENKPLLFNSNYQPKGQYTAILNTLK

SEQ ID NO: 23 - protein, 293 aa, Neocallimastix californiae
  (Trans)glycosidases
ITINGKRLLIKGVNRHDSDPFNGRAVPQQTLREDIALMKKHNINAIRTSHYSNDSYLYWLCNKYGMYVMGETNLESHALQNNHDAKAKFYELGMDRTETAYKRLKNNPSIFAWSIGNEMAYTNNPNDAGGLFRDMIWYFKKNDSSRPVHSEGQGSSMGVDMSSNMYPGSDGLGVHAGRGKMPYIMCEYDIASGNAIGALKEYWDVIRSADNMLGGFIWDWVDQSRAKTLNGGWDYYSQSYAITNLYSEEIKGKFYAYGGDWGDWPNDNSFCVNGLINPDRTPQPELAEVKFQY

SEQ ID NO: 24 - protein, 211 aa, Neocallimastix californiae
  (Trans)glycosidases
DLPDMLPYWPYKWPGMQSWLNQVKSFIDDKKKSGLTNWYGLEIWNEPDGTWDNANGSFNDMWKKTYDLIRQADPGEKIIGPCFSWYEENKMKNFLQYCKQNNCIPDIISWHELSGIEGVSSHLRGYRNLERSLGIKELPISINEYCDAEHELEGQPGSSARFIGKFERYKVDSAMITWWFVPHPGRLGSLMATDTQKGAGWYFYKWYGDMT

SEQ ID NO: 25 - protein, 310 aa, Neocallimastix californiae
  (Trans)glycosidases
LRDHANGFRIGAAANTMYFNNQSYINALKSFNYMVAENGCKLSGIQQQKGVYNFNDCDNHLKKAQELGMDFRGHCLIWHAYQPSWFENADANTLKNAIVDHITKTLQHYEGKIDTWDVVNEAIDDSSNGNGWKMRNSFLYQKVPNFIDLAFQTARKVSPNTKLFYNDYNTEGIYGKSESVYQFVKDLVSRNIPIDGVGIQYHVSVQSQPQYNKINDLISRYCKLGLEVHITELDVKCDNQCYSGNVEQQQATVFTNALKACLSNSCCTGYLVWGVGDNNSWLGSDKKGLLFDGNYRPKSQYTAVLNMLKE

SEQ ID NO: 26 - protein, 54 aa, Neocallimastix californiae; identical to SEQ ID NO: 15
  (Trans)glycosidases

SEQ ID NO: 27 - protein, 177 aa, Neocallimastix californiae
  (Trans)glycosidases
DILPYWPYQWPGLDKWLDAVRSFIRDKKASGLKNWYGYEIWNEAENTWRDSNGLSFFEMWKETYRVIREMDPDEKIIGPCDGLYSEQRMRPFLEYCLKNDVMPDIMCWHELMGIELIPGRYKAYRKLEKSLGIKELPITINEYCDIKHELEGQPGSNARFIGKFERYKIDSALISWW

SEQ ID NO: 28 - protein, 110 aa, Neocallimastix californiae
  (Trans)glycosidases
IIFEVHQYFDSDYSGTHDTCVQRPCQNLLKEFVEWLKTNNLKGWLGETSSTLSEGCKECVQEVLEYLEENREHVLGVTWWAAGPWWGHTACAIEPNEEKAFPEQMAWLKP

SEQ ID NO: 29 - protein, 310 aa, Neocallimastix californiae
  (Trans)glycosidases
KLQYLGTNEAGGEFGDAVLPGVYNEHYIYPNINAIEASIEQGMNVFRMGLRWERFQHELFGDLTEFDLTEYKKIVDATTAKGAVLIIDPHNYARYNNNVIGSEEVPIEAFADFWAKLAEVFKDNEKVWFDLVNEPHDMETDDWFKAARAAVDAIRTTGAKNNILISGNGWDGAWSWGKEAWYGESNADVALRYFSSEDENIIFEVHQYFDSDYSGTHDTCVQRPCQNLLKEFVEWLKTNNLKGWLGETSSTLSEGCKECVQEVLEYLEENREHVLGVTWWAAGPWWGHTACAIEPNEEKAFPEQMAWLKP

SEQ ID NO: 30 - protein, 323 aa, Neocallimastix californiae
  (Trans)glycosidases
RLWSESEDLAKAFVEKMTLDEKIGMITGSKNSFGPCVGYIEPIERLDFKGMCLQDGPAGVRNANHSTTFPSGLNIASTFDPEIMKKLGVALGEECRAKGVNALLGPAMNMYRSPAAGRNWEGYGEDTYLASVTSKNVVAGVVSQGVLATVKHFAGNEQETRREHSNSVVDERVLQEVYFPPFKAAIVSGAGGVMAAYNDLNGIPAANNTWLLNKVLKKQMMFHGFVTSDWWGTKDKYEIMNGLDINMPGGTDWGESVTESYWGEELKASVESGEIDVSYVDDACVRIMTMLYKYRQFDDYPEINLDADATEGHAEIAREAAAA

SEQ ID NO: 31 - protein, 351 aa, Neocallimastix californiae
  (Trans)glycosidases
LLTLSAASSALALTTQQVIKEMGLGWNLGNTLEATGDWINGNNVNAYETAWGNPAATKELINAIKNNGFNSIRIPVSWSNLMSSDYTISEELLKRVNEVVSWVIENDMYAIINIHWDGGWIEKFGTNESTMANQKFVKIWNQVSDYFKNYGEHLIFESLNEEGCWNDVWNRYSNAGDKNKAYSTLNNINQQFVDIVRKSGGNNKSRHLLIAGYCTDIDLTVDSAFKMPTDSENRMMVSVHYYTPSTFTILEKDEDWGKFQGTWGTDADVNELITNFDKLKKRFVDNGVPVIIGEYATVLTNKDKASVHKYLFTCAQYATSLGICPMLWDNGEYFDRKGLQFKDSEIGEFYK

SEQ ID NO: 32 - protein, 32 aa, Neocallimastix californiae
  (Trans)glycosidases
DDPETIQYKAKYIIDNNFGGMMIWELENDTDD

SEQ ID NO: 33 - protein, 234 aa, Neocallimastix californiae
  (Trans)glycosidases
IDSKIIVGYFSEWKNANYPISRVDLSKITHLNYAFGVIDPNSYAVTGYDSNILSQVVTAAHSQGVKVLMSVGGWYGSRYFTQMTSSKSNIEKFVDSCQSLISNYGVDGIDIDWEYPGREGACNSPDMANDAENYLTLLKILREKIGNALISAAVSVIPFEKNGQPISDLSEYEKYFDYINVMAYDFAGSWTPTVSHHSALYDPEAGEKLSLSSGVKNWLSRGFPANKIVVGVPA

SEQ ID NO: 34 - protein, 66 aa, Neocallimastix californiae
  (Trans)glycosidases
GEFSGHISDSQCKECVQEFLEYLQLNNEYVLGATWWAAGPWWGQNNYTIEPNAKKEFPGQMAWLKP

SEQ ID NO: 35 - protein, 313 aa, Neocallimastix californiae
  (Trans)glycosidases
GGKLKYLGVNEAGGDFGEGHLPGVYNTHYTYPNIDAISTSIEQGMNAFRMGLRWERFQHELFGELTEFDLTEYKKIVDAVTAMGAVIIVDPHNYARYKDKLIGSEEVPTEAFVDFWKKMANVFKDNDKVWFGLVNEPHDMKTDDWFKIARAAVDGIRSTGANNTILIPGNGWDGAWSWGSQAWYGESNAEVALRYFSSEDENIAFEVHQYFDSDYSGGHGTCEKRPCQNNVKEFVQWLKDNNLKGWFGEFSGHISDSQCKECVQEFLEYLQLNNEYVLGATWWAAGPWWGQNSYTIEPNAKKEFPGQMAWLKP

SEQ ID NO: 36 - protein, 351 aa, Neocallimastix californiae
  (Trans)glycosidases
LLTLATASSALALTTQQVVKEMGLGWNLGNTLESTGDWINGRNVNAYETAWGNPAATKDLIKAIKNNGFNSIRIPVSWSNLMSSDYTISQELLKRVNEVVSWVIDTGMYAIINIHWDGGWIEKFGTNESTMANQKFNKIWTQVSDYFKNYGEHLIFESLNEEGCWNDVWNRYSNSGNKNKAYSTLNNINQQFVDIVRKSGGNNKNRHLLIAGYCTDIDLTVDSAFKMPSDSANRMMVSVHYYTPSTFTILEKDEDWGKFQGTWGTDAEIKTLMADFDKLKKRFVDNGVPVIIGEYATVLTNKDKASVHKYLFTCAQYATSLGICPMLWDNGDYFDRKALKFKDSEIGDFYK

SEQ ID NO: 37 - protein, 208 aa, Neocallimastix californiae
  (Trans)glycosidases
DFLPYWPYQWPGMQKWLELVRQFIRDKKAAGIKNFYGYEIWNEAENTWRDSNGYTFFEMWKETYKVIREMDPDEKIIGPCDGLYSEERMRPFLQYCLDNDVMPDIMCWHELMGVELIPRRYKAYRELEASLGIKELPITINEYCDIKHELEGQPGSSARFIGKFERYKIESALISWWFNNLPGHLGSLLATDSEKGAGWYFYKWYGDM

SEQ ID NO: 38 - protein, 73 aa, Neocallimastix californiae
  (Trans)glycosidases
GIPMILSEYCAMNRDNEEDRATWAEFYMEKVTAMGVPQIWWDNGIFEGTGERFGLLDRKNLKIVYPTIIAALQ

SEQ ID NO: 39 - protein, 270 aa, Neocallimastix californiae
  (Trans)glycosidases
HYGLIENVPKDYKNLVAPLNVNVMRAPARSGNGRQQPIGDVIKVAQRLKESPGARVTIELADILPGWPYKWPGIQTWFNEIRSFINDKKKSGLTNFYGNEIWNEPDVTWKDSNGLSFNQMWKQTYDLLRQIDPNEKIIGPSFSWYEENKMKNFLQFSKQNNCLPDIIAWHELSGIDGVSSHFRSYRNLEKSMGISERPITINEYCDENHDLEGQPGSSARFIGRFERYKVDSGMITWWFVPHPGRLGSLLASDTQKGAGWYFYKWYGDMT

SEQ ID NO: 40 - protein, 369 aa, Neocallimastix californiae
  (Trans)glycosidases
LSFYKGVDISSIISLENSGVQFYDTNGQPQDIFKTLASVGVNCIRVRIWNSPRSTDGKTYGGGNNDLEVAREIGSRAAKAGLPLFVDFHYSDFWADPAKQSIPKEWKGFDLNKRIFEIYRFTKGCLEWLLENGSYISMVQIGNETTCFMCGENEMVNVMKMMSNGIQAVRDINKNILIALHFTNPNKTDNMLWYASQLAEAKVDYDVFCTSYYPFWHGTTENLQWILGEIANKYGKKVMVAEFSYPYTEVAKTSDNCEYSHVNHKLEGTEFNYPLTLDGQIQCIKDVYSHIKNTKNGIGAFYWEPAWIAPKASNDLERRQLWEKYGSSWATKTAAEYDINADSSLTGESAWDNQAVFDQEGKPLKSIWA

SEQ ID NO: 41 - protein, 304 aa, Neocallimastix californiae
  (Trans)glycosidases
GYLSTKGHNIVDSKGRKVQLSGLSWFGGETTNLSPHGLWANSLANFIKIVKDNGYNHLRYPWTNEMFFEGAKTQSVDQVNNPDLADLSPLEIMDAVINECGKAGLKVYLDRHRPLSGGQSELWYVDEVDEAKWIEDWQFLAKRYKGNPTVIGADLHNEPHGTACWGCGETKRDWRLAAERCGNAIHKVNPDWLIIVEGNDHYGEEGWQKGEGYWWGGMLKGVKENPVRLNTPNKLVYSAHDYDKNVFMQDWFKESDFPDNMPPIWDDKWGYIVKEDIAPVLIGEFGSLLRDATDVKWLSNLIYY

SEQ ID NO: 42 - protein, 256 aa, Neocallimastix californiae
  (Trans)glycosidases
EAIDYFIAAASQRNIRLVLGFTNNWTDYGGMDEWVKGFGGKYHDDFYTNKEIRNAFKRYIKTVITRINRHTNIRYRDDPTIFSWQLANEPRCGNGPSGLPQSGKCTPEVITEWADDISSYIKELDPNHLVSVGVEGFGLEAPKGSKGLYAYKYDEGTDFEALTALPNVDYNTYHYYPIPWGMTDLISHTKDWIESHQAVGKKLNKPVVFEEWGLEVPTDCSKEERIQYYKTWTKQILDADVPMNMFWYTVGADYYG

SEQ ID NO: 43 - protein, 308 aa, Neocallimastix californiae
  (Trans)glycosidases
KDYANGFRIGVAANTMKFNNQAYNEALKAFNYMVAENGCKLSGIQQQKGVYNFSDCDNHLKKAKELGMDFRGHCLIWHSYQPSWFENADANTLKNAIVDHITKTLQHYEGKIDTWDVVNEAIDDSSNGNGWKMRNSFLYQKVPNFVDLAFQTARKVSPNTKLFYNDYNTEGIYGKSESVYQFVKDMISRNIPIDGVGIQYHVSVSSQPKYEKINDLISRYCKLGIEVHITELDVKCDNQCNSNNVEQQQATVFTNALKACFSNSCCTGYLVWGVGDNDSWLGSDKKGLLFNSNYKPKSQYTAILNFLK

SEQ ID NO: 44 - protein, 347 aa, Neocallimastix californiae
  (Trans)glycosidases
PFRFGVGLNGASIENSTVSSKTMREVIKHQFNSVTYSNLMKSLFILNQEGSIKNLKEGKQDPALDFSGIVDGLDFCQKNGIHMRGHVLVWHNQVPRWFFTKDYSEDGEFVDPETMEYRLDSFIRQYLGFVQYYYPGVVDVWDVVNEAVEVVGEQYDNSTGWYTRTLYDEVKPNMWYDMFGPDYVVKTFRIARKYALPNVKLVYNDYCTYVTKPISKRDAIVKLLGILQKEDLVDAIGMQSYINPEEDVNDHLAAIEVYQQTGLEIQITELTIRVKNTDDWEEYNIQQYSQLFEGIMKYVRKGYNIGSVTVFGLQDGYRFYENDSTKTRLFDHDLQKKKVYRAIMDII

SEQ ID NO: 45 - protein, 349 aa, Neocallimastix californiae
  (Trans)glycosidases
EAPFRFGVGLNGGAISTSTTTSKKMREVIKYQFNSMTYTNLMKPEFVLDKEGCLKNAENGSEEVVLKFDDIVDGLDFALKNNIHVRGHVLVWHTQTPDWFFRKGFNSENEFADVETIYQRLESYIRQYLGFVQHNYPGVIDVWDVVNEAIEINDGYFDNSTGWYTRVSTQTEESLWYKIVGPDYVKKTFEIARKYALPNVKLVYNDYNTFQTYPHDKTQAIIDLMNILRKDNLVDALGMQSYIGETWPKIEEYVRAIERFTEAGLELQITELTITPPSGEGWLEKQAQQYREFFEKVMEQINKGANITSVTVFGIQDGYRFYTSDSTKTRLLDHDLQKKPNYEAIMEVL

SEQ ID NO: 46 - protein, 344 aa, Neocallimastix californiae
  (Trans)glycosidases
FRMGVGLYGTSKTNSPIFSKKMRDVIAYQFNSVTFTNLMKADQMLDKAASQANARSGNDMPVLKFDSIVDGLEYCKANNIKMRGHTLVWHVQAPEWFFRTGFNDNGNYVDKNKMEKRMESYIKQMFEFVQHYYPGVVDVWDVVNEAVEITNGSFDASSGWNTRTKYDNNKTNPWYATMGPDYVFKAFRFARKYANKDVKLVYNDFNTFMSQKTNAICNLVKKLKAENLIDGVGLQSYLGPSWPNRNDYKNAIQKFSALGVEIQITELTISVEESNNKFNAQANHYRDVFKIYKDLKKSGVNITSVTVFGLQDHYLFYDNDKTETRLWDRNLKKKQAYNSVMSVL

SEQ ID NO: 47 - protein, 167 aa, Neocallimastix californiae
  (Trans)glycosidases
PGVSSWSWVAHWGYGESDQSNPNTHKKWIDLASTMGWRFYILDEGWQPDSYDNDGSYYSGWFDWWPEVRDYAKRKGVQLIAWVHKNDVDTPEKRRKRFKEWSEEGIVGIKVDFFFNEAQSTLQLHQDIYKEAARYHLLVNVHGSNPPSGEIRTYPNVLAREGIRGQE

SEQ ID NO: 48 - protein, 325 aa, Neocallimastix californiae
  (Trans)glycosidases
WIKMSDVIQQVRPDFYFGVATQKTFFANPKYKDIMSTFNLEVGGNECKFYTINGSETFNTKACDESIAFAKKQGAKYRGHNLFWPANSPSWFKSAYDGKDPEEVKEYILDYITKVLDHYKDEEDIIYWDVINESVTDDSTPENIKLRTGSDTSNEFKGWDTYTEDIFKLAREHTNENVKLIYNDYNAEANGGNFGGKTGAVFQYIKSMKENGVPIDGVGLQMHISCNWTPNYEELTKLISQYEEIGVEVHVTEIDVKMENCKTHDDQRKVYMNIFKACFDHENCKVFTVWGAYDSESWVGAENEPLIFDEDMYPKDIYFDMLDYV

SEQ ID NO: 49 - protein, 342 aa, Neocallimastix californiae
  (Trans)glycosidases
GYLSTKGKYIVDEKGRKVKLAGLSWFGGETPNLSPHGLWAKPLAHFIKVIKDHGYNHIRYPWTNEMFVEGAKTESINAMENPDLVDLTPLEVMDAVIDACGKAGLKVYLDRHRPTAAGQSELWYISKVDEKKWIEDWKFLAKRYKGNPTVIGADLHNEPHGTACWGCGETERDWRLAAERCGNAIHEVNPDWLIIVEGNDHFGEEGWQKGESYWWGGMLKGVKENPVRLNKPNKLVYSAHDYDKNVHMQEWFKLSTFPDNMPEIWDDVWGYISKEDIAPVLISEFGSLLRDKTDVKWLENLVSYMNDNAVHWTFWCLNPNSGDTEGILGYDWETVNTQKDGI

SEQ ID NO: 50 - protein, 370 aa, Neocallimastix californiae
  (Trans)glycosidases
FEGFGTSFCWWANRLGYSDILSEKAATLFYDKKEGLGLTIIRYNIGGGDNPSHNHITRTDSNMPGYAINPRYNGNGSYTWDYNWNSDFNQRNALLKAIAKNKEEIIVEGFSNSPPYFMTNSGCSTGNTDPNKDNLKSDAYPAFAKYLADVAEHFSKSWGVTFQSMTPVNEPFTNYWGANSKKQEGCHFDQGNSESKIIVELRKAIDQKGLKSIQISGTDETSIDTQITSYEKLSNEAKNIITRIDTHTYSGSKRYELRVLAENSKKNLWMSEVDGGGVAGTNAGEMGAGLWLANRIIEDLNGLRSSAWVLWQVIDNHISKNGYNGKKDSGMVNLNGGYWGIAVADHDKNDIILTQKYYAFGQFSRYIRPG

SEQ ID NO: 51 - protein, 355 aa, Neocallimastix californiae
  (Trans)glycosidases
MKFENFLFIFGCVGSSLALTTKEVIKDMGLGWNLGNTLEACGDWINGSTTKQYETAWGNPETTEAMIKGVKSYGFKSVRIPVAWSNLMSSDYTISPLLLKRVEEVVNYVVKNDMYAIMNIHWDGGWFEKFSTSEQEAFTKYKKVWEQLTDYFKSFDEHLIFESLNEEGCWDSIWNRYSKSGDKAKAYGLLNTINQNFVDIVRNSGGNNTNRHLLLAGYCTDIDLTVDEAYVVPKDDRVMVSVHYYTPSTFTLLEEDADWGKAAPTWGTDDEVNYLINDFNKLKTRFVDKGIPVIIGEYGTTAKNKDTESIHKYLMTCAEYALNLDMCPVVWDAGQYFDRNSLTFKDSEIGELYKS

SEQ ID NO: 52 - protein, 337 aa, Neocallimastix californiae
  (Trans)glycosidases
GFVQTDGTNFVVDGCKRYFSGSNTYYLMVSNHERVDLALEAYARHNLNVVRAWAFCDECEDATRLVDFSGPEVTLNSENMEKVDYYLAAAAQRNIRVVLTLTNNWTDYGGMDVWVKQFGGKYHDEFYTNRKIVEGYKQYIKAMINRVNTYTGQLYKDDPTIFSWQLANEARCNNGPHGLPVKNCNTDTITNWMDEIASFIHQEDPNHLVSSGIEGIGLTPPSGVDPNTYVYRYDEGTDYEAISALDSIDYNTVHMYPVGWGLKDYSKDGVTWIKAHADVDKKFNKPTVVEEWGLSTSADNVPLEERDPIYTKWMDAVLANDNIGMNMFWYVCGEDYY

SEQ ID NO: 53 - protein, 211 aa, Neocallimastix californiae
  (Trans)glycosidases
DLPDMLPGWPYNWPGMQSWLNQVKSFINDKKKSGLTNWYGLEIWNEPDGTWKDSNGSFNQMWKQTYDVIRQADPGEKIIGPCYSWYQENKMKDFLQFCKQNNCLPDIISWHELSGIEGVSSHLKAYRNLERSLGIKELPISINEYCDAEHELEGQPGSSARFIGKFERYKVDTAMITWWFVPHPGRLGSLMATDNQKGAGWYFYKWYGDMT

SEQ ID NO: 54 - protein, 211 aa, Neocallimastix californiae
  (Trans)glycosidases
  MOD_RES (30)..(30): Any amino acid
DLPDMLPGWPYNWPGMQSWLNQVKSFINDXKKSGLTNWYGLEIWNEPDGTWRDSNGSFNQMWKQTYDLIRQADPGEKIIGPCYSWYQENKMKDFLQFCKQNNCIPDIISWHELSGIEGVSSHLKAYRNLERSLGIKELPISINEYCDAEHELEGQPGSSARFIGKFERYKVDTAMITWWFVPHPGRLGSLMATDNQKGAGWYFYKWYGDMT

SEQ ID NO: 55 - protein, 353 aa, Neocallimastix californiae
  (Trans)glycosidases
MKLSILFSIIGWASTTLAALTTEDIIKGLTVGVNLGKTFEINRDWKSVENINQPWAEKNFTAKEIVESYKQLGFNAIRIPVKWAKTINSKTVIEPNLLKSVEEVVRQTLNNNMFAIINLETSNTFMTGFISEDDNIRSETYDGYKGIWKQISNYFKDYDEHLLFESMNDSGYWEDIWNTRTSDGDRQYALDILRQVNQEFINMVRSTGGSNEERYLLVSGYANDPILTQDNFYKIPSDPSHKLMVSLYYYVPNHFTIIDNYYTWGSQDDIKQLQTIMKNLSVRFVIQGVPVVITRYGTIVKNRSSANIHSYLTSIANNASSKNIPSFLSDSGEFISRDHLPLSFIEEELGKFY

SEQ ID NO: 56 - protein, 369 aa, Neocallimastix californiae
  (Trans)glycosidases
INFYKGVDISSIISLENSGIRFYDTNGQQIDIFKMFASVGVNCIRVRIWNNPKSANGKTYGGGNNDLEVAREIGSRAASAGLPLFVDFHYSDFWADPGKQTIPKDWKNFNLDKRVSEIYRFTKGCLEWLLQNGSLISMVQIGNETTCFMCGDKNMTNVMKMMSNGAKAVREINRDILIALHFTNPNKSDNMLWYASQLASARVDYDVYSTSYYPYWHGTTDNLKWVLGEIANKYGKKVMIAEYSYPYTEVAYTSDNCHYGVVDSKASGTVFRYPISVDGQIQCIRDMYSVMRNTKNGIGAFYWEPAWIAPKARNDMERRQIWEQYGSSWATKTAAEYDSNADRNLTGGTSWDNQAIFDQNGKVLKSIWA

SEQ ID NO: 57 - protein, 291 aa, Neocallimastix californiae
  (Trans)glycosidases
GMHVQGSKLLDGNGNEFIFRGINIAHAWYTDKTEFSINEINALGANSARIVLACGAKYTKTSYTEVEKIIGWCEKAGLVCVLELHDFTGSDNPSDITTTALNYWKEMKDLVNTHKDYIIINIANEWQGSWNKGSLWGNTYSSAVKSMRNIGIQNAIMIDASGYGQETGPMINYAQSVLSADPNKNVIFSYHVYSVLGKDNTSLYSGFDGIKAKGVCWIVGEFGWWQNGGDVVYKSLMSYCNSNRIGWIAWSWSGNGGIDTCLDLTSSKTFSRNSLSDWGKYVFYSNDGIKY

SEQ ID NO: 58 - protein, 354 aa, Neocallimastix californiae
  (Trans)glycosidases
AKAAPFRFGVGLNGGAIENSTTSSKTMREVIKHQFNSVTYSNLMKAVFVLNQEGSIKNLKKGKQDPVLDFSTFVDGLDFCQKNGIHMRGHVLVWHNQAPRWFFTKNYEEDGEYVDAKTMEYRLESYIKQYLSFVQFNYPGVVDVWDVVNEAIEVVDNQYDKSTGWYTRTLYGNNSPNMWYDIFGPDYVVKTFRIARKYALPNVKLVYNDYSTFVTKPVSKRDAIIKLLGILKKEDLVDAIGMQSYINPDEDINEYLAAVDEYQKTGLEIQITELTIRVKSTDDWEEYNIQQYSQLFEGLMKRVKKGYNIGSVTVFGLQDGYRFYENDTQKFRLFDHDLKKKKVYHAIMKILKGE

SEQ ID NO: 59 - protein, 325 aa, Neocallimastix californiae
  (Trans)glycosidases
MKLFNIFFFIIECASTALSIALKDVLNGMSVGVNLGKTFEIKKDWKTVENINQPWDKKSFTAKEIVESYKQLGFNAIRIPVNWATKINSKTIIEPNLLKSVEEIVHNTIDNNMFAIINLETSNSFMTGFISEDEELRSETYDGYKNIWKQVSNHFKDYDEHLLFESMNDSGYWEDIWNTRTTDGDRQAALDVLRQVNQEFINAVRSTGDNNEKRYLLVSGYANDPILTQDNFYKIPSDPSHKLLVSLYYYVPNHFTTIDNYYTWGSQEDVKQLQTIMKNLSIRFVIQGVPVIITRYGTIVKNRSSANINSYLTSIVNNASSQNMP

SEQ ID NO: 60 - protein, 348 aa, Neocallimastix californiae
  (Trans)glycosidases
GYFHVKGSEIVDENDEPVRIAGVNWFGTETAQLSPHGLWSKNLTEILYLIVDHGYNTIRYPYCNDIFKPGASTVSIEYYRNPWAKGLSPLEVMDVVIREATDLGLKIILDRHRPDFQAQSALWYTSAVSEEQWISDWQKLAKRYKDNSGVIGADLHNEPHDEACWGCDDISIDWRLAAERCGNAIHEINPNWLIIVEGIHHIGETCWQCGDNYWWGGYLKKGVVDIINKPVNLKIPNRVVYSTHDYPREVFPQTWFDDPTFPDNMPDKWYNYWSWIKKDNIAPILVGEFGTKLEDDWDRVWLKTLVNYMKENRLHWTFWCLNENSSDTGGLITGGAWDGWHDEKDSML

SEQ ID NO: 61 - protein, 235 aa, Neocallimastix californiae
  (Trans)glycosidases
KSIIIYYPEWKYYNYPPRNLPFNKLTHINYAFGEIDPTNYSLKYDSTKFLELIETARSRNKNVKIIMSVGGWTGSRYFSVMSSNPANRSKFISSVKSMLESTGADGIDIDWEHPGVPGAFYDSFDAQNDTYNLLKLMQELREAIGKSKIISTAVTFNLFVVNYQPLQDLSKFAEILDYINLMCYDFNGSWSNIISHQSSLYPTGGNDSGFSVEGAVKNWMNAKFPSNKIVIGIPS

SEQ ID NO: 62 - protein, 35 aa, Neocallimastix californiae
  (Trans)glycosidases
DDPESVKIKADYVIERNLGGMMMWEIEEDTKDGEL

SEQ ID NO: 63 - protein, 357 aa, Neocallimastix californiae
  (Trans)glycosidases
KEAPFRFGVGLNGVDINNYTPSSKKMMELIKYQFNSMTYSNGMKSIKIMDEEGSRKNIAEGREEVAVDFSGIIDGLEFAKKNGIHIRGHVLVWHKQTPDWFFRKDFDTEKEYADVETIFVRLESYMKAFFDFLNFNYPGVVDVFDVVNEAIEVREGKFDNSTGWYTRTESLEGDDNIWNTLVGPSYVVRAFRIARKYALPTTKLVYNDVDTFMTKPHDKTQAVIDLMNILRAEDLVDALGMESYIDQDLVNVDAPEDYARAIERFTEAGLEIQITEFTIYNDDREDWLETQTKRYRDFFQVVIDHVKKGYDNISSFTVFGLQDGYRFYDNDTQKTRLFDHDLQKKPNYYAIMEILKQ

SEQ ID NO: 64 - protein, 303 aa, Neocallimastix californiae
  (Trans)glycosidases
KIQYTGVNESGAEFGEGKYPGVYNTDYIYPDVKAIQASIDQGMNIFRVGFSWERMQRTLNSAFDTTEFKRLDEVISYITKNGAVAILNPHNFARYRNSVVGSSQVPNSAFADFWKRMADKYKSNNKVWFGLVNEPHDMPTEQWFSAARDAVNAIRKAGANNNVLVPGNSYTGAWCWTKTHYGSPNSKVALEYFNASDKNIIYEVHQYFDSDYSGTHEQCVQRPCNKLFTDFVDWLKENNLKGFVGELGAAINNDCKACVEEALNYLEKNSDYVVGWTWWAAGPWWGNYMYSIEPKGNAFPEQM

SEQ ID NO: 65 - protein, 324 aa, Neocallimastix californiae
  (Trans)glycosidases
WVKMSDVIQQVRPDFYFGVATSIAYSSNPKYKDIVSSFNLHVGGNECKFYTIQASKTRNFYQCDQSLSYAKKFGAKYRGHNLFWPANSPNWFKTYSDDIEVTKSYIIDYIKSVLNHYRDDDSIIYWDVINESVMDESTSNDIQLRTGSKTSDEFLGWDTYTEDIFKLARDNINENVKLIYNDYYCEANNGNFDGKTGAVFNYIKNMKEKEVPIDGVGLQMHVSCNDAPSYDDLYLLISRYEEIGVEVHVTEIDVTMARCNSLKDQKDVYMNIFKACFNHNNCKVFTVWGAYDTESWIGAENTPLIFDSDMYPKDIYFEMLDYVL

SEQ ID NO: 66 - protein, 344 aa, Neocallimastix californiae
  (Trans)glycosidases
GFLSTKGRNIVDQKGRNVKLAGISWFGGETDNLSPHGLWSKSLAHFIKVIKDNGYNHIRYPWTNEMLLSGARTKSINAMENPDLANLTPLEVMDAVINAAGKAGLKVYLDRHRPTAAGQSELWYISKVDEKKWIEDWKFLAKRYKGNPTVIGADIHNEPHGTACWGCGETKRDWRLAAERCGNAIHEVNPDWLIIVEGNDHYGEEGWQKGESYWWGGMLKGVKQYPVRLNKKNKLVYSAHDYDKNVHLQDWFKVSNFPDNMPSIWDDKWGYIAKQNIAPVLISEFGSLLKDKTDVKWLQNLISYMNKNGVHWTFWCLNPNSGDTEGILGYDWETVNKQKDGILT

SEQ ID NO: 67 - protein, 351 aa, Neocallimastix californiae
  (Trans)glycosidases
YFFSLLGCAGSTLALTSKEITKELGLGWNLGNTLEACGDWINGKTTKQYETAWGNPVTTEEMIKGVKSYGFSTVRIPVAWSNLMSSNYTISPLLLNRVEEVVNYVVKNDMYAIVNIHWDNGWFTKFATDEEEAFIKYKRIWGQISEHFKDYDEHLIFESLNEEGCWESIWNNYSNEGDKPKAFGLLNTINQNFVDIFRNSGGYNAERFLLLAGYCTGIDHTIDKNYILPKDDKVMVSVHYYGPSTFTILEEDADWGKAAYYWGTEEEINNITNDLIKVKTHFVDNNIPVIIGEYGTATTNKDPESVRKWLRTVAGKATELGICPIVWDAGQYFDRKALTFKDPQIGELYKE

SEQ ID NO: 68 - protein, 348 aa, Neocallimastix californiae
  (Trans)glycosidases
AKAAPFRMGVGLNGSDKSTSTVLSKKMRQLIAYQFNSVTYSNLMKAEHILDKSASQANANKGNDMPVLKFDTIIDGLEFCKENNIKMRGHTLVWHVQTPEWFFRTNFSDSGSYVNAQKMEKRMESYIKQMLEFVQYYYPGVVDVWDVVNEAVEIEGGSYDSSTGWNTRTKYNGSANPWYATMGPDYVFKAFRFARKYADKNVKLIYNDYNTFMSQKTNAIYNLVKKLKSENLIDGVGLQSYLNADWPNRNDYKNAMQRFASLGVEIQATELTIKTDGSSNKFNNQAKHYQEVFKIYKDLKKSGVNITSVTVFGLQDGYLFYSNDSTDTRLWDHNLKKKPVYYSIMNAL

SEQ ID NO: 69 - protein, 353 aa, Neocallimastix californiae
  (Trans)glycosidases
KEAPFRFGVGLTGTNLQVSTTVSEKMRDIIKHQFNSMTYTNLMKPLYILDKEGSIQNIKNGIQDPKLNFTSIVDGLEFAYKNGIHIRGHVLIWHTQTPDWFFNEGYTDDGKKVSPEVMESRLDSYIKQYLSFVQFNYPGVVDVWDVVNEAIEITDGQYDANTGWYTRTMLNNTPNPYYDMFGPDYVIKAFRIARKYALPNVKLVYNDFNTFQVWPHNKTQAIMDLAGILQKEDLIDGIGLQSYLGVTWPSLDEYFRGVERLATTGLELQITELTITAPDGDNWLEAQAEQYRDFFERLMKHVEEGYNIGSVTVFGLQDGYLFYASDSTKTRLLDHDLQKKPNFEAIMSILKSY

SEQ ID NO: 70 - protein, 261 aa, Neocallimastix californiae
  (Trans)glycosidases
TQKNIAAFESLQDRHLDVVHLFIHWDNKDEPWEWARNFVDIAKANGSIMMISWMPQPYTAQDILDGKGDEYIDTFVKGVKDFGEEIWLRPLHEANGDWYTWGTGADRINNSEDKLAAAYRHIVDRFRDANVTNVKWIWTTNCSNSGVATLTGSYPGDDYIDYTSIDGYNWGTAQSWSRWNTFEEVFDNAYKALIKIPKPIFLAEFSSSRFGGDKAGWFTDMFNLLPEKYPRIVGLVIFSRSKNETEADWALDSQEEAVEAW

SEQ ID NO: 71 - protein, 309 aa, Neocallimastix californiae
  (Trans)glycosidases
RDYSKGFRIGAATNTIHYSNSNYNNAMKAFNYMVAENACKFVSIQGTKGKFNFNDCDNHLKKAQELGMDFRGHALVWHSMAPKWLENEDANTMKNSIINHITTVLKHYEGKIDTWDVVNEAIDDSSNGNGWNMRKSFLYNKVPNFIDIAFQTARQVSPKTKLFYNDYNTEGIWGKSESVYQFVADLKKRNIPIDGVGIQYHVSLENNPRFDKINDLISRYCKLGVEVHITEMDVSCDKNCWASDVEQQQGKVFTNALQACLNNSCCTGFLVWGIGDNDSWIGGDKKGLLFNSNYQPKSQYTAVLNLLKS

SEQ ID NO: 72 - protein, 350 aa, Neocallimastix californiae
  (Trans)glycosidases
AKEAPFRFGVGLNGGALSTSTTTSKTMREVIKYQFNSMTYTNIMKPEYIFDKEGCLKNAENGSEEMALKFDDIVDGLDFALKNNIHIRGHVLVWHKQTPDWFFRKGFNSENEFADVDTIYYRLESFIKQYLGFIQFNYPGVIDVWDVVNEAVEINDGSFDNSTGWYTRTMTGDEESLWYKVVGPDYVKKTFEIARKYALPNVKLVYNDYNTFQTYPHDKTQAIIDLIDILRKDNLIDAIGMQSYIGVNWPSVDEYIRAIERFTEAGLEIQITELTITAPSGDDWLEKQAQQYGELFERIMEQIKKGANISSVTVFGLQDGYRFYSSDSTKTRLLDHDLQKKPNYEAIMKV

SEQ ID NO: 73 - protein, 32 aa, Neocallimastix californiae
  (Trans)glycosidases
DDPESVSLKADYVINKNLGGMMMWEIEEDTQD

SEQ ID NO: 74 - protein, 236 aa, Neocallimastix californiae
  (Trans)glycosidases
SKSIIVYYPEWKYYDFPPKNIPFNKLTHINYAFAEIDSNDYSLDYDSSRFLELVETAHEKNKNIKVLMSIGGWTGSKYYSKMASSSSRRSKFVKSVKRMLEASDADGIDIDWEYPGTSGAYDDNFDAENDTNNLLKLLKELREAIGSSKIISAAVPFNTFEVDSRPLKDMSEFAELFDYVNIMAYDFAGSWSTVTSHQSSLYSISEDDNGYSLSGAVSNWINANFPSSKIVVGIPA

SEQ ID NO: 75 - protein, 31 aa, Neocallimastix californiae
  (Trans)glycosidases
DDPESVSIKADYVIKYNLGGMMMWEIEEDTK

SEQ ID NO: 76 - protein, 235 aa, Neocallimastix californiae
  (Trans)glycosidases
KSIIVYYPEWKYYNFPPKNIPFNKLTHINYAFAEINSSDYSLEYDSSKFLELVETAHEYNKNIKVLMSIGGWTGSRYYSKMASSSSNRSKFVKSVKRMLEASGADGIDIDWEYPGTSGAYDDNFDAKNDTNNLLKLLQELRASIGYSKIISAAVPYNTFEVNYKPLEDMSEFAELFDYINIMAYDFAGSWSSVTSHHSSLYSTVEDDSGYSLAGAVKNWMNARFPATKIVVGIPA

SEQ ID NO: 77 - protein, 301 aa, Neocallimastix californiae
  (Trans)glycosidases
LTNPNSTSSTKLLYNYLVNNFGKKIISGQVGSAGYLETEEFDYIKKITGKTPAMFNVDFIFESLDHDWKPDDSIADMVLAWWKKYEGKGILHAQWHWNKKGSDGQVSFYTKNVDFDITKALIEGTNEYKSIMADMDYIASQIKILQDKDIPIIWRPLHEASGGWFWWGAKGPEPCVALYKMMYERFTKVHKLNNLIWCWNGGIGNWYPGDEYVDIISEDVYDKHSSFASKYNSLLNQVGNKKIIALSENGSLPDIESCMKERITWSFFCTWNNEYILNNSDNIYNTPEYIKSVYNSNYVIT

SEQ ID NO: 78 - protein, 197 aa, Neocallimastix californiae
  (Trans)glycosidases
MEKWLELVRQFIRDKKASGLTNWYGYEIWNEAENTWRDSNGYTFLEFWKETYKVIREMDPDEKIIGPCDGLYVESRMRPFLEFCKENDVMPDIMCWHELMGVELIPRRYKAYRELERSLGIKELPITINEYCDIKHELEGQPGSSARFIGKFERYKIESALISWWFNNLPGHLGSLLATDSKKGAGWYFYKWYSEMT

SEQ ID NO: 79 - protein, 225 aa, Neocallimastix californiae
  (Trans)glycosidases
WLPSQGMTWNYVLGNDIDVNSETANVVDIDIRKTEAINKLHKKGIKVICYFSVGTLESFRDDYPQFLAVKGLVKNRYDDWPDERWLDFRVEGIKPLLKNRMKSAVSKNCDAIEVDNLDGYQMDEVKSWSKPLTKKDTIVFAKWLSTTAHGLGLSIGLKNVAGLIDELTSYYDFAINEECIKYNECSLYKNFLRTGKAVFGVTYNGLSANKSKLCKNLNGLGISMI

SEQ ID NO: 80 - protein, 93 aa, Neocallimastix californiae
  (Trans)glycosidases
IGRYCKLGLEVHITELDVKCDNVCNSGNVEQQQATVFTNALKACLNNSCCTGYLVWGIGDNDSWLGGDKKGLLFNSQYKPKSQYTAVLNVLKE

SEQ ID NO: 81 - protein, 305 aa, Neocallimastix californiae
  (Trans)glycosidases
LDEKINMVTGSQNSFGPCVGYLEPIERLGFKGLCLQDGPAGVRSAKHSTTFPSGLNIASTFDPELMKSLGVALGEEVRAKGVNAILGPAMNMYRSPVGGRNWEGYGEDTYLASVAAKNVVAGITSQGVIATIKHFVGNEQETKRESSNSIIDERVLQEVYFPPFKAAIVSGAGGAMAAYNDLNGIPCANNTWLLNKVLKKQMLFHGFVTSDWWGVKDKYGIMNGLDLNMPGGKEWGPTVKDSYWGEELKEAVESGEIDEMYLDEACIRVMTMLYKYRQFDDYPEINLDADATEGHAEIVRKAAAN

SEQ ID NO: 82 - protein, 349 aa, Neocallimastix californiae
  (Trans)glycosidases
FRMGVGINGSLRKTSTILSKKMVDIINHQFNSVTLTNLMKPSYLLDQNGSQKNIMKGIQDPSVNFQSAIDTLEYCKKNNIKMRGHTLVWHTQTPSWFFKKDYDDKNDYVDSEVMELRIESYIKQVMQFVQYYYPGVVDVWDVVNEAVEIDEGYYDEKVSWKTRTKCNESSNPWYETMGPDYVIKAFRFARKYAAPGVKLIYNDYNTFMSEKTTAIINLLKILKEENLIDGIGMQSYLTPTFPERSTYANAIKKFGELGIEVQITELTISIDDKLSEEEMYEKQAEQYKEVFEIYLKAYHNGINIGSVTVFGLQDGYLFYTNDSTKTRLWDKDLQKKKNYYSILEVLKEY

SEQ ID NO: 83 - protein, 313 aa, Neocallimastix californiae
  (Trans)glycosidases
AYELLKDYSKGFRIGAATNTIHYNNANYVNAMKAFNYMVAENACKFVSIQGTKGKFNFNDCDAHLNKAKQLGMDFRGHALIWHSMAPKWLENEDSNSMKNSIVNHITNVLKHYEGKIDTWDVVNEAIDDSSNGNGWKMRNSFLYQKVPNFIDLSFQTARKVSPKTKLFYNDYNTEGIWGKSESVYQFIADLKKRNIPIDGVGLQYHVSVQHQPQFNKINDLIGRYCKLGVEVHITELDVSCVESCYAGDVEKKQSDVFTNALKACLGNSCCTGFLVWGIGDPDSWLGSDKKGLLFNSNYQPKSQYTAVLNVLK

SEQ ID NO: 84 - protein, 227 aa, Neocallimastix californiae
  (Trans)glycosidases
DIEEVKEYYLDYVAKVLDHYKDEEDIIYWDVINESVTDDSTVDNIKLRYGSDDSNEFKGWDTYTEDIFKVAREHTNKNVKLFYNDYNAENNNGNYNGKTGAVFNYIKSMREKDVPIDGVGLQMHISCNYYPNYDQLYELISQYEEIGVEVHITEIDVSMKSCSTLEDQKKLYMDVFKACFDHSNCKVFTVWGAYDSESWVGAENVPLIFDEDMYPKDIYFDMLDYVM

SEQ ID NO: 85 - protein, 226 aa, Neocallimastix californiae
  (Trans)glycosidases
WLPSQDMTWNYVLGNDIDVNSEKANVVDIDIRKSETKIKNLQKKGIKVICYFSVGTLESFRDDYPQFIAVKGLVQNTYDAWPDERWLDFRVEGIKPLLKNRMKLAVSKNCDAIEVDNLDGYQMKEVKSWPNPLTKKDTIVFAKWLSATAHSLGLSIGLKNVPSLIDELSSYYDFAINEECIKYNECYLYKNFLKTGKAVFGVTYYGLTENKNQLCKNLDGLGISMI

SEQ ID NO: 86 - protein, 299 aa, Neocallimastix californiae
  (Trans)glycosidases
TSNWQPITINGKRLLLKGVNRHDTDPFNGKAIPQATMEMDITLMKTNNINAIRTSHYSNDSYLYWLCNKYGMYVMGETNMESHALMDNNDAKALFYEVGLDRTETAYKRLKNHPSIVAWSIGNEMAYTSNPSDAGGLFRDMIWYFKKNDNSRPVHSEGQGGSMGVDMSSNMYPSSDGIRGNAGKGKMPYVMCEYDHAMGNSVGALKEYWDGIRSADNMLGGFIWDWVDQSRATPLKGGWDYYSESYAKTNLYAEEIKGKFYGYGGDWGDWPNDNSFCVNGLISPDRTPQPELAEVKYQY

SEQ ID NO: 87 - protein, 211 aa, Neocallimastix californiae
  (Trans)glycosidases
DLADILPYWPYQFKGIQSWLNDIGSFIDDKKASGLTNWYGYEIWNEPDGTWKDSNGMNFNEFWKQTYQFIRQKDPNEKIIGPCISWYNENNIRSFLQFAKANNCLPDIISWHELSGIDGMSSHFRSYRNLEKSLGIKELPISINEYCDAEHELEGQPGSSARFIGKFERYKIDTAMITWWFVPQPGRLGSLMATDTQKGAGWYFYKWYGDM

SEQ ID NO: 88 - protein, 131 aa, Neocallimastix californiae
  (Trans)glycosidases
NNFIFPEDDDKVIAAVHAYSPYNFALNNGDGAVDTFDSAGKNELDWNINLMKKRFVDQGIPMILGEYGAMNRDNEEERAKWAEYYMEKVTALGIPQVWWDNGIFEGEGERFGIIDRTSLKIMYPDIVASLQ

SEQ ID NO: 89 - protein, 309 aa, Anaeromyces robustus; identical to SEQ ID NO: 71
  (Trans)glycosidases

SEQ ID NO: 90 - protein, 258 aa, Anaeromyces robustus
  (Trans)glycosidases
MTLVDDLHPYVMRNPPRGKMGDQHPFGNAIEVARRLSRTPGALVSVILTDFLPYWPYQWPGMEKWLELVRQFIRDKKASGLTNWYGYEIWNEAENTWRDSNGYTFLEFWKETYKVIREMDPDEKIIGPCDGLYVESRMRPFLEFCKENDVMPDIMCWHELMGVELIPRRYKAYRELERSLGIKELPITINEYCDIKHELEGQPGSSARFIGKFERYKIESALISWWFNNLPGHLGSLLATDSKKGAGWYFYKWYSEMT

SEQ ID NO: 91 - protein, 319 aa, Anaeromyces robustus
  (Trans)glycosidases
DVIQQVRPDFYFGVATTKSFFANPKYKDIMSTYNLQVGGNECKFYTFQGTETFNTKPCDDSIAFAKKLGAKFRGHNLFWPAYSPSWFKTYSSDIEEVKEYYLDYVAKVLDHYKDEEDIIYWDVINESVTDDSTVDNIKLRYGSDDSNEFKGWDTYTEDIFKVAREHTNKNVKLFYNDYNAENNNGNYNGKTGAVFNYIKSMREKDVPIDGVGLQMHISCNYYPNYDQLYELISQYEEIGVEVHITEIDVSMKSCSTLEDQKKLYMDVFKACFDHSNCKVFTVWGAYDSESWVGAENVPLIFDEDMYPKDIYFDMLDYVM

SEQ ID NO: 92 - protein, 310 aa, Anaeromyces robustus
  (Trans)glycosidases
LRDYANGFRIGAATNTMHYNNQNYVNAMKSFNYMVAENACKLSGIQQQKGVYNFNDCDNHYKKAKELGMDFRGHCLIWHAYQPSWFQNADANTLKNAIVDHITKVLQHYDGKIDAWDVVNEAIDDSSNGNGWKMRNSFLYQKVPNFIDLAFQTARKVAPNVKLFYNDYNTEGVYAKTESVYQFIQDMIKRNIPIDGVGIQYHVAVNQQPSYQKINDLIGRYCKLGLEVHITELDVKCDNVCNSGNVEQQQATVFTNALKACLNNSCCTGYLVWGIGDNDSWLGGDKKGLLFNSQYKPKSQYTAVLNVLKE

SEQ ID NO: 93 - protein, 323 aa, Anaeromyces robustus
  (Trans)glycosidases
RLWSESEDLAKAFVEEMTLDEKINMVTGSQNSFGPCVGYLEPIERLGFKGLCLQDGPAGVRSAKHSTTFPSGLNIASTFDPELMKSLGVALGEEVRAKGVNAILGPAMNMYRSPVGGRNWEGYGEDTYLASVAAKNVVAGITSQGVIATIKHFVGNEQETKRESSNSIIDERVLQEVYFPPFKAAIVSGAGGAMAAYNDLNGIPCANNTWLLNKVLKKQMLFHGFVTSDWWGVKDKYGIMNGLDLNMPGGKEWGPTVKDSYWGEELKEAVESGEIDEMYLDEACIRVMTMLYKYRQFDDYPEINLDADATEGHAEIVRKAAAN

SEQ ID NO: 94 - protein, 322 aa, Anaeromyces robustus
  (Trans)glycosidases
WEEADKKASSFVSDLSEAEKIDIVTGYMNMQGTCVGNIKPNSRKNFKGLCLQDGPAGVRFNEGTSTTWQTGINSAATFNKDLLYKIGKDQGAEFYAKGINVALAPSMNILRAPASGRVWENFGEDPYLSGVCGTQITKGMQDSGVIVSAKHYVANDIEHNREASTSNMDEQTLMEIHVEPFYRTVTEGEAGSVMASYNAVNGVYVVQNKKVLTEILKEGMNFQGFIVSDWWAIHDLEGSFNAGVDMNMPGGKAWGPNYINDSFWGSNISNAIRSGKVSSARLDDAVKRIIRSMYKMNQMGNFPNVNLRAQSMHTETHRQAAT

SEQ ID NO: 95 - protein, 344 aa, Anaeromyces robustus
  (Trans)glycosidases
GYLSTKGRYIVDEKGRKVKLAGISWFGGETTNLSPHGLWAKPLSHFIKIIKDLGYNHIRYPWTNEMLFPGAKTQSVDQLQNPDLADLTPLEVMDAVIDACGKAGIKVYLDRHRPLSGGQSELWYVAKVDEDKWIEDWQFLAKRYKGNPTVIGADLHNEPHGTACWGCGETKRDWRLAAERCGNAIHKVNPDWLIIVEGNDHYGEEGWQKGEGYWWGGMLKGVKENPVRLNTPNKLVYSAHDYDKNVFMQDWFKVSNFPDNMPEIWDDKWGYIAKEDIAPVLIGEFGSLLMDNKDVKWLQNLISYMNKNDVHWTFWCLNPNSGDTEGILGYDWTTVNTKKDNILT

SEQ ID NO: 96 - protein, 211 aa, Anaeromyces robustus; identical to SEQ ID NO: 87
  (Trans)glycosidases

SEQ ID NO: 97 - protein, 307 aa, Anaeromyces robustus
  (Trans)glycosidases
AANGFRIGAATNTIHYSNRNYIEAMKSFNYMVAENACKFVSIQGTKGRYNFDDCDNHLKKAQELKMDFRGHALIWHSMAPQWLEREDSNTMKQSIIDHITTVLKHYEGKIDTWDVVNEAIDDGSNGNGWKLRNSFLYQKVPNFIDIAFQTARKVSPNTKLFYNDYNTEGIWAKSESVYQFVADMKKRNIPIDGVGIQYHVGVNVQPQFDKINNLISRYCKLGVEVHITELDVSCDDNCNDRDGGEGKQSQVYINALKACLNNSCCTGFLVWGIGDSDSWRGAENKPLLFNSNYQPKGQYNAILETLK

SEQ ID NO: 98 - protein, 223 aa, Anaeromyces robustus
  (Trans)glycosidases
LSRTPGALVSVDLADILPYWPYKWPGMQKWLDEVRSFIRDKKASGLTNWYGYEIWNEAENTWRDSNGYNFLEFWKETYKVIREMDPDEKIIGPCDGLYSEERMRPFLQFCKENNVLPDIMCWHELMGVELIPRRQKAYRELERSLGIKELPITINEYCDVEHELEGQPGSSARFIGKFERYNVESALISWWFVPQPGRLGSLLATDSKKGAGWYFYKWYSDMT

SEQ ID NO: 99 - protein, 348 aa, Anaeromyces robustus
  (Trans)glycosidases
AKAAPFRMGVGLNGSDKSSSTVLSKKMCQLIAYQFNSVTYSNLMKAEHMLDKTASQNNAKNGNDMPVLKFDTIIDGLEFCQKNNVKMRGHTLVWHTQTPSWFFRTNFQDNGSFVNASKMEKRMESYIKQMLEFIQYYYPGVVDVWDVVNEAVEITNGSYDSSTGWNTRTKFDGGDNLWYKTMGADYVFKAFRFARKYADKNVKLIYNDYNTFMSQKTNAISNLIKKLKAENLVDGVGLQSYLNADWPNRNDYKSAIQKFSSLGVEIQITELTIKTDGSGNKFNNQATHYQQVFQIYKDLKKSGVNITSVTVFGLQDGYLFYSNDSTDTRLWDHNLKKKPVYNAIMKVL

SEQ ID NO: 100 - protein, 346 aa, Anaeromyces robustus
  (Trans)glycosidases
PIGFLSTKGHLIVDEKGRAVKLAGISWFGGETTNLSPHGLWAKPLSHFIKTIKDLGYNHIRYPWTNEMFKEGAKTESVDSVNNPDLADLTPLEVMDAVIEAAGAAGIKVYLDRHRPLAGGQSELWYIDEVPESQWIEDWQFLAKRYKGNPTVIGADLHNEPHGTACWGCGEEVRDWRLAAERCGNAIHEVNPDWLIIVEGNDHYGEEGWQKGESYWWGGMLKGVKENPVRLKVPNKLVYSAHDYDKNVHLQDWFTTSDFPDNMPEIWDDKWGYIVKEDIAPVLIGEFGSVLRDAVDVKWLTNLVTYMHENGVHWTFWCLNPNSGDTEGILGYDWETVNTKKDGILT

SEQ ID NO: 101 - protein, 302 aa, Anaeromyces robustus
  (Trans)glycosidases
PTLVNPKAIPAAKKLYDFLKTNYGKRILSGQVGAAGQAGDEGEEFKRIINATGKKPAVWNMDFIFESNDCTWRPTNPDITEMALDWWKKYQGKGIMSAQWHWNIAGQTGNFAFYKKDTTFDLEKAVTEGTWEYNKIIKDIDRVSGLIKKLQAVNMPLLWRPLHENNGDWFWWGNNPKACAKLWKILYERMVNYHGLNNLIWLWNGNNDEYTPIEYIDLIGVDIYADDHGPQTTAFNTHFDFYDGKKMVVLSENGRIPDIQKCVAQGAWWGYFQTWNSEFILQDSYHTTAQLKEYFSNKVVMN

SEQ ID NO: 102 - protein, 351 aa, Anaeromyces robustus
  (Trans)glycosidases
LLTLAAASSALALTSQEVVNEMGLGWNLGNTLEAFGDWINGSTVNQFETAWGNPAATKQLITAIKNSGFNSIRIPVAWSNLMSSDYTISSELLKRVNEVVSWVIDSNMYAIINIHYDGGWIEKFGTSESTMANNKFNKIWTQVADYFKNYGEHLIFESLNEEGCWNDVWNRYSNSGDKNKAYSTLNNINQQFVDIVRKSGGNNKSRHLLIAGYCTDIDLTVDSAFKMPTDSANRMMVSVHYYTPSTFTILEKDESWGKFAGTWGTDAEVNALLADFDKLKKRFVDNGVPVIIGEYGTVLTNKDKDSVHKYLFTCAQYATSLGMCPMLWDNGDHFDRKGLKFKDSEVGDFYK

SEQ ID NO: 103 - protein, 300 aa, Anaeromyces robustus
  (Trans)glycosidases
KNQYTGVNESGAEFGQGKYPGEYNKDYIYPDVKAIQASIDQGMNVFRIGFSWERLQRSLNAELDSTEFDRLDEVVSYVTKNGAVAILNPHNFARYNGQIVGTSQVPNSAFADLWKRIAQKYKSNNKVWFGLVNEPHDMPTAQWFSAARDAVDSIRALGANNNVLVPGNAYTGAWNWKETFYGDSNASTALIYFSSSDKNIIFETHQYFDSDYSGTHKECVQRPCNNLFKNFVEWLKANNLKGFIGELGAAINDDCKACVEEAITYLEQNSDYIVGWAWWAAGPWWQDYMYSIEPKGERFP

SEQ ID NO: 104 - protein, 370 aa, Anaeromyces robustus
  (Trans)glycosidases
LSFYKGVDISSIISLENSGVKFYNPLGQEQDLFQILANVGVNCIRVRIWNSPKNANGKTYGGGGNDLEVARAIGSRAARYGLSLFVNFHYSDFWADPSKQTIPKEWKNFDLDKRIFEIYRFTKGCLEWLLENGSIISMVQIGNETTSFMCGEKNMTNVMKMMSNGVKAVRDISKNIVVALHFTNPNKADTMLWYASQLASARVDYDVFATSYYPYWHGTLDNLKGVLNKIANQYGKKVLIAEYSYPYTNAALTDDRCHYELISSSTSNIQLRYPVSIDGQIQSIRDIYKTIKEIKNGIGAFYWEPAWIAPKARNDAERKQIWEKYGSGWASTPAAEYDSDVDRYQTGGTTWDNQAVFTQNGKPLDSLYAL

SEQ ID NO: 105 - protein, 369 aa, Anaeromyces robustus
  (Trans)glycosidases
FEGFGTSFCWWANRLGYSDSLSEKAATLFYDKEKGLGLTVIRYNIGGGDDPTHNHITRTDSNMPGYAINPKYDGRSYTWDYNWNSDSNQRNVLLKSVAKNKDEIIVEAFSNSPPYFMTYSGCSTGNFDPGKDNLRSDAYPAFAKYLADVAEHFKTHWGVYFQSITPTNEPYTNFWGANSYKQEGCHFDQGESESKIIVELRKAIDQKGLKEMQISGTDETSIDTQITSFEKLSNEAKNIITRIDTHTYGGWKRDELRLLAENNHKNLWMSEVDGKGTEGTNAGEMGAAIWLANRIIGDLNGLRASAWVLWQVIDNHISKNGYNGRKDSGMININEGYWGVAVADHDNDNIILTQKYYGFGQFSRYIRPG

SEQ ID NO: 106 - protein, 349 aa, Anaeromyces robustus
  (Trans)glycosidases
FRMGVGLNGGNISNYTPSSKKMMELINYQFNSMTYSNGMKSLFIMDQEKSLKNLAEGKEEVGINFSGVIDGLEFSAKNNLNIRGHVLVWHKQTPEWFWRKDFDETKEYVDRETIFKRLDSFMKNYFDFLNFNYPGVVDVVDVVNEAVEVLEGKYDNSTGWYTRTESYEGDENIWYNLVGPDYVKEAFRIARKYALPTTKLVYNDYDTWRTTPHDKTEAIINLMKILKAEDLVDVIGMESYITPGEPTPEEYGKAIERYAAEGLEIQITEFTIYVTDGDDWLEQQTIHYRDMFKAIMEAYKKGANITSFTVFGLQDGYRFYDSDSTRTRLYDHDLQKKPNFQAIMDILKE

SEQ ID NO: 107 - protein, 323 aa, Anaeromyces robustus
  (Trans)glycosidases
RLWSESEDLAKEFVSQMTLDEKIGMVTGSQNSFGPCIGYLEPIERLGFKGLCLQDGPAGVRSAKHSTTFPSGLNIASTFDVELMHDLGVALGEECRAKGVNVILGPAMNMYRSPAAGRNWEGYGEDTYLASVASKNVVAGIQSQGVLATAKHFVGNEQEYKRDSSNSIIDERVLQEVYLPPFKAAVVSGAGAFMASYNSINGIPATNHTQLLNKVLKKQFLFHGFVTSDWWGTKDKIEITNGLDMNMPGGKVWGPTVKESYWGEELKDAIENEEIDISYLDESCERIMTMLYKYKQMDDFPDLNLDADATEGHTELVRKAAAA

SEQ ID NO: 108 - protein, 205 aa, Anaeromyces robustus
  (Trans)glycosidases
LPGWPYQFKSMQHWKDEIKSFVNDKKASGLTNWYGYEIWNEPDGTWKDPNGLNFNEFWKQTYQYLRQIDPNEKIIGPALSWYNEDRIRSFLQYAKANNCLPDIICWHELSGIDNMSAHFRSYRNLEKSLGIKELPISINEYCDAEHSLEGQPGSSARFIGKFERYKIDSAMITWWFVPLPGRLGSLMASDTQKGAGWYLYKWYGD

SEQ ID NO: 109 - protein, 311 aa, Anaeromyces robustus
  (Trans)glycosidases
MHFKLNHLLLVLGFVNISLALTTKEFMKSIGMGVNIGHTFDTIRDWSNIDISEINSDFKLWTDSEVKIKEAVEGYKNLGFHSIRIPVKWSTRPTTKTPIEPKLLKAVEEVVRVAIENDMYVIINLETDNFYMNGFISEDKAILTETYDSYKGTWKQIANYFKDYDEHLMFEALNESGYWETIWNTRTADGDRPEALAVLLKVNQEFINTVRSIEGYNQERYLLIEGYACDPILTQDHFYKTPSDPKSSGKLIVSLYYFIPYTFTVIEKYGIWGSSYDVHQLQEVVDDLRYRFVIQGVPVIFTRYGTNIRNR

SEQ ID NO: 110 - protein, 307 aa, Anaeromyces robustus
  (Trans)glycosidases
NHERVDLALEAYAKHNLNVVRAWAFCDECEDATRLVDFSGPEVKLNSENMEKVDYYLAAAAQRNIRVVLTLTNNWTDYGGMDVWVKQFGGKYHDEFYTNRKLIEGYKQYIKAMINRVNTYTGQRYKDDPTIFSWQLANEARCNNGPHGLPVKDCNTDTITKWMDEIATFIHEEDPNHLVSSGIEGIGLTPPAGVDPNTYVYTYVEGTDYEAISALDSIDYNTVHMYPVGWGLKDYAKDGVKWIQAHADVDKKFNKPTVVEEWGLSTSADNVPLEERDPIYTQWMDAVLANDNIGMNMFWYVCGEDYY

SEQ ID NO: 111 - protein, 207 aa, Anaeromyces robustus
  (Trans)glycosidases
ILPNWPYRWPGLQKWLDEVKSFINDKKKSGLTNWYGYEIWNEPDGTWKDADGINFNELWRQTYQVMRQNDPNEKIIGPCDSWYNENRMRSFLQYAKTNNCLPDIMCWHELSGIENVSNHLKAYRNLEKSLGIKELPITINEYCDAKHEWEGQPGSSARFIGKFERYKVDSALISWWFVPHPGRLGSLLATDTQKGAGWYFYKWYGDM

SEQ ID NO: 112 - protein, 310 aa, Anaeromyces robustus
  (Trans)glycosidases
KLQYVGVNEAGGEFGENNLPGIYNKHYIYPNIESIRASVEQGMNVFRMGLRWERFQHELFGEFSEFDVTEYKKVVDATTSMGAVLIIDPHNYARYNDNIVGSKEVPIEAFADFWAKLANIFKDNEKVWFGLVNEPHDMETDDWFKAARAAVDAIRATGATNNILIPGNGWDGAWSWGKEAWYGEANADVALRYFSSEDKNIIFEVHQYFDEDYSGTHDTCIQRPCQNLLKEFVEWLKTNNLKGWVGEIGGTLNDECKECVHELIEYLQENRDYVLGLQWWAAGPWWGHNSYSIEPNSEKAFPGQMAWLKP

SEQ ID NO: 113 - protein, 253 aa, Anaeromyces robustus
  (Trans)glycosidases
FEGFGTSFCWWANRLGYSDSLAEKAATLFYDKVNGLGLTVIRYNIGGGDDPTHHHITRTDSNMPGYAINPRYDGRSYTWDYNWNSDANQRNVLLKSVAKNRDEIIVEAFSNSPPYFMTNSGCSTGNFDANKDNLKSDAYPAFAKYLADVAEHFKTSWGVGFQSITPVNEPFTNYWGANSKKQEGCHFDQGNSESKIIVELKKAIDQRGLRDMQISGTDETSIDTQITSFQKLSNEAKNIITRIDTHTYGGSKR

SEQ ID NO: 114 - protein, 344 aa, Anaeromyces robustus
  (Trans)glycosidases
GFLSTKGRSIVDQNGRKIKLAGISWFGGETNNLSPHGLWAKPLDHFIKTIKDLGYNHIRYPWTNEMLTPGAKTNSIDSTSNPDLVNLTPLEVMDAVINACGKVGLKVYLDRHRPQSGGQSELWYIPEVDESKWIEDWQFLAKRYKGNPTVIGADIHNEPHGEACWGCGESKRDWKAAAERCGNAIHQVNPDWLIIVEGNDHYGEEGWQKGESYWWGGMLKGVKENPIKLNKPNKLVYSAHDYDKNVHMQDWFKESNFPDNMPTIWDDKWGFIAKQNIAPVLIGEFGSLLKDATDSKWLQNLVTYMTKNEIHWTFWCLNPNSGDTEGILGYDWETVDTKKDGLLT

SEQ ID NO: 115 - protein, 242 aa, Anaeromyces robustus
  (Trans)glycosidases
DSKKIVGYFSEWRNSNYPISRVDLSKITHLNYAFGLIDPSTYAVTGYESWILTQVVEAAHKQGVKVLMSIGGWYGSRYFTKMTSSKSNMERFADSCKNLIDTYKIDGIDIDWEYPGREGACNTPDLANDTDNYLTLLEILRKKIGNDSLITAAVSAIPFEKNGQPVSNLSAYAKYFDFINLMAYDFAGSWSSVTSHHSGLYDPEAGDKLSVSTGVKNWLNAQFPASKIVVGVPAYGKSWIAA

SEQ ID NO: 116 - protein, 54 aa, Anaeromyces robustus
  (Trans)glycosidases
KAKYVLSNNFAGMMVWELENDTEDFEILSAINKHLGCDGSFNGDSNKPTTTTTK

SEQ ID NO: 117 - protein, 236 aa, Anaeromyces robustus
  (Trans)glycosidases
SKSIIVYYPEWKYYDFPPKDIPFSKLTHINYAFAEINPDDFSLEYDSNKFLELIDTAHKKNKSIKVLMSIGGWTGSRYFSKMASSSSNRTKFVKSVKRMIDASNADGIDIDWEYPGSSGAYDDNYDSENDTNNLLKLLKELRETIGTSKLITAAVPFNTFEVDHKPLSDMTEFAKLFDFINIMAYDFSGSWSSVTAHQSALYSTHEDDSGYSLSGAVKNWMNANFPAKKIVVGIPA

SEQ ID NO: 118 - protein, 32 aa, Anaeromyces robustus
  (Trans)glycosidases
DDPKSVGLKADYVIENNLGGMMMWEIEEDSKD

SEQ ID NO: 119 - protein, 61 aa, Anaeromyces robustus
  (Trans)glycosidases
FVGEIGAAINDKCKACVEETLNYLEENSDNIVGWAWWAAGPWWGNYMYSLEPKGKAFPEQM

SEQ ID NO: 120 - protein, 212 aa, Piromyces finnis
  (Trans)glycosidases
WTQVSSYFKDFDEHLIFESLNEEGCWNDVWNRWSNAGDKNKAYGTLNNLNQQFVDIVRNSGGNNKNRHLLLAGYCTDIDLTVDSAFKIPSDSSNRLMVSVHYYTPSTFTILEKDEDWGKFAGSWGTDAEVKALIADFDKLKKRFVDNGIPVIIGEYGTVLTNKNKDSVHKYLFTCAQYATSLGMCPMLWDNGDHFDRKGLKFKDSEIGDFYK

SEQ ID NO: 121 - protein, 224 aa, Piromyces finnis
  (Trans)glycosidases
QGIKWNYVLGSDINENTETANVVDIDIRKDQSKIDNLHKRGIKVICYFSGGTLEYFREDYKDFLNVPNLVQNRYEAWPDEDWLDIRVEGLKPLLKKRIKLAVSKKCDAIEVDNLDGYQMAEVKSWRNPLTKSDTIKFAKWLANTAHNYDISIGLKNVPGLIDELSSYFDFAINEDCVVYNECRLYKNFLAKGKAVFGVTYNGIEANRSALCRNLNGLNISMIVK

SEQ ID NO: 122 - protein, 348 aa, Piromyces finnis
  (Trans)glycosidases
FRFGVGLYGNDLAMSTITSEKMRKVIKYQFNSMTYTNLMNPSAILDQQASIDNIMNGNEDPILNFSNIVDGLDFAYKNGLNIRGHALVWHTQVPEWFFRDGYYSNTEFVSRDVMEYRLDSYIRKFLGFVQFNYPGTVDVWDVVNEAIEITDGQYDETTGWYTRTANNKTPNPWYEIFGPDYVAIAFRIARKYALPNVKLIYNDHNTFQIQPHDKTQAIIDLANILQQENLIDGIGMQSYIGVTWPNLDDYFNGLERLITSTGLEIQITELTITPPIGDNWLGAQAEQYYEYFNRLLSYIKNGYNISSVTVYGLQDGYRFYTKDSTKTRLLDHDLKKKPNFNAIINVLK

SEQ ID NO: 123 - protein, 302 aa, Piromyces finnis
  (Trans)glycosidases
VTTKNWQPITINGKRLLLKGVNRHDTDPFNGKAIPQETMREDITLMKKNNINAIRTSHYSNDSYLYWLCNKYGMYVMGETNMESHALMDNNDGKALFYELGLDRTETAYKRLKNNPSIVAWSIGNEMAYTGNPSDAGGLFRDMIWYYKKNDNTRPVHSEGQGGGMGVDMSSNMYPSSDGIRGNAGKGKMPYVMCEYDHAMGNSVGALKEYWDAIRSADNMLGGFIWDWVDQSRAVPIKSGGWDYYSESYAKTNLYSSEIKGKFYGYGGDWGDRPNDNSFCVNGLINPDRTPQPELAEVKFQY

SEQ ID NO: 124 - protein, 301 aa, Piromyces finnis
  (Trans)glycosidases
SLVNPKAIPAARKLYDFLKSNYGKRILSGQVGAAGKAGDEGQEFQRIKNASGKLPAVWNMDFIFESNDCTWRPENPDITEMAINWWKKYEGKGIMAAQWHWNIAGKTGNFAFYSKDTTFSLENAVTKGTWEYEKIIKDIDRVSGHIKKLQAVNMPLIWRPLHENNGDWFWWGNNPKACAKLWKILYERMVNYHGLNNLIWLWNGNNDEYTPVDYIDIIGVDIYANDHGPQTTAFNTHFDFYGGKKMVVLSENGRIPDIQQCVDQDAWWGYFQTWNSEFILQESYHTNAQLKEYFNHEIVMN

SEQ ID NO: 125 - protein, 193 aa, Piromyces finnis
  (Trans)glycosidases
LNEPRKVGDPVEWTGDQEGYNFVNEMNEVFIKTIRSTGGNNALRHLMIPPYAAGVMDASLNTFRVPRDDDKIIVSLHSYSPYNFALNNGSGAISNFYDGSEIDYVMNTIHQRYISQNIPVIIGEFGAMNRDNEVDRARWAEYYIKKATSIGVPCVLWDNAYYEGKGERFGAINRTTLEVVFPDYINGLMKGLG

SEQ ID NO: 126 - protein, 185 aa, Piromyces finnis
  (Trans)glycosidases
NGAAVSTSTTSSKVMRELVKYQFNSFSYSNLMKPLFVLDQAGCQKNFKNGSNEIALNFTPFVDGLDYAQKNGLHIRGHVLVWHKQFPDWFFREEFDDAKEYVSEEVIYERLENYIKQYLGFVNYNYPGVVDVWDVVNEAVEVLEGKFDNSTGWYTRTITYEGDRNIWYDFVGPDYVVKTFRIARK

SEQ ID NO: 127 - protein, 336 aa, Piromyces finnis
  (Trans)glycosidases
GYVYTEGTNFYIDGYKIYFSGTNTYYLHSSQNERVDLALEVSAKHNIQVVRAWAFCDLKVCGDKQFVKFENGKAVFLEDNMEAIDYFIAAASQRNIRLVLGFTNNWTDYGGMDEWVKGYGGKYHDDFYTNTDIRKAFKSYIKLLITRINRHTNIRYSDDPTIFSWQLANEPRCGNGPSGLPQSGKCTPEVITEWANDISSYIKELDPNHLVSVGCEGFGLEAPEGSKGLYAYKYDEGTDFEALTALPNIDYNTYHYYPIPWGMKDLVSHTKDWIESHQAVGKKLNKPVVFEEWGLEIPTDCSKEERIQYYKTWTKQILDADVPMNMFWYTVGEDYY

SEQ ID NO: 128 - protein, 337 aa, Piromyces finnis
  (Trans)glycosidases
GFVQTDGTNFVVDGCKRYFSGSNTYYLMVSNHERVDLALETYARHNLNVVRAWAFCDECEDATRLVDFSGPEVTLNSENMEKVDYYLAAAAQRNIRVVLTLTNNWTDYGGMDVWVKQFGGKYHDEFYTNRDIVNGYKQYIKAMINRVNTYTGQYYKDDPTIFSWQLANEARCNNGPHGLPVKNCNTDTITKWMDEIASFIHEEDPNHLVSSGIEGIGLTPPAGVDPNTYVYSYIEGTDYEAISALDSIDYNTVHMYPVGWGLKDYTKDGMKWIQAHADVDKKFNKPTVVEEWGLSTSADNVPLEERDPIYTKWMETVLENDNIGMNMFWYVCGEDYY

SEQ ID NO: 129 - protein, 342 aa, Piromyces finnis
  (Trans)glycosidases
GYLSTKGKYIVDEKGRKVILGGLSWFGGETTNLSPHGLWANSLENFIKIVKDHGYNHLRYPWTNEMLFPGAETQSVDQVNNPDLANLSPLEVMDAVIDACGKAGLKVYLDRHRPLSGGQSELWYIPEVPEEQWIEDWQFLAKRYKGNPTVIGADLHNEPHSSACWGCGEIERDWRLAAERCGNAIHEVNPDWLIIVEGNDHYGEEGWQKGESYWWGGMLKGAKEFPVRLNVPNKLVYSAHDYDKNVHMQDWFKEPDFPDNMEPIWDDKWGYLVKENTAPVLISEFGSLLRDATDIKWLGNLVSYMKENDVHWTFWCLNPNSGDTEGILGYDWKTVNAQKDGL

SEQ ID NO: 130 - protein, 323 aa, Piromyces finnis
  (Trans)glycosidases
RLWSESEDLAKAFVEEMTLDEKINMVTGSENSFGPCVGYIPPIERLGFKGLCLQDGPAGVRSAKHSTTFPSGLNIASTFDQNLMKKLGVALGEECRAKGVNVILGPAMNMYRSPAAGRNWEGYGEDTFLATVASKNVVAGIQSQGVFATAKHFAGNEQEYKRESSNSIIDERVLQEVYFPPFKAAVVSGAGAFMSAYNDLNGIPSANNTYLLNQVLKKQFKFHGFVTSDWWGTKDKYEITNGLDVNMPGGKQWGPTEKESYWGEELKAAIESEEIDISYLDEACERILTMMYKYKQMDDFPELNLDADGTEGHTELVREAAAA

SEQ ID NO: 131 - protein, 323 aa, Piromyces finnis; identical to SEQ ID NO: 130
  (Trans)glycosidases

SEQ ID NO: 132 - protein, 351 aa, Piromyces finnis
  (Trans)glycosidases
LLTLAAASSALALTSQQVIGEMGLGWNLGNTLEAFGDWINGSTVNQFETAWGNPAATEQLIGAIKDNGFNSIRIPVAWSNLMSSDYTINSNLLKRVKEVVSWVTNKNMYAIINIHYDGGWFEQFGTSQSTQANQKFNKIWTQVSSYFKDFDEHLIFESLNEEGCWNDVWNRWSNAGDKNKAYGTLNNLNQQFVDIVRNSGGNNKNRHLLLAGYCTDIDLTVDSAFKIPSDSSNRLMVSVHYYTPSTFTILEKDEDWGKFAGSWGTDAEVKALIADFDKLKKRFVDNGIPVIIGEYGTVLTNKNKDSVHKYLFTCAQYATSLGMCPMLWDNGDHFDRKGLKFKDSEIGDFYK

SEQ ID NO: 133 - protein, 339 aa, Piromyces finnis
  (Trans)glycosidases
ISSLELIKEMRFGWNLGNTLEAFGDWINGSTVNQFETAWGNPAATEQLIGAIKDNGFNSIRIPVAWSNLMSSDYTINSNLLKRVKEVVSWVTNKNMYAIINIHYDGGWFEQFGTSQSTQANQKFNKIWTQVSSYFKDFDEHLIFESLNEEGCWNDVWNRWSNAGDKNKAYGTLNNLNQQFVDIVRNSGGNNKNRHLLLAGYCTDIDLTVDSAFKIPSDSSNRLMVSVHYYTPSTFTILEKDEDWGKFAGSWGTDAEVKALIADFDKLKKRFVDNGIPVIIGEYGTVLTNKNKDSVHKYLFTCAQYATSLGMCPMLWDNGDHFDRKGLKFKDSEIGDFYK

SEQ ID NO: 134 - protein, 340 aa, Piromyces finnis
  (Trans)glycosidases
ISSLELIKEMRFGWNLGNTLDAECTSWMDYEKNPIGSETCWGNVKTNEDIFKTLMDNQFNVFRIPTTWTGHIGEAPEYKINEQWMKRVHEIVDYPYKNGAFVILNIHHETWNHAFAETVDEAKVELAQVWKQIAEEFKGYGERLIFEGQNEPRKNGTPVEWNGGDKEGWDVVNAMNAVFLETVRSSGGNNAKRHLMIPPYAAACNENSFKNFDFPEDDDKVIASVHAYSPYNFALNNGEGAVDKFDASGKNELDWNINLMKKRFVDQGIPMILGEYGAMNRDNEEERAAWAEYYMEKITALGVPQVWWDNGVFEGEGERFGLIDRKNLKIVYPSIVAALQ

SEQ ID NO: 135 - protein, 340 aa, Piromyces finnis
  (Trans)glycosidases
ISSIELIKEMRFGWNLGNTLDAECTSWMDYEKNPIGSETCWGNVKTNEDIFKTLMDNQFNVFRIPTTWTGHIGEAPEYKINEQWMKRVHEIVDYPYKNGAFVILNIHHETWNHAFAETVDEAKVELAQVWKQIAEEFKGYGERLIFEGQNEPRKNGTPVEWNGGDKEGWDVVNAMNAVFLETVRSSGGNNAKRHLMIPPYAAACNENSFKNFDFPEDDDKVIASVHAYSPYNFALNNGEGAVDKFDASGKNELDWNINLMKKRFVDQGIPMILGEYGAMNRDNEEERAAWAEYYMEKITALGVPQVWWDNGVFEGEGERFGLIDRKNLKIVYPSIVAALQ

SEQ ID NO: 136 - protein, 339 aa, Piromyces finnis
  (Trans)glycosidases
ISSIELIKEMRFGWNLGNTLEAFGDWINGSTVNQFETAWGNPAATEQLIGAIKDNGFNSIRIPVAWSNLMSSDYTINSNLLKRVKEVVSWVTNKNMYAIINIHYDGGWFEQFGTSQSTQANQKFNKIWTQVSSYFKDFDEHLIFESLNEEGCWNDVWNRWSNAGDKNKAYGTLNNLNQQFVDIVRNSGGNNKNRHLLLAGYCTDIDLTVDSAFKIPSDSSNRLMVSVHYYTPSTFTILEKDEDWGKFAGSWGTDAEVKALIADFDKLKKRFVDNGIPVIIGEYGTVLTNKNKDSVHKYLFTCAQYATSLGMCPMLWDNGDHFDRKGLKFKDSEIGDFYK

SEQ ID NO: 137 - protein, 211 aa, Piromyces finnis
  (Trans)glycosidases
DLADILPYWPYKWPGMQSWANEVKSFIADKKKSGLTNWYGLEIWNEPDGTWKDSNGLNFNEFWKQTYQVIRQNDPNEKIIGPCDSWYNESRMRSFLQFCKTNNVIPDIMCWHELSGIENVSNHIKAYRELEKSLGIKELPISINEYCDAEHELEGQPGSSARFIGKFERYKIDSAMISWWFVPKPGRLGSLLATDTQKGAGWYFYKWYGDM

SEQ ID NO: 138 - protein, 207 aa, Piromyces finnis
  (Trans)glycosidases
LPGWPYKFPGLQTWLNEVKSFVNDKKASGLKNWYGLEIWNEPDGTWKDSTNGLSFNDLWKETYKLLRQLDPNEKIIGPCNSFYHEDRIRSFLQFAKQNNCLPDIMCWHELSGIDYVSSHFRAYRNMEKSLGIKELPITINEYCDAEHELEGQPGSSARFIGKFERYKIDSGLITWWFTAHPGRLGSLLATDTQKGAGWYFYKWYGDM

SEQ ID NO: 139 - protein, 207 aa, Piromyces finnis
  (Trans)glycosidases
LPGWPYKFPGLQTWLNEVKSFVNDKKASGLKNWYGLEIWNEPDGTWKDSTNGLSFNDLWKETYKLLRQLDPNEKIIGPCNSFYHEDRIRSFLQFAKQNNCLPDIMCWHELSGIDYVSSHFRAYRNMEKSLGIKELPITINEYCDAEHELEGQPGSSARFIGKFERYKIDSGLITWWFTAHPGRLGSLLATDTQKGAGWFFYKWYGDM

SEQ ID NO: 140 - protein, 133 aa, Piromyces finnis
  (Trans)glycosidases
GYCTDIDLTIDEAYVVPKDDRVMVSVHYYTPSTFTILEEDADWGKAQPTWGSESEVEYLLNDFKKIKTRFVDNGIPVVIGEYGTVTKNKDINSVHKFLKTVAETSLNSGMCPFLWDNGEHFNRKTLVFRDEAI

SEQ ID NO: 141 - protein, 271 aa, Piromyces finnis
  (Trans)glycosidases
AWSNLMLDNYIINPLLLSRVKEVVDYIVNNDMYAIVNIHWDMGWFTKFATNEKEAFKKYTSIWGQISQYFKDYDEHLVFESLNEEGCWDEIWNQWSNQGDKKKAFNLLNNINQEFVDIFRNSSENNAKRHLLLAGYCTSLDLTSDELYVIPKDDRVMISVHYYGPSTFTILEEDADWGKAAYSWGTEKEINYLVDELKKIKKNFIDKGIPIIVGEYGTAITNKEPASVIRWLKTVAKTTSSFGMVPCLWDAGQYFDREKLVFKNPAIGELF

SEQ ID NO: 142 - protein, 37 aa, Piromyces finnis
  (Trans)glycosidases
SYDDPESIGYKAKFVLENGFAGMMVWELENDTDDFEI

SEQ ID NO: 143 - protein, 33 aa, Piromyces finnis
  (Trans)glycosidases
YDDPESIGYKAKFVLENGFAGMMVWELENDTDD

SEQ ID NO: 144 - protein, 11 aa, Piromyces finnis
  (Trans)glycosidases
IRNEILLSSYN

SEQ ID NO: 145 - protein, 32 aa, Piromyces finnis
  (Trans)glycosidases
DDPESIGYKAKFVLENGFAGMMVWELENDTDD

SEQ ID NO: 146 - protein, 227 aa, Piromyces finnis
  (Trans)glycosidases
YFSEWRYSSYPVSRIDFSKFTHLNYAFAVIDPNTYALTGYEGWILNEVVTAAHNQDVKVLMSVGGWYGSRYFTKMTSSENNMKKFAESCKNLIDTYHIDGIDIDWEYPGREGACNNPDYANDTDNYLKLLKILREYIGNENIISAAVSITPFEKNGQPITNLAPYAEYFDFINIMGYDFAGSWSSVTSHHAALYDPEAGDILSISSGVNNWLNGQFPADKIVIGVPT

SEQ ID NO: 147 - protein, 311 aa, Piromyces finnis
  (Trans)glycosidases
KKLQYLGVNESSGEFGEGNLPGVYNKHYIYPDVKAIETTIEQGMNAFRICNRWERLQHELFGEFNEFDITEFKKVVDATTAKGAIAIIDPHNYARYNNKLIGSEDVPIEAFVDFWTRLAEIFKDNENVWFGLVNEPHDMETDDWFKAARAAVDGIRSTGAKNNILIPGNGWTGAWSWGKEAWYGEANADVALRYFSSEDENILFEVHQYFDKDYSGTGDQCVQRPCQNLFKEFVEWLKTNNLKGWIGEIGSYLTDECRECVQESIEYLQENNEYVLGTLWWAAGPWWGHNAMSIEPNAEKAFPGQMAWLKP

SEQ ID NO: 148 - protein, 311 aa, Piromyces finnis; identical to SEQ ID NO: 147
  (Trans)glycosidases

SEQ ID NO: 149 - protein, 319 aa, Piromyces finnis
  (Trans)glycosidases
DVIQQVRPDFYYGVATTKSFFSNPKYKDIISTYNLHTGGNECKFYTIQGTQTFNTKQCDDSIAFAKKFGAKFRGHNLFWPANSPDWFKNYSDDIEEVKAYYLDYVAKVLDHYKDEEDIIYWDVVNESVTDDSTIDKYKLRYGSDRSNEFKGWDTYTEDIFTLAREHTNPNVKLIYNDYNAENNNGNFNGKTGAVYKYIKEMKEKGIPIDGVGLQMHISCNYTPNYEQLTELIDMYKEIGVEVHVTEIDVSMKNCKTHDQQRKLYMDVFRACFDNENCKVFTVWGAYDTESWIGASNVPLPFDDDMYPKDIYFDMLEYVM

SEQ ID NO: 150 - protein, 308 aa, Piromyces finnis
  (Trans)glycosidases
DYAKDFRIGVAANTMRFNNQAYNEALKAFNYMVAENGCKLSGIQQRQGNYDFSDCDNHYKKAKELGMAFRGHALIWHAYMPSWFENANASTLKNAIVEHVTKVLQHYEGKIDTWDVVNEAIDDSSNGNGWKMRNSFLYQKVPNFVDLAFETARKVSPNTKLFYNDYNTEGIYGKTESVFQFVKDMKSRGIPIDGVGIQYHVSVDSQPQYNKIDDLISRYCGLGLEVHITELDVKCGSQCSSSNVESKQATVFTNALKACLNNSCCTGYLVWGVGDSDSWLGANEKGLLFNSNYQPKSQYTAVLNVLKE

SEQ ID NO: 151 - protein, 308 aa, Piromyces finnis; identical to SEQ ID NO: 150
  (Trans)glycosidases

SEQ ID NO: 152 - protein, 67 aa, Piromyces finnis
  (Trans)glycosidases
SNVESKQATVFTNALKACLNNSCCTGYLVWGVGDSDSWLGANEKGLLFNSNYQPKSQYTAVLNVLKE

SEQ ID NO: 153 - protein, 67 aa, Piromyces finnis; identical to SEQ ID NO: 152
  (Trans)glycosidases

SEQ ID NO: 154 - protein, 66 aa, Piromyces finnis
  (Trans)glycosidases
NVESKQATVFTNALKACLNNSCCTGYLVWGVGDSDSWLGANEKGLLFNSNYQPKSQYTAVLNVLKE

SEQ ID NO: 155 - protein, 301 aa, Piromyces finnis; identical to SEQ ID NO: 124
  (Trans)glycosidases

SEQ ID NO: 156 - protein, 184 aa, Piromyces finnis
  1-PHOSPHATIDYLINOSITOL PHOSPHODIESTERASE-RELATED PROTEIN
NTRINQINIPGTHDSGTYAVDWHSFPIINGFRRQWGRTQSLDIYQQLMHGIRYLDIRLETNPKKQIYLTHDKFDCINKKTNDLYYLSNVFDEAINFLHYNPSETVIMHLKCDNCHFHKYNKDGSMKEKGDLKEEEFYEAIANLSINNSDRPYEKFYKDYFYQDNKSNELFPTLGKARGTIIIYT

SEQ ID NO: 157 - protein, 193 aa, Piromyces finnis
  1-PHOSPHATIDYLINOSITOL PHOSPHODIESTERASE-RELATED PROTEIN
SNWMSKYLNNTRINQINIPGTHDSGTYAVDWHSFPIINGFRRQWGRTQSLDIYQQLMHGIRYLDIRLETNPKKQIYLTHDKFDCINKKTNDLYYLSNVFDEAINFLHYNPSETVIMHLKCDNCHFHKYNKDGSMKEKGDLKEEEFYEAIANLSINNSDRPYEKFYKDYFYQDNKSNELFPTLGKARGTIIIYT

SEQ ID NO: 158 - protein, 123 aa, Neocallimastix californiae
  4-PPantetheinyl_Trfase_SF
GIGVDIELVTEVPITNENFLERNFTKEEIKYCMSRPDPQSSFAGRWSAKEAVIKAVSSRATSKVWTKGEAAPLIDIEILPGESGAPVVKFYNDAEKAVKDAGINNVKVTISHSGGFSCAMAMA

SEQ ID NO: 159 - protein, 122 aa, Neocallimastix californiae
  4-PPantetheinyl_Trfase_SF
GIGVDIELVTEIPINNENFIERNFTKEEIKYCMSRPDPQSSFAGRWSAKEAVVKAVSSHSSSKVWTKGEAAPLIDIEILPGESGAPVVQFHNDAEKAVKEAGVKSVNVTISHSGGFSCAMAT

SEQ ID NO: 160 - protein, 122 aa, Anaeromyces robustus
  4-PPantetheinyl_Trfase_SF
GVGIDIALISELNVDNEGFIERNFTNNEIQYCEAKPDRRSSFAGKWAAKEAVIKAISSYSLEAQKIWEGAGAPLKDIEVVIAESGAPKVLLSPTLNEKVKSVGVNDVKVTISHSGQFAVAMA

SEQ ID NO: 161 - protein, 122 aa, Anaeromyces robustus
  4-PPantetheinyl_Trfase_SF
GIGVDVELVSEIPITNETFLERNFTKDEITYCMSRPDPQSSFAGRWSAKEAVIKAVSSRATSKVWTKGEAAPLVDIEILPGESGAPVVKFHNDAEKAVKDAGIKDVKVTISHSGGFSCAMAI

SEQ ID NO: 162 - protein, 123 aa, Piromyces finnis
  4-PPantetheinyl_Trfase_SF
GIGVDVELVTEIPISNQNFLERNFTPKEIEYCMSRPDPQSSFAGRWSAKEAVIKAVSSRSTSKVWTKGEAAPLVDIEILPGESGAPVVEFHGDAEKAVKEAGINSVKVTISHSGGFSCAMAMA

SEQ ID NO: 163 - protein, 122 aa, Piromyces finnis
  4-PPantetheinyl_Trfase_SF
GVGVDVALISEINIENESFVERNFTSTEINYCKSKPDARSSFAGRWAAKEAVIKAISSYSLEAQKIWEGAGAPLKDIEVVMAESGAPKVLLSQELKDKIKSVGVNDVKVTISHSGQFAIAMA

SEQ ID NO: 164 - protein, 123 aa, Piromyces finnis; identical to SEQ ID NO: 162
  4-PPantetheinyl_Trfase_SF

SEQ ID NO: 165 - protein, 122 aa, Piromyces finnis; identical to SEQ ID NO: 163
  4-PPantetheinyl_Trfase_SF

SEQ ID NO: 166 - protein, 122 aa, Neocallimastix californiae
  4'-phosphopantetheinyl transferase
GIGVDIELVTEVPITNENFLERNFTKEEIKYCMSRPDPQSSFAGRWSAKEAVIKAVSSRATSKVWTKGEAAPLIDIEILPGESGAPVVKFYNDAEKAVKDAGINNVKVTISHSGGFSCAMAM

SEQ ID NO: 167 - protein, 121 aa, Neocallimastix californiae
  4'-phosphopantetheinyl transferase
GIGVDIELVTEIPINNENFIERNFTKEEIKYCMSRPDPQSSFAGRWSAKEAVVKAVSSHSSSKVWTKGEAAPLIDIEILPGESGAPVVQFHNDAEKAVKEAGVKSVNVTISHSGGFSCAMA

SEQ ID NO: 168 - protein, 126 aa, Anaeromyces robustus
  4'-phosphopantetheinyl transferase
MGNGVGIDIALISELNVDNEGFIERNFTNNEIQYCEAKPDRRSSFAGKWAAKEAVIKAISSYSLEAQKIWEGAGAPLKDIEVVIAESGAPKVLLSPTLNEKVKSVGVNDVKVTISHSGQFAVAMAY

SEQ ID NO: 169 - protein, 121 aa, Anaeromyces robustus
  4'-phosphopantetheinyl transferase
GIGVDVELVSEIPITNETFLERNFTKDEITYCMSRPDPQSSFAGRWSAKEAVIKAVSSRATSKVWTKGEAAPLVDIEILPGESGAPVVKFHNDAEKAVKDAGIKDVKVTISHSGGFSCAMA

SEQ ID NO: 170 - protein, 122 aa, Piromyces finnis
  4'-phosphopantetheinyl transferase
GIGVDVELVTEIPISNQNFLERNFTPKEIEYCMSRPDPQSSFAGRWSAKEAVIKAVSSRSTSKVWTKGEAAPLVDIEILPGESGAPVVEFHGDAEKAVKEAGINSVKVTISHSGGFSCAMAM

SEQ ID NO: 171 - protein, 123 aa, Piromyces finnis
  4'-phosphopantetheinyl transferase
GVGVDVALISEINIENESFVERNFTSTEINYCKSKPDARSSFAGRWAAKEAVIKAISSYSLEAQKIWEGAGAPLKDIEVVMAESGAPKVLLSQELKDKIKSVGVNDVKVTISHSGQFAIAMAY

SEQ ID NO: 172 - protein, 122 aa, Piromyces finnis; identical to SEQ ID NO: 170
  4'-phosphopantetheinyl transferase

SEQ ID NO: 173 - protein, 123 aa, Piromyces finnis; identical to SEQ ID NO: 171
  4'-phosphopantetheinyl transferase

SEQ ID NO: 174 - protein, 68 aa, Neocallimastix californiae
  6-blade_b-propeller_TolB-like
KIYDFDESSIFDGSQATDITFNKDGSVTYVANAAGSGGGIVFYIKKDKSVINLSNYDSVDIELVFSPV

SEQ ID NO: 175 - protein, 15 aa, Neocallimastix californiae
  6hp_glycosidase
KELQQAYGTWDIYAM

SEQ ID NO: 176 - protein, 88 aa, Neocallimastix californiae
  6hp_glycosidase
AADEYAQRAIEHYNVVTGNGSYSSEYFSPENVPYHSIETMMVEAPDHGHESVSETYSFWVWLEAVNGKLTGNYDGVETAWSYLEKHLI

SEQ ID NO: 177 - protein, 19 aa, Neocallimastix californiae
  6hp_glycosidase
TYHRFWGQTEIMVANGLIS

SEQ ID NO: 178 - protein, 315 aa, Neocallimastix californiae
  6hp_glycosidase
APDADARAIQAAYFGYIWAEEDGQDLSSVASKAAKLGDYLRYSHYDKYFKKIGNCIDYQRCAAGSGKNSAHYLISWYFAWGGGLQGDWAWRISSSHTHSGYQNPLAAWILSTESAFKPKGSTAVKDWSTSLDRQLELFRWLQSAEGCIAGGATNSWQGHYAQPPSDITTFYGMYYDWQPVYHDPPSNNWTGMQGWGMERVCSLYYLSGNEKAGKVCQEWAKWIKANTRVNGGEVVHATNLEWTGNPDEWKSSNFNKNGLNASLHGTVSSEGTDLGSIASMIKALMWVSLKDGDTEGLQLVLDVMDAIENYKDDLG

SEQ ID NO: 179 - protein, 19 aa, Neocallimastix californiae
  6hp_glycosidase
TYHRFWGQTEIMVANGLIS

SEQ ID NO: 180 - protein, 88 aa, Neocallimastix californiae
  6hp_glycosidase
RAADYAERAIEHYNKVTGNGSYQSEYFSPENVPYHSIETMMVEAPDQGHESVSETYSFWVWLEAVNGKLTGNYEGVETAWSFLEKHLI

SEQ ID NO: 181 - protein, 15 aa, Neocallimastix californiae
  6hp_glycosidase
KELQQAYGTWDIYAM

SEQ ID NO: 182 - protein, 315 aa, Neocallimastix californiae
  6hp_glycosidase
APDADARAIQAAYFGYIWAEEDGQDLSSVASKAAKLGDYLRYSHYDKYFKKIGNCIDYQRCAAGSGKNSAHYLISWYFAWGGGLQGDWAWRISSSHTHSGYQNPLAAWILSTESAFKPKGSTAVKDWSTSLDRQLELFRWLQSAEGCIAGGATNSWQGHYAQPPSDITTFYGMYYDWQPVYHDPPSNNWTGMQGWGMERVCSLYYLSGNEKAGKVCQEWAKWIKQNTRVNGGEVVHATNLEWSGNPDEWNASNFDKSGLNASLHGTVSSEGTDLGSIASMIKALMWVSLKDGDTEGLQLVLDVMDAIENYKDDLG

SEQ ID NO: 183 - protein, 19 aa, Neocallimastix californiae
  6hp_glycosidase
TYHRFWGQTEIMVANGLIS

SEQ ID NO: 184 - protein, 134 aa, Neocallimastix californiae
  6hp_glycosidase
HDPPSNNWTGMQGWGMERVCSLYYLSGNEKAGKVCQEWAKWIKKNTRVNGGEIVHATNLAWTGNPDEWKSSNFNKSGLNASLHGTVSSEGTDLGSIASMIKALMWVSLKDEDTEGLQLVLDVMDAMENYRDDLG

SEQ ID NO: 185 - protein, 274 aa, Neocallimastix californiae
  6hp_glycosidase
YSHYDKYFKKIGNCIDYQRCAAGSGKNSAHYLISWYFAWGGGLQGDWAWRISSSHTHSGYQNPLAAWILSTESAFKPKGSTAVKDWSTSLDRQLELFRWLQSAEGCIAGGATNSWQGHYAQPPSDITSFYGMYYDWQPVYHDPPSNNWTGMQGWGMERVCSLYYLSGNEKAGKVCQEWAKWIKETTRVNGGEIVHATNLEWSGNPDEWKSSNFNKSGLNASLHGTVSSEGTDLGSIASIIKGLMWVSMKDGDEEGLRLVLDVMDAIENYKDDLG

SEQ ID NO: 186 - protein, 19 aa, Neocallimastix californiae
  6hp_glycosidase
TYHRFWGQTEIMVANGLIS

SEQ ID NO: 187 - protein, 19 aa, Neocallimastix californiae
  6hp_glycosidase
TYHRFWGQTEIMVANGLIS

SEQ ID NO: 188 - protein, 139 aa, Neocallimastix californiae
  6hp_glycosidase
WQPVYHDPPSNNWTGMQGWGMERVCSLYYLSGNEKAGKVCQEWAKWIKKNTRVNGGEIVHATNLAWTGNPDEWKSSNFNKSGLNASLHGTVSSEGTDLGSIASMIKALMWVSLKDEDTEGLQLVLDVMDAMENYRDDLG

SEQ ID NO: 189 - protein, 438 aa, Neocallimastix californiae
  6hp_glycosidase
SQDYARHIELSLLFYEAQRSGKLPEDNRIYWRHDSELEAGADHGVDLTGGYYDAGDNAKFNFPAASTMTLLAWSGIDYAEGYKNAGQWKYILDAVRWGADYFIKCHTGKTELYAQVGDGNTDHSFWYPPEYVQYDYPSFKVTAQEPGSEVAGETAAFLAAASILFKDEDPSYSATLLKHSKEIYDFADKYRGDYTVAVPAVSFYNTYSGYMDELAWGAAWLLRATGDESYLDKYNVIANKKYESYDPKKFTGATGPISWDDKRPGCYILMAMITGDEKRINEAYSYCDAVLTQPRTKGGLWYDDGLSIWGSNRYASNAASMLGMFANYLPKSDPKRAKYVEFVKQQTDYILGDNPAKINYVVGAEANSPKAVHHRGASGVFDSQDKAAKPDENIYTLWGALAGGPDKNDKFVDSRKDYQMSEVALDYNAAFQMNLAFL

SEQ ID NO: 190 - protein, 440 aa, Neocallimastix californiae
  6hp_glycosidase
SQDYARHIELSLLFYEAQRSGKLPENNRIYWRHDSLLDAGADNKVDLTGGYYDAGDNVKFNFPAAAALTLLAWSGIDYADGYKKAGQWDYLLDAVKWGADYFLKCHTGKNELYVQVGKGATDHGFWYPPEYVQYEYPSYKITSSAPGSEVAGDTASFLAASSILFKDVDSSYSATLLKHAKEIYDFADTYRGEYIKAVPDAQGFYSNWSGCDDELAFGALWLYRATKDESYMNKFKKIADASYGEQDTKAYGTCSGPISWDDKRPGAYILAAMLTGDEKRKSKAYSYCDAILTQPKTPGGLWYDANLSKWGSNRYASNAAAMVAMFANSLPASDSKRSKYVDFVQKQTDYILGNNPAKVNYVVGAEANSPKAVHHRAASGTYDSQDKNAKPTDYNVFTLWGALAGGPGSKDEYTDTRKNYEMNEVALDYNAAFQMNLAFL

SEQ ID NO: 191 - protein, 440 aa, Neocallimastix californiae
  6hp_glycosidase
SQDYARHIELSLLFYEAQRSGKLPENNRIYWRHDSMLDAGADNGVDLTGGYYDAGDNVKFNFPAAAALTLLAWSGVDYADGYKKAGQWDYLLDAVRWGADYFIKCHTGKNELYAQVGRGTTDHGYWYPPEYIQYDHPSYKVTASSPGSEVAGDTASFLAATSILFKDEDPSYSKKCLQHATEIYDFADTYRGDYTGSIPDVSGFYSTWSGYNDELAFGALWLYRATGDESYYEKFKKIADAEYGAQDSKAYGTCTGPISWDDKRPGAYVLAAIITGDEDRLKQAYWYCDNVLTQPRTKGGLWYDSNLSKWASNRYASNAAAMLAMMANYLPKGDARRAKYVDFVKSQTDYILGDNPAGVNFVVGAEANSPKAVHHRGASGTYDSQDVHARPTDYNIFTLWGALAGGPSKDDTYSDTRKDYEMNEVALDYNAAFQTNLAFL

SEQ ID NO: 192 - protein, 170 aa, Neocallimastix californiae
  6hp_glycosidase
YALMYMVTGEDKYKEQAFNHSDLMVNYKTTPGGLWFDTNLSAWGSNRYASNAAYTVAMVASTMDASDAKRKQYVKFIQKQIDYIQGDNPAKVDYVVGADPSSPKSVHHRGSSGTMNAMAEPPFNVFPLYGALAGGPDGNDKYTDDRTNYNSNEVALDYNAAYTGLLAFLI

SEQ ID NO: 193 - protein, 372 aa, Neocallimastix californiae
  6hp_glycosidase
GAYYTGDYTSPFKTYLGKTDEEIQKKLDQLWNHYFKGNNNSKVFYDQGNEGYILDVNNNDVRSEGMSYGMMICVQTDHREEFDKIWNWAKNHMWHKSGSWDGYFAWKRGSNGYGGDDNCAPDGEMYFMMSLLFAANRWNNKQYMDDAQYILKRMWDNSQHSLFNPRYNVITFQPQGNENNFSDPSYDLPAFVDLFSRWSTTNQGKWKAAASATRDHLYKSSNTKSGLFSDYNNFDGTPHSVSYNSNAQKYMYDAMRCAMNFGMDYYLFGADAKRQTEMARRLIDFFEKDGYQHARFNWDGSNPSEQYTLGEVGANAVATYALMGVNGYEDIIKKNLKMAWDGEPMTGQYRYYDGLVHYLSMLHLTGSFKIWK

SEQ ID NO: 194 - protein, 315 aa, Neocallimastix californiae
  6hp_glycosidase
APDADARAIQAAYFAYIWAEEDGVNLSSVASKAAKLGDYLRYAQYDKYFKKVGNCVGYQQCQAGRGKNSAHYLISWYFAWGGGLQGDWAWRIGSSHTHTGYQNPLAAWVLSTQSAFKPKSSTGAKDWATSLDRQLELFRWLQSAEGCIAGGATNSWQGSYAQPSSDITSFYGMWYDWQPVYHDPPSNNWTGMQGWGMERVCSLYYLSGNEKAGKICQEWAKWVKNTTRVSGGEVVHATNLEWSGNPDEWNSSNFNKSNLNRSLHGTVSSDGIDIGTIASIIKGLMWVSMKDGDQEGINLSIDVMDAIENYKDDLG

SEQ ID NO: 195 - protein, 88 aa, Neocallimastix californiae
  6hp_glycosidase
ASDEYGNRVTELYNKVTGNGSYSSEYFSAEKVPYHSVETLMVEAPDHGHESVSETFSFWIWLEAVNGKITGNYDGVEEAWSYLEKHII

SEQ ID NO: 196 - protein, 19 aa, Neocallimastix californiae
  6hp_glycosidase
TYHRFWAQTEIAVANGLIS

SEQ ID NO: 197 - protein, 15 aa, Neocallimastix californiae
  6hp_glycosidase
KELQQAYGNWDIYIM

SEQ ID NO: 198 - protein, 433 aa, Neocallimastix californiae
  6hp_glycosidase
RDYARILNLNLRFYECNWSGKAPEHKQVYWRYDSALEDGADVGLDLTGGYYDAGDHVKFNLPMSYAMTMLAWGGIDLYDNYVAAGQIDYLVQIVNHGADYFVKCHPEKEVIYAQVGLGDVDHCFWVPPELMTMERPAVCKLTPENGASDVTAQMAAALASASILNKMVGNTEKSELYLKHAIEIYDFADKYRDVYGNPCPEGASFYPSASYKDELVWGAAWVYRASGDEKYYEKADSYYDSLGLSGRVLIGPISWDDASSGIIFLMSKPGFGSNWKRYLGEAQTYVDQYLNDKSARTDAGMLWYSAVSGWGSARHAMAGVFLYCIFNTYHKPTDPKYFNFIQQQADYILGNNPFNRSLVVGSIPGHDPLNVHHRGSHGGYSPISLPEHNMYTLYGALAGGPLQDDSWDDDRNNYITNEVSCDYNAGVTGVMAY

SEQ ID NO: 199 - protein, 89 aa, Neocallimastix californiae
  6hp_glycosidase
RANDEYAQRAINTYNTVTGNGSYKSSYFSPEVVPYHSIETLMVEAPDQGHESVSETFSFWVWLEAVNGKLTGDYSGVEKAWSYLEKHMI

SEQ ID NO: 200 - protein, 315 aa, Neocallimastix californiae
  6hp_glycosidase
APDADARAIQGAYFAWLWAKEDGKNLSSLASKAAKLGDYLRYSHYDKYFKKIGNCVGYQQCQAGSGKNSAHYLISWYFSWGGGLQGDWSWRIGSSHTHSGYQSPLAAWILSTESAFKPKSASGAKDWATSLERQIELFRWLQTSEGCIAGGATNSWQGHYAQPDSSITSFYGMWYDWQPVYHDPPSNNWTGMQGWGMERTCCYYYLSGDEKAGLVCQNWAKWVKANTRVSGGQIVHATNLSWEGSPDEWNSSNFNKANLNASLHGTVSAEGIDLGSIASIIKGLMWVSMKDNDQEGINLVIDVMDAIENYKDDEG

SEQ ID NO: 201 - protein, 19 aa, Neocallimastix californiae
  6hp_glycosidase
RYHRFWGQTEIMVANGLIS

SEQ ID NO: 202 - protein, 15 aa, Neocallimastix californiae
  6hp_glycosidase
QELQQAYGTWDIYAM

SEQ ID NO: 203 - protein, 19 aa, Neocallimastix californiae
  6hp_glycosidase
TYHRFWGQTEIMVANGLIS

SEQ ID NO: 204 - protein, 315 aa, Neocallimastix californiae
  6hp_glycosidase
APDADARAIQAAYFGYIWAKEDGVDLSSVASKAAKLGDYLRYSHYDKYFKKIGNCIDYQRCAAGSGKNSAHYLISWYFAWGGGIQGDWSWRIGSSHTHSGYQNPLAAWVLSTESAFKPKGSTAVKDWSTSLDRQLELFRWLQSAEGCIAGGATNSWQGHYAQPDSDITTFYGMFYDWQPVYHDPPSNNWTGMQGWGMERVCSLYYLSGNEKAGKICQEWAKWVKENTRVIGGEVVHATNLEWTGNPDEWKSSNFNKNGLNSQLHGTVSSEGTDLGSIASIIKALMWVSLKDEDSEGLRLVIDVMDAIENYRDDLG

SEQ ID NO: 205 - protein, 88 aa, Neocallimastix californiae
  6hp_glycosidase
KYDEYSQRAIEHYNIVTGNGSYQSEYFSPENVPYHSIETMMVEAPDHGHESVSETYSFWVWLEAVHGKLTGNYDGVSTAWSYLEKHLI

SEQ ID NO: 206 - protein, 15 aa, Neocallimastix californiae
  6hp_glycosidase
KELQQAYGTWDIYAM

SEQ ID NO: 207 - protein, 19 aa, Neocallimastix californiae
  6hp_glycosidase
TYHRFWGQTEIMVANGLIS

SEQ ID NO: 208 - protein, 141 aa, Neocallimastix californiae
  6hp_glycosidase
YDWQPVYHDPPSNNWTGMQGWGMERVCSLYYLSGNEKAGKVCQEWAKWVKKNTRVNGGEVVHATNLEWTGNPDEWKSSNFNKNGLNSQLHGTVSSEGTDLGSIASIIKALMWVSLKDEDSEGLRLVIDVMDAIENYRDDLG

SEQ ID NO: 209 - protein, 88 aa, Neocallimastix californiae
  6hp_glycosidase
ASDEYAQRVIDTYNAVTGNGSYNSDYFSPENVPYHSIETMMVEAPDYGHESVSETYSFWVWLEAINGKMTGDYKGVETAWSFLEKHLI

SEQ ID NO: 210 - protein, 19 aa, Neocallimastix californiae
  6hp_glycosidase
TYHRFWAQTEIAVANGLIS

SEQ ID NO: 211 - protein, 15 aa, Neocallimastix californiae
  6hp_glycosidase
KELQQAYGTWDIYAM

SEQ ID NO: 212 - protein, 315 aa, Neocallimastix californiae
  6hp_glycosidase
APDADSRAIQAAYFAYIWAKEDGQNLSSLASKAAKLGDYLRYAQYDKYFKKIGNCIGYQQCQAGRGKNSAHYLISWYFSWGGGLQGDWSWRIGSSHTHTGYQNPLAAWILSTQSAFKPKGSTAVKDWTTSLDRQLELFRWLQAAEGCIAGGATNSWQGHYAQPPSEITSFYGMYYDWQPVYHDPPSNNWTGMQGWGMERVCSLYYLSGNEKAGKVCQEWAKWVKNNVRVNGSEIVHATNFEWSGNPDEWKASNFNKSGLNASLHGAVSSEGIDLGSIASIIKGLMWVSMKDNDQEGIDLSVQVMDAIEQYKDQYG

SEQ ID NO: 213 - protein, 389 aa, Neocallimastix californiae
  6hp_glycosidase
DSLIERTTSFIPYWNKEMFKGTWNYIDGVFLNSVINLYKKTNNEKYKDFFIKYVNYYVSEDGTFVHYTADGVKTVDNEMGWVNGELDTVCESKILFDAYEMTGDKRYLTAIEFTYKKLMEMPYCYNSPNFWHKTFYINQIWLDGMYMYAPFLARYALLKNDLSILDDIKNQYAFIHDNMRDENGLYHHGFDTTKTIFWSKNNDGKSENFWLRSMGWFAVSLADILEYYPEGENKEYLKSILEELLNGILPYQDKTTKMFYQVIDRPEEIQLVDKFYFSNLKNSKYGNINTFVSNYVESSGSSMLAYSFLKYGKVYQNGGNFEEIGKEIFEAVYKHSYKNNTLSDICITAGLGPEVKTYRDGTLSYYLAEVVGDDDAKGVGPFIMAFIEY

SEQ ID NO: 214 - protein, 392 aa, Neocallimastix californiae
  6hp_glycosidase
SYVDSLIERTTSFIPYWNKESFKGKWNYIDGVFLNSVVNLYKKTNNEKYKEFFIKYINYYVAEDGTFVHYTEDGVKTVDNDLGWVTGELDTVCESKILFDAYEMTGDKRYLTAIEFTYQKLMEMPLCYNSPNFWHKTFYINQIWLDGMYMYAPFLARYAVLKNDLSILDNIKEQYAFIHDNMRDENGLYHHGFDTTKTIFWSKNNDGKSENFWLRSMGWFAVSLADILEYYPEGENKEYLKNVLEELLNGILPFQDKTTKMFYQVIDKPEEIQLVDKFYFSNLGNSKYGDINTFVSNYVESSGSSMFAYSFLKYGKVYQNGGKFEDIGKEIFEAVYQHSYQNHTLSDICITAGLGPEAKTYRDGTLSYYLAEKVGEDDAKGVGPFLMAFIEY

SEQ ID NO: 215 - protein, 88 aa, Neocallimastix californiae
  6hp_glycosidase
ASDKYAQRVIDTYNAVTGNGNYNSEYFSPENVPYHSVETMMVEAPDYGHESVSETYSFWVWLEAINGKMTGDYKGVETAWSYLEKHLI

SEQ ID NO: 216 - protein, 19 aa, Neocallimastix californiae
  6hp_glycosidase
TYHRFWAQTEIAVANGLIS

SEQ ID NO: 217 - protein, 15 aa, Neocallimastix californiae
  6hp_glycosidase
RELQQAYGTWDIYAM

SEQ ID NO: 218 - protein, 315 aa, Neocallimastix californiae
  6hp_glycosidase
APDADARAIQAAYFAYIWAKEDGTNLSSLASKAAKLGDYLRYSHYDKYFKKIGNCIGYQQCQAGRGKNSAHYLISWYFSWGGGLQGDWSWRIGSSHTHTGYQNPLAAWVLSTESAFKPKSSTAVKDWATSMDRQLELFRWLQASEGCIAGGATNSWQGHYAEPPSDITTFYGMYYDWQPVYHDPPSNNWTGMQGWGMERVCSLYYLSGNEKAGKVCQEWAKWVKKNVRVNGNEITHATNFSWSGNPDEWNPSNFNKSGLNASLHGTVSSEGIDIGSLASIIKGLMWVSMKDKDQEGINLSIKVMDAIENYRDDLG

SEQ ID NO: 219 - protein, 438 aa, Neocallimastix californiae
  6hp_glycosidase
SQDYARHIELSLLFYEAQRSGKLPENNRIYWRHDSELEAGADNGVDLTGGYYDAGDNAKFNFPGAATMTLLAWSGVDYAEGYKNAGQWEYLLDAVRWGADYFMKCHTGKTELYAQVGDGNTDHSFWYPPEYVQYEYPSFKVTADAPGSEVAGETAAFLAAASILFKDEDPTYSATLLKHSKEIYDFADKYRGDYTVAVPAVSFYNTYSGYMDELAWGAAWLLRATGDESYLEKYNVIANKKYESYDPKKFTGSTGPISWDDKRPGCYILIAMITGDEKRINEAYNYCDAVLTQPRTAGGLWYDDGLSIWGSNRYASNAASMVAMFANYLPESDPKRAKYVEFVKQQTDYILGDNPAKINYVVGAEANSPKSVHHRGASGVFDSQDKAAKPDENIYTLWGALAGGPDKNDKFVDSRKDYQMSEVALDYNAAFQMNLAFL

SEQ ID NO: 220 - protein, 433 aa, Neocallimastix californiae
  6hp_glycosidase
RDYARILNLNLRFYECQWSGKAPEHKQVYWRYDSALEDGADVGLDLTGGFYDAGDHVKFNLPMSYAMTMLAWGGIDLYDNYVAAGQIDYLLQMVNHGADYFVRCHPEKEVIYAQVGVGDVDHCFWVPPELMTMERPTVCKLTPENGASDVTGQMAAALASASILNKKYGNTEKAELYLKHAIEIFDFADKYRDVYNNPCPEGASFYPSASYKDELVWGAAWVYRASGDEKYYQKADEYYDSLALSGRNLIGPITWDDASSGIVFLMSKPGFGSNWERYLGEAQHYVDQYLNDKGARTDGGMLWYSSVSGWGSARHAMAGTFLYCIFNTYHKPTDPKYFNFIQEQADYILGNNPFNRSLVVGSIPGYEPLNVHHRGSHGGYSPLSPPEHNMYPLYGALAGGPLQNDFWDDDRNNYVTNEVACDYNAGITGVMAY

SEQ ID NO: 221 - protein, 436 aa, Neocallimastix californiae
  6hp_glycosidase
SQDYARHLELSILFYEAQRSGKLPDNNRIYWRGDSMLEAGSDNKVDLTGGYYDAGDNIKFNFPQASSLTLLSWSAVEWKDGYKQAGQWEYMKDLIKWGMDYFIKCHTDKYVLYGQVGNAKLDHNSWVSPENISYDYPSYKITDSSPGSDLAAETSAALVAASMVFRDEDPNYADLLLKHGKELYEFADKYRGSYDESIPEANDYYHSNSYNDELVWGAAWLFRATGEEYYKSKVDAIWDYPYDENDSNKFLDSKNPISWDDKKASSYTLMAMITGDQKYLKEATTHSDLMVNHTTTPGGLWYNENLSVWGSNRYASNAAFTVAMMTSIMNDDDSKRQEYIDFVKKQTDYILGDNPAKIDYVVGAAPNSPKAVHHRGASGTKDVYENPDENTYVLYGALAGGPGPKDEYKDIREDYQKNEVALDYNAAFQGLLAFLI

SEQ ID NO: 222 - protein, 315 aa, Neocallimastix californiae
  6hp_glycosidase
APDADARAIQAAYFGYMWAEEDGVDLSDLASKAAKLGDYIRYAQYDKYFKKIGNCIGHDRCSAGRGKNSAHYLISWYFAWGGGLQGDWAWRIGSSHTHTGYQNPLAAWVLSTQSAFKPKSRTGADDWATSLDRQLELFRWLQASEGCIAGGATNSWQGHYAQPSSDITTFYGMYYDWQPVYHDPPSNNWTGMQGWGMERVCSLYYISGNEKAGTICRDWAKWVKNTVRVNGNEVIHSTNLEWSGNPDEWNSNNFNKSGRNRSLHGTSSSDGLDLGTLASIIKGLLWVSAKDNDAEGIQLVLDVMNAIEQYSDDLG

SEQ ID NO: 223 - protein, 19 aa, Neocallimastix californiae
  6hp_glycosidase
TYHRFWAQTEIMVANGLIS

SEQ ID NO: 224 - protein, 15 aa, Neocallimastix californiae
  6hp_glycosidase
KELQQAYNTWDIYAM

SEQ ID NO: 225 - protein, 88 aa, Neocallimastix californiae
  6hp_glycosidase
AADAYAQRAIDHYNKMTNGGQYNTDYFSPETVPYHSIETLMVEAPDHGHESVSETYSFWIWLEAVNGKLTGNYDGINTAWSYLEKHMI

SEQ ID NO: 226 - protein, 88 aa, Neocallimastix californiae
  6hp_glycosidase
ASDAYAQRAIEHYNKMTNGGQYNTEYFSPENVPYHSIETLMVEAPDHGHESVSETYSFWIWLEAVNGKLTGNYDGINTAWSYLEKHMI

SEQ ID NO: 227 - protein, 315 aa, Neocallimastix californiae
  6hp_glycosidase
APDADARAIQAAYFGYIWAEEDGVDLSDLASKAAKLGDYLRYSHYDKYFKKIGNCVGYDKCSAGRGKNSAHYLISWYFAWGGGLQGDWAWRIGSSHTHTGYQNPLAAWILSTQSAFKPKGSTAVKDWQTSLDRQLELIRWLQATEGCIAGGATNSWQGHYAEPDSDITTFYGMYYDWQPVYHDPPSNNWTGMQGWGMERTCSLYYVSGNEKAGTICRDWAKWVKETVRVSGGQVIHATNLEWSGNPDEWNKNNFNKSGANRSLHGTVSAEGLDLGSIASIIKALLWVSAKDGDEEGIDLAIQVMDAIENYKDDLG

SEQ ID NO: 228 - protein, 15 aa, Neocallimastix californiae
  6hp_glycosidase
KELQQAYRTWDIYAM

SEQ ID NO: 229 - protein, 19 aa, Neocallimastix californiae
  6hp_glycosidase
TYHRFWGQTEIMVANGLIS

SEQ ID NO: 230 - protein, 315 aa, Neocallimastix californiae
  6hp_glycosidase
APDADARAIQAAYFGYIWAEEDGVNLSDLASKAAKLGDYMRYAQYDKYFKKIGNCIGHDKCSAGRGKNSAHYLISWYFAWGGGLQGDWAWRIGSSHTHSGYQNPLAAWVLSTQSAFKPKSKSGADDWATSLDRQLELFRWLQASEGCIAGGATNSWQGHYAKPGSDITTFYGMYYDWQPVYHDPPSNNWTGMQGWGMERVCSLYYVSGNEMAGTVCRDWAKWVKNTVRVSGGQVVHATNLEWSGNPDEWNKSNFNKSGLNRSLHGTVSAEGLDLGSIASIIKGLLWVSAKDGDEEGIDLSLQVMDAIENYKDDLG

SEQ ID NO: 231 - protein, 19 aa, Neocallimastix californiae
  6hp_glycosidase
KYHRFWGQTEIMVANGLIS

SEQ ID NO: 232 - protein, 17 aa, Neocallimastix californiae
  6hp_glycosidase
IAKELQQAYNTWDMYAM

SEQ ID NO: 233 - protein, 19 aa, Neocallimastix californiae
  6hp_glycosidase
KYHRFWGQTEIMVANGLIS

SEQ ID NO: 234 - protein, 314 aa, Neocallimastix californiae
  6hp_glycosidase
PDADARAIQAAYFGYIWAEEDGVNLSDLASKAAKLGDYMRYAQYDKYFKKIGNCIGHDKCSAGRGKNSAHYLISWYFAWGGGLQGDWAWRIGSSHTHSGYQNPLAAWVLSTQSAFKPKSKSGADDWATSLDRQLELFRWLQASEGCIAGGATNSWQGHYAKPGSDITTFYGMYYDWQPVYHDPPSNNWTGMQGWGMERVCSLYYVSGNEMAGTVCRDWAKWVKNTVRVSGGQVVHATNLEWSGNPDEWNKSNFNKSGLNRSLHGTVSAEGLDLGSIASIIKGLLWVSAKDGDEEGIDLSLQVMDAIENYKDDLG

SEQ ID NO: 235 - protein, 428 aa, Neocallimastix californiae
  6hp_glycosidase
SQDYARHLELNFLFYEAQRSGPLPSTNRIPWRGDSGLDHGSDVGVDLTGGYYDAGDNVKFNFPQAFSMTAISWMGIEFAKGVEMANQTEYLKDTVKWGCDYLLKCHEKGTDVFYMQVGDGDIDHQYWKAYENIDYPTPTFFVDSKNPGTEVTGETAAAFAAASILFKDSDPEYSATLLDQAKEWYEFADKYQFDYSQSVPAAGSYYKSYNGYNDELAWAAIWLYRALGDEAYLEKAKSLVANYKLSEVGIDWDSKYQGVIVILAQLGVKEYVEKVEAWVKDICTNGKFSPGGLYINKDSEWGSNRRATAMAASLIYYTHNLPEGNELREMAKKFAKSQADYIQGANPLGIDYVVGADETSPRSVHHRTASGAACIECDPVQNVHIIYGALAGGPDVEDNYLDDRADYKKNEVALDYNVCYAAVLAYLV

SEQ ID NO: 236 - protein, 306 aa, Neocallimastix californiae
  6hp_glycosidase
DSKYVSKIIETIYWAYCWSNEQKKRKFMDTILKKVLRMSDYMLYFINSNESLQEFNVESKDDDLNYLVSRYFSWKGDIHGKWLTKKVSSNIIGIGSQNPLVAYILSNIKEFKSDNEDIILKWKKTYKRQIEFIRWLQSSEGAIVGNAIYISSSIEINKVPTFYNLVFSNNSNEEENNLFSTQCFVFESIAELYYITKDKDIETILFKWLDWVLTVFHLTSDRSFRIPNRLSFEGQPEKWIPNTKIKDHKNKHLNVIIEDFNNDLGVAASLSKILLWVGKKINNEDYLTLGREILERQEILNKDEDG

SEQ ID NO: 237 - protein, 22 aa, Neocallimastix californiae
  6hp_glycosidase
FRYHRFWEQCEILSAQGLYSLL

SEQ ID NO: 238 - protein, 124 aa, Neocallimastix californiae
  6hp_glycosidase
EIYKNHYNKLNLHNSTSSFYNLDSIPYTTLETLYIDQTVDYGHITTIKEFSYKLWIEAIQGKISGKWKSFVNAWNIFEMNMIPKEENQRGSYIYYSNNHNSQNNQDTLYKSLNEYYQTWSIYLP

SEQ ID NO: 239 - protein, 437 aa, Neocallimastix californiae
  6hp_glycosidase
SQDYARHLELSILFYEAQRSGKLPANNRIFWRHDSMVDAGKDNNVDLTGGYYDAGDNVKFNFPQASALTLLAWSAVDWKDGYKEAGQWGYMKDLLKWGMDYFIKCHTSKYELYGQVGNGSLDHGAWVPPEEIDYEYPSYKITASAPGSDLAAETSASMVAASMAFRDDDPEYADILLKHGKELYDFAEKYQGTYDKSITDAKGYYRSYSGFNDELVWGAAWLYRATGDKTYKDKVDKIWDTPYGDLDPDKFLGSGGPISWDDKKAAAYALMALTTGESKYVDESTKHSELMVNYKTTPGGLWYDTNLSMWGSNRYASNAAFTVAMLATSMDANDAKRKEYVKFIKKQIDYIIGDNPAKVDYVVGADPSSPKAVHHRGASGSKGADKGPSENVFVLYGALAGGPGANDNFKDARDNYEMNEVALDYNAAFQGLLAFLI

SEQ ID NO: 240 - protein, 437 aa, Neocallimastix californiae; identical to SEQ ID NO: 239
  6hp_glycosidase

SEQ ID NO: 241 - protein, 19 aa, Neocallimastix californiae
  6hp_glycosidase
TYHRFWAQTEIAVANGLIS

SEQ ID NO: 242 - protein, 315 aa, Neocallimastix californiae
  6hp_glycosidase
APDADARAIQAAYFAYIWAEEDGQNLSSLASKAAKLGDYLRYSHYDKYFKKIGNCIGYQQCQGGRGKNSAHYLISWYFSWGGGLQGDWSWRIGSSHTHTGYQNPLAAWVLSTQAAFKPKGSSAVKDWSTSLDRQLELFRWLQAAEGCIAGGATNSWQGHYAQPPSDITSFYGMYYDWQPVYHDPPSNNWTGMQGWGMERVCSLYFISGNEKAGKVCQEWAKWVKNNVRVNGSEIVHATNFEWSGNPDEWKPSNFNKSGLNASLHGTVSSEGVDLGSLASIIKGLMWVSMKDNDQEGIDLSVQVMDAIEQYKDKYG

SEQ ID NO: 243 - protein, 15 aa, Neocallimastix californiae
  6hp_glycosidase
KELQQAYGTWDIYAM

SEQ ID NO: 244 - protein, 88 aa, Neocallimastix californiae
  6hp_glycosidase
ASDEYAKRVTDTYNAVTGNGSYNSDYFSPENVPYHSIETMMVEAPDYGHESVSETYSFWVWLEAINGKMTGNYKGVETAWSYLEKHLI

SEQ ID NO: 245 - protein, 440 aa, Neocallimastix californiae
  6hp_glycosidase
SQDYARHIELSLLFYEAQRSGKLPENNRIYWRHDSMLDAGSDHGVDLTGGYYDAGDNVKFNFPGAASLTLLAWSAIDYADGYKKADQWKYILDAVRWGADYFVKCHTGKNELYVQVGDGQIDHGYWYPPEYIQYKHSSYKITASAPGSEVAGDTASFLAASSILFKEENPTYSATLLKHAIEIYDFADKYRGEYTKAVPDAQGFYANWSGFLDELAFGALWLYRATGDESYMQKFSTIADAKYGEQDSKAYGISTGPISWDDKRPGAYILAAMVTGEEKRLQQAYWYCDSILTQPKTRGGLWYDASLSQWGSNRYASNAAAMLAMFANYLPKSDPKRSKYVDFVKKQTDYILGDNPAKINYVVGAEASSPKAVHHRAASGTYDSQDTNAKPTDYNIFTLWGALAGGPGPKDEYTDSRKNYQMNEVALDYNAGFQMNLAFL

SEQ ID NO: 246 - protein, 79 aa, Neocallimastix californiae
  6hp_glycosidase
ARFNWDGSNPSEQYTLGETGANAVATFALMGLSGYENVIKKNLKMAWDAQLMTGRYRYYDGLVHYLAMLHLLGSFKIWK

SEQ ID NO: 247 - protein, 373 aa, Neocallimastix californiae
  6hp_glycosidase
SGAYYTGDYTSPFKTYLGKTDAEIQGKLDQLWNHYFKGDNNSKVFYDRGNEGYILDVNNNDVRSEGMSYGMMIAVQTNHKEEFDKLWNWAKNHMWHKGGGWDGYFAWQRNTSGNGGDDNCAPDGEMYFMMSLLFAANRWNNKQYMDDAQYIIKRMWDNPQHKLFNQQNNIITFQPQGTGNNFSDPSYDLPAFVDLISRWSTTNQNRWKSAAQATRDHLYKSSNTRSGLFSDYNNFDGTPHSESYNQNASKYMYDAMRCAMNFGMDYYLFGSDAKRETEMAKRIIDFFEKDGYKHARFNWDGSGASEQYTQGETGANAVACFALMGTQGYESIIKKNLQMAWDVKPMTGQYRYYDGLVHYLAMLHLLGSFKIWK

SEQ ID NO: 248 - protein, 196 aa, Neocallimastix californiae
  6hp_glycosidase
RDYARILNLNLRFYECQWSGKAPEHKQVYWRYDSALDDGADVGLDLTGGFYDAGDHVKFNLPMSYAMTMLAWGGIDLYDNYVAAGQLDYLLQMVNHGADYFVRCHPEKEVIYAQVGLGAIDHCFWVPPELMTMERPAACKLTPDNGASDVTAQMAAALASASILNKMYGNKEKAELYLKHAIEIYDFADKYRDVYN

SEQ ID NO: 249 - protein, 19 aa, Anaeromyces robustus
  6hp_glycosidase
TYHRFWAQTEIMVANGLIS

SEQ ID NO: 250 - protein, 255 aa, Anaeromyces robustus
  6hp_glycosidase
CSAGRGKNSAHYLISWYFAWGGGLQGDWAWRIGSSHTHTGYQNPLAAWVLSTQSAFKPKSRTGADDWATSLDRQLELFRWLQASEGCIAGGATNSWQGHYAQPSSDITTFYGMYYDWQPVYHDPPSNNWTGMQGWGMERVCSLYYISGNEKAGTICRDWAKWVKNTVRVNGNEVIHSTNLEWSGNPDEWNSNNFNKSGRNRSLHGTSSSDGLDLGTLASIIKGLLWVSAKDNDAEGIQLVLDVMNAIEQYSDDLG

SEQ ID NO: 251 - protein, 19 aa, Anaeromyces robustus
  6hp_glycosidase
TYHRFWGQTEIMVANGLIS

SEQ ID NO: 252 - protein, 258 aa, Anaeromyces robustus
  6hp_glycosidase
TTKCSAGRGKNSAHYLISWYFAWGGGLQGDWAWRIGSSHTHTGYQNPLAAWILSTQSAFKPKGSTAVKDWQTSLDRQLELIRWLQATEGCIAGGATNSWQGHYAEPDSDITTFYGMYYDWQPVYHDPPSNNWTGMQGWGMERTCSLYYVSGNEKAGTICRDWAKWVKETVRVSGGQVIHATNLEWSGNPDEWNKNNFNKSGANRSLHGTVSAEGLDLGSIASIIKALLWVSAKDGDEEGIDLAIQVMDAIENYKDDLG

SEQ ID NO: 253 - protein, 103 aa, Anaeromyces robustus
  6hp_glycosidase
SKYVDFVKKQTDYILGDNPAKINYVVGAEASSPKAVHHRAASGTYDSQDTNAKPTDYNIFTLWGALAGGPGPKDEYTDSRKNYQMNEVALDYNAGFQMNLAFL

SEQ ID NO: 254 - protein, 373 aa, Anaeromyces robustus; identical to SEQ ID NO: 247
  6hp_glycosidase

SEQ ID NO: 255 - protein, 37 aa, Anaeromyces robustus
  6hp_glycosidase
GGPGARDDYKDDRTNYNSNEVALDYNAAYTGLLAFLI

SEQ ID NO: 256 - protein, 437 aa, Anaeromyces robustus
  6hp_glycosidase
SQDYARHLELSILFYEAQRSGKLPANNRIFWRHDSMVDAGKDNNVDLTGGYYDAGDNVKFNFPQASALTLLAWSAVEWKDGYKEAGQWEYMKDLLKWGMDYFVKCHTGKTELYGQVGNGSLDHGAWVPPEDIDYKYPSYKITASAPGSDLAGETAAALVASSLAFREDDPEYADLLLKHGKEIYDFADKYRGSYDKSIEDAKGYYRSYSGYMDELVWGAAWLYKATGDETYKKKVDAIWDYPYGDLDPDKFLGSTGPISWDDKKASSYALMAMITGEDKYVKESTTHSDLMVNYKTTPGGLWYDTNLSMWGSNRYASNAAFTVAMLASSMDPNDSKRKQYVKFVQKQIDYIIGNNPAKVDYVVGADPSSPKAVHHRGASGSKGADKGPDENVFVLYGALAGGPGARDDYKDTRNNYEMNEVALDYNAAFQGLLAFLV

SEQ ID NO: 257 - protein, 440 aa, Anaeromyces robustus
  6hp_glycosidase
SQDYARHIELSLLFYEAQRSGKLPENNRIYWRHDSLLDAGADNGVDLTGGYYDAGDNVKFNFPAAATLTLLAWSGIDYAQGYKEAGQWDYLLDAVRWGADYFMKCHTGKNELYVQVGSGRVDHAYWYPPEYVNYDHPSFKITASAPGSEVAGDTASFLAAASILFKDVDSSYSQKCLKHAKEIYDFADTYRGEYTKAVEDAQQFYANWSGFLDELAFGALWLYRATGDESYHNKFKKIADDSYGEQDTKAYGICTGPISWDDKRPGSYILAAMITGEEKRLQQAYWYCDEVLTQPKTPGGLWYNDNLSKWGSNRYASNAAAMLGMFANYLPKSDPKRSKYIDFVKSQTNYILGDNPAKVNYVVGAEANSPKAVHHRGSSGTYDSQDNNAKPTDYNIYTLWGALAGGPGKSDDYSDTRKNYEMNEVALDYNAAFQMNLALL

SEQ ID NO: 258 - protein, 316 aa, Anaeromyces robustus
  6hp_glycosidase
RDYARILNLNLRFYECQWSGKAPEHKQVYWRYDSALDDGADVGLDLTGGFYDAGDHVKFNLPMSYAMTMLAWGGIDLYDNYVAAGQLDYLLQMVNHGADYFVRCHPEKEVIYAQVGLGAIDHCFWVPPELMTMERPAACKLTPDNGASDVTAQMAAALASASILNKMYGNKEKAELYLKHAIEIYDFADKYRDVYNNPCPEGASFYPSASYKDELVWGAAWVYRASGDEKYYKKADEYYDSLALSGRNLIGPITWDDASSGIVFLMSKPGFGSNWERYLGEAQHYVDQYLNDMGARTDGGMLWYSSVSGWGSARHA

SEQ ID NO: 259 - protein, 441 aa, Anaeromyces robustus
  6hp_glycosidase
SQDYARHIELSLLFYEAQRSGKLPENNRIYWRFDSQLDAGADHGVDLTGGYYDAGDNVKFNFPAAAALTLLAWSGVDYADGYKKAGQWDYFLDAIRWGADYFMKCHTGKNELYFQVGDGKIDHTYWYPPEYTVYEHPSLKLTTSKPGSEVASDTASFLAATYMIFKDIDPTYAKKCLQHSKEIYEFADKYRGDYSKSFGNYVNDFYKNWGTINDELAFGALWLYRATGDESYLAKYKVIADASYDSRDESAYPNCSGPISWDDKRPGAYVLGAIVTGEDKYLDKAISYCDAVLTQPKTRGGLWYNNNLSKWGSNRYASNAASMLGMLANYLPKDHPKRSKYIDFVKSQTNYILGDNPAKVNFVVGAEKNSPKAVHHRGASGTYDSQDTNAKPTDHNVYTIWGALAGGPGKDDSYTDTRKNYEMNEVALDYNAAFQMNLALL

SEQ ID NO: 260 - protein, 35 aa, Anaeromyces robustus
  6hp_glycosidase
PGARDDYKDDRTNYNSNEVALDYNAAYTGLLAFLI

SEQ ID NO: 261 - protein, 433 aa, Anaeromyces robustus
  6hp_glycosidase
RDYARILNLNLRFYECNWSGKAPEHKQVYWRYDSALEDGADVGLDLTGGFYDAGDHVKFNLPMSYAMTMLAWGGIDLYENYVAAGQIDYLVQIVNHGADYFVKCHPEKEVIYAQVGLGDVDHCFWVPPELMEMERPAVCKLTPENGASDVTAQMAAALASASILNKKVGNTEKAELYLKHAIEIYDFADKYRDVYGNPCPEGASFYPSASYKDELVWGAAWVYRASGDEKYYDKADEYYDSLGLSGRVLIGPISWDDASSGIIFLMSKPGFGKNWERYLNEAQIYVDQYLNDKGSRTDAGMLWYSSVSGWGSARHAMAGVFLYCIFNTYHKPEDPKYFNFIQQQADYILGNNPFNRSLVVGSIPGHDPLNVHHRGSHGGYSPISPPEHNMYTLYGALAGGPLQDDSWDDDRNNYITNEVSCDYNAGITGVMAY

SEQ ID NO: 262 - protein, 315 aa, Anaeromyces robustus
  6hp_glycosidase
APDADARAIQAAYFGYIWAKEDGQDLSAVAAKAAKLGDYMRYAQYDKYFKKIGNCIGYNKCAAGSGKNSAHYLISWYFAWGGGLQGDWAWRISSSHTHSGYQNPLAAWVLSSEPAFKPKSSTGAEDWATSLDRQLELFRWLQSSEGCIAGGATNSWQGHYAQPDSSITTFYGMFYDWQPVYHDPPSNNWSGMQGWGMERVCSLYYLSGDERAGKVCQEWAKWVKKNVRVSNGEITHCTNIKWEGNPDEWNSSNFNKANLNASLHGTSSSEGTDLGTVASIIKGLLWVSLKDNDQEGIDLVIDVMDAMENYKDSLG

SEQ ID NO: 263 - protein, 19 aa, Anaeromyces robustus
  6hp_glycosidase
TYHRFWAQTEIMVANGILS

SEQ ID NO: 264 - protein, 15 aa, Anaeromyces robustus
  6hp_glycosidase
QELQQAYGNWDMYAM

SEQ ID NO: 265 - protein, 89 aa, Anaeromyces robustus
  6hp_glycosidase
RADDQYAKRATEHYNIITGNGSYSSKYFSSEKVPYHSVETLMVEAPDHGHESVSETYSFWIWLEAVNGKLTGNYEGVDTAWSYLEKHLI

SEQ ID NO: 266 - protein, 15 aa, Anaeromyces robustus
  6hp_glycosidase
KELQVTYGTWDMYSL

SEQ ID NO: 267 - protein, 316 aa, Anaeromyces robustus
  6hp_glycosidase
CPDADARAIQATYFAYLWAKEDGINLPYSIILRATRLGDYLRYSHYDKYFKKIGDCFNYKLCTPGSGKNSAHYLISWAYSWGGGIMGDWTWRRGSSYIHSGYQNPLVAWIFSTQSAFKLKSSTGNKDWSVSLDRQLEFMRWLQTPEGCIAGGATNSWEGQYNTPPQNITNFYGMYYDWQPVYHNPSSNNWIGMQARSIERVCSLYYLSGNQKAELICQTWVEWIKKNIQIHDYEIIHATKLTWEGNPDDWDSSSFYKSGINTSLHGTVFEMGFDLGSMASIVKSLLWVSMKDNDQEGLDLAIQIMDIIENYKDDLG

SEQ ID NO: 268 - protein, 95 aa, Anaeromyces robustus
  6hp_glycosidase
TNDEYAQRVIEQYEKLTNNGTYDTDYFSKDNYLPFYSIETLIVEEDNSFSRLDYGHLSTSETLSYWIWLEAVNGKITGNYEGVDWAWSVMEKFLI

SEQ ID NO: 269 - protein, 20 aa, Anaeromyces robustus
  6hp_glycosidase
FTYHRFWVQAEIMIANGLLS

SEQ ID NO: 270 - protein, 22 aa, Anaeromyces robustus
  6hp_glycosidase
FKYHRFWEQCEILLAQGLYSQY

SEQ ID NO: 271 - protein, 275 aa, Anaeromyces robustus
  6hp_glycosidase
VLNKITKMSDYMLYFINNDASLQSFNSDSTDENKNYLLSRYFSWKGSIHGKWLTKKIISNIIGIGSQNPFVAYILSNVKEFNSENPNSVNKWKKSYKRQIEFIRWLQSSEGAIVGNAKYPSNIDDINHKSSFYDLIFTSSNEEENDLFSTQCFVFESIAELYYITKDKDIEIILFKWLDWVLSVFHLTSDRSFRIPNKLSFEGHPEKWKPNTSIEDHENDNLNVIVEDYNNNIGVAASLSKILLLVGKKNNNDDYLTLGRDILEKIELINKDEYG

SEQ ID NO: 272 - protein, 428 aa, Anaeromyces robustus
  6hp_glycosidase
SQDYARHLELNFLFYEAQRSGHLPANNRIPWRSDSGLDHGADNGVDLTGGYYDAGDNVKFNFPQAFSMTAIAWYGLEFAKGVEMAGQTEYLKDTVKWGCDYLLKCHKKGTDVFYMQVGDGDIDHLYWKAVEDIDYPTPSFYVDSKNPGTEVTGETAAAFAAASLLFKESDPEYSATLLDQAVEWFNFANTYRFDYSVSVPKVASYYKSWGGYKDELAWAAIWLYKALGEEKYLELAKDLVKDYKLGELGFDWDSKYQSTIVILAQLGVKEYVEKVENWVREICTKGKLSPGGLYINKDSEWGSCRRATSMAASLIFYTHTLPEGNELREMAKKFAQSQADYVQGNNPLGIDFVVGADASSPRSVHHRTASGADCIECDPVENAHIIYGALAGGPDENDQYEDIRADYQKNEVALDYNVCYAAVCAYLI

SEQ ID NO: 273 - protein, 22 aa, Piromyces finnis
  6hp_glycosidase
FKYHRFWEQCEILLAQGLYSQY

SEQ ID NO: 274 - protein, 124 aa, Piromyces finnis
  6hp_glycosidase
EIYQNHYDKLNINNSSSIYYNADSIPYSTLETLYIDQNVDYGHLTTLKEISYKLWIEALQGKISGKWKPFVNAWNIFENNMIPKDESQKGNSKYYSTTNNSINTKDSLYKELYEQYQTWSLYLP

SEQ ID NO: 275 - protein, 309 aa, Piromyces finnis
  6hp_glycosidase
ISDSRYISKIIESVYRAYCWSTEQKKNKFMKPILKKIIKMSDYMLYFINSDDSLQSFDSESNEDNKNYLLSRYFSWKGSMEGKWLEKEVTTDIIGIGSQNPLIAYVLSNDKNFNSENPEFVSKWKKSYQRQIEFIRWLQSSEGAIVGVAQYPSNHNLSSKKMPSFYNLIFSKNFEVEENNLFGTQCYVFESLAELYYITKDKDIEIIITKWLDWVLSVFHLTSDRLFKIPNKLTFEGQPKDWNQKDGIKNHKNDKLNVIVEDYNNSIGVAASLSKILLLIGKKNNNEDYLTLGRDILERIEISSKDSQG

SEQ ID NO: 276 - protein, 441 aa, Piromyces finnis
  6hp_glycosidase
SQDYARHLELSLLFYEAQRSGKLPENNRIYWRHDSLVDAGADNGVDLSGGYYDAGDNAKFNFPGAATMTLLAWSGIDYAEGYKEAGQWKYLLDAVRWGADYFMKCHTGKNELYAQVGKGTTDHSYWYPPEYASYDHPSFKLTASAPGTEVSADTASFLAASYLLFKDEDPSYASKCLQHSKEIYDFADTYRGDYIGSIPDVSGFYSTWSGYNDELAFGALWLYRATGSESYMKKFEAIADAVYGAQDTKAYGTCTGPISWDDKRPGAYILAAIITGDEKRMKQASWYCDNVLTQPKTPGGLWYDANLSKWASNRYASNAAAMVAMYANYLPSSDSKRSKYVDFVKKQTDYILGDNPAKINYVVGAEANSPKAVHHRGASGTYDSQDTNAKPTDYNIFTLWGALAGGPGPDDEYTDSRKNYEMNEVALDYNAAFQMNLAFLT

SEQ ID NO: 277 - protein, 439 aa, Piromyces finnis
  6hp_glycosidase
SQDYARHLELSLLFYEAQRSGKLPENNRIYWRHDSLVDAGADNGVDLSGGYYDAGDNAKFNFPGAATMTLLAWSGIDYAEGYKSAGQWEYILDAVRWGADYFMKCHTGKNELYAQVGDGNTDHAFWYPPEYVKYDYPSFKVTAEKPGSEVAGETAAFLAAASILFKDEDSSYSAKLLKHAKEIYEFADTYRGDYTGAIPGVVSFYSTYSGYNDELAWGAAWLLRATGDESYLNKYNVIANKKYESYDPKKFSGATGPISWDDKRPGCYILIAMVTGDENRIKEAYNYCDAVLTQPKTPGGLWYDDGLSMWGSNRYASNAASMLAMFANYLPKSDPKRAKYVEFVQQQTNYILGDNPAKINYVVGAEANSPKAVHHRGSSGVFDSQDKAAKPDENIYTLWGALAGGPDETDSYIDTRSNFRTNEVALDYNAAFQMNLAFL

SEQ ID NO: 278 - protein, 441 aa, Piromyces finnis
  6hp_glycosidase
SQDYARHIELSLLFYEAQRSGKLPENNRVYWRHDSLLDAGADNGVDLTGGYYDAGDNVKFNFPGAAALTLLAWSGIDYADGYKEAGQWDYILDAVRWGADYFVKCHTGKNELYVQVGKGATDHGFWYPPEYVQYDHPSYKITAAAPGSEVAGDTASFLAAASILFKDIDSSYSSNLLKHAIEIYDFADSYRGEYIKAVPDAQGFYSNWSGYNDELAFGALWLYRATGESKYMDKFSKIADASYGEQDTKAYGTCTGPISWDDKRPGAYILAAIITGDEKRMKQASWYCDNVLTQPKTPGGLWYDANLSKWASNRYASNAAAMVAMYANYLPSSDSKRSKYVDFVKKQTDYILGDNPAKINYVVGAEANSPKAVHHRGASGTYDSQDTNAKPTDYNIFTLWGALAGGPGPDDEYTDSRKNYEMNEVALDYNAAFQMNLAFLT

SEQ ID NO: 279 - protein, 440 aa, Piromyces finnis
  6hp_glycosidase
SQDYARHLELSLLFYEAQRSGKLPENNRIYWRHDSLVDAGADNGVDLSGGYYDAGDNAKFNFPGAATMTLLAWSGIDYAEGYKEAGQWKYLLDAVRWGADYFMKCHTGKNELYAQVGKGTTDHSYWYPPEYASYDHPSFKLTASAPGTEVSADTASFLAASYLLFKDEDPSYASKCLQHSKEIYDFADTYRGDYIGSIPDVSGFYSTWSGYNDELAFGALWLYRATGSESYMKKFEAIADAVYGAQDTKAYGTCTGPISWDDKRPGAYILAAIITGDEKRMKQASWYCDNVLTQPKTPGGLWYDANLSKWASNRYASNAAAMVAMYANYLPSSDSKRSKYVDFVKKQTDYILGDNPAKINYVVGAEANSPKAVHHRGASGTYDSQDTNAKPTDYNIFTLWGALAGGPGPDDEYTDSRKNYEMNEVALDYNAAFQMNLAFL

SEQ ID NO: 280 - protein, 440 aa, Piromyces finnis
  6hp_glycosidase
SQDYARHLELSLLFYEAQRSGKLPENNRIYWRHDSLVDAGADNGVDLSGGYYDAGDNAKFNFPGAATMTLLAWSGIDYAEGYKSAGQWEYILDAVRWGADYFMKCHTGKNELYAQVGDGNTDHAFWYPPEYVKYDYPSFKVTAEKPGSEVAGETAAFLAAASILFKDEDSSYSAKLLKHAKEIYEFADTYRGDYTGAIPGVVSFYSTYSGYNDELAWGAAWLLRATGDESYLNKYNVIANKKYESYDPKKFSGATGPISWDDKRPGCYILIAMVTGDENRIKEAYNYCDAVLTQPKTPGGLWYDDGLSMWGSNRYASNAASMLAMFANYLPKSDPKRAKYVEFVQQQTNYILGDNPAKINYVVGAEANSPKAVHHRGSSGVFDSQDKAAKPDENIYTLWGALAGGPDETDSYIDTRSNFRTNEVALDYNAAFQMNLAFLT

SEQ ID NO: 281 - protein, 440 aa, Piromyces finnis
  6hp_glycosidase
SQDYARHIELSLLFYEAQRSGKLPENNRVYWRHDSLLDAGADNGVDLTGGYYDAGDNVKFNFPGAAALTLLAWSGIDYADGYKEAGQWDYILDAVRWGADYFVKCHTGKNELYVQVGKGATDHGFWYPPEYVQYDHPSYKITAAAPGSEVAGDTASFLAAASILFKDIDSSYSSNLLKHAIEIYDFADSYRGEYIKAVPDAQGFYSNWSGYNDELAFGALWLYRATGESKYMDKFSKIADASYGEQDTKAYGTCTGPISWDDKRPGAYILAAIITGDEKRMKQASWYCDNVLTQPKTPGGLWYDANLSKWASNRYASNAAAMVAMYANYLPSSDSKRSKYVDFVKKQTDYILGDNPAKINYVVGAEANSPKAVHHRGASGTYDSQDTNAKPTDYNIFTLWGALAGGPGPDDEYTDSRKNYEMNEVALDYNAAFQMNLAFL

SEQ ID NO: 282 - protein, 436 aa, Piromyces finnis
  6hp_glycosidase
SQDYARHLELSILFYEAQRSGKLPANNRIFWRHDSMVDAGKDNKVDLTGGYYDAGDNVKFNFPQASALTLLAWGAYKWKDGYKEAGQWDYMKDLLKWGMDYFIRCHTDKYVLYGQVGNGSLDHGAWVAPEDIDYEYPSYKITASAPGSDLAAETSASMVAASLAFRDEDPTYADTLLKHGRELYEFAEKYQGTYDKSITDAKGYYRSYSGFNDELVWGAAMLYAATGEQTYKDKVDKIWNTPYGELDPDRFLGSTGPISWDDKKAAAYALMAITTGESKYIEESTRHSDLMVNYPTTPGGLWYDTNLSMWASNRYAANAAFTVAMLATSMDANDSKRKEYVAFVKKQIDYILGDNPAKVDYVVGADPSSPKAVHHRGASGSKGADKGPDENVFILYGALAGGPGAKDNYKDARNNYEMNEVALDYNAAFQGLLAFL

SEQ ID NO: 283 - protein, 304 aa, Piromyces finnis
  6hp_glycosidase
SLKLTTGAPGSEVAGDTASFLAATYIIFKDIDPSYAKKCLQHSKEIYEFADTYRGDYSKSFGDYVNSFYKNWGTIYDELAFGALWLYRATNDESYLKKYKAIADASYDTRDENAYGNCKGPISWDDKRPGGYVLGAIVTGEEKYIEKALSYCDMVLTQPRTPGGLWYDSNLSKWGSNRYASNAASMVAMMADFLPKDDARRAKYVDFVKSQTDYILGDNPAGVNYVVGAEENSPKAVHHRAASGTYDSQDRNAKPNDHNVYTIWGALAGGPAKDDSYEDTRKNYEMNEVALDYNAAFQMNLAFL

SEQ ID NO: 284 - protein, 41 aa, Piromyces finnis
  6hp_glycosidase
GALAGGPDANDKYTDDRTNYNSNEVALDYNAAYTGLLAFLI

SEQ ID NO: 285 - protein, 41 aa, Piromyces finnis
  6hp_glycosidase
GALAGGPDGNDKYTDDRTNYNSNEVALDYNAAYTGLLAFLI

SEQ ID NO: 286 - protein, 398 aa, Piromyces finnis
  6hp_glycosidase
RDYARILNLNLRFYECQWSGKAPENKQVYWRYDSALEDGADVGLDLTGGFYDAGDHVKFNLPMSYAMTMLAWGGIDLYDNYVAAGQIDYLIQMVNHAADYFVRCHPEKEVIYAQVGLGDVDHCFWVPPELMEMERPAVCKLTPENGASDVTAQMAAALASASILNKKYGNEEKAELYLKHAIEIYDFADKYRDVYGNPCPEGASFYPSASYKDELVWGAAWVYRASGDEKYYEKADSYYDSLGLSGRVLIGPISWDDASSGIIFLMSKPGFGSNWKRYLGEAQTYVDQYLNDKSARTDAGMLWYSAVSGWGSARHAMAGTFLYCIFNTYHNPTDPKYFNFIQQQADYILGNNPFDRSLVVGSIPGHDPLNVHHRGSHGGYSPISPPEHNMYTLYGALA

SEQ ID NO: 287 - protein, 398 aa, Piromyces finnis
  6hp_glycosidase
RDYARILNLNLRFYECNWSGKAPEHKQVYWRYDSALEDGADVGLDLTGGYYDAGDHVKFNLPMSYAMTMLAWGGIDLYDNYVAAGQIDYLVQIVNHGADYFVKCHPEKEVIYAQVGLGDVDHCFWVPPELMEMERPAVCKLTPENGASDVTAQMAAALASASILNKKYGNEEKAELYLKHAIEIYDFADKYRDVYGNPCPEGASFYPSASYKDELVWGAAWVYRASGDEKYYEKADSYYDSLGLSGRVLIGPISWDDASSGIIFLMSKPGFGSNWKRYLGEAQTYVDQYLNDKSARTDAGMLWYSAVSGWGSARHAMAGTFLYCIFNTYHNPTDPKYFNFIQQQADYILGNNPFDRSLVVGSIPGHDPLNVHHRGSHGGYSPISPPEHNMYTLYGALA

SEQ ID NO: 288 - protein, 114 aa, Piromyces finnis
  6hp_glycosidase
SMYYLSGNEKAGLVCKNWAQWVKDTTRVNGGEVIHATNLGWDGNPDEWKASNFNKSGLNKSLHGTVTSEGLDLGSIASIMKGLMWVSMKDGDEEGLSLAVSVMDAIENYKDDLG

SEQ ID NO: 289 - protein, 19 aa, Piromyces finnis
  6hp_glycosidase
TYHRFWGQTEIMVANGLIA

SEQ ID NO: 290 - protein, 89 aa, Piromyces finnis
  6hp_glycosidase
RASDEYGRRVTDLYDVMTGNGSYSSEYFSAEKVPYHSVETLMVEAPDHGHESVSETFSFWIWLEAVNGKITGNYDGVEEAWNYLEKHII

SEQ ID NO: 291 - protein, 19 aa, Piromyces finnis
  6hp_glycosidase
TYHRFWGQTEIMVANGLIA

SEQ ID NO: 292 - protein, 315 aa, Piromyces finnis
  6hp_glycosidase
APDADARAVQAAYFAYIWAEEDGVNLSSVAAKAAKLGDYLRYAQYDKYFKKIGNCVGSDKCSAGRGKNSAHYLISWYFAWGGGLQGDWAWRIGSSHTHSGYQNPLAAWILSTQAAFKPKSSTGAKDWATSMDRQLELFRWLQTPEGCIAGGATNSWQGSYAQPSSDITTFYGMWYDWQPVYHDPPSNNWTGMQGWGMERVCSLYYVSGDERAGKVCQEWAKWVKDTTRVSGGEIVHATNLDWSGNPDEWNSSNFNKSNLNRSLHGTVSSEGVDLGSIASIIKGLMWVSMRDGDQEGINLSIEVMDAIENYKDDLG

SEQ ID NO: 293 - protein, 15 aa, Piromyces finnis
  6hp_glycosidase
KELSQAYGNWDIYIM

SEQ ID NO: 294 - protein, 89 aa, Piromyces finnis; identical to SEQ ID NO: 290
  6hp_glycosidase

SEQ ID NO: 295 - protein, 15 aa, Piromyces finnis
  6hp_glycosidase
KELSQAYGNWDIYIM

SEQ ID NO: 296 - protein, 315 aa, Piromyces finnis; identical to SEQ ID NO: 292
  6hp_glycosidase

SEQ ID NO: 297 - protein, 19 aa, Piromyces finnis
  6hp_glycosidase
NYHRFWAQTEIAVANGLIS

SEQ ID NO: 298 - protein, 114 aa, Piromyces finnis; identical to SEQ ID NO: 288
  6hp_glycosidase

SEQ ID NO: 299 - protein, 19 aa, Piromyces finnis
  6hp_glycosidase
NYHRFWAQTEIAVANGLIS

SEQ ID NO: 300 - protein, 372 aa, Piromyces finnis
  6hp_glycosidase
GAYYTGDYTSPFKTYLGKTDEEIQKKLDELWNHYFKGDNNSKVFYDQGNEGYILDVNNNDVRSEGMSYGMMIAVQTDHQKEFDKLWNWAKNHMWHKSGSWDGYFAWKRGSNGSGGDDNCAPDGEMYFMMSLLFAANRWNDKKYMDDAQYILKRMWDNSQHSLFNPAYNVITFQPQGNENNFSDPSYDLPAFVDLFSRWSTTNQNKWKAAASATRDHLYKSSNPQSGLFSDYNNFDGTPHSVSYNSNAQKYMYDAMRCAMNFGMDYYLFGTDAKRQTEMAKRIINHFEKDGYQHARFNWDGTGGSEQYTLGETGANAVATYALMGIAGYEDIIKKNLKMAWDGKPMTGQYRYYDGLVHYLSMLHLLGSFKIWK

SEQ ID NO: 301 - protein, 114 aa, Piromyces finnis; identical to SEQ ID NO: 288
  6hp_glycosidase

SEQ ID NO: 302 - protein, 19 aa, Piromyces finnis
  6hp_glycosidase
TYHRFWGQTEIMVANGLIS

SEQ ID NO: 303 - protein, 89 aa, Piromyces finnis; identical to SEQ ID NO: 290
  6hp_glycosidase

SEQ ID NO: 304 - protein, 19 aa, Piromyces finnis
  6hp_glycosidase
TYHRFWGQTEIMVANGLIS

SEQ ID NO: 305 - protein, 15 aa, Piromyces finnis
  6hp_glycosidase
KELSQAYGNWDIYIM

SEQ ID NO: 306 - protein, 315 aa, Piromyces finnis; identical to SEQ ID NO: 292
  6hp_glycosidase

SEQ ID NO: 307 - protein, 114 aa, Piromyces finnis; identical to SEQ ID NO: 288
  6hp_glycosidase

SEQ ID NO: 308 - protein, 19 aa, Piromyces finnis
  6hp_glycosidase
NYHRFWAQTEIAVANGLIS

SEQ ID NO: 309 - protein, 19 aa, Piromyces finnis
  6hp_glycosidase
NYHRFWAQTEIAVANGLIS

SEQ ID NO: 310 - protein, 15 aa, Piromyces finnis
  6hp_glycosidase
KELSQAYGNWDIYIM

SEQ ID NO: 311 - protein, 89 aa, Piromyces finnis; identical to SEQ ID NO: 290
  6hp_glycosidase

SEQ ID NO: 312 - protein, 315 aa, Piromyces finnis; identical to SEQ ID NO: 292
  6hp_glycosidase

SEQ ID NO: 313 - protein, 372 aa, Piromyces finnis; identical to SEQ ID NO: 300
  6hp_glycosidase

SEQ ID NO: 314 - protein, 282 aa, Piromyces finnis
  6hp_glycosidase
HHMWHKSGSWDGYFAWKRGSNGSGGDDNCAPDGEMYFMMSLLFAANRWNDKKYMDDAQYILKRMWDNSQHSLFNPAYNVITFQPQGNENNFSDPSYDLPAFVDLFSRWSTTNQNKWKAAASATRDHLYKSSNPQSGLFSDYNNFDGTPHSVSYNSNAQKYMYDAMRCAMNFGMDYYLFGTDAKRQTEMAKRIINHFEKDGYQHARFNWDGTGGSEQYTLGETGANAVATYALMGIAGYEDIIKKNLKMAWDGKPMTGQYRYYDGLVHYLSMLHLLGSFKIWK

SEQ ID NO: 315 - protein, 15 aa, Piromyces finnis
  6hp_glycosidase
KELSQAYGNWDIYIM

SEQ ID NO: 316 - protein, 20 aa, Piromyces finnis
  6hp_glycosidase
LTGDYSGVETAWSYIEKHMI

SEQ ID NO: 317 - protein, 315 aa, Piromyces finnis
  6hp_glycosidase
APDADARAVQAAYFAYIWAEEDGVNLSSVAAKAAKLGDYLRYAQYDKYFKKIGNCVGSDKCSAGRGKNSAHYLISWYFAWGGGLQGDWAWRIGSSHTHSGYQNPLAAWILSTQAAFKPKSSTGAKDWATSLDRQLELFRWLQTPEGCIAGGATNSWQGSYAQPSSDITTFYGMWYDWQPVYHDPPSNNWTGMQGWGMERVCSLYYVSGDERAGKVCQEWAKWVKDTTRVSGGEIVHATNLDWSGNPDEWNSSNFNKSNLNRSLHGTVSSEGVDLGSIASIIKGLMWVSMRDGDQEGINLSIEVMDAIENYKDDLG

SEQ ID NO: 318 - protein, 19 aa, Piromyces finnis
  6hp_glycosidase
NYHRFWAQTEIAVANGLIS

SEQ ID NO: 319 - protein, 89 aa, Piromyces finnis; identical to SEQ ID NO: 290
  6hp_glycosidase

SEQ ID NO: 320 - protein, 19 aa, Piromyces finnis
  6hp_glycosidase
NYHRFWAQTEIAVANGLIS

SEQ ID NO: 321 - protein, 15 aa, Piromyces finnis
  6hp_glycosidase
KELSQAYGNWDIYIM

SEQ ID NO: 322 - protein, 315 aa, Piromyces finnis; identical to SEQ ID NO: 317
  6hp_glycosidase

SEQ ID NO: 323 - protein, 273 aa, Neocallimastix californiae
  9-O-ACETYL-N-ACETYLNEURAMINIC ACID DEACETYLASE-RELATED
FAIAAFVATTLSAISQTFAAPDPNFHIYLAFGQSNMEGQGPIGSQDRTVDKRFQMISTVSGCNGRQMGNWYDAIPPLANCDGKLGPVDYFGRTLVKNLPQEIKVGVAVVAVAGCDIQLFEKNNYRNYRLESYMQGRVNAYGGNPYGRLIEVAKKAQQVGVIKGILLHQGETNTGQQNWPNRVKAIYEDMLKDLGLNAKDVPLLAGEVVQSNQGGQCGSMNSIIQRLPSVIPTAHVISSQGLGQQGDGLHFSSQAYRTFGERYANEMLKILGDV

SEQ ID NO: 324 - protein, 257 aa, Neocallimastix californiae
  9-O-ACETYL-N-ACETYLNEURAMINIC ACID DEACETYLASE-RELATED
TVAAPDPNFHIYLAFGQSNMEGQGPIEPQDRIPEKRYQVLSTFGNCDGREVGKWYDAVPPLARCFARVGPMDYFGRTLAKKLPEEIKIGAVIVAVGGCSIQLFEKDNYMNYKLENYMVDVVKNYGGNPYKRLIDVAKLAQKDGVIKGILLHQGESNNGQTNWPYRVKAVYENILNDLGLKAEEVPLLAGEVVQTSEGGQCGGMNKIINTLPNVIPTAHVVSSVGLKQQGDGYHFSTEAYREFGERYAEEMLKILGDV

SEQ ID NO: 325 - protein, 277 aa, Neocallimastix californiae
  9-O-ACETYL-N-ACETYLNEURAMINIC ACID DEACETYLASE-RELATED
MRGNIAITTILATAFTLVSKTWAAPDPNFHIYLAFGQSNMQGDGKIENQDRVVDKRFKMLATAGGCNNRRVGEWYDAIPPLANCAGGLGPVDYFGRTLLKKLPEQIKVGVAVVAVAGCDIQLFEKDNYRSYNMPDWMVGIVNGYNGNPYGRLIEMGKKAKEAGVIKGILLHQGETNTGQQDWPDRVKKIYQNIINDLSLNADEVPLLVGEVVNADSGGACAYHNEVIKRVPQLIKNSYVISSKGLPQKGDGLHFTSAGYRTFGERFADTMLKILGNV

SEQ ID NO: 326 - protein, 277 aa, Neocallimastix californiae
  9-O-ACETYL-N-ACETYLNEURAMINIC ACID DEACETYLASE-RELATED
MRVTLSISTLLISAISLITKTCAAPDPNFHIYLAFGQSNMQGAGQIANQDKTVDKRFQMLATAGGCNNRQVGNWYDAIPPLAHCGGGLGPVDYFGRNLIKNLPSQIKVGVVVVAVAGCDIQLFEKDNYRSYNMADWMKSIVNSYGGNPYGRLVEMGKKAQQAGVIKGILFHQGETNSGQQNWPNRVKGIYDNLIKDLGLKASEVPLLAGELVSSAKGGVCGGHNSIIQRLPQVIPNAHVISSSGLDQQGDGLHFTSAAYRTFGQRFAETMLKLLGDV

SEQ ID NO: 327 - protein, 277 aa, Neocallimastix californiae
  9-O-ACETYL-N-ACETYLNEURAMINIC ACID DEACETYLASE-RELATED
MRANIAITAILTTALSFVSKTWAAPDPNFHIYLAFGQSNMQGAGQIENQDKTVDKRFQMIATAAGCNNRRVGEWYDAIPPLAHCGGGLGPVDYFGRTLVKKLPEQIKVGVAVVAVAGCDIQLFEKNNYRSYNMADWMKGIVDSYGGNPYGRLIDMGKKAQQVGVIKGILLHQGETNNGQSDWPNRVKAIYEDILKDLSLKAEEVPLLVGETVDSDSGGVCGYHNSVIARIPQVIKNGHVISSKGLGQQGDGLHFTSAAYRTFGERYADTMLKLLGNV

SEQ ID NO: 328 - protein, 277 aa, Neocallimastix californiae
  9-O-ACETYL-N-ACETYLNEURAMINIC ACID DEACETYLASE-RELATED
MRANIAIATFLATSLSFVSKAFAAPDPNFHIYLAFGQSNMEGNGPIESQDRTVDKRFKMLATVSGCNNRQAGNWYDATPPLANCNGKLGPVDYFGRTLVKKLPQEIRIGAVVVAVAGCDIQLFEKDKYRSYQQPDWMRGIVQQYGGNPYGRLIEMAKKAQQEGIIKGILLHQGETNTGQQDWPNRVKGIYENILNDLGLKAEDVPLLAGEVVSSAVGGQCGSHNAVIQRLPSVIKTAHVISSQGLQHQGDGLHFTSAAYRTFGERYAEEMLKILGDV

SEQ ID NO: 329 - protein, 277 aa, Anaeromyces robustus; identical to SEQ ID NO: 327
  9-O-ACETYL-N-ACETYLNEURAMINIC ACID DEACETYLASE-RELATED

SEQ ID NO: 330 - protein, 277 aa, Anaeromyces robustus; identical to SEQ ID NO: 328
  9-O-ACETYL-N-ACETYLNEURAMINIC ACID DEACETYLASE-RELATED

SEQ ID NO: 331 - protein, 259 aa, Anaeromyces robustus
  9-O-ACETYL-N-ACETYLNEURAMINIC ACID DEACETYLASE-RELATED
SKTFAAPDPNFHIYLAFGQSNMYGSGDIEEQDKTVDSRFQMVSTVNDCGSRKLGTWYDAIPPLATCDAGLGPADYFGRTLVETLPKEIKVGIAVVAVPGCDIQLFEKDNYQNYFPDDWMYPFIDEYGGNPYGRLVEMGKQAKELGVIKGILLHQGETNNEQTDWPLRVKAIYENLLTDLELKAEEVPILIGELVQLSENGTCGAMNAIIQTVPSVIPTAHVISSEGLKQRGDGFHFTSPSYRVFGQRYAEVMLDLLKDT

SEQ ID NO: 332 - protein, 272 aa, Anaeromyces robustus
  9-O-ACETYL-N-ACETYLNEURAMINIC ACID DEACETYLASE-RELATED
AIAIAAFVASTLSAISFAAPDPNFHIYLAFGQSNMEGQGPIGQQDRSVDKRFQMISTVNGCNGRRLGEWYDAVPPLSSCSGKLGPVDYFGRTLVKKLPQEIKVGVAVVAIAGCDIQLFEKNNYRNYQLQSYMVNTVNAYGGNPYGRLIEMGKKAQQVGVIKGILLHQGETNTGQQNWPNRVKAIYEDILKDLGLNAKDVPLLAGEVVSSQQGGQCGSMNSIIQSLPRTIPTAHVISSQGLGQQGDGLHFSSDAYRTFGQRYAEEMLKILGDV

SEQ ID NO: 333 - protein, 261 aa, Anaeromyces robustus
  9-O-ACETYL-N-ACETYLNEURAMINIC ACID DEACETYLASE-RELATED
ISQVFTAPDPNFHIYLAFGQSNMEGRGKIYQEDKTVDSRFQMIATVDGCKGRKFGEWNDAIPPLSNCNMGQLGPADYFGRTLVKKLPHEIKIGIAVVAIGDCDIQLFEKTKNRNYRIPNEIKNTYEAYGRNSYSRLIEMGKKAQEVGVIRGILLHHGENNIGQTDWPNRVKAIYDNILNDLDLNSDDVPLLAGEVVSSEKGGKYGEMNPIIHNLAKICSTCHIISSQNLDSEDDGFHFTTNAYRTLGERYAEEMLKIHNYN

SEQ ID NO: 334 - protein, 1177 aa, Neocallimastix californiae
  AAC-RICH MRNA CLONE AAC4 PROTEIN-RELATED
SINSNTNNIMDNSGNCWATYLDKNYTCCSNDNIEIKSINMDGEWGLENNNWCGLRNSKVHWNDRESIDETRQQWNIFKNKWDNEYKTNFERLSVFVGEDESKLNFGWYSTHQETPVIRFGSKQDMSDAKEFMGNSEFHRELKGIRYFSNKVTVDGIKRKSTYYYQRKLNSQWEETIQFDTHDPENFNFIFLGDPQIGGSNSRHSALDPTRPLTVEEGTRNDAFNWNRTITNSFQFTREPSVIMTAGDQADSMCIDSNLDEIYNQETQYSAFLLPELMQKIPTATTVGNHDSFTTNYRNHFNPPNTYTTPEYVMANGFSGVIPGYSYFFKYNNVLVVVLETNYNNCNDFENVINKAIEKYPYTDWRIAMFHHDIYGDGYIHSTEDYITKYLRPCLTGIFTDKKFDLVINGHDHVYTASHFISYTGAYNNGGYSFSHIEKNKVYRDPKGTLYITANCSSGSKLYTFVDDNLEPDYVNFSNQTFTATFGVLDFKKENGISRLSVASYEVETFNLTDGPYIFEKNSVVEGSDKVSDGGGNKVLKWVIIIVVADIIILLFLYFFFARGYFKEKRENHGKRISSSSTSFYSHGYPTHLNNNNNDNNNNNNNNNTNHFNYNNHSNVSSYINNTNNPMMMNDLTTLPHSLPTPSLGNSLYPLNQSRNQNQSQNQSQSQSQNQNQNQSQSQIQNQSEIQIPISDDFPNVSVRTNSLQEISSANATHNNSISISSIKDNRNSFKQQKNFFDAGGNAELNQDLYLLTLNKLRNNKFVGYVNPLDRQQQQQQQKQKQQQQQQQSLQNRSPSLPQSKSNSIESTPLKSKSYDMYPSSMIRSTIAHPSRSFDLPPTKSYIARPFRSFDLQPSETIASPIVKSSSFNQTNFSKSFESDEPLNVSSLGENEQDNHLILDPNMPSGVVLTKDDDDDDLSKKMGISSHSKIIEEPDISLGIVDETDLSINHGKQNISNIDGFQAMKDIDISLSSVGRGDEEEEEEEVSLEVGHIIEPSFNFEVKNQQQPISQSSSGLISSPTLTDQVVNSSKYLLNNNNNNNNNNNNNNNNNSNNNNNNNNNNNTNNNSIPPSRTSFGLKRANPLYLNIPSNKLNSGNIPMASSSTTKNYLNLKHNQITDQTQAHMNVTSPRKTSFNTESEEANKNNSNTKKINLNYFNEKDINKVKITKDNVDN

SEQ ID NO: 335 - protein, 298 aa, Neocallimastix californiae
  AB_hydrolase
TFEKIMFGEKPRNPDKVEGRKSGNKYTVTVTNKGNTASFDVTISNAGTAAKPKPAIIGLDQGFGMGGSLGASTNGLDVASITFNTNNLAPENNPRSGAFFKANPSSNAGTIMAWAWGVSRLIDALEKDSSVGIDVKHLAVTGCSRLGKAALAIGAFDERIALTIPQESGSGGASLWRVGAQVNRQKGKQFVQGLGSAATEGNWMISSFRNYDGRETTLPFDQHMLTGMVAPRALLIIDNAGQEWLGEVPSNYCGQATKEIFDALGATDKYTYTQEGGHMHCSLPNGQFDEVKDFVNKF

SEQ ID NO: 336 - protein, 193 aa, Neocallimastix californiae
  AB_hydrolase
TFEKIMFGEKPRNPDKVEGRKSGNKYTVTVTNKGSTASFDVTISNAGTAAKPKPAIIGLDQGFGMGGSLGASTNGLDVASITFNTNNLAPENNPRSGAFFKANPSSNAGTIMAWAWGVSRLIDALEKDSSAGIDVKHLAVTGCSRLGKAALAIGAFDERIALTIPQESGSGGASLWRVGAQVNRQKGKQFVQG

SEQ ID NO: 337 - protein, 208 aa, Neocallimastix californiae
  AB_hydrolase
TTQKQPQTTQKVQPTQAQVVDCSGKTLKSNTNLSIGGRKVIVKFPNGYRGDKPTPLLINYHPIMGSASQWEGGSQTAKAALNDGAIVAFMDGAQGPMGQAWNVGPCCTDADDVKFTRDFIKEITNKACVDPKRIYAAGFSMGGGMSNYAGCYLSDVIAAAAPSAFDLAKEIVDAGKCKPSRPFPILNFRGTSDQIVMYNGGLSQVVPG

SEQ ID NO: 338 - protein, 15 aa, Neocallimastix californiae
  AB_hydrolase
GVKVGLCTINGGGHN

SEQ ID NO: 339 - protein, 15 aa, Neocallimastix californiae
  AB_hydrolase
RFPVRWCTQSGGHQW

SEQ ID NO: 340 - protein, 169 aa, Neocallimastix californiae
  AB_hydrolase
PWSGGRRKVIIDLPDNYDKNKPYRLIFGMQCMGGSSDNVRSEGYYGLKPLDTGKTSIFVAPEGNGQQLPWGEADYRLFDELLDKLKEDLCIDESRVFSTGFSYGSMYSNGLSWNHQKVLRGVAVYETAERNIWLPKHTGEPIAWMGVLGFDDGLCTPEMGRHARDIILE

SEQ ID NO: 341 - protein, 132 aa, Neocallimastix californiae
  AB_hydrolase
GSFEFSWSGGRRTVRIDIPNNYNNQNPYRLVFGMHCMGGWAGGVQQEGYYGLKPLDTGKTTIFVAPEGNGNVAPWGQGDYKLFDELLEKMKNDLCIDESRVFSTGFSYGSMFSNGLSWDHQKVLRGVAVYET

SEQ ID NO: 342 - protein, 271 aa, Neocallimastix californiae
  AB_hydrolase
TDDGLTEEQRGSVEHVEYESHDYVTGDETEVYNKPAWVYLPAGYDANDKDTKYPLVILMHGYGMTEDSWGLTDKSSGGRIKSMMDRGMAKSKDEEDYVEKFILVVPTGLASKDYRNNNDYNYTDPWYAFGGELRNDLIPFMRSKYNIKDGRENVAMAGLSMGAEETLNLGIGECLDLISYFGAFSFPFGETMIEKAEKAFPDKSLTIKTLYTICGDNDSIAYDKYGDAVEKMSKWDRVEDGKFKSEIYVGGTHDFPVWFRGFEHFIPLLFK

SEQ ID NO: 343 - protein, 180 aa, Neocallimastix californiae
  AB_hydrolase
SNTNLTINGRKVIVKFPSGFSGDKAAPLLINYHPIMGSASQWEGGSQTAKAALSDGAIVAFMDGAQGPMGQAWNVGPCCTDADDVQFTRDFIKEITSKACVDPKRIYAAGFSMGGGMSNYAGCFLSDVIAAAAPSAFDLAKEIVDAGKCKPTRAFPILNFRGTQDNIVMYNGGLSQVVQG

SEQ ID NO: 344 - protein, 15 aa, Neocallimastix californiae
  AB_hydrolase
GAKVGLCTINGGGHS

SEQ ID NO: 345 - protein, 15 aa, Neocallimastix californiae
  AB_hydrolase
GAKVGLCTINGGSHS

SEQ ID NO: 346 - protein, 182 aa, Neocallimastix californiae
  AB_hydrolase
LKSNTNLTINGRKVIVKFPSGYTGNEATPLLINYHPIGGSASQWEGGSQTAKAALSDGAIVAFMDGAQGPMGQAWNVGPCCTDADDVQFTRNFIKEITSKACVDPKRIYAAGFSMGGGMSNYAGCYLADVIAAAAPSAFDLAKEVVDAGKCKPARPFPILNFRGTQDPIVMYNGGLSQVVQG

SEQ ID NO: 347 - protein, 203 aa, Neocallimastix californiae
  AB_hydrolase
GSLTLTSKITVPSGNGPFPVIIGMNSATGSLGSNLFSGFIQVPFMHDQCATYSMNGQKNTNAPFYKMYPNLKQAGDYIAWSWGVSRLIDGLEQVKSQIHADMAHIGVTGCSYAGKMALFAGAFDERIALTIPQESGGGGINAWRVSDTIGNVEKIDNTNYSWFMQALKNNFGSNKAGKLPYDHHEAIAMIAPRAVFAMGNPDY

SEQ ID NO: 348 - protein, 173 aa, Neocallimastix californiae
  AB_hydrolase
PDVAFYEQEGISYGTLQRITYYSENTKSNRPMNILLPPNYNPEKKYPILYLLHGILSDQNSLIKSKYGTPNIAGYLMNKGMAKEMIIAYPYTYAPKDGIEVEPGFTKEHAAGYDNFINELLFNIMPYMEKNYPILTGRDNTAIAGFSMGGRNSLYIGYSKPELFGYIGAFSPA

SEQ ID NO: 349 - protein, 263 aa, Neocallimastix californiae
  AB_hydrolase
SYKDAPGNYLNPCQQAGRIVKESYSGINGGNSLNVYLPYGYDKNKQYNIFYLMHGGGENENTIFSNDVKLQNIIDHLIMNGELEPLIIVTPTFNKCEARTFYKEFRESVIPFVEGKYSTYAKSVSPSDIKASRMHRAFGGFSMGSASTWAVLVNCLDIVAYYMPLSGDNWEANGGYGKAKSVADAINRAGLKSNEFFIFCATGSEDIAYPNMNPQMDEMKKMQPFIYTSDFSKGNFYYLVAPGKTHWWGYVKHYIYDALPSFF

SEQ ID NO: 350 - protein, 18 aa, Neocallimastix californiae
  AB_hydrolase
RFPVRWCTQSGGHIWDHK

SEQ ID NO: 351 - protein, 175 aa, Neocallimastix californiae
  AB_hydrolase
TGSFEFNWSGGKRTVRIDIPNNYDNKHPYRLVFGMHCMGGWAGGVQQEGYYGLKPLDTGKTTIFVAPEGNGQQAPWGQADYQLFDQLLEKLKNDLCIDESRVFSTGFSYGSMFSNGLSWNHQKVLRGVAVYETAERNIWLPKHTGEPIAWMGVLGLDDGLCTPEMGRKARDIILE

SEQ ID NO: 352 - protein, 132 aa, Neocallimastix californiae
  AB_hydrolase
GEFNFNWSGGSRKVLIDIPQNYDSSHPYRLVFGMQCMGGSAGNVRNEGYYGLKPLDTGKTTIFVAPEGNGQQLPWGEADYKLFDELLEKLKGDLCIDESRVFSTGFSYGSMFSNGLSWNHQKVLRGVAVYET

SEQ ID NO: 353 - protein, 271 aa, Neocallimastix californiae
  AB_hydrolase
CPPEFLERKDGVEYPAIENISYYSTTTQSERPLVVVLPPNYNEKKKYPVVYILHGIMTDGSFMLQEGFGTVTIPGNLFHKHMAKEFIMVLPNQYAPAPGTEVEPNLNEEYFAGYNNFINDLVNDIMPYMKKHYSIATGKKNTAICGYSFGGRNSLYIGLKRPDLFGYVGSFSPAPGILPGDDVFTGHHNGLFKEEKDVVFAGKPPYLTMISCGTNDTVVGTFPKSYHEALTHNNQQHIWYEMTGLDHADDAAINSPYYNFFSSIFGQVNKK

SEQ ID NO: 354 - protein, 247 aa, Neocallimastix californiae
  AB_hydrolase
GGTCSGKTLKSNTTLNIGGRKVIVKFPSGYSGDKNVPLLINYHPIGGSATQWEGGSQTAKAALNDGAIVAFMDGAQGPMGQAWNVGPCCTDADDVQFTRDFIKEITSQACVDTNRIYAAGFSMGGGMSNYSGCMLADVIAAAAPSAFDLSKEIVDSGKCKPSRPFPILNFRDTQDNVVMYEGGLSQVVPGKAITFLGAKNNFKEWAKMNGCTGEPKMNTPGNNCEMYENCSGGAKVGLCTINGGGHS

SEQ ID NO: 355 - protein, 131 aa, Neocallimastix californiae
  AB_hydrolase
SFEFNWSGGRRTVRIDIPNNYNNQNPYRLVFGMHCMGCWAGGVQQEGYFGLKPLDTGKTTIFVAPEGNGNQAPWGQGDYKLFDELLSKLKNDLCIDESRVFSTGFSYGAMFSNGLSWDHQKDLRAVAVYET

SEQ ID NO: 356 - protein, 134 aa, Neocallimastix californiae
  AB_hydrolase
TGSFDFQWSGGKRTVRIDVPDNYNNKNPYRLVFGMHCMGGWAGGVQQEGYYGLKPLDTGKTTIFVAPEGNGNQAPWGEGDYKLFDELLEKLKGEFCIDESRVFSTGFSYGSMFSNGLSWNHQKVLRGVAVYETA

SEQ ID NO: 357 - protein, 272 aa, Neocallimastix californiae
  AB_hydrolase
FCPEEFLQKKEGVEYPTVKNLTYYSTTTKSERPLHVLLPPSYDGKKKFPVVYLLHGVMTNGEFMLQEGFGTIAIPGNLFHKHMAKEFIMVLPDQYAPAPGTEVEPNLNEEYFAGYNNFINDLVNDIMPYMKKNYRIFTGKKNTAICGYSFGGRNSLYIGLMRPDLFGFVGAFSPAPGILPAEDMFTHHNGLFKEEKDVVFQGKPPYLTMISCGTNDFVVGTFPKSYHEALEHNHQEHIWYEMTGLDHGDNESVTSPLYNFFSSIFGQLDEKK

SEQ ID NO: 358 - protein, 266 aa, Neocallimastix californiae
  AB_hydrolase
NITDNCPDVAFNAQENITYGTLQRITYYSSNTKTDRPMNILLPPNYDPENKKYPVLYLLHGILSDQNSLIKPKYSTPNIAGYLMHEGLAKEMIIVFPYTYAPKDGIEVEPGFTEEHYAGYNNFINELLDVIMPYMNENYPILTGRDNTAIAGFSMGGRNSLYIGYTKPELFGYIGAFSPAPGVLPEEGKKGLLTEETFRIEDKQYTPYVTLVCTGTEDDVVAEYPSIYHGVLTNNEQPHLWYEVPTGGHDGITVSSGVYNFMQTLF

SEQ ID NO: 359 - protein, 16 aa, Neocallimastix californiae
  AB_hydrolase
RFPVRWCTQSGGHIWD

SEQ ID NO: 360 - protein, 174 aa, Neocallimastix californiae
  AB_hydrolase
GSFEFNWSGGKRTVRIDIPDNYDNKKAYRLVFGMHCMGGWAGGVQQEGYYGLKPLDTGKTTIFVAPEGNGQQAPWGQADYQLFDQLLEKLKNDLCIDESRVFSTGFSYGSMFSNGLSWNHQKVLRGVAVYETAERNIWLPKHTGEPIAWMGVLGLDDNLCTPEMGRKARDIILE

SEQ ID NO: 361 - protein, 269 aa, Neocallimastix californiae
  AB_hydrolase
DDGLSDSDRGTVQHIEYPTHDYMTNDENDTYNKPAWVYLPAGYDPEDKDTKYPLFILMHGFGQTEDNWGLTDQGSGGKIKGMMDRGMAKPKDEEGSVEKFILVVPTGMATRNYRENGNYDYTEPYYRFGGELRNDLIPYMKKNYNIKEGRENMAMAGLSMGGFQTLYIGIGECLDIMSYFGFFSYPFTDDLKEKIETNFPEKDLTIKRLYTICGDNDPTPFSDFYNYVDVLSKWDKVEDGNFSYEVYPGGTHDFPVWYRGFEHFIPQLF

SEQ ID NO: 362 - protein, 260 aa, Neocallimastix californiae
  AB_hydrolase
DAPGNYLNSCPQAGRIVKEYYNGINGNNALNVYLPYGYDSKKQYNIFYLMHGGGENENTIFSNDVKLQPIIDNMIMNGELEPLIIVTPTFNKCEARTFYKELRESVIPFVEGKYSTYAKSTSPSDIRASRMHRAFGGFSMGSASTWAVFVNCLDIVAYYMPLSGDNWEANGGYGKAKNVADAVSRFGIKSNEFFIFCATGSEDIAYPNMNPQMDEMKKMQPFIYTSDFSKGNFYYLVAPGKTHWWGYVKHYIYDALPSFF

SEQ ID NO: 363 - protein, 265 aa, Neocallimastix californiae
  AB_hydrolase
AMSYRDAPGNYLQPCQQAGRIVKEYYNGINGSNSLNVYLPYGYNSNQQYNIFYLMHGGGENENTIFGSDVYLQYIIDHLIMNGELEPLIIVTPTFNKCEAQTFYKEFRSSVIPFVEGKYSTYAKSTSESDIRASRMHRAYGGFSMGSVSTWAVLINCLDIVGYFMPLSGDCWEANDAYGKAKAVADAINRSGLRSNEYFIFCATGSDDIAYPNVTPQIEQMKKMSQFIYTSDFSKGNFYYLVAPGKTHWWGYVKHYIYDALPSFF

SEQ ID NO: 364 - protein, 260 aa, Neocallimastix californiae
  AB_hydrolase
GSLTLTSKLSVPSGSGPFPVIIGMNSGTGSLGGNLFSGFIQVPFNHDQCAQYSMNGQKNTNAPFYRMYPNLKQAGDYIAWSWGVSRLIDGLEKVKDQIHADLSHIGVTGCSYAGKMALFAGAFDERIALTIPQESGGGGINAWRVSDTIGNVEKIDNTNYSWFMQALKNNFGSNRAGKLPYDHHEAIAMIAPRAFFTMGNPDYEWLGDKSGYTSAMAAYEVWKAMGVEDRFGFNIVGGHMHCSAAGSQNNDVSKFIDKFL

SEQ ID NO: 365 - protein, 175 aa, Neocallimastix californiae
  AB_hydrolase
TGSFDFQWSGGKRTVRIDVPDNYNNNNPYRLIFGMHCMGGWAGGVQQEGYYGLKPLDTGKTSIFVAPEGNGNQAPWGQGDYQLFDQLLDKLKNEFCIDESRVFSTGFSYGSMFSNGLSWNHQKVLRGVAVYETAERNIWLPKHTGEPIAWMGVLGLDDGLCTPEMGRHARDIILE

SEQ ID NO: 366 - protein, 15 aa, Neocallimastix californiae
  AB_hydrolase
RFPVRWCTQSGGHIW

SEQ ID NO: 367 - protein, 245 aa, Neocallimastix californiae
  AB_hydrolase
TQQEGLPDFTIYRPENLKEAVDAEGRLPVILFGNGGCGRISFSYGNFLTELASYGYVVAAVGPWVGEDNTDYLSLSLDFSEETINGFKADANSLIDVALSWLEKENKERTSIFYKTLNTNKVSAMGQSCGGLQALIISTKNDKRIKTTVALNSGANSPGDLLDSLIVKDELQKLTQPIIYIIGGEEDIAHYNALDDFSLIKKVPVAVACKADAGHMGTYSEPNGGTFGKMTLAWLDYILKNDKSH

SEQ ID NO: 368 - protein, 264 aa, Neocallimastix californiae
  AB_hydrolase
QILNSCPMEARTKQDGVKYPTSEKITYHSNTTGTDRQMNIILPVDYDGTKKYPVVYYLHGIFGNEDSMLDETAIALPVNLYNEGKAKEAIFVLPNTYAPPPGKEVVPDFNQDYFDGYDNFINELIDDIMPYVEQNYSVLTGKENTGLCGFSMGGRNSLYIGYKRPDLFGYVGAFSPAPGVTPGDDFSGHHPGLFQESEFRTDVPPFVTLVSCGTNDSVVGTFPKSYHEILTTNGQEHIWFEVPGADHDDKAIAAGLYNYLSTAF

SEQ ID NO: 369 - protein, 268 aa, Neocallimastix californiae
  AB_hydrolase
PEYLEMKEGVEYPKVENITYYSTTTESKRPLIVVLPPNYSKSKKYPVLYLLHGIMTDGSFMLQEGFGTITIPGNLIHEHKAKELIMVLPNQYAPAPGTEVEPALNEKYFAGYNNFINDLINDIMPYMKKNYSIATGKENTAIAGYSFGGRNSLYIALQRPDLFGFVGAFSPAPGLLPADDIFSGHHIGLYQEEKEIHYTGEAPYLTMISCGTNDTVVGTFPESYHNAFAKNNEDHVWYQITGADHIDNVSVTSPVYNFIKSIFGQLNE

SEQ ID NO: 370 - protein, 258 aa, Neocallimastix californiae
  AB_hydrolase
VRREGVAYGEAEKITYFSTTAQMDRKMNVILPAGYTEDKKYPVLYYLHGLSGNEDSLLAKERATIEIYGNLVSEGKAKEMIIVLPDCYVPLDGVFDRPQFSPEYLKAYDNFLYELIDDVMPYIESHYSVALGRENTALAGFSQGGRNTIYIGYKHPELFGYLGAFSPAQGIFPCYDIMAGHQPGLMKPEELQADAEVQPIVSMITVGTKDFAVQKNPKLYHEALATNGQPHIWFTVPGALHDDLACTTGYYNFLSTLW

SEQ ID NO: 371 - protein, 257 aa, Neocallimastix californiae
  AB_hydrolase
QAKAFRGIMYAQPEKVTYFSNTTHTERQMNIILPPDYSKEKKYPVLYYLHDLLSDENGLLEKSIGTLEIYSNLVNLGKAKDMIIVLPNCIVPADGAKIEPGNSEEYNAAYDNFINELLQDVMPFIESNYSVDSGRENTAIAGFGQGGRSSLYIGYKHPELFGYLGAFSPTQGLLPYNKEQGLMKPEELQVEDAELQPIVTMITVGAKDTEAQESAKLYHETLASNEQPHIWFTVPDALHDSDACSASYYNFISTLWK

SEQ ID NO: 372 - protein, 182 aa, Neocallimastix californiae
  AB_hydrolase
LKSNTNLNINGRKVIVKFPSGFSGNKAVPLLINYHPIGGSASQWEGGSQTARAALSDGAIVAFMDGAQGPMGQAWNVGPCCTDADDVQFTRNFIKEITSKACVDPKRIYAAGFSMGGGMSNYAGCFLSDVIAASAPSAFDLAKEIVDAGKCKPSRPFPILNFRGTQDPIVMYNGGLSQVVQG

SEQ ID NO: 373 - protein, 15 aa, Neocallimastix californiae
  AB_hydrolase
GVKVGLCTINGGGHS

SEQ ID NO: 374 - protein, 270 aa, Neocallimastix californiae
  AB_hydrolase
TDDGLTDKDRGTVSHIEYPTHDYMTDDENDKYNKPAWVYLPAGYDPEDKNTKYPLVILMHGFGQNEDNWGLTDQGTGGKIKGMMDRGMAKAKDEEGSVEKFVLIVPTGMASKDFRDNNNYGNTEPWYKFGNEIRNDIIPYMRSHYNIKEGRENVAMAGLSMGGMQTLNLGIGECLDLISYFGAFSFPFGADIFEKTETNFPDKNLTIKGLYTICGDADAGAFAGYGPAVEAFEKWDRIDEGKFKSEIYPGGTHDFPVWYRGFEHLIPLLF

SEQ ID NO: 375 - protein, 201 aa, Neocallimastix californiae
  AB_hydrolase
GSLTLTSKISVPNGNGPFPVIIGMNSNTGSLSTNQFSGFIQVPFMHDQCAQYSMNGQKNTNSPFYKLYPNLKQAGDYIAWSWGVSRLIDGLEQVKSQIHADMEHIGVTGCSYAGKMALFAGAFDERIALTIPQESGGGGINSWRVSDTIGNVEKIANTNYSWFMQALKNNFNGKASKLPYDHHELVAMIAPRAFFTLGNPD

SEQ ID NO: 376 - protein, 261 aa, Neocallimastix californiae
  AB_hydrolase
KEAPGNYLQRCQQAGKIVKENYNGINGGNTLNVYLPYGYDKNKQYNIFYLMHGGGENENTIFSNDVNLHNILDNMIMKGELEPLIVVTPNFNKCDARTFYKELRESVIPFVEGKYSTYAKSTSPADIKASRMHRAFGGFSMGSASTWAVLINCLDIVAYYMPLSGDNWEANGGYAKAKSVADAIDKSGLQKNQYFIFCATGSEDIAYNNMNPQIDEMKKMSQFVYTSDFSKGNFYYLVAQGKTHWWGYVRHYIYDALPSFF

SEQ ID NO: 377 - protein, 173 aa, Neocallimastix californiae
  AB_hydrolase
SFEFNWSGGRRTVRIDIPDNYDNKNPYRLIFGMHCMGGWAGGVQQEGYYGLKPLDTGKTTIFVAPEGNGNQAPWGQGDYTLFDELLEKLTNDLCIDVSRVFSTGFSYGSMFSNGLSWNHQKVLRGVAVYETAERNIWLPKNTGEPIAWMGVLGLDDGLCTPEMGRNARDIILK

SEQ ID NO: 378 - protein, 16 aa, Neocallimastix californiae
  AB_hydrolase
RFPVRWCTQSGGHIWD

SEQ ID NO: 379 - protein, 15 aa, Neocallimastix californiae
  AB_hydrolase
GAKVGLCTINGGGHA

SEQ ID NO: 380 - protein, 201 aa, Neocallimastix californiae
  AB_hydrolase
TTTPKPQPTQEVVDCSGKTLRSNTNLSIGGRKVIVKFPSGYKGDKPVPLLINYHPIMGSASQWENGSQTAKAALSDGAIVAFMDGAQGNMGQAWNVGPCCTDADDISFTRNFIKEITNKACVDPKRIYAAGFSMGGGMSNYVGCYLADVIAAAAPSAFDLAKEVVDGGKCKPSRPFPILNFRGTQDNIVMYNGGLSQVVPG

SEQ ID NO: 381 - protein, 264 aa, Neocallimastix californiae
  AB_hydrolase
YRDAPGNYLNSCPQAGRIIKESYNGINGGNSLNVYLPYGYDKNKQYNIFYLMHGGGENENTIFSRDVNLQPIIDNLIMNGELEPLIIVTPTFNKCEARTFYREFRESVIPFVEGKYSTYAKSTSANDIKASRMHRAFGGFSMGSASTWAVLVNCIDIVGYFMPLSGDNWEADGGYGKAKSVADAINRAGFKKDEFYIFAATGSEDIAYPNMNPQMDEMKKMDPFVYTSDFSKGNFYYLVAPGKTHWWGYVKHYIYDALPSFFHE

SEQ ID NO: 382 - protein, 263 aa, Neocallimastix californiae
  AB_hydrolase
SYRDAPNNYLNRCQQAGRIVKESYNGVNGGNSLNVYLPYGYTDSKQYNIFYLMHGGGENENTIFGSDVYLQYILDNLIMNGELEPLIVVTPTFNRCEAGTFYREFRESVVPFVEGKYSTYAKSTSAADLKASRMHRAYGGFSMGSVSTWAVLINCLDYVGYFMPLSGDNWVGNGGYGKAKSVADAIDKFGYRTDEYFIFCATGSDDIAYPNMNPQIDEMKKMKQFIYTSDFSQGNFYYLVAPGKTHWWGYVKHYIYDALPYFF

SEQ ID NO: 383 - protein, 258 aa, Neocallimastix californiae
  AB_hydrolase
NDKAEGVTVEKKSYYSNITKGYRKLNVVLPPNYSTEKKYPVLYLLHGIYGDEDSMLNNGMGTLNVPANLAKENKAKEMIIVLPNEVALLPGTDPNITKNFSLEHLKVYDNFINELLNNIMPFIEYEYSVATGRDNTAIAGFSMGGRTALYIGYTRPDLFGYVAGFSPAWGLTPGGMDILPGVFPRDEDFKIQNPSEYTPYVTLISTGTADGVVEDYPASYHEILEKNQQNHIWIEIEGADHDESAVIVGLYNFVATLF

SEQ ID NO: 384 - protein, 191 aa, Neocallimastix californiae
  AB_hydrolase
IKGFMDRGMASGDVGRFILVCVTGVASRNWGPNGAGNDVNGFNAFKGELRDDIIPYMRSKFNIKSGRDNVALAGLSMGGGQTFNIGIAECLDLISNFAGFSGAMFSGADEFKRNVDNKREFNGLKIHNLYMTCGDKDDLVYSSFPGYVRSMKSWSRVENFKDYTYPGGTHDFPVWYKGFNDFIHMIFPEMR

SEQ ID NO: 385 - protein, 273 aa, Neocallimastix californiae
  AB_hydrolase
LSGNTLTVTVNDNGGSLTLTSKISVPSGNGPFPIIIGMNSNTGSLSAGQFNGFIQVPFNHDQCAKYSMDGRKDTNAPFYRMYPNLRQAGDYIAWSWGVSRLIDGLEQVKNQIHADLEHIGVTGCSYAGKMALFAGAFDERIALTIPQESGGGGINSWRVSDTIGNVEKIDNTNYSWFMQALKNNFGNGKATRLPYDHHEAIAMIAPRAFFTMGNPDYEWLGDKSGYTSAMAAYEVWKAMGVEDRFGFNFIGNHMHCSAASSQTNDVNKFIDRF

SEQ ID NO: 386 - protein, 43 aa, Neocallimastix californiae
  AB_hydrolase
PEAKIQKSGVTYSKAEKITYHSYSTNVDRKMNIILPANYTTEK

SEQ ID NO: 387 - protein, 16 aa, Anaeromyces robustus
  AB_hydrolase
RFPVRWCTQSGGHIWD

SEQ ID NO: 388 - protein, 173 aa, Anaeromyces robustus; identical to SEQ ID NO: 377
  AB_hydrolase

SEQ ID NO: 389 - protein, 15 aa, Anaeromyces robustus
  AB_hydrolase
GAKVGLCTINGGGHA

SEQ ID NO: 390 - protein, 201 aa, Anaeromyces robustus; identical to SEQ ID NO: 380
  AB_hydrolase

SEQ ID NO: 391 - protein, 264 aa, Anaeromyces robustus; identical to SEQ ID NO: 381
  AB_hydrolase

SEQ ID NO: 392 - protein, 263 aa, Anaeromyces robustus; identical to SEQ ID NO: 382
  AB_hydrolase

SEQ ID NO: 393 - protein, 181 aa, Anaeromyces robustus
  AB_hydrolase
SPGIKTGSFQFQWGGRKNRLVHIDLPNNYDNNHPYRLVFGMQCMGGSGANVRNEQYYGLKPLDTGKTTIFVAPEGNGQQLPWGQEDYQLFDELLEKLKTDLCIDESRVFSTGFSYGSMFSNGLAWDHQKVLRGVAVYETAAVNIWLPKNTGLPIAWMGVLGFDDGLCTPQMGRQARDVILK

SEQ ID NO: 394 - protein, 17 aa, Anaeromyces robustus
  AB_hydrolase
RFPVKWCTQSGGHQWEH

SEQ ID NO: 395 - protein, 31 aa, Anaeromyces robustus
  AB_hydrolase
DQGVYIKHLKLVGRGHSPSKADIGDIWNFVK

SEQ ID NO: 396 - protein, 172 aa, Anaeromyces robustus
  AB_hydrolase
QKSINDYKRVQVSGRDIHVYAPSNLAAKSPLLLSLHGMDQDPNYQQSNTHWETLADTEGFVVVYPRGGTGMSTWDIQGDKDTKWVLQIIDQMAKDYDIDRNRVYLSGFSMGGMFTYHAMSKIGDKIAAFAPCSGPNVFGASKAMRPVPIFHVHGTNDDVLNYNQVEGFLKNY

SEQ ID NO: 397 - protein, 276 aa, Anaeromyces robustus
  AB_hydrolase
AEDKPFDDGLTDSQRGTVVEINYPTRDYTVDQSRAQKYNKHGWVYLPAGYDADDKNTQYPLFVLLHGFGQNENTWGLSNKGRGGKIKGFMDRGMASGDVGRFILVCVTGVASRNWGPNGAGNDVNGFNAFKGELRDDIIPYMRSKFNIKSGRDNVALAGLSMGGGQTFNIGIAECLDLISNFAGFSGAMFSGADEFKRNVDNKREFNGLKIHNLYMTCGDKDDLVYSSFPGYVRSMKSWSRVENFKDYTYPGGTHDFPVWYKGFNDFIHMIFPEMR

SEQ ID NO: 398 - protein, 15 aa, Anaeromyces robustus
  AB_hydrolase
GAKVGLCTINGGGHS

SEQ ID NO: 399 - protein, 208 aa, Anaeromyces robustus
  AB_hydrolase
PAPRTTTTTTPKPQPTQEVVDCSGKTLRSNTNLSIGGRKVIVKFPNGYKGDKPVPLLINYHPIMGSASQWESGSQTAKAALNDGAIVAFMDGAQGNMGQAWNVGPCCTDADDVSFTRNFIKEITNKACVDPKRIYAAGFSMGGGMSNYAGCYLADVIAAAAPSAFDLAKEVVDGGKCKPSRPFPILNFRGTADNVVSYNGGLSQVVPG

SEQ ID NO: 400 - protein, 272 aa, Anaeromyces robustus
  AB_hydrolase
SGNTLTVTVNDNGGSLTLTSKISVPSGNGPFPIIIGMNSNTGSLSAGQFNGFIQVPFNHDQCAKYSMDGRKDTNAPFYRMYPNLRQAGDYIAWSWGVSRLIDGLEQVKNQIHADLEHIGVTGCSYAGKMALFAGAFDERIALTIPQESGGGGINSWRVSDTIGNVEKIDNTNYSWFMQALKNNFGNGKATRLPYDHHEAIAMIAPRAFFTMGNPDYEWLGDKSGYTSAMAAYEVWKAMGVEDRFGFNFIGNHMHCSAASSQTNDVNKFIDRF

SEQ ID NO: 401 - protein, 272 aa, Anaeromyces robustus; identical to SEQ ID NO: 400
  AB_hydrolase

SEQ ID NO: 402 - protein, 15 aa, Anaeromyces robustus
  AB_hydrolase
GVKVGLCTINGGGHS

SEQ ID NO: 403 - protein, 177 aa, Anaeromyces robustus
  AB_hydrolase
TLSIGGRKVIVKFPNGFSGDKPAPLLINYHPIMGSASQWESGSQTAKAALNDGAIVAFMDGAQGPMGQAWNVGPCCTDADDVSFTRNFIKEITSKACVDPKRIYAAGFSMGGGMSNYAGCFLADVIAAAAPSAFDLAKEIVDGGKCKPARAFPILNFRGTQDNVVAYNGGLSQVVQG

SEQ ID NO: 404 - protein, 268 aa, Anaeromyces robustus
  AB_hydrolase
NPAIQFKEAPGNYLQRCQQAGKIVKESYNGINGRNSLNVYLPYGYDEKKQYNIFYLMHGGSENENTIFNNEVQLNNILDNMIMKGELEPLIVVTPTFNRCECRTFYKEFRESVIPFVEGKYSTYAKSTSAADIKASRMHRGFGGFSMGSASTWAVFINCLDICAYYMPLSGENWEADGAYMKAKTVADAVDKLGLKKNQYFIFCATGSEDIAYPNMNPMMNEMKKMSQFVYTSDFSKGNFYYLVANGKTHWWGYVRHYIYDALPSFFH

SEQ ID NO: 405 - protein, 16 aa, Anaeromyces robustus
  AB_hydrolase
KFPVRWCTQSGGHQWE

SEQ ID NO: 406 - protein, 181 aa, Anaeromyces robustus
  AB_hydrolase
SPGLKTGSFQLKWGGNKNRLVHIDIPDNYNNSKPYRLVFGMQCMGGSGANVRNEQYYGLKPLDTGKTTIFVAPEGNGQQLPWGQEDYQLFDDLLEKLKNDLCIDESRVFSTGFSYGSMFSNGLSWNHQKVLRGVAVYETAERNIWLPQNTGLGIGWMGVLGFDDNLCTPEMGRKARDIILK

SEQ ID NO: 407 - protein, 265 aa, Anaeromyces robustus
  AB_hydrolase
FMQYRDAPGDYLRDCPQPGKIIKEYYNGINGANSLNVYLPYGYDKNKQYNIFYLMHGGGENENTIFSVDVHLQPIIDHLIMNGELEPLIIVTPTFNKCEARTFYKEFRESVIPFVEGKYSTYAKSTSPADIRASRMHRAYGGFSMGSASTWAVLINCLDIVGYFMPLSGDNWEANGGYGKAKSVADAINRAGLKKNEFFIFCATGSDDIAYPNMNPQMDEMKKMEPFVYTSDFSKGNFYYLVAPGKTHWWGFVKHYIYDALPSFF

SEQ ID NO: 408 - protein, 15 aa, Anaeromyces robustus
  AB_hydrolase
GSKVGLCTINGGGHS

SEQ ID NO: 409 - protein, 197 aa, Anaeromyces robustus
  AB_hydrolase
TQTNSPSVVDCSGKTLKSNTNLSIGGRKVIVKFPNGFKGDKPVPLLINYHPIMGSASQWENGSQTARAALNDGAIVAFMDGAQGPMGQAWNVGPCCTDADDVSYTRNFIKEITSKACVDPKRIYAAGFSMGGGMSNYAGCYLADVIAAAAPSAFDLAKEIVDAGKCKPARPFPILNFRGTQDNIVMYNGGLSQVVQG

SEQ ID NO: 410 - protein, 250 aa, Anaeromyces robustus
  AB_hydrolase
ISSKQQGVNYPSAKKVTYHSKTTNNDRKMNVILPIGYTESKKYPVLYLLHGIMGNEDSMLSTNMGSITIPTNLLREGKAKEMIIVLPNEYAPEGGKEVPAGINQAYFEGYDNFINDLIGSIMPYMEKNYSVATGRENTAIAGFSMGGRNSLYIGYKRSDLFGYIGAFSPAPGVVPGLFRNENQFRTDQPPIVSLISCGTDDSVVGTNPKNYHNVLTKNNQDHIWFEVPGADHDAKAVTAGYYNFIQTCFG

SEQ ID NO: 411 - protein, 204 aa, Anaeromyces robustus
  AB_hydrolase
GSATLTSKLNVPSGNGPFPIIIGMNSGTGSLSASQFSGFIQVPFNHDQCAKYSMNGQKDTNAQFYKMYPNLKQAGDYIAWSWGVSRLIDGLEQVKDQIHADISHIGVTGCSYAGKMALFAGALDERVALTIAQESGGGGINSWRVSDTIGNVEKIDNTNYSWFMQALKNNFGNGKATKLPYDHHELVAMIAPRAFFTLGNPDYE

SEQ ID NO: 412 - protein, 16 aa, Anaeromyces robustus
  AB_hydrolase
GAKVGLCTINGGGHDE

SEQ ID NO: 413 - protein, 175 aa, Anaeromyces robustus
  AB_hydrolase
NINGRKVLVRFPNGYKGDKPVPLLINYHPISGSAAAWEYGSQTARAALNDGAVVAYMDGAVGPGGQAWNVGPCCTDADDVQYTRDFIKEITSKACVDPKRIYAAGFSMGGGMSNYAGCKLADVIAAAAPSAFDLSKEVVQSGQCTPARPFPILNFRGTSDFVVPYSGGYSNAVAG

SEQ ID NO: 414 - protein, 135 aa, Anaeromyces robustus
  AB_hydrolase
DEYRKKQEGIEYPTPQKITYYSKVTESERKMNVILPVGYDENKKYPVVYFLHGLMSDEDGMLGDESTIAIPTNLIKEGKAKEMIMVLPDIYAPVPGTAVEPNYDPEYYKGYDNFINELTEVIMPYMEEHYPILTG

SEQ ID NO: 415 - protein, 265 aa, Anaeromyces robustus
  AB_hydrolase
TCPDEYRKKQEGIEYPTPQKITYYSKVTESERKMNVILPVGYDENKKYPVVYFLHGLMSDEDGMLGDESTIAIPTNLIKEGKAKEMIMVLPDIYAPVPGTAVEPNYDPEYYKGYDNFINELTEVIMPYMEEHYPILTGRENTAICGFSMGARTSLYIGYMKSDLIGYTGAFAPAPGITPGEDSFSGKHPGLITEDEFRAEIPPIVSLIDCGTNDSVVGQFPKSYHEILTRNGQEHIWFEVPYADHDWNAISAGLYNFLQTTFDAL

SEQ ID NO: 416 - protein, 262 aa, Anaeromyces robustus
  AB_hydrolase
CPDVAFNQQENITYGELQRITYYSENTKSDRPMNILLPPNYDPDNKKYPVLYLLHGILSDQNSLIKPKYSTPNIAGYLMNEGLAKEMIIVYPYTYAPKDGIEVEPGFSEEHAAGYNNFINELLYNIMPYMEKNYPILTGRDNTAIAGFSMGGRNSFYIGLNKPELFGYIGAFSPAPGVLPEEGKTSLFPSEDDFLVKDKQLTPYVTLVCTGTDDDVVAEYPIHYHNVFTKNNHPHLWYEVPTGGHDGITVSSGVYNFLQTLF

SEQ ID NO: 417 - protein, 132 aa, Anaeromyces robustus
  AB_hydrolase
SFEFNWSGGKRTVRIDLPDNYDNKKPYRLVFGMQCAGGWAGGVQQEGYYGLKPLDTGKTTIFIAPEGNGQQLPWGEADYKLFDELLDKLTNDLCIDISRVFSTGFSYGAMFSNGLSWNHQKVLRGVAVYETA

SEQ ID NO: 418 - protein, 257 aa, Anaeromyces robustus
  AB_hydrolase
PANFRYKQNNIQYPSPQKITYFSSNTNSERKMNIILPVGYDESKKYPIVYFLHGIFGDEDSMLDESTIAIPTNLLKEGKAKEFIMVLPSEYAPTPGNEVEPGFSQKYFDGYDNFINELVDVIMPYMEQNYPILTGKDNTALCGFSMGGRNSLYIAYKRSDLFGYVGAFSPAPGVTPGDDFSGHHPGLFTEEQFRSDDPPYVTLISCGTNDSVVHEFPKSYHEILTRNNQKHIWFEVPGADHNEDAISAGLYNFVQTI

SEQ ID NO: 419 - protein, 183 aa, Anaeromyces robustus
  AB_hydrolase
FCPAEFVERKEGVEYPSINQLTYYSTTTESERPLIVLLPPNYTETKKYPVLYLLHGIMGTGMFMLQEGFGTVAIPGNLYAKNMAKEMIIVLPDQYAPAPGTEVEPDLNEEYFAGYNNFINDLINDIMPFLEKNYSIATGRENTALCGYSFGGRNSLYIGLKRPDLFGYIGAFSPAPGLVPGDD

SEQ ID NO: 420 - protein, 268 aa, Piromyces finnis
  AB_hydrolase
YVANMQFKEAPYNYQQPCQQAGRIIKESYNGVNGGNTLNVYLPYGYDKNKQYNIFYLMHGGGENENTIFSDDVKLQNILDHQIMNGELEPLIVVTPTFNKCEARTFYKEFRESVIPFVEGKYSTYAKSTSASDIKASRMHRAYGGFSMGSASTWAVLVNCLDICAYYMPLSGDNWEANGGYGKAKSIADAVNRFGLKKNEFFIFCATGSEDIAYPNMNPQMDEMKKMDPFVYTSDFSKGNFYYLVAPGKTHWWGYVKHYIYDALPSFF

SEQ ID NO: 421 - protein, 262 aa, Piromyces finnis
  AB_hydrolase
SCPKDAISERPGVQYPTAKKIYYFSKITQSYRPLNVILPVGYTESKQYPVLYLLHGIMCNEDSMLEAEMGSLTIPTNLFNDGRAKEMIIVLPYEYAPEAGKEVEAAFNQAYFDGYDNFINELTDVIMPYVKANYSIKTGRENTAICGFSMGGRNSLYIGFKRSDLFGYVGAFSPAPGVTPGTDSSGYHKGLFTEDSFRAEISPIVALINCGTSDSVVGQFPKSYHEILTRNNQEHIWFEVQGADHNGVAVSAGFYNFILAAF

SEQ ID NO: 422 - protein, 132 aa, Piromyces finnis
  AB_hydrolase
SFEFKWGNNKRTVRIDIPDNYDKSKPYRLVFGMHCMGGWAGGVQQEGYYGLKPLDTGKTTIFVAPEGNGQQLPWGEADYYMFDELLAKLKGDLCIDESRVFSTGFSYGSMFSNGLSWNHQKVLRGVAVYETA

SEQ ID NO: 423 - protein, 143 aa, Piromyces finnis
  AB_hydrolase
PSKGCGKSLSLPKTGSFEFSWSGGRRTVRIDIPDNYNNNNPYRLIFGMHCMGGWAGGVQQEGYYGLKPLDTGKTTIFVAPEGNGQQLPWGEADYYMFDELLAKLKGDLCIDESRVFSTGFSYGSMFSNGLSWNHQKVLRGVAV

SEQ ID NO: 424 - protein, 156 aa, Piromyces finnis
  AB_hydrolase
SFEFKWGNNKRTVRIDIPDNYDKSKPYRLVFGMHCMGGWAGGVQQEGYYGLKPLDTGKTTIFVAPEGNGQQLPWGEADYYMFDELLAKLKGDLCIDESRVFSTGFSYGSMFSNGLSWNHQKVLRGVAVYETAERNIWLPKHTGEPIGWMGVLGFDD

SEQ ID NO: 425 - protein, 62 aa, Piromyces finnis
  AB_hydrolase
NPALQFKEAPYDYQNPCQQAGKIVKESYNGINGGNTLNVYLPYGYDKNKQYNIFYLMHGGGE

SEQ ID NO: 426 - protein, 200 aa, Piromyces finnis
  AB_hydrolase
TTQKPQQTQNVVDCSGKTLKSNTNLTINGRKVIVKFPNGYKGDKAVPLLINYHPIMGSASQWEGGSQTAKAALNDGAIVAFMDGAQGPMGQAWNVGPCCTDADDVTYTRNFIKEITQKACVDPKRIYAAGFSMGGGMSNYAGCYLSDVIAAAAPSAFDLAKEIVDSGKCKPSRPFPILNFRGTSDNVVMYNGGLSQVVPG

SEQ ID NO: 427 - protein, 15 aa, Piromyces finnis
  AB_hydrolase
GVKVGLCTINGGGHS

SEQ ID NO: 428 - protein, 200 aa, Piromyces finnis; identical to SEQ ID NO: 426
  AB_hydrolase

SEQ ID NO: 429 - protein, 15 aa, Piromyces finnis
  AB_hydrolase
GVKVGLCTINGGGHN

SEQ ID NO: 430 - protein, 199 aa, Piromyces finnis
  AB_hydrolase
TQKPQQTQNVVDCSGKTLKSNTNLTINGRKVIVKFPNGYKGDKAVPLLINYHPIMGSASQWEGGSQTAKAALNDGAIVAFMDGAQGPMGQAWNVGPCCTDADDVTYTRNFIKEITQKACVDPKRIYAAGFSMGGGMSNYAGCYLSDVIAAAAPSAFDLAKEIVDSGKCKPSRPFPILNFRGTSDNVVMYNGGLSQVVPG

SEQ ID NO: 431 - protein, 16 aa, Piromyces finnis
  AB_hydrolase
GVKVGLCTINGGGHSE

SEQ ID NO: 432 - protein, 16 aa, Piromyces finnis
  AB_hydrolase
GVKVGLCTINGGGHSE

SEQ ID NO: 433 - protein, 200 aa, Piromyces finnis; identical to SEQ ID NO: 426
  AB_hydrolase

SEQ ID NO: 434 - protein, 216 aa, Piromyces finnis
  AB_hydrolase
AEWECRRNEIKAEIENYELGKKPAPPTNIKASYSGGTLTVTVNDNGGSLTLTSKISVPSGNGPFPIIIGMNSNTGSLSASQFNGFIQVPFNHDQCAQYSMSGQKNTNSPFYKLYPNLKQAGDYIAWSWGISRLIDGLEQVKNQIHADMEHIGVTGCSYAGKMALFGGAFDERIALTIPQESGGGGINSWRVSDTIGNVEKIDNTNYSWFMQALKNN

SEQ ID NO: 435 - protein, 257 aa, Piromyces finnis
  AB_hydrolase
EGVTKEKVYYYSSFSQSQRPLNVILPPNYSTDKKYPVLYLLHGVAANEDIMVEEYNGALNIPPNLAKQGKAKEMIIVSPRVNIYPPGVDEVEFAFSTEYLSGFDNFINDLIDSIMPFIETHYSVLTGRNNTAIAGFSMGGRTALYIGYSKPELFGYVCGLSPAFGLTPIEGSSVYHSLFPSEEDVKIRNVNKTPYVTLISWGNIDTVVNPYPFIYHKVLTNNNQPHLYMEVIGANHDEIAITHGLYNFVMTLFGQLD

SEQ ID NO: 436 - protein, 260 aa, Piromyces finnis
  AB_hydrolase
IKKGVNYPTVDSLTYYSTTTETNRTLTVLVPPNYSPKKKYPVLYLLHGIMTDGAWMIQDGFGTIAIPGNLAHQKKAKEMFIVLPDQYAPSPGTEVEPALNQEFFNGYDNFINDLVNDIMPFMKKQYSIKTDRKNTAISGYSFGGRNSLYIGITRSDLFGYVGSFSPAPGLVPGDDIFTGHFDGLYQEKELKFKHQPYLTMLSCGTNDTVVFDFPKQYHEILKTNKQEHIWYEITGHDHMDNESFSSPYHNFLTSIFDQVN

SEQ ID NO: 437 - protein, 79 aa, Piromyces finnis
  AB_hydrolase
EGVTKEKVYYYSSFSQSQRPLNVILPPNYSTDKKYPVLYLLHGVAANEDIMVEEYNGALNIPPNLAKQGKAKEMIIVSP

SEQ ID NO: 438 - protein, 66 aa, Neocallimastix californiae
  AB_hydrolase
TNESNIKIRSKLLMFSGKQDKIIDENNAALWKKEVSDEYSEFTQHIRMRGNHWFMMKNTAKYLKNI

SEQ ID NO: 439 - protein, 115 aa, Neocallimastix californiae
  AB_hydrolase
FIFFPSADEGEIDYESYVENMEESLLFTLNLPGYGVRKDEPLITDWDLLVKNVTKAIIQTAASDKFKQCNTIHFVGNGFGAILAWKTLLQIQAYEDENKEVPPISTLIISRAMAP

SEQ ID NO: 440 - protein, 132 aa, Neocallimastix californiae
  AB_hydrolase
GDWIVRLDTNKDTTNSFFLIPAAGSSINMYNSWSKYMNKSALFAISYPGHLARIDETPIDDFKVLVKSIGEEILNNIKNGKISKDKPIYFFGHSLGALVSYETVLYLQNERKKGNPNAPVVTALVVSASPSP

SEQ ID NO: 441 - protein, 56 aa, Neocallimastix californiae
  AB_hydrolase
LYDIGGISDPIISVASRSRWDLENAEGYPIVRIEFEGDHWFIQENVEVVLERLKKE

SEQ ID NO: 442 - protein, 212 aa, Neocallimastix californiae
  AB_hydrolase
LLFTINLPGYGERKGEAVITDWDLLVKNVTKVILQTAADSEKFKQCNTIHFVGNGFGALLAWKTLLQIQIYEDEDKDVPIISTLIISRVVAPTAERPIQLAGEVISKLPPEGIRLFLEMIGSKVDFEGEKAYLLPIIHNEYAMMDSVTNENDMKIRSKLLVLSGKQDKIINENNTSLWKKEVSDEFSEFTQHIKMRGDHWFMMKDTTKYLKN

SEQ ID NO: 443 - protein, 132 aa, Anaeromyces robustus
  AB_hydrolase
GDWLIRLDMNKSTNNTFILFPAAGSSINMYSNWNKYLTNSTLLAVSLPGHLIRLEEKPIDNMEDLVDNIYKEIIKNVKNGNIPKDQPLYLFGHSLGALVGYEVAMTLQNERKKGNPDIPNITALISSGSPAP

SEQ ID NO: 444 - protein, 67 aa, Anaeromyces robustus
  AB_hydrolase
SEKDHQLEVPIYDIGANSDYVAPKDSRTNWDIEIANGYPLKRMNFEGGHWFIQDNLEVVMDYLKKEL

SEQ ID NO: 445 - protein, 116 aa, Anaeromyces robustus
  AB_hydrolase
VFIFFPSADEGEIDYSEYVEKMEDSLLFTVNLPGYGVRKDEPFINDWDLLIKNITKAIIQTDISGKFKECKTIHFVGNSFGGIVAWKTLLQIQAYEDEDKEVPIISTLIISRAIAP

SEQ ID NO: 446 - protein, 66 aa, Anaeromyces robustus
  AB_hydrolase
TNESNMKIRSKLLMFSGKQDKIIDDNNTSLWKKEVSDEFSEFTQHIKMRGNHWFVMKDTSKYLKNI

SEQ ID NO: 447 - protein, 114 aa, Piromyces finnis
  AB_hydrolase
FIFFPSADEGEIDYAEYVEDMEDSLLFTVNLPGYGVRKDEPLVTDWDLLVKNVTKAIIKSDESEKFKDCNAIHFIGNGFGALLAWKTLLQIQIYEDEDKDVPIISTLIISRALA

SEQ ID NO: 448 - protein, 60 aa, Piromyces finnis
  AB_hydrolase
KIRSKLLMFSGKQDKIIDDNNTSLWKKEVSDEFSEFTQHIKMRGNHWFMIKDSSKYLKNI

SEQ ID NO: 449 - protein, 67 aa, Piromyces finnis
  AB_hydrolase
TDKDHQLECPLYDIGGVSDPMVNPDSRKNWELEVTEETPLVRITFEGGHWFIQENMESVLERLKKEL

SEQ ID NO: 450 - protein, 131 aa, Piromyces finnis
  AB_hydrolase
EWLIRLDTNNNITNSFFLFPAAGSSISMYGNWNSYMKNSALFGVSYPGHLVRLDETPIDDLKTLVSAIAKEIMENIKNGNIPKDQPLYCFGHSLGALVSYEVVMLLQNERKNGNPNAPVFAGLIVSASPAP

SEQ ID NO: 451 - protein, 204 aa, Neocallimastix californiae
  Abhydrolase_5
HPIMGSASQWEGGSQTAKAALNDGAIVAFMDGAQGPMGQAWNVGPCCTDADDVKFTRDFIKEITNKACVDPKRIYAAGFSMGGGMSNYAGCYLSDVIAAAAPSAFDLAKEIVDAGKCKPSRPFPILNFRGTSDQIVMYNGGLSQVVPGKPITFMGAKNNLKEWAKMNGCSGSPKQNTPGNNCEMYENCNGGVKVGLCTINGGGH

SEQ ID NO: 452 - protein, 205 aa, Neocallimastix californiae
  Abhydrolase_5
YHPIMGSASQWEGGSQTAKAALSDGAIVAFMDGAQGPMGQAWNVGPCCTDADDVQFTRDFIKEITSKACVDPKRIYAAGFSMGGGMSNYAGCFLSDVIAAAAPSAFDLAKEIVDAGKCKPTRAFPILNFRGTQDNIVMYNGGLSQVVQGKPITFMGAKNNFKEWAKMNGCTGEPKQNNPGNNCEMYENCKDGAKVGLCTINGGGH

SEQ ID NO: 453 - protein, 207 aa, Neocallimastix californiae
  Abhydrolase_5
INYHPIGGSASQWEGGSQTAKAALSDGAIVAFMDGAQGPMGQAWNVGPCCTDADDVQFTRNFIKEITSKACVDPKRIYAAGFSMGGGMSNYAGCYLADVIAAAAPSAFDLAKEVVDAGKCKPARPFPILNFRGTQDPIVMYNGGLSQVVQGKPITFMGAKNNLKEWAKMNGCTGSPVQNNPGNNCEMYENCNGGAKVGLCTINGGSH

SEQ ID NO: 454 - protein, 166 aa, Neocallimastix californiae
  Abhydrolase_5
ILFGNGGCGRISFSYGNFLTELASYGYVVAAVGPWVGEDNTDYLSLSLDFSEETINGFKADANSLIDVALSWLEKENKERTSIFYKTLNTNKVSAMGQSCGGLQALIISTKNDKRIKTTVALNSGANSPGDLLDSLIVKDELQKLTQPIIYIIGGEEDIAHYNALD

SEQ ID NO: 455 - protein, 204 aa, Neocallimastix californiae
  Abhydrolase_5
YHPIMGSASQWENGSQTAKAALSDGAIVAFMDGAQGNMGQAWNVGPCCTDADDISFTRNFIKEITNKACVDPKRIYAAGFSMGGGMSNYVGCYLADVIAAAAPSAFDLAKEVVDGGKCKPSRPFPILNFRGTQDNIVMYNGGLSQVVPGKPITFMGAKNNFKEWAKMNGCTGSPKTNTPGNNCEMYENCNGGAKVGLCTINGGG

SEQ ID NO: 456 - protein, 204 aa, Anaeromyces robustus; identical to SEQ ID NO: 455
  Abhydrolase_5

SEQ ID NO: 457 - protein, 142 aa, Anaeromyces robustus
  Abhydrolase_5
LLSLHGMDQDPNYQQSNTHWETLADTEGFVVVYPRGGTGMSTWDIQGDKDTKWVLQIIDQMAKDYDIDRNRVYLSGFSMGGMFTYHAMSKIGDKIAAFAPCSGPNVFGASKAMRPVPIFHVHGTNDDVLNYNQVEGFLKNYR

SEQ ID NO: 458 - protein, 204 aa, Anaeromyces robustus
  Abhydrolase_5
HPIMGSASQWESGSQTAKAALNDGAIVAFMDGAQGNMGQAWNVGPCCTDADDVSFTRNFIKEITNKACVDPKRIYAAGFSMGGGMSNYAGCYLADVIAAAAPSAFDLAKEVVDGGKCKPSRPFPILNFRGTADNVVSYNGGLSQVVPGKPITFMGAKNNFKEWAKMNGCTGSPKTNTPGNNCEMYENCNGGAKVGLCTINGGGH

SEQ ID NO: 459 - protein, 205 aa, Anaeromyces robustus
  Abhydrolase_5
YHPIMGSASQWENGSQTARAALNDGAIVAFMDGAQGPMGQAWNVGPCCTDADDVSYTRNFIKEITSKACVDPKRIYAAGFSMGGGMSNYAGCYLADVIAAAAPSAFDLAKEIVDAGKCKPARPFPILNFRGTQDNIVMYNGGLSQVVQGKPITFMGAKNNMKEWAKMNGCTGSPKTNTPGNNCEMYENCEGGSKVGLCTINGGGH

SEQ ID NO: 460 - protein, 204 aa, Anaeromyces robustus
  Abhydrolase_5
YHPISGSAAAWEYGSQTARAALNDGAVVAYMDGAVGPGGQAWNVGPCCTDADDVQYTRDFIKEITSKACVDPKRIYAAGFSMGGGMSNYAGCKLADVIAAAAPSAFDLSKEVVQSGQCTPARPFPILNFRGTSDFVVPYSGGYSNAVAGKPLTFLGAQNNFKEWAKMNGCSGSPKSNTPSNNCEMYENCNGGAKVGLCTINGGG

SEQ ID NO: 461 - protein, 204 aa, Piromyces finnis
  Abhydrolase_5
HPIMGSASQWEGGSQTAKAALNDGAIVAFMDGAQGPMGQAWNVGPCCTDADDVTYTRNFIKEITQKACVDPKRIYAAGFSMGGGMSNYAGCYLSDVIAAAAPSAFDLAKEIVDSGKCKPSRPFPILNFRGTSDNVVMYNGGLSQVVPGKPITFMGAKNNLKEWAKMNGCTGSPKSNTPGNNCEMYENCNGGVKVGLCTINGGGH

SEQ ID NO: 462 - protein, 204 aa, Piromyces finnis
  Abhydrolase_5
HPIMGSASQWEGGSQTAKAALNDGAIVAFMDGAQGPMGQAWNVGPCCTDADDVTYTRNFIKEITQKACVDPKRIYAAGFSMGGGMSNYAGCYLSDVIAAAAPSAFDLAKEIVDSGKCKPSRPFPILNFRGTSDNVVMYNGGLSQVVPGKPITFMGAKNNLKEWAKMNGCTGSPKSNTPGNNCEMYENCSGGVKVGLCTINGGGH

SEQ ID NO: 463 - protein, 204 aa, Piromyces finnis; identical to SEQ ID NO: 461
  Abhydrolase_5

SEQ ID NO: 464 - protein, 204 aa, Piromyces finnis; identical to SEQ ID NO: 461
  Abhydrolase_5

SEQ ID NO: 465 - protein, 107 aa, Neocallimastix californiae
  Ac_transferase_dom
TDAFHSPLMDPAIEELNGWIEEKNDAQFRQTLKVKFISNVDSTIKPVGDRLEKDYWGKHARNAVRFVDGVKSMIESEKKLLAVIEVGPAATLTNMSSRFVRETESLR

SEQ ID NO: 466 - protein, 125 aa, Neocallimastix californiae
  Ac_transferase_dom
KHEVGMSFTGQGSIKPGVGKELFRTQPVFRAAMEKCDAVVKKSTGISILDALYDQNQGHHLKKAQIAQPALFAYEYAMYMLWKSWGIKPVIVNGHSLGEIVAAAATGAIDIDLAIDFIIERARCM

SEQ ID NO: 467 - protein, 133 aa, Neocallimastix californiae
  Ac_transferase_dom
QKSTAFAFTGQGVAKVGMGKHFYQTQPVFREAMDRCDAVTRRLLGVSIVEVLYNVSNIPNGTEEGEKALKKSSVAQPALFAYEYAMSQLWISWGIKPSMVLGHSLGEIVATTIAGGIDFELAMEFIVERASCM

SEQ ID NO: 468 - protein, 105 aa, Neocallimastix californiae
  Ac_transferase_dom
TEAFHSALMDPAIEKLYEWIDSKPDEKFRQPLKYGLISNVTGKLIPAGERLPKNYWGEHARNAVQFVKAVETLLANSETLLNVIEVGPASVLTNMSSRILREKKV

SEQ ID NO: 469 - protein, 118 aa, Neocallimastix californiae
  Ac_transferase_dom
NKAFHTPFILSAKEKFLKGIEGIHLRVQPPKIPFISSTHGNEYQGPFDANYWWSNIINPVNFSQAVKIAHTKVDKVLEISSTPVLGIYISSVFQPDSIFYTLSRKLKDHNSLCRNIAN

SEQ ID NO: 470 - protein, 134 aa, Neocallimastix californiae
  Ac_transferase_dom
KISAKPKLAFTFSGQGTQYPDMGRQLYHSNPYFANIIDYCNEIVLSISKKDLLKETGLFGDLPVNEENLMDPQYSFLAIGIIQLALVEFWKAYGVEPSLVFGHSMGEVAAAYAAGILTLEDAILLLYHYGLISQ

SEQ ID NO: 471 - protein, 102 aa, Neocallimastix californiae
  Ac_transferase_dom
VSDLYHRLPSFRQAIKECDKEIKKLTQYKYSLIKDLASLGEESKKSNLSYLGNVLVLALHYAFYKVIRSIHPVEGTLLVGYGYGELAAILNAGGISFGKAAQ

SEQ ID NO: 472 - protein, 137 aa, Neocallimastix californiae
  Ac_transferase_dom
KINEKPGINFAFSGQGSQFINMGRRMYQVNGLFKRIVDYCAAVLVTYNGGEDIFEKYHIFKGDVSQISEADLSLPQYSILAIGVAQIALTEIWKAMGVTPEAVFGHSMGEVAAAYAAGILTLEDAILLLYMRGHILA

SEQ ID NO: 473 - protein, 118 aa, Neocallimastix californiae
  Ac_transferase_dom
KQAFHSPYVEGAEQAFKESIRGISERTSAPKCKFISACFGQEYEGPFDENYWWANIRNPVSFYAAASIGTQFSKRVLEIGAHPVLSVYLKEIYGKEYVYQSLSRKMDDVDSMCRTTAA

SEQ ID NO: 474 - protein, 108 aa, Neocallimastix californiae
  Ac_transferase_dom
VTIPAHNEILKEAAELVVEDAAKLNITFPTKNLAIPVYRTDNGVDMKEESDITDVVEPVVNQICILPVDWVKATNVPGLTHVLDFGPGGASGIGSLIQKNKEGTGVQV

SEQ ID NO: 475 - protein, 68 aa, Neocallimastix californiae
  Ac_transferase_dom
LNATQFTQPAITLTEKAAFEDMYEKGYICDDAVYAGHSLGEYAALSCVANTLSIESMAEIVFYRGLVM

SEQ ID NO: 476 - protein, 55 aa, Neocallimastix californiae
  Ac_transferase_dom
ELLSYQLASAVQWIKTQEFLFSSQKKGGADIERLIEFGPTPTLVGMAKRTLGMKY

SEQ ID NO: 477 - protein, 57 aa, Neocallimastix californiae
  Ac_transferase_dom
KPTAYVFTGQGAQEVGMGQDLYNKSAVAKAVWDRADAYLMKKYGYSILEIVRTNPKS

SEQ ID NO: 478 - protein, 54 aa, Neocallimastix californiae
  Ac_transferase_dom
IDVPFHSSYLLWGVPTFRELLHQRVRREDVDVKCLVGRYIPNLMGEPFSVEKDY

SEQ ID NO: 479 - protein, 150 aa, Neocallimastix californiae
  Ac_transferase_dom
AVFGGQGYPGFNEILQAYTMYGAIVRDYIAELSTILKELASKPEFQRTYKQGLDILKWLRNPESLPEDAYLDSAPVSFPLIGIVQLVQYLILFRTFRKTPDWARHLFAGTTGHSQGLVTSVVIASSGTEEEYLENSKKAVSLLFLIGARS

SEQ ID NO: 480 - protein, 98 aa, Neocallimastix californiae
  Ac_transferase_dom
LGLYDVYPCFRKAIKECDKEIKKLTNKQYSLIKDITNLGKEDKKGMDYLGNVIVLALNYAFNKMINDIHVSKNPLLIGYGYGELSAILNAGGVTFGAA

SEQ ID NO: 481 - protein, 132 aa, Neocallimastix californiae
  Ac_transferase_dom
KQGITFVFRGMSQLNSNIGYSLYQYNQKFAEIVDYCDKVLEKVSGGVCSLKREFGLFQSENLNFLSLQNPKMSIIGNGMIQLALGHLLKSYGIKPSSVVGYNSGEIAAAYTAGIISLEDAILVLYQYSTILE

SEQ ID NO: 482 - protein, 98 aa, Neocallimastix californiae
  Ac_transferase_dom
SCGICTPYLNDFKDEFFASLKGIGNNCKTPVIKFISTTLGQPFNGPLNEYYWWANLSSTVNFSHALSLAMNEQQKGSGYILDVGSGYANAALFTNYFG

SEQ ID NO: 483 - protein, 56 aa, Neocallimastix californiae
  Ac_transferase_dom
ITAYVFTGQGAQEVGMGMDLYEKSPVAREIWDRADAHLMENYGFSIIDIVKNNPTE

SEQ ID NO: 484 - protein, 46 aa, Neocallimastix californiae
  Ac_transferase_dom
ELLAYQFASAVRWIETQDRLFVDIGVERLIEIGPGPTLSGMAQKTL

SEQ ID NO: 485 - protein, 68 aa, Neocallimastix californiae
  Ac_transferase_dom
LSATQFTQPSLVLMEKAAFEEMRSRGFIQQNSAFAGHSLGEYAALTAIGDVLSIETLVDVVFYRGMTM

SEQ ID NO: 486 - protein, 55 aa, Neocallimastix californiae
  Ac_transferase_dom
IDVPFHSSFLLRGVAPFRQYLMSKFDPNLIDVNRLIGNYIPNLTAEPFSLKKEFI

SEQ ID NO: 487 - protein, 46 aa, Neocallimastix californiae; identical to SEQ ID NO: 484
  Ac_transferase_dom

SEQ ID NO: 488 - protein, 112 aa, Neocallimastix californiae
  Ac_transferase_dom
ISVPFHCDYLKDVNDIIMKDVERDHLILGKGELVIPILSTETGEDLRGHPQFTYELIKQICTLPVHWEKATSVTNATHVLEFGPSGAGVGLLTHRNKIGTGIQIILANSLES

SEQ ID NO: 489 - protein, 160 aa, Neocallimastix californiae
  Ac_transferase_dom
VAKHKASIFAVFGGQGSEDYFNEIKEIYSTYEVIIKSYLERMSCMLEELASKPELLQFFPKGLHVLKWLEEPETLPDTKYLVNAPISLPLVGLCQLLHYSVLYKILGKTPDEMRRCFVGTTGHSQGIISSVVVSSSGTEEEFIENSQKALSLLFWIGVRS

SEQ ID NO: 490 - protein, 68 aa, Neocallimastix californiae; identical to SEQ ID NO: 485
  Ac_transferase_dom

SEQ ID NO: 491 - protein, 56 aa, Neocallimastix californiae; identical to SEQ ID NO: 483
  Ac_transferase_dom

SEQ ID NO: 492 - protein, 55 aa, Neocallimastix californiae; identical to SEQ ID NO: 486
  Ac_transferase_dom

SEQ ID NO: 493 - protein, 102 aa, Neocallimastix californiae
  Ac_transferase_dom
VKELLSTENSFKKTFEFCDSEIQKIAEGISLKQMIEEEKNGKESELNNSFFILSFYYSLHQLVESIMIKNNSSKKIYGGFGFGEIISLVLSGGLSFSSAISL

SEQ ID NO: 494 - protein, 88 aa, Neocallimastix californiae
  Ac_transferase_dom
SFAIHTKKISEAMKEELVKRLTNIKSKPSSIAMFSTTKFSKEGKPYTDALDGQYWWMNMRNPVLYAHSLSQTANFLPTDGKNILEIGL

SEQ ID NO: 495 - protein, 126 aa, Neocallimastix californiae
  Ac_transferase_dom
TCRDFYCNNSYFADCIDYCDQVLKMISGRSLLEDYGLFQSVKEEEKEKEKEKKNKLREDLLKDPTTTLLINGIIQLGLVALYRYYGISPNAVIGYGAGEIAAAYAAEKIDLKSAVQILYHYGRVLS

SEQ ID NO: 496 - protein, 115 aa, Neocallimastix californiae
  Ac_transferase_dom
FACYLYRTYPVYAKALEECDRIISELSNFKVLLVNLIICMGELVQPDLLKEYKKQVDEDPCMAQFIILSMNYALTALLRHLNISINLVMGDGFGEVSAALACQKITLRNAFILIQ

SEQ ID NO: 497 - protein, 104 aa, Neocallimastix californiae
  Ac_transferase_dom
LLELFLSRPEFRKALLDCDSIISEVSNKTYSLVDDIVNGGKNNKEAADAFQAINVLSFYYALHKTLDKELDISKSIYCGYGLGELITILVNGGISLKKAIQFLK

SEQ ID NO: 498 - protein, 95 aa, Neocallimastix californiae
  Ac_transferase_dom
SVPFHCDYLKDVNDIVMKDVERDNLTLGKGELAIPILSTETGEDLRGHPQFTYELIKQICTLPVYWEKATSITNATHILEFGPSGAGVGLLTHRN

SEQ ID NO: 499 - protein, 162 aa, Neocallimastix californiae
  Ac_transferase_dom
AVTKHKASIFAVFGGQGSEDYFNEIKEIYSTYEVIIKSYLERMSCMLEELASKPELLQFFPKGLHVLKWLEEPETLPDTKYLINAPISLPLVGLCQLLHYSVLYKSLGKTPDEMRRCFVGTTGHSQGIISSVVVSSSGTEEEFIDNSEKALSLLFWIGVRSQ

SEQ ID NO: 500 - protein, 46 aa, Neocallimastix californiae; identical to SEQ ID NO: 484
  Ac_transferase_dom

SEQ ID NO: 501 - protein, 55 aa, Neocallimastix californiae; identical to SEQ ID NO: 486
  Ac_transferase_dom

SEQ ID NO: 502 - protein, 56 aa, Neocallimastix californiae
  Ac_transferase_dom
ITAYVFTGQGAQEVGMGMDLYEKSPVAREIWDRADAHLMESYGFSIIDIVKNNPTE

SEQ ID NO: 503 - protein, 68 aa, Neocallimastix californiae
  Ac_transferase_dom
LSATQFTQPSLVLMEKAAFEEMRTRGFIQQNSAFAGHSLGEYAALTAIGDVLSIETLVDVVFYRGMTM

SEQ ID NO: 504 - protein, 108 aa, Neocallimastix californiae
  Ac_transferase_dom
VTIPAHNEILKDAAELVVDDAAKLNITFPTKNLAIPVYRTDNGVDMKEEAEVTDVVESVVNQICILPVDWVKATNVPGLTHVLDFGPGGASGIGSLIQKNKEGTGVQV

SEQ ID NO: 505 - protein, 68 aa, Neocallimastix californiae
  Ac_transferase_dom
LNATQFTQPAITLTEKAAFEDMLENGYICDDAVYAGHSLGEYAALSCVANTLSIESMAEIVFYRGLVM

SEQ ID NO: 506 - protein, 150 aa, Neocallimastix californiae
  Ac_transferase_dom
AVFGGQGYPGFNEILQAYTIYGAIVRDYIAELSTVLKELAAKPEFERTYKQGLDILKWLRNPESLPEDAYLDSAPVSFPLIGIVQLVQYLILFRSFRKTPDWARRLFAGTTGHSQGLVTSVVIASSGTEEEYLENSKKAVSLLFLIGARS

SEQ ID NO: 507 - protein, 57 aa, Neocallimastix californiae
  Ac_transferase_dom
KPTAYVFTGQGAQEVGMGQELYNKSAVAKAVWDRADAYLMKKYGYSILEIVRTNPKS

SEQ ID NO: 508 - protein, 51 aa, Neocallimastix californiae
  Ac_transferase_dom
ELLAYQLASAVQWIKTQEFLFSSKNKGGADVERLIEFGPTPTLVGMAKRTL

SEQ ID NO: 509 - protein, 54 aa, Neocallimastix californiae; identical to SEQ ID NO: 478
  Ac_transferase_dom

SEQ ID NO: 510 - protein, 69 aa, Neocallimastix californiae
  Ac_transferase_dom
TDAFHSPLMDPAIEELNNWIEEKDDAKFRQSLKVKFISNLDGTIKPVGDRLEEDYWAKHARNAVRFVDG

SEQ ID NO: 511 - protein, 122 aa, Neocallimastix californiae
  Ac_transferase_dom
VGMSFTGQGSIKPGVGQELFRSQPVFHAAMEKCDAVVKKVTGVSIIDALYDQSQAHHLKKAQIAQPALFAYEYAMCMLWKSWGVEPVIVNGHSLGEIVAAAVTGAIDIDLAIDFIIERARCM

SEQ ID NO: 512 - protein, 196 aa, Neocallimastix californiae
  Ac_transferase_dom
IKDVYQNYDYYKECFIYCEQKIQKLGGDKKYPMFDVVFEHDKINIDTLDPIVKRLIIFSHFYSLHKLFLNFNISINAISGKGIGEYFTLAISYALSLEDSLRLLINYYNNTTVDSDKIEKEVKLIMSIQKPLRCYFYSNATKRLLKTNEYLDETYWKTLLSNVVFQEENKENEIDNLFIKQIITISPQTITVKPAS

SEQ ID NO: 513 - protein, 196 aa, Neocallimastix californiae; identical to SEQ ID NO: 512
  Ac_transferase_dom

SEQ ID NO: 514 - protein, 155 aa, Neocallimastix californiae
  Ac_transferase_dom
IKEIYQYYDYYKECFIYCEQKIQSLGGNKKHPMFDVVFDSNYSDIKNLDPIVKRLIIFSHFYSLHKLFLNFNVSINSIGGEGIGEYFALAISGVLSLEESLKLLINYHNIIVDKNKIEKEVKSLLSIQKPLRCHFYSSATKRLMKTSQYLDDSYW

SEQ ID NO: 515 - protein, 86 aa, Neocallimastix californiae
  Ac_transferase_dom
SFGIHSKIITEAMKDELTKRLENISSHSSSIAMFSTAKFNEKSEPYTGALDGSYWWMNMRNPVLYAHTLSQTVNYLPSDGKNILEI

SEQ ID NO: 516 - protein, 73 aa, Neocallimastix californiae
  Ac_transferase_dom
DKLKEDLLKDPSTALLISGIVQFSLVSLYKYYGITPSVVIGYGAGEITAAYAAEKIDLKDAVQILYHYGQVLS

SEQ ID NO: 517 - protein, 52 aa, Anaeromyces robustus
  Ac_transferase_dom
ELLAYQLASAVQWIKTQEFLFSSEKKGGVDIERLIEFGPTPTLVGMAKRTLA

SEQ ID NO: 518 - protein, 150 aa, Anaeromyces robustus
  Ac_transferase_dom
AVFGGQGYPGFNEILQAYTIYGAIVRDYIDELSTVLKDLASKPEFERTYKQGLDILKWLRHPDSLPEDAYLDSAPVSFPLIGIVQLVQYLILFRTFRKTPDWARHLFAGTTGHSQGLVTSVVIASSGTEEEYLENSKKAVSLLFLIGARS

SEQ ID NO: 519 - protein, 68 aa, Anaeromyces robustus; identical to SEQ ID NO: 505
  Ac_transferase_dom

SEQ ID NO: 520 - protein, 57 aa, Anaeromyces robustus
  Ac_transferase_dom
KPTAYVFTGQGAQEVGMGQELYNKSAVAKSVWDRADAYLMKKYGYSILEIVRTNPKS

SEQ ID NO: 521 - protein, 54 aa, Anaeromyces robustus; identical to SEQ ID NO: 478
  Ac_transferase_dom

SEQ ID NO: 522 - protein, 108 aa, Anaeromyces robustus
  Ac_transferase_dom
VSIPAHNEILKEAADLIIEDAAKLNITFPTQDLAIPVYRTDNGVDMKEEVDVPDVVESVVKQICILPVDWVKATNVPGLTHVLDFGPGGASGIGSLIQKNKEGTGVQV

SEQ ID NO: 523 - protein, 134 aa, Anaeromyces robustus
  Ac_transferase_dom
KISAKPKLAFTFSGQATQYPDMGRQLYHSNPYFASIINYCNEIIIRLSQKDLIKDTGLFSDTPVDEEKLIDPQYSFLAIGIIQLALVEFWKLYGVEPALVFGHSMGEVAAAYAAGILTIEDAILLLYNYGLISQ

SEQ ID NO: 524 - protein, 118 aa, Anaeromyces robustus
  Ac_transferase_dom
KKAFHTPYIITAKQKFIQGIQGIGSRVNSPKIPFISSTYGKEYQGPFDEEYWWTNIINPVNFSQATKVARTKVEKVLEIGSTPVLGIYMSKIFNPDNIFYSLSRKLKDYHSLSRNIAN

SEQ ID NO: 525 - protein, 134 aa, Anaeromyces robustus
  Ac_transferase_dom
QSKSSAFAFTGQGVAKVGMGKHFYQTQPVFRKAMDKCDEVTRRLLNVSIVEVLYNISNAPNGIEKGENALKKSSVAQPALFAYEYAMSQLWISWGVEPSMVLGHSLGEIVATTIAGGIDFELAMEFIVQRASCM

SEQ ID NO: 526 - protein, 104 aa, Anaeromyces robustus
  Ac_transferase_dom
TEAFHSALMNPAIEKLYEWIETKPDDKFRKPLKYGLISNVTGELIPAGERLPKNYWGEHARNAVQFVKAVETLLANSETLLNVIEVGPSNVLTNMSARILREKK

SEQ ID NO: 527 - protein, 104 aa, Anaeromyces robustus
  Ac_transferase_dom
TDAFHSPLMEPAIEELDKWIEGKDDEKFRQPLKVRFISNVDGKIKEVGERLDENYWAEHARSTVRFVDGVKSMIESENNNILAVIEVGPAATLSHMSARYVREN

SEQ ID NO: 528 - protein, 127 aa, Anaeromyces robustus
  Ac_transferase_dom
SDKTEVGMSFTGQGSIKPGVGQELYRSQPVFRDAIDKCDTVLKKVTGISLVDVLYNPQQAHHLKKAQIAQPALFAFEYAMCMLWKSWGVEPTIVNGHSLGEIVAAAVTGAMDIDLAIDFIVERARCI

SEQ ID NO: 529 - protein, 162 aa, Anaeromyces robustus
  Ac_transferase_dom
AVDKHKASIFAVFGGQGSEDYFDEIKEIYNTYEVLIKSYLERMACVLEELASKPELLQFFPKGLHVLKWLEEPETLPDTKYMINAPISLPLVGLCQLLHYCVLYKSLGKTPDEMRSSFVGTTGHSQGIISSVVVSSSGTEEEFIENSIKALSLLFWIGVRSQ

SEQ ID NO: 530 - protein, 94 aa, Anaeromyces robustus
  Ac_transferase_dom
SVPFHCDYLKDVNDTIMKDVERDHLILGKGELAIPIYSTETGEDLRGHPQFTYELIKQICTLPVHWEKATSITNATHILEFGPSGAGVGLLTHR

SEQ ID NO: 531 - protein, 56 aa, Anaeromyces robustus
  Ac_transferase_dom
ITAYVFTGQGAQEVGMGMDLYEKSAVAREIWDRADAHLMETYGFSIIDIVKNNPTE

SEQ ID NO: 532 - protein, 55 aa, Anaeromyces robustus
  Ac_transferase_dom
IDVPFHSSFLLRGVAPFRQYLMSKFDPNLIDVNRLIGNYIPNLTAEPFSLEKKFI

SEQ ID NO: 533 - protein, 68 aa, Anaeromyces robustus; identical to SEQ ID NO: 485
  Ac_transferase_dom

SEQ ID NO: 534 - protein, 46 aa, Anaeromyces robustus; identical to SEQ ID NO: 484
  Ac_transferase_dom

SEQ ID NO: 535 - protein, 134 aa, Anaeromyces robustus
  Ac_transferase_dom
ASHKQGITFVFRGISELNSNFSYSLYKYNQKFAKIVDYCDKVLEKVSQGLSLKRDYGLFQKENFDETTLRDPKISVIGSGIIQLTMAHLLKSYAIIPSSVVGYSIGEISAAYAAGIISLEDAVLILYQYSSILE

SEQ ID NO: 536 - protein, 86 aa, Anaeromyces robustus
  Ac_transferase_dom
SNGICTPYLNDFKDEFYESLRDIGSRCKDPVIPFISTTLGQPFNGPLNEFYWWANLTSTVNFSSALSLAMNEQPNGSGYILDVGSG

SEQ ID NO: 537 - protein, 95 aa, Anaeromyces robustus
  Ac_transferase_dom
LLELTLAHPVFKEALDECDVLISEILNNNYSLIDDLVNKGKNSNKNYQIFGIISFYYALSKILDEELKINQSINFGYDIGELIAILLNNGISIRK

SEQ ID NO: 538 - protein, 127 aa, Piromyces finnis
  Ac_transferase_dom
SDKTEVGMSFTGQGSIKSGVGLELYRTQPVFRDALNKCDVVVKKATGISLIDALYNPSQSHHLNKAQIAQPALFAYEYAMCMLWKSWGINPTIVNGHSLGEIVAAASTGAMDIDLAIDFIIERARCM

SEQ ID NO: 539 - protein, 107 aa, Piromyces finnis
  Ac_transferase_dom
TDAFHSPLMDPAVSELNKWIERKDDSKFRQDLKVKFISNVDGNIKPVGSRLEEDYWGKHARNAVRFVDGVKSMIESEKKLLAVIEVGPAATLTNMSSRFVRETESLR

SEQ ID NO: 540 - protein, 101 aa, Piromyces finnis
  Ac_transferase_dom
VSELYNSQPVFRKVIKNCDKEIMEITHQQYSLVKDIASLGKEEKKDMPYINNIITLAIHHAYYKLMKSVYSVDNSLFIGYGYGELSAILNAGGISFKAASQ

SEQ ID NO: 541 - protein, 101 aa, Piromyces finnis
  Ac_transferase_dom
VELYISRPEFKQAIEECDAIITTISNNVYSLVDDITSKGMNINESKDAFKNIKILSFYYALSKVIDNELNVKQSIFGGYGLGEIISILINNGISIEKAIRF

SEQ ID NO: 542 - protein, 86 aa, Piromyces finnis
  Ac_transferase_dom
SCGICTPFLNNFKNEFHEALKDIGSRCKAPATPFISTTLSQPFNGPLNEYYWWANFTSTVNFNVALSLAMNEQQKGSGYILDVGCG

SEQ ID NO: 543 - protein, 134 aa, Piromyces finnis
  Ac_transferase_dom
ASHKQGITFVFRGISELKTNLGYSLYQNNKMFADVVDYCDKILEKISQGYSVKKNTGLFLKENLDAATLQSPKISVVGSGMIQLAMAHLLKTYGIVPSSVVGYNTGEIAAAYATGIISLEDAILILYQFSNILE

SEQ ID NO: 544 - protein, 131 aa, Piromyces finnis
  Ac_transferase_dom
SSAFAFTGQGVAKVGMGKHFYQTQPVFRKAMDKCDEVTRRLLDVSIVEVLYNISNSPNGVEEGEKALKKSSVAQPALFAYEYAMSQLWISWGVEPSMVLGHSLGEIVATTIAGGIDFELAMEFIVQRASCM

SEQ ID NO: 545 - protein, 105 aa, Piromyces finnis
  Ac_transferase_dom
TEAFHSALMDPAIEKLYEWINTKPDEKFRQPLKYGLISNVTGELIEAGERLPKNYWGEHARNAVQFVKAVETLLANSETLLNVIEVGPANVLTNMSSRILREKRI

SEQ ID NO: 546 - protein, 105 aa, Piromyces finnis; identical to SEQ ID NO: 545
  Ac_transferase_dom

SEQ ID NO: 547 - protein, 131 aa, Piromyces finnis; identical to SEQ ID NO: 544
  Ac_transferase_dom

SEQ ID NO: 548 - protein, 87 aa, Piromyces finnis
  Ac_transferase_dom
NYGLHSMMINDKMKEDLVNSLKDIPLQTSDIAFFTTTKLNKDGKPYEGKLDGEYWWMNMRNPVLYAHALSQTVAFLPIDGKNIIEIG

SEQ ID NO: 549 - protein, 126 aa, Piromyces finnis
  Ac_transferase_dom
STYYNCCRNLYCNNKYFSDCIDYCDGIFKALSQRSLLQDYGLFTTEMMDNNKFKKFNSDLRKDPLVMIMFGGMVQLTLSALLKYYGLFPNAVIGYGAGEIVAAYVADKMDLKTTVKVLYHYGRVLS

SEQ ID NO: 550 - protein, 68 aa, Piromyces finnis
  Ac_transferase_dom
LSATQFTQPSLVLMEKAAFEEMRSRGYIQQNSAFAGHSLGEYAALTAIGDVLSIETLVDVVFYRGMTM

SEQ ID NO: 551 - protein, 160 aa, Piromyces finnis
  Ac_transferase_dom
VAKHKASVFAVFGGQGSEDYFDEINEIYSTYEAMVKSYLERMACILEELASKPELLQFFPKGLHVLKWLEEPETLPDKKYLVNAPISLPLVGLCQLLHYTVLYKSLGKTPDEMRRSFIGTTGHSQGIISSVVVSSSGTEEEFIENSEKALSLLFWIGVRS

SEQ ID NO: 552 - protein, 46 aa, Piromyces finnis; identical to SEQ ID NO: 484
  Ac_transferase_dom

SEQ ID NO: 553 - protein, 56 aa, Piromyces finnis
  Ac_transferase_dom
ITAYVFTGQGAQEVGMGMDLYEKSPVAREIWDRADKHLMENYGFSIIDIVKNNPTE

SEQ ID NO: 554 - protein, 55 aa, Piromyces finnis
  Ac_transferase_dom
IDVPFHSSFLLRGVAPFRQYLMSKFDPKLIDVNRLIGNYIPNLTAEPFSLEKKFI

SEQ ID NO: 555 - protein, 112 aa, Piromyces finnis
  Ac_transferase_dom
ISVPFHCDYLKDVNDIIMKDVERDHLILGKGELAIPIYSTENGEDLRGHPQFTYELIKQICTLPVHWEKATSVTNATHILEFGPVGAGVGLLTHRNKIGTGVQVILANSLET

SEQ ID NO: 556 - protein, 68 aa, Piromyces finnis; identical to SEQ ID NO: 550
  Ac_transferase_dom

SEQ ID NO: 557 - protein, 160 aa, Piromyces finnis; identical to SEQ ID NO: 551
  Ac_transferase_dom

SEQ ID NO: 558 - protein, 46 aa, Piromyces finnis; identical to SEQ ID NO: 484
  Ac_transferase_dom

SEQ ID NO: 559 - protein, 56 aa, Piromyces finnis; identical to SEQ ID NO: 553
  Ac_transferase_dom

SEQ ID NO: 560 - protein, 55 aa, Piromyces finnis; identical to SEQ ID NO: 554
  Ac_transferase_dom

SEQ ID NO: 561 - protein, 112 aa, Piromyces finnis; identical to SEQ ID NO: 555
  Ac_transferase_dom

SEQ ID NO: 562 - protein, 68 aa, Piromyces finnis; identical to SEQ ID NO: 550
  Ac_transferase_dom

SEQ ID NO: 563 - protein, 160 aa, Piromyces finnis; identical to SEQ ID NO: 551
  Ac_transferase_dom

SEQ ID NO: 564 - protein, 46 aa, Piromyces finnis; identical to SEQ ID NO: 484
  Ac_transferase_dom

SEQ ID NO: 565 - protein, 56 aa, Piromyces finnis; identical to SEQ ID NO: 553
  Ac_transferase_dom

SEQ ID NO: 566 - protein, 55 aa, Piromyces finnis; identical to SEQ ID NO: 554
  Ac_transferase_dom

SEQ ID NO: 567 - protein, 112 aa, Piromyces finnis; identical to SEQ ID NO: 555
  Ac_transferase_dom

SEQ ID NO: 568 - protein, 68 aa, Piromyces finnis; identical to SEQ ID NO: 550
  Ac_transferase_dom

SEQ ID NO: 569 - protein, 160 aa, Piromyces finnis; identical to SEQ ID NO: 551
  Ac_transferase_dom

SEQ ID NO: 570 - protein, 46 aa, Piromyces finnis; identical to SEQ ID NO: 484
  Ac_transferase_dom

SEQ ID NO: 571 - protein, 56 aa, Piromyces finnis; identical to SEQ ID NO: 553
  Ac_transferase_dom

SEQ ID NO: 572 - protein, 55 aa, Piromyces finnis; identical to SEQ ID NO: 554
  Ac_transferase_dom

SEQ ID NO: 573 - protein, 112 aa, Piromyces finnis; identical to SEQ ID NO: 555
  Ac_transferase_dom

SEQ ID NO: 574 - protein, 132 aa, Piromyces finnis
  Ac_transferase_dom
SVKPKVAFTFSGQGTQYPEMGLQLYNMNPYFASIIDYCNSIHTQISKKDLLKETGLFGKGPVNEEKLLDPQYSFPAIGIIELALVELWKRYGVEPALVFGHSMGEVAAAYAAGILTIEDAILLLYNYGQISE

SEQ ID NO: 575 - protein, 118 aa, Piromyces finnis
  Ac_transferase_dom
KKAFHTSYIITAKDKFLQSIQGIGNRVKAPKIPFISSTYGREYQGPFDEEYWWTNIISPVNFSQATKIARSKIDKVLEIGSTPVLGIYMSNDFHQDNIFYTLSRKLNNNNSLSRNIAN

SEQ ID NO: 576 - protein, 118 aa, Piromyces finnis
  Ac_transferase_dom
KQAFHSPYVEGAEKAFKESIRGIGERTKAPNCKFVSACFGQEYEGPFDENYWWANIRNPVSFHAAASIATQFSKRVLEIGAHPVLGMYLKEIYGKDNVYFSLSRKMDDVDSMCRTTAN

SEQ ID NO: 577 - protein, 137 aa, Piromyces finnis
  Ac_transferase_dom
KISEKPGINFAFSGQGSQFINMGRRMYQTNDLFKKVVDYCAAVLVTINGGEDIFEKYSIFKGDVAQISETDLSLPQFSVLAIGIAQIALIEVWKSMGVTPKAVYGHSMGEVAAAYAAGVLTIDDAVLLLYMRGHILA

SEQ ID NO: 578 - protein, 187 aa, Piromyces finnis
  Ac_transferase_dom
YLYRTQPVYAKALEECDKIITELSNFKILLVNLVICMGELIQPELLQEYKKQVDEDPCMAQFIALSMNYALIKLLEHLSISPNLVVGYKFGEITAALACGKISLRNAFLIIHYICKIIRKNIQLSDETITSDITQLMIIKDESKAFSSAKNNDYSYRMEHSQSFYSSIHQQVFSKGQNLNGDYWVKF

SEQ ID NO: 579 - protein, 263 aa, Neocallimastix californiae
  ACCESSORY GLAND PROTEIN ACP76A-RELATED
KNMLYSPFSIKYALKMLQEGAANNTFDEINKLIGNTQLSKYTNIDEVLSLANGLFIRDTFYDYINTNYINTLKENYDAEVVKDEFKNAANANKWIEDKTFNIIKNMLTDEMIKNPTSVMLIINALAIDMEWKEGFSFQYTDGDYFYLDNGEKMKATTMYRKEFGTILSYYIDDSVTVVTLDLKKYGNIQFEFMAIMPKGNLSSFIENFTEEQMDHINKNLNFANNVEDGVVLYIPKFKFNYDLKLKQDLINLGIKDAFNYSKS

SEQ ID NO: 580 - protein, 351 aa, Neocallimastix californiae
  ACCESSORY GLAND PROTEIN ACP76A-RELATED
KNMLYSPLSIKYALKMLQEGAANNTFDEINKLIGNTQLSKYTSIDKVLSLANGLFIRDTFYDYINTNYINTLKENYDAEVVKDEFKSAANANKWIEDKTFNIIKNMLDDDIVQNPSSVMLIINALAIDMGWYRSFSFENTNGYDFYLDNGEKMKTTMMSKTEKSTNLSYYIDDNVSVVTSDLKKYDDIQFEFMAIMPKENLSSFIENFTEEQMDHINQNLNFSTTIEDGVVFRIPKFKFDYDLELKQDLMKLGIKDAFNYSKSDFSKMEGSTDPDKKLYVSEALHKADIEFTEEGIKAAAVTVFGMKATSAHNPIIPKPLYITFDKPFMFIIRDKKTQDIWFTGTVYEPNK

SEQ ID NO: 581 - protein, 358 aa, Anaeromyces robustus
  ACCESSORY GLAND PROTEIN ACP76A-RELATED
ENKKKNMLYSPLSIEYALKMLQEGANGNTYSEINKIVGNEELPKYISLDKNLSLANGLFIRNTYSEYVKPSYVSTLRDKFYAEVVEDEFNDASNVNEWIEDKTLGIIKDMLRDDIVQNPRTSLILVNALAMDMKWAYPFRDESTHGRTFYKENGQEIEATTLSTTISANGVSYYKDDDLTVLTMDLKKYSEFQFEFVAIMPKNENLSSFVEKVTREQIDEIDEKLISSYDERDGIYIRIPKFKFQYDLELKKDLINLGVNDAFSPIKADLKKIADPEDPDKKLYVGDALHKADIEFSEEGIKAAAVTVIIIMAAGAAPGPRREPQPVNVIIDKPFMFMIRDKNTKNIWFTGTVYEPNL

SEQ ID NO: 582 - protein, 355 aa, Anaeromyces robustus
  ACCESSORY GLAND PROTEIN ACP76A-RELATED
ENHKENMLYSPLSIEYALNMLQEGADGNTYDEINKIIGNDELPKYTNIENNLSLANGVFIKDTFYENVKTDYINTLKEKFDSEVIQDPFESAENVNHWIEDKTLGIIKNVVNDDAVRSPAMAMLLINALAMDMDWKILFDSYDTNEENFYMENGQRIQVSMMNKKEIKSDVVSYYKSNKVKAVTMEFEEYNGTELEFLALMPNEDLSSFVENITLEQIQKLDQKLIPSSETSNGVNLKIPKFKFSYDLALKKNLMDLGINDAFDELKANFTKISDPYSSGMNLFVSDALHKADIEFTEKGVKAAAVTVALTYATSFRPKKGDPIEIVIDKPFMFIIRDKNTKDIWFTGTVYEPEL

SEQ ID NO: 583 - protein, 371 aa, Anaeromyces robustus
  ACCESSORY GLAND PROTEIN ACP76A-RELATED
VVEYNSDFDFSFLKLENNKENMLYSPLSIKYALKMLLEGADGNTYNEISKLVGNSELTKCSNIDKVLSLANGLFIRDTFYTCINPEYIKTLEEKYNSEVVKDEFKNADNVNEWIENKTLGIIKKMLDDKKVQDPSSVMLLINALAIEMDWYSAFKIESTYGNTFYIDDDKKVEATMMSQKVYSNNLSYYLSDELTAVTMDLKEYGGTQFEFMAIMPTKDNLSTFIENVTKKQINEIDEKLILASEAEYGVIIKIPKFKFSYDLKLKDDLKSLGIKDAFDMSRANFSKMENPSELTQNLYVSDALHKADIEFTEKGIKAAAVTVIIITYGSAGPSKPTTPVYVTIDRPFMFIIRDKNTKDIWFTGTVYKPNL

SEQ ID NO: 584 - protein, 357 aa, Neocallimastix californiae
  Acetyl-CoA synthetase-like
EEFRNEILEAKNKGLSFERQGLATDIIYIIGTSSTSQAIIKNGHCTEMKFVPITTTSGGECYNNYIYRGMKNKPTFMINIPVSHLLGFYGCVFHTIQYGGPVAYHTQNLRDIGFIPEIILDDMIEVKMDRTILFPFHFNEFKKLFDDHHPHCEKWKKFISSRNPYCFRNGGAPLSNSIDDWFNDTFGIRTCQDYGSSETGAILTSDFNSKPLPGEETYLSKFPHCELYLKPLDDNDPSVGELFVHSPTLTTGYISKAKPGEFYESDMPGMRTDIDADKLFVYFEGKKFLKTNDIVIRSPKSGKYKYVSRSDDVLVFETGLKMNPIPFERTVSSECEDISRCCLIIDDTKTEVVCFVE

SEQ ID NO: 585 - protein, 95 aa, Neocallimastix californiae
  Acetyl-CoA synthetase-like
PSPWLTVTYNEFGSLIKACAYVLKKKYDLYPNSRIGIIGTYTPMNQLLIYALWYLRCAVVQIPIKLGNDVKQFWCRLLNLKMIFYDVNFIPFDNK

SEQ ID NO: 586 - protein, 540 aa, Neocallimastix californiae
  Acetyl-CoA synthetase-like
TIYETTNIVDRMNLRFKSDEDDIAIVAKENLLMKPFHGIPNPSYPSPWLTVSYREFGALVKACAYVLKKKYDLYPNSRVGIIANFTPLNHLLVYALWYNRCAVVQIPVKLGNDVKQFWTRILNLKMIFYDVNFKPFDDEENIKMMEENDEWIWKWQHPLTENEMNLDSGKDGILSVNLYGESFRNEILKAKNQGKSFERKCYETDIIYIIGTSSSTQAIIKNGQCSKMKFVPMTTMQSGECYNYCVQQGLKYKPTFMINAPASHDLGYKKCVLHNIQMGGAVVYHTQQLRDIGFIPEIILDDMVETNVDHTLLFPFHIAEIKKLFDSHHPHCEKWKKFLCSRSKYFLNTGGAPMSDKIDNWFFETFGFRTTQIYGSSESGPVMISDFSVPALPGEETYLTKYPHIDIYFKPIDNNDPNIGELYVHSPTLTTGYIRKAEKDEFYESNVPGMRTDIEADDLFIYINGEKFYKTNDIWNRSPKSGKYKYISRLDDIIVFSTGLKMNPLPFENTVSLECNDITCCCLMLDDTKTEVVCFVEPQW

SEQ ID NO: 587 - protein, 534 aa, Neocallimastix californiae
  Acetyl-CoA synthetase-like
TIYERLEYRYNLCKDSDEPALVSKPNLWSLPFKPEPHPDYPSPWTCVSYKQFFRLVKACAYVLKKRFDLPPQSRVGVVANTLPLNILIIYALWYIRCTPVAVPPKLGNDVKQFWARMLDISMFIYDINVNIFDEEKQNQLNESGEWIWEWEYPLREDEYNLSAGFKGIPMFCMNNSEFLEEIYQCSLEGKTYARPGLKDDVVMVIGTSSSTQAIIKNGHCSKMKFIPVRLIQCGSLFQNILLTRKISLKYSVLASIPSYHMMGFTWIGVHHMNTGGALIFHTQKLHDIGFVPEVLLDDIVETKPGVIPLFPFNYAEIKRLFDEHHPRCEVWEKAIQACPKNCFRTGGAPIGYDLLHWFNQTFKILINNEYGSSETGIMMYKQFDKDLVPGEEGYLTRVPWQYFHFKLIDENNPNEGELFIYNPFAITGYIGRAKKGEFYESAVPGMRCDYEHDNLYETIDGIEYYRTNDIWTRSTISGDYKYVSRVDDILTFATGHKMNPLPFENTMSSECKNIKHCCLLVDNTQYEVVCFVEP

SEQ ID NO: 588 - protein, 53 aa, Neocallimastix californiae
  Acetyl-CoA synthetase-like
LLQDNAKSLNNWTKQLTIHNVYIIDYGKQFPVTAKGSVARRVAKLEYSEVLNQ

SEQ ID NO: 589 - protein, 490 aa, Neocallimastix californiae
  Acetyl-CoA synthetase-like
YPWLSVSFSEFEALAKAMAYVINKRYHLEPQSRVAIIANSLPKNQLLTIALWYLRVITVEITPKIGNDVKQCWMRMLDMSMGFYDCVFKPFYQDHQEEEEWTWPWIYPITPDENLVSGKEGIRMVNMDGEAFMQEVLDAKEQGLFYERVGDNDDLITIGGTSSSAQAIIKNGQSSEMKFVGLHHRKAGHTFNSYLYKNLPLETNFLLVSPFHHLLGICQGLLHPIYNGGPLVYRTQSLDDIGVIAEMLLDDIMEKGVNETLIFSFQYAEWKKLKESGHPKWPIWEKAIRSKPIGCFQTGGAPPIPEVTKWLARELQLFPAEQYGSSESGVMMYCTGEPPLRGEEGYLKRIPWVDVYLNPLSEDDPNVGEAFIYSEQNFTGYIRRVEKGETAKNSPAPGLHVDIKADEVFVEIDGKKFYKTNDIFRRSPITGNYKYVSRMDDVITFSTGLKMNPVPFERTMVQFCKNVKLCCLLLDTTGTEAVCFVEPEWE

SEQ ID NO: 590 - protein, 408 aa, Neocallimastix californiae
  Acetyl-CoA synthetase-like
PFKPEISSRYPENWKTIPFYQLFDLVKATAYVLKKRYDFAPGTRVGIIANTLPFTQLMIYALWNLRCVVVTFPPRLGNDVKQYWVKHCDIKMIFYDVNFRLYDDYEKNEKLNKQGQWIWKWIHPLTEEDEGLCAGKEGVKMCFIYSDELCKEIYQAKAEGKAYQRKGDPDDVLLVMGTSSSSQAIIKNGQCTKMKFVPWQFKQCVDKYKQFLTPQNRLYTDLFVNIPFHQSFGAICALSYCVTGASGLIFKTQQLSDIGFVPEMILDDMAETKAQSVCHFPFQYAEYKKLFDENHPRKKIWADYFREDHEHKVFKTGGAPLNPVVAKWYKDTFDILIMNGLGSTEGGHVLHDIMEGEILPGEEGYYMRVPWVDFYFKPLNDDDPTIGELYTHSSANVTGYFGRAKPGE

SEQ ID NO: 591 - protein, 70 aa, Neocallimastix californiae
  Acetyl-CoA synthetase-like
FKTNDVLKRSPKSGYYKYVTRIDSIITFATGLKMNPLPFENTINFECTNIKHCCLILDSTQTEVVCFVEP

SEQ ID NO: 592 - protein, 628 aa, Neocallimastix californiae
  Acetyl-CoA synthetase-like
NTVTSFLNKRCYYYGNDPMIVAKPNLFSLPFKPKPNKNFPKPYLSVTYSEFSNLAKSYAYVLKHKYNIPSHSRIGIIGEASPIHHLLLTYTVWYLRGTIVDISTGVGEEVVQAWMTTTDVILTLYDSGLPPFPSIQSININEELEWTWTWTSKIGNEDEINKTKSMTMVNIENDILNTEVLSAYKSGNFFEEELSPDDYVSIIGTSSSTQAVVKDGVYTKMKFVAAKSPVLLNTEYFRKIATYKNKPTALFNLGYGSAIGQRHSFMYAIMCGGPIVFGTKNKENIGLIPEVVLDDIDTIKPDICFIFPYMFSIWKNFADDNHPNWPRWKSALESRPKWCFSTGGAPVDPEILHWLRKDLNIQLNNIYGTSEAGLVFTRNEYTVDVEGEEGYVSELPGVEYYLDPIDGNENEGELYVHSPLVFSGYVDKAKEGDPNSCYGIVVNKWREENFRTFNGKEYYKTNDIWRRCPKTGNYCYVSRVDDTLVFKTGIKMNPIPFESTMTLKCNSIKNCCLLLEKKHQTDVFFFVEPIWDKIDGIDLTNEEMMKTTASSIAKDQIWNEISAVLKKEMSSMANWVKQISKNSLYIVEYGQKIPITLKGNVSRRNCKIAFNKILDELSSDSNIANEES

SEQ ID NO: 593 - protein, 505 aa, Neocallimastix californiae
  Acetyl-CoA synthetase-like
PNPYLSVTYSEFANLAKSYAYVIKQKYNVPSHSRIGIIGEANPIHHLLLTYAVWYLRGTIVDISTGVGEEVVQAWMTTTDVTLTFYDSGLPSFPSLQSINPMDKSDWVWSWSSKIGNENDKNEIKTMTMVNLESDILNAEVLSAYKSENFFEEALSPDDYVSIIGTSSSTQAIVKDGVYTTMKFVAAKSPVILNLEYFRKIATYKNKPRVLFNLGFGSAIGQRHSFMYAIMCGGPIIFGTKNKKNIGLIPEVVLDDIDTVKPDICFIFPYMFSIWKSFKDNKHPDWPRWRNALRSRPKWCFSTGGAPVDPEILRWLRKDLYIQLNNIYGTSEAGLVFTRNEYTVDVEGEESYVSALPGVEYYLDPVNENENEGELYVHSPLVFSGYVDKAKEGDPNSYYGIVVNKWHDENFKTINGKEYYKTNDLWKRCPKTGNYCYISRVDDTLVFKTGIKMNPIPFESTMTLKCNSIKNCCLLLETKNQTEVFLFVEPVWDKINGLDLSNEEI

SEQ ID NO: 594 - protein, 289 aa, Anaeromyces robustus
  Acetyl-CoA synthetase-like
LHPKVMVVAPLYHSLGSAWSIAQIMNTGSPLIFRTQKKYDIGFVAENILDDIIETRPDVIPLFPINFVEFKRLFDENHPKCEIWAKGISSLSRRCFLSAGAPPNYEVMCWFENKFKIPVNNVCGATEAGLFLYKDIDKPQVPGETNYVSRCPWIHFHMEHMSDDPNEGELYIYNPFGIYGYATKAKKGEFYESTLPKIRIDLEHDDLYKTINGLEYYKTNDIWRRSTVSGDYVYVARADDVINFSNGLKMNPLPFESTVTYECNDIKQCCLLLDDTQCEVVCFVEPEWS

SEQ ID NO: 595 - protein, 563 aa, Anaeromyces robustus
  Acetyl-CoA synthetase-like
NMIDRINIRFSSRKDNVAIVAKENILLFPFKGVPSPEYPDPWLTVSFKEFHSLIKALAYVLKKRYDFRVGDRVGITANTLPMTQLYLYALFFLRCVVVLIPPKLGNDVKQYWVRHNDIRMIFYDFSLRISDNDEENQKLNDQGEWTWPWTYPLTEEDAGLSAGEEGIPMCFMYNKDLCNEIYQTKLDGKEYYRKGDRNDVLMILGTSSTSQAIIKNGQCSKMKFVTYQVTRVGTIYQKVLMPNVKHYTNFYLNCPFHHGMGANNAVGFSIVNGGPLVYHTQKLYDVGFIPEIMLDDMTEVNAVNTLQFPFHYEGYKKLFDENHPKCPIWAKYLSKHDKHRIFKFGGALLNPVVKEWYKEKFGIHIVNDFGSSEGGNTLVEDIENVLPGEEGYFKRIPWVDFCLKPLNENEPNIGELYTHSNIMTLGYVGRAKPGEFYDSPIPGMTCDIDADTLFTYIDGVKYYKTNDVFMRSPVSGKYKFVTRMDGILAFSTGLKMNPIPFEETITDECDDVVRCCLLLNDTLTEVICFVEPNWNEIIIDGKKFDTSIEASTLDKDTIKSMKK

SEQ ID NO: 596 - protein, 70 aa, Anaeromyces robustus
  Acetyl-CoA synthetase-like
FKTNDVVRRSPLSGKYKYVSRIDSILTFATGIKMNPMPFEETIMSECQNIKKCCLILDSTQTEVVCFIEP

SEQ ID NO: 597 - protein, 441 aa, Anaeromyces robustus
  Acetyl-CoA synthetase-like
LKENNIIDRINRRFTLRGDNIAIVAKDNILPIPFKSVPHPDYPEPWVTVSFKEFHALIKAMAYVIKRRFDFAPGTRVGVIANSLPITHLLVYTLWTLRCIVVFIPPKIGNDVKQYWVRHIDIKMIFYDINFRPFDDDNINKELNEQCQWIWKWTYPLTEEDEGISAGKEGINMFYFYDEDFRNEIYNIKLEGKGYYRKGCSEDVLTVVGTSSSSQAIIKNGQCSKMKFVPWQMVHLGNFSQKSLTIQYEYFSPFFLDIPYHHSMGITCALSYNINCGGPIVYHTQQLYEVGFIPEMVLTDIVETKSKVIQLFPFHFVAFKKLFDDKHPKCEYWSKYLGNGDKSKLFRSGGAPLNPMVKKWFKDTFDIQIITGCGSSEGGYILHEIVDDEVLPGEESYIWRRVPWVDFLILPLNENEPNIGELYTRNEANVPGYIGRPKPGE

SEQ ID NO: 598 - protein, 570 aa, Anaeromyces robustus
  Acetyl-CoA synthetase-like
EYNNNIHNIEYIPKIEKERIIETFNNNEYNYDRNKFYHEEFSKVAKEIPNKCAIVCNNNEITFKKLDEMSNSLAHYLRKENIGRGDIVPIISERSHYFVIATLAIMKSGAAFLPIDPDFPKERIEYMINEVNAKFILKYITNIETERKIKFDNVIEYELQKHNYKDNVFEITNINNSDDLCYVLFTSGTTGKPKGTMMTHNNLINYSLYSQTYNGKEIYTNDFNNALSAAKFTFDMSLCEILYPLIKGKCVFICDDNEYNNPQLIGEKILKYNIDYIFSTPSRIENYMKNKTYMKALKNLKCILIGGEGCNIKTVENIIKNTNANIYNLYGPTETTIMCTVSELSNLYKQNKLNVITIGKPLCNCKLYILDEYLKPVPIGVEGEIYIGGYGVGKGYLNREQLTREKFVDCPFNIKNGLPNQMYSTGDLGKWTEKGEIICSGRADFQVKIRGQRIELTEIENTIKKIKGIKYSIVIDKIKENNDKYLMCYYITDENINSGDIRNYLKNKLPIYMIPSYFKKIDNIPVTSNGKLNRKALPEPNIDDLIKENYIAPISKVEKIICKIYSNVFN

SEQ ID NO: 599 - protein, 402 aa, Anaeromyces robustus
  Acetyl-CoA synthetase-like
INNSDDLCYVFFTSGTTGKPKGTMMTHNNMTNFCLYSQHFNGNENIYDYGFENALAFSKFTFDMSLIEIYYPLYKRCRVVLCNDEEFNNSEMLSDLIIKYNVNYICSVQSRIKNYIKDEGFKKALKNVKWIGLGGEKLNSDIIQDIKNCSKATLINYYGPTETTVCCTLKKFENNELNNFENNNTSITIGKPLCNCKIYILDKYLKPVPIGVEGEIFIGGNCVGKGYLNREDLTKEKFVNCPYYNSINGSSNKMYRTGDLGKWTKEGEIICLGRADFQVKINGQRIELSEIENTMKEINGIDYAIVIDNNKENGNKYLTGYYISKNNITGKDIRKSLKLKLPSFMIPNYFIRIYNLPITSSGKLDKKSLPIPNINDLINEQYVAPETETEKLICNVYSKTLN

SEQ ID NO: 600 - protein, 41 aa, Anaeromyces robustus
  Acetyl-CoA synthetase-like
FSKNAKSNPDKCAIIFENREFTYKELDEMSNSLACYLRNYG

SEQ ID NO: 601 - protein, 191 aa, Piromyces finnis
  Acetyl-CoA synthetase-like
FKTGGAPMSDEIDNWLFETFGIRSFQDYGSSEAGSIMNSDFSKPALPGEETYLSKRPWADIYLKPIDDDPNIGELHVRSPTNTTGYIRKAEIGEFYESSMPSMRTDIGAESLFTYINGEKFLKINDIWRRSPKSGKYKYISRIDDVIVFSTGLKMNPIPFESTVTKECNNIKYCCLILDSSKSEVVCFVEP

SEQ ID NO: 602 - protein, 52 aa, Piromyces finnis
  Acetyl-CoA synthetase-like
LYSVLMDDSKSLTSWAKQLTINNIFVIEYGKQLPRTEKGSISRRITKVEYEN

SEQ ID NO: 603 - protein, 523 aa, Piromyces finnis
  Acetyl-CoA synthetase-like
EKMNHRFAVSKDKPMIVAKENILTPPFKGIPNEKFPSPWLTVSFNEFEKLAKAMAYVINKRYHLEPQSRVAIIANSLPKNHLLSIALWYLRVVTVEITPKIGNDVKQCWMRMLNMSMGFYDCVFKPFYQDHKNEEEWVWPWIYPPTSNENLVAGNEGVLMVDMDSESFIQEVIEARDQGLTFEREGDWDDLLTIGGTSSSAQAIIKNGQCSEMKFVGVHHRKAGSCYEKYLHKHLPEETNFLLVSPFHHLLGICQGMLHPIYDGGPLIYRTQSVDDVGVISEMLLDDIAEIDVTETLIFSFQFAEWKKLKEAGHPKWPIWEKAIRSRPIGCFQTGGAPPIPEVTKWLARELQLFPAESYGSSEGGVMMYTEGLPPLRGEEGYLKRIPYVDIYLKPLNEDDPNIGEAYIHSAQNFTGYVRRIESGETCENSPCPGLRVDIKADECFVEIDGKKFFKTNDIFRRSPITGDYKFVSRVDDIIAFSTGLKMNPVPFERTMVQFCKNVKLCCLLLDTTGTEAVCFVEP

SEQ ID NO: 604 - protein, 308 aa, Neocallimastix californiae
  ACID PHOSPHATASE RELATED
WYSKSKEYPLIRFGVSKDLTEENEVTGTSYQCKNIDDVQYYCNQVTVTGLESLSTYYYQRNLNGKWEDVIEFKTKNPNNFRFVFLGDPQIGASKNNFSVLTEQRLTEEEGLRNDAFNWNMTIYNSYAKANEASIILSAGDNADSGQSPGDSSGKTEEYIRNDLLRQEREYSTLLLPKLMQQVPFAPAVGNHESFTPSFRYHFNTPNPYLIGKTETSPGYSYFFKHNNVLVIVLETNYGTEEEFREVVGKANSTFPDVDWRVALFHHDIYSNGYTHSQDPLITEYIRKEVTQLFDIYDIDLVINGHDHM

SEQ ID NO: 605 - protein, 363 aa, Neocallimastix californiae
  ACID PHOSPHATASE RELATED
ERLAVIPGEDETKLNFGWYSISNEYPLIRFGSTSDLTEKDEVRGINFKCKNINDTQYYCNHITVTGLKSNTIYYYQRNLNGNWEETIEFETRSPDNFRFIFLGDPQIGASAGAISELHLNKVLSDDEGLRNDAFNWNMTIYNSYEKANGPSLILSAGDNADSGQSPSNENSKIEDIKKDLIRQEKQYSALLLPSLMQKVPFATALGNHESYSPSFKYHFNNPNPYKVERSEFSPGYNYFFKYNNALVVMLESNYGIKDDYSDVISNATSTYPDTDWRIAVFHHDIYSNGVMHSSEYRVTELRKWLTPLFDEYDFDLVINGHDHMYSASQFVHHDKSSTDKFKYKVSEIERGKVYDNPKGTLYI

SEQ ID NO: 606 - protein, 322 aa, Neocallimastix californiae
  ACID PHOSPHATASE RELATED
INGVQYYCNQVSVTGLKPNSIYYYKRNLDGTWEETIEFKTKDPENFRFVFLGDPQIGSSRGSYSIGNRKQFSDDEGLRNDAFNWNMTIFNSYSKANEASLILSAGDNADSGETPSNGDILDNISNISKMSTDLLRQEKEYSSLLLPELMQKVPFVPAVGNHESYTATYRYHFNTPNSYKVESENQIPGYNYTSITPGYNYYFKHNNVLIVVLESNYGNEEIYTTVMNMANDAYPDVDWRIALFHHDIFSDGYIHSEEGRVQELRQWLTPLFDKFNFDLVINGHDHMYSASHFITYGNNNNIYKFEKIEKNKIYKDPNGTMFI

SEQ ID NO: 607 - protein, 303 aa, Neocallimastix californiae
  ACID PHOSPHATASE RELATED
NEFYRKKDDVNYYSNKVTVSGLEPNSVYYYQRKLNNKWEDPVKFNTFDPDNFKFIFLGDPQIGGSIGRHQYHSSDYFDYAEAIRNDAFNWNITIFNSIKFTKTPSLILSAGDQADTMGDDITQEQQYSGLLLPELIKTIPFAPTLGNHEVFSESFRRHFNVPHPYIPKKYDDLDYVPAYNYYFKYNNVLVVVLESNHNSCHDCEIVMAKAVDKYPNTDWRIALFHHDIYGNGATHSQGDAKKLRPCLTGLFDIYKFDLVINGHDHVYTTTKFINYNNSNKKSYTLSEIKEGVTNKNPKGTFFI

SEQ ID NO: 608 - protein, 315 aa, Neocallimastix californiae
  ACID PHOSPHATASE RELATED
IKNVQYYCNQVTVTGLERNSIYYYQRNLNGKWEDPIEFKTHDPDNFRFVFLGDPQIGASRNLISGKKSLTDDEGLRNDAFNWNMTIYNSYEFANEPSLILSAGDNADSGQSPGDDKKSEENIKIDLLRQEREYSTLLLPQIMQKVPFASAIGNHESFTPTFRYHFNTPHSYKVESDNFIKGFQSSITPGYNYFFKYNNVLIVVLESNYSTEEQYREVIENAITTYPETDWRIGLFHHDIYSNGYGHSTEPRVMDLRKWLTPMLDKYDFDLVINGHDHVYVATHFVTSDKNSKNGYSFNKIERNKVYNDPKGTLYL

SEQ ID NO: 609 - protein, 320 aa, Neocallimastix californiae
  ACID PHOSPHATASE RELATED
INGTQYYCNQVTVIGLEPNSTYYYQRNLNGNWEESIEFKTHDPYNFRFIFLGDPQIGASHNVLSIDKYIDDDESLRNDAFNWNMTIYNSYSKANEASLILSAGDNTDSGQSPSDRDILRYPDELEYDLIKQEKEYSSLLLPELMQKVPFASAVGNHESFTASFRYHFNTPNSLEVESNNQIPGYDYASVTPGYSYFFKYNNVLIIVLESNYGTEEQYETLLEKACSTYPGVDWRIALFHHDIYSNGFNHSEEERVLLLRQWLTKLLYKNKIDLVINGHDHIYSASHFISYDINNSNQYKYNITEIERNKIYKDHKGTMYI

SEQ ID NO: 610 - protein, 345 aa, Neocallimastix californiae
  ACID PHOSPHATASE RELATED
RIALTPGADETQLNFGWESLTNIEPVIRISSDKNMKIYKDFIGKNEYYRELDGNKYYSNQVTTTGLKPNSVYYYQRKLDGKWEDVVEFNTYDSNDFKFVFVGDPQIGGSNDRLAYKSKSKMNESSIGNDAFNWNMTVNSFYELTGKPSLLLSAGDQADYMGGDKTQERQYSAYLLPDLIKKIPIAPALGNHEVYSESFRRHFNVPNPMFNALHYKTSYSAYNYYFKYNNVLVVVIESNYNTCHQCEKIISKAVKEYPDADWRIALFHHDLYGNGNTHSQGDAQRLRPCLTGLFDIHKFDLVINGHDHVYTSTHFVKFHDSQNKIYDIAKISKGSVNENPNGTFYV

SEQ ID NO: 611 - protein, 316 aa, Anaeromyces robustus
  ACID PHOSPHATASE RELATED
FPGEDESMLNFAWYSVGKSYPKVRLSTDKKMSNPIEFEGDLVRNRSKYIRKQGYMINRVTVSGLERNKTYYYQVYMDGEWEKPVEFKTYDPDNFTVAFLGDPQIGGSAGHIPYEKNFKDTLSIEEATRNDAFNWNMTIYKIFEKTVKPSLILSAGDQIDYDGNRKSEYDIDIQEEQYAAFFLPEKLKQVPIAEAIGNHESRLDTFNLHYNVPNPYDTPIEPQIAPGYSYFFKHNNILVVVLETNFGFCEDYQEVMRRAYNKYPDTDWRIALFHHDIYSSGWCHSQEESVTDFLRPCLTELFTKYKFDLAINGHDHI

SEQ ID NO: 612 - protein, 329 aa, Anaeromyces robustus
  ACID PHOSPHATASE RELATED
WYSKTESIPTIRLSTKEDMSNYTEFTGINEYHRIYIEDPYYTNKVTVTGINRQSTYYYQRKLNDQWEDPIKFTTHDPDNFKFIFFGDPQIGGSHSHVSLGQRRILGVDDGIRNDAFSWNRTISKSFEFTKEPSLILSAGDQADDDVDELYQEIEYSALFLPELLKTVPLATAVGNHDSYTINYRQHFHVPNPYLTPEYQYTIPGYSYFFKYNNVLVVVLETNYITENDAYEIIPNAVKKYPDTDWRIALFHQDLYSNGYTHSQQYDVLRLRPFLTKLFSEYNFDLVINGHDHIYSASQFVSYDNINDYYKVSFIQRGKPQENPEGTLYI

SEQ ID NO: 613 - protein, 327 aa, Anaeromyces robustus
  ACID PHOSPHATASE RELATED
WYSTTESNPIIRFSSNQDMSNAKNFIGTIEKYMVLNNKTYYSNKVTVTGLEPHSTYYYQRNLNGKWDEPISFFKTHDPNNFKFIFVGDPQIGASHDRISFAKNLQDVLTIPESTRNDAFNWNMTIYKSFEFIKEPSLLLSAGDQIDIACSPKTEEDLYLQETQYSGFLLPDLLKTIPSVIAVGNHEALTHSFKHHFNPPNPYTTPIEPELAPGYSYFFKYNNILFVILETNYGFCDDFKEVMRRAYLKYPNTDWRIAMFHHDIYSNGSNHSQEEYIVRFLRPCLTELLSKYKFDLVINGHDHAYSSSHLISFHQYLNNNNDNNNNNT

SEQ ID NO: 614 - protein, 301 aa, Anaeromyces robustus
  ACID PHOSPHATASE RELATED
WYSKTKTEPAIRVSKYKNMKPYVDFVGKIEFYREIGGQSYYSNKVTISGLERSSTYYYQRRLNNKWESAIKFNTYDPDNFKFIFVGDPQIGGSEGHVTYDNPTEPLSEVDGTKNDAFNWNMTIHKSLELTKEPSLLLSAGDQVNAFCMEGYDKQYELQEYEYSALLLPDPLKSLPMATTVGNHEIYTKAFKNHYHTPNSYETPLEPDLAPGYNYFFKYNNVLVIVLETNYGYCDDFKEVMRRAHLKYPNTDWRIVMFHHDIYSNGKFHSQESYITDTLRPCLSQLMTYYKIDLVINGHDHI

SEQ ID NO: 615 - protein, 317 aa, Anaeromyces robustus
  ACID PHOSPHATASE RELATED
ERISVFVGEDESKLNFGWYSTSNSKPKIRFGSKKDLSDAKDFTGTNSYYKTLNGKKYYSNKVTVTGLKRKSTYYYRRNLNGKWEETIRFNTYDPNNFQFIFVGDPQIGGSHDRLSVADPYHVLTREEGTRNDAFNWNMTIYKSFEKTGKPSVLLSAGDQVDTECFSGTTEEDYSQEIQYSAFLLPDLLKTIPSATTVGNHEALNKNYRNHYNTPNSHIPLEPEIAPGYSYFFKYNNVLVVVLETNYSFCDDFKAVFKKAFLKYPNTDWRVAMFHHDIYGNGSFHSQDEYIINKLRPCLTELLSYYKFDLVINGHDHI

SEQ ID NO: 616 - protein, 344 aa, Piromyces finnis
  ACID PHOSPHATASE RELATED
WYSTTETIPSICWGTTKDTSDCEEFKGTVTYFKDLSGTSYYSNAVTVKNIKRNTTYYYKRKLNGQWEKPIQFKTYDQDNFKILFVGDPQIGGAHDRITASNNYSRVLTREEGNRNDAFNWNVTVYNSFNFAGQPSLLLSAGDQADEEYAVKGNEYDYNEESQYSAFLLPKLMQTIPTVPTIGNHDSYTENFKYHFNTPNNYASKNYTKYYNGNEPGYNYFFKYNNILFVVLNTNAPICEEFTEIINKAITKYPDTDWRIAMFHQDLYGDGSTHSQNDGITKVLRPCLTKLIYDNKFDLVLNGHDHVYTVSKFITYTGADNYGGYGFNSIERNKVYHKPDGTLYI

SEQ ID NO: 617 - protein, 305 aa, Piromyces finnis
  ACID PHOSPHATASE RELATED
YSNKVSVTGLERNSVYYYKRKLNGQWEKPIQFKTYNPDNFKFIFVGDPQIGGSHDRYSISNLYERVLTVDEGTANDAFNWNRTITHSFDFVKEPSLLLSAGDQADEENNSFYSDQEHYNEETQYSALLLPKQIQTIPMAAAIGNHDRNTENFRHHFNVPNPYKNPSYLMDDGWIEGYNYYFKYNNVLIVVLNTNHEECVDFESVITNAVEKYPDTLWRIALFHHDIYGNGVTHSLEDGMKNVLRPCLTKLLSNFKFDLAISGHDHVYTASKFITYDANANNSGKYVTSDIQTNETFKDPKGTFFI

SEQ ID NO: 618 - protein, 342 aa, Piromyces finnis
  ACID PHOSPHATASE RELATED
WYSTTKTLPSIRYSVNKDMSDAVQYDGYFEQHYKLNGTQYYSNKVTIEDLKPNTVYYYQRLLNGEWEKPVIKLKTRDPYNFKFVFVGDPQIGGSHDRFSITNNYERVLTLNEGNRNDAFNWNRTISRSFEFANKPSLLLSAGDQADEECKHLEDNEKGPMELLNEEMQYSAFLLPDLLKSVPVAAAVGNHDASNNNFRKHFNSPNSYTDPKYQDLIPGYNYFFRHHNVLVVVLETNYGYCEDFSNVIEKAIKKYPDVDWRIAMFHHDIYGNGVTHSKEPYIVNELRPCLTQLFYENKFDLVINGHDHVYTASKFISYDNNNYSVSDIKKNKVYKQPKGTFYI

SEQ ID NO: 619 - protein, 342 aa, Piromyces finnis; identical to SEQ ID NO: 618
  ACID PHOSPHATASE RELATED

SEQ ID NO: 620 - protein, 359 aa, Piromyces finnis
  ACID PHOSPHATASE RELATED
EHLSVSVGEDESMLNFGWYSTMDEIPSIRYGTAEEDESQYKEFTGTLLKHRTIKDTVYYSNKVTITGLQRNTIYYYQRKLNGIWEPAVEFKTYPSDHFNFIFLGDPQIGGSKNRYSKLLKDRGVTIEEGIRNDAFNWNRTLTEAVNYVKTPSLILSAGDQAESMAYDSDEELILQEKEYAAFLTPNLIQSIPTAATVGNHDQYTDNFIHHFNPPNLYNQDTVLQTTGTRVLPGYNYYFKYNNVLVVVLDTNNHNCTDFSTVIEEAIEKHPKTDWRIAMFHHDIYGNGSTHSSEDDIKLYLRPCLTPLIDKAHFDLVINGHDHVYSSSKFISYNDDGSLYSLNDIETNKIYENQNGTLYL

SEQ ID NO: 621 - protein, 359 aa, Piromyces finnis; identical to SEQ ID NO: 620
  ACID PHOSPHATASE RELATED

SEQ ID NO: 622 - protein, 359 aa, Piromyces finnis; identical to SEQ ID NO: 620
  ACID PHOSPHATASE RELATED

SEQ ID NO: 623 - protein, 359 aa, Piromyces finnis; identical to SEQ ID NO: 620
  ACID PHOSPHATASE RELATED

SEQ ID NO: 624 - protein, 52 aa, Neocallimastix californiae
  ACP_DOMAIN
IFEVMELELKKVLQYGENDEIDPYQSLSELGIDSIMMMELRTILKNVTGINI

SEQ ID NO: 625 - protein, 60 aa, Neocallimastix californiae
  ACP_DOMAIN
TKDNIPEILKEEVRRMLMYNENDELDIFQPLSELGIDSIMMMELRQIIKAVTNITVPLSI

SEQ ID NO: 626 - protein, 71 aa, Neocallimastix californiae
  ACP_DOMAIN
AIRMIHESIKEIIPSTPEFNKFNPDAPFTVYGIDSLSVIKLTNVLSRKFNKKYSPAILFTYGTTASLAKYL

SEQ ID NO: 627 - protein, 56 aa, Neocallimastix californiae
  ACP_DOMAIN
LTKDITEKLQSMLGLIDEEIDVTIPLRVYGLDSLTAMELTKWIESEMNIEFSQSQL

SEQ ID NO: 628 - protein, 56 aa, Neocallimastix californiae; identical to SEQ ID NO: 627
  ACP_DOMAIN

SEQ ID NO: 629 - protein, 69 aa, Neocallimastix californiae
  ACP_DOMAIN
LKNEICDRLQNMLGLVDEKIDPAIPLRVYGLDSLTTMELTNWIQSELKVTLPQSQLLSDEITTNELVSI

SEQ ID NO: 630 - protein, 56 aa, Neocallimastix californiae
  ACP_DOMAIN
LTKDITEKLQSMLGLIDEEIDVTIPLRVYGLDSLTAMELTKWIESEMNIEFNQSQL

SEQ ID NO: 631 - protein, 69 aa, Neocallimastix californiae
  ACP_DOMAIN
LKNEVVEKLQDLLGLVDENIDTNVPLQVYGLDSLTSMEIVKWVENDKKVELPQSALLSSEITTEELVNM

SEQ ID NO: 632 - protein, 56 aa, Neocallimastix californiae
  ACP_DOMAIN
LTKDITDKLQSMLGLIDEEIDVTIPLRVYGLDSLTAMELTKWIESEMNIEFSQSQL

SEQ ID NO: 633 - protein, 56 aa, Neocallimastix californiae; identical to SEQ ID NO: 627
  ACP_DOMAIN

SEQ ID NO: 634 - protein, 56 aa, Neocallimastix californiae; identical to SEQ ID NO: 627
  ACP_DOMAIN

SEQ ID NO: 635 - protein, 56 aa, Neocallimastix californiae; identical to SEQ ID NO: 627
  ACP_DOMAIN

SEQ ID NO: 636 - protein, 71 aa, Neocallimastix californiae
  ACP_DOMAIN
AIRIIYESIKEIIPSTPEFEKFDPESPFTVYSIDSLAIIKLTNILSRKFNERYSPAILFNYGTTSLLAQYI

SEQ ID NO: 637 - protein, 82 aa, Neocallimastix californiae
  ACP_DOMAIN
TEEEINEEIQKAVMIVYESIKEIIPSTPDFEDFNINAPFTIYSIDSLATRKLTSVLNRKTLKPFSASTLFNYGTPYDLARYI

SEQ ID NO: 638 - protein, 75 aa, Neocallimastix californiae
  ACP_DOMAIN
SEEFLIMLIYQSIKEIIPSTPDFEQFVPEKSFTMYGIDSLTTVKLTNLLSRKLKKNYSPSIIFNYASPLLLAKYL

SEQ ID NO: 639 - protein, 82 aa, Neocallimastix californiae
  ACP_DOMAIN
TREEINDEIQDAIKLIYQSIKEIIPSTPEFESFNPESPFTIYGIDSLSTIKLTNVLSRKLNKHYSPAILFNYGNTFELAKFL

SEQ ID NO: 640 - protein, 56 aa, Neocallimastix californiae; identical to SEQ ID NO: 627
  ACP_DOMAIN

SEQ ID NO: 641 - protein, 56 aa, Neocallimastix californiae; identical to SEQ ID NO: 627
  ACP_DOMAIN

SEQ ID NO: 642 - protein, 56 aa, Neocallimastix californiae; identical to SEQ ID NO: 627
  ACP_DOMAIN

SEQ ID NO: 643 - protein, 56 aa, Neocallimastix californiae
  ACP_DOMAIN
SKDNIFEIMETELKRILQYGENDEIDPYQSLTELGIDSLMMMEFRTILKNVTTVNI

SEQ ID NO: 644 - protein, 71 aa, Neocallimastix californiae
  ACP_DOMAIN
IINVIYSCMAEIIPSTVPFDEFNIYDTFTSSGFNSINSVKLIKLLNSKLKTNYSTVMLFNFNSPYELARAL

SEQ ID NO: 645 - protein, 71 aa, Neocallimastix californiae; identical to SEQ ID NO: 644
  ACP_DOMAIN

SEQ ID NO: 646 - protein, 71 aa, Neocallimastix californiae
  ACP_DOMAIN
IINVIYSCITEIIPSTVPFDEFNIHDTFTSSGFNSINSVKLIKLLNSKLKTKYSTVMLFNYNTPYELAKAL

SEQ ID NO: 647 - protein, 71 aa, Anaeromyces robustus
  ACP_DOMAIN
AIKLIYEAIKEIVPSTPEFEEFNINAPFTIYSIDSIGTRKLTNILGRRTGKPFTTSTLFNYGTTYDLAKYI

SEQ ID NO: 648 - protein, 82 aa, Anaeromyces robustus
  ACP_DOMAIN
SQEEINEEIQEAIKLIYESIKEIVPSTPEFEEFNINAPFTIYSIDSIGTRKLTNILARRTGKPFTSSTLFNYGTTYDLAKYI

SEQ ID NO: 649 - protein, 74 aa, Anaeromyces robustus
  ACP_DOMAIN
IEEGIKIIYQSIKEIIPSTPSYEEFNPERPFNLYGIDSLATVKLTNVLSRKMGKRYSPAILFNYGNSLELAKFI

SEQ ID NO: 650 - protein, 56 aa, Anaeromyces robustus
  ACP_DOMAIN
INEILKREVRRMLMYNDNDELDELQPLSELGLDSIMMMEFRQIIKAVTNIVVPLSI

SEQ ID NO: 651 - protein, 56 aa, Anaeromyces robustus
  ACP_DOMAIN
TEDNVYAIMESELKRILQYSENDEIDPYQSLTELGIDSIMMMELRTILRTATGVNI

SEQ ID NO: 652 - protein, 74 aa, Anaeromyces robustus
  ACP_DOMAIN
IDEAIKIIYYSVKEIIPSTPEFEDFNPERPFNFYGIDSLATIKLTNIISRKLGKRYTPAVLFNYGNALELAKFV

SEQ ID NO: 653 - protein, 69 aa, Anaeromyces robustus
  ACP_DOMAIN
TEKLICNVYSKTLNIDESKIGKMSDFFELGGDSLNAIRIISMIEKELNIKLYIKDILSHPLVSEISEYI

SEQ ID NO: 654 - protein, 73 aa, Anaeromyces robustus
  ACP_DOMAIN
PISKVEKIICKIYSNVFNINENSVGLMNEFYELGGDSLIVISILSLIEKELKIKLNVKDILSHPLIKDLCDYI

SEQ ID NO: 655 - protein, 71 aa, Anaeromyces robustus
  ACP_DOMAIN
LINMIYSCIVEIIPSTVPFNEFNADEAFSSFGLNSINSIKLIKLLNSKLKTNYSTVMLFNYNSPTELAKAL

SEQ ID NO: 656 - protein, 56 aa, Piromyces finnis
  ACP_DOMAIN
SEDNIYEIMEHELKNVLQYGENDEIDPYQSLTELGIDSIMMMELRTIMRTATGINI

SEQ ID NO: 657 - protein, 71 aa, Piromyces finnis
  ACP_DOMAIN
AIRIIHESIKEIIPSTPDFLEFNAEAPFTIYGIESLATIKLANILSRKFNKRYSPAILFNYGTTMLLAKHI

SEQ ID NO: 658 - protein, 67 aa, Piromyces finnis
  ACP_DOMAIN
IYQSIKEIIPSTPDFELFNPENPFNIYGIDSLSTIKLTNILSRKLNKYFSPAILFNYGNTYALAKFI

SEQ ID NO: 659 - protein, 56 aa, Piromyces finnis
  ACP_DOMAIN
VQDILKKEIRRMLMYNEDDEIDEMQPLSELGMDSIMMMEFRQVIKAVTDIMIPLSI

SEQ ID NO: 660 - protein, 60 aa, Piromyces finnis
  ACP_DOMAIN
NKDKLTKDISEKLQSMLGLIDEEIDVTIPLRVYGLDSLTAMELTKWIESEMNIEFSQSQL

SEQ ID NO: 661 - protein, 60 aa, Piromyces finnis; identical to SEQ ID NO: 660
  ACP_DOMAIN

SEQ ID NO: 662 - protein, 60 aa, Piromyces finnis; identical to SEQ ID NO: 660
  ACP_DOMAIN

SEQ ID NO: 663 - protein, 60 aa, Piromyces finnis; identical to SEQ ID NO: 660
  ACP_DOMAIN

SEQ ID NO: 664 - protein, 60 aa, Piromyces finnis; identical to SEQ ID NO: 660
  ACP_DOMAIN

SEQ ID NO: 665 - protein, 60 aa, Piromyces finnis; identical to SEQ ID NO: 660
  ACP_DOMAIN

SEQ ID NO: 666 - protein, 69 aa, Piromyces finnis
  ACP_DOMAIN
LKNEVITKLQDLLGLVDEEIDVNVPLQVYGLDSLTSMEIVKWIENDKNVDLPQTALLNSEITTEELINM

SEQ ID NO: 667 - protein, 60 aa, Piromyces finnis; identical to SEQ ID NO: 660
  ACP_DOMAIN

SEQ ID NO: 668 - protein, 67 aa, Piromyces finnis
  ACP_DOMAIN
IYQSIKEIIPSTPDFDQFDPEMSFTMYGIDSLSTVKLTNILSRKLKKNYSPSIIFNYASPLLLAQYL

SEQ ID NO: 669 - protein, 90 aa, Neocallimastix californiae
  ACP-like
NEDNIFEVMELELKKVLQYGENDEIDPYQSLSELGIDSIMMMELRTILKNVTGINIPLVVFSTQNICLYRLVEYVKTKLVKEKEEAAKSK

SEQ ID NO: 670 - protein, 72 aa, Neocallimastix californiae
  ACP-like
NIPEILKEEVRRMLMYNENDELDIFQPLSELGIDSIMMMELRQIIKAVTNITVPLSIITTPNLTLSKIFEYL

SEQ ID NO: 671 - protein, 103 aa, Neocallimastix californiae
  ACP-like
MIHESIKEIIPSTPEFNKFNPDAPFTVYGIDSLSVIKLTNVLSRKFNKKYSPAILFTYGTTASLAKYLKGYENISYLPSQEKDHGASSNKKIAIIGMAFRLPG

SEQ ID NO: 672 - protein, 100 aa, Neocallimastix californiae
  ACP-like
KDKLTKDITEKLQSMLGLIDEEIDVTIPLRVYGLDSLTAMELTKWIESEMNIEFSQSQLLGDDITTEDLINIIMDGSPATSAPVAAPIVKDTMASITPVV

SEQ ID NO: 673 - protein, 87 aa, Neocallimastix californiae
  ACP-like
ALKNEVVEKLQDLLGLVDENIDTNVPLQVYGLDSLTSMEIVKWVENDKKVELPQSALLSSEITTEELVNMIASKITGEDLVKAPSYD

SEQ ID NO: 674 - protein, 89 aa, Neocallimastix californiae
  ACP-like
KDKLTKDITEKLQSMLGLIDEEIDVTIPLRVYGLDSLTAMELTKWIESEMNIEFSQSQLLGDDITTEDLINIIMDGSSSAPVTESTQVA

SEQ ID NO: 675 - protein, 76 aa, Neocallimastix californiae
  ACP-like
LKNEICDRLQNMLGLVDEKIDPAIPLRVYGLDSLTTMELTNWIQSELKVTLPQSQLLSDEITTNELVSIIINLLAN

SEQ ID NO: 676 - protein, 90 aa, Neocallimastix californiae
  ACP-like
KDKLTKDITEKLQSMLGLIDEEIDVTIPLRVYGLDSLTAMELTKWIESEMNIEFNQSQLLGDDITTEDLINIIMDDSSSTQDVTLAPVAV

SEQ ID NO: 677 - protein, 99 aa, Neocallimastix californiae
  ACP-like
NRDKLTKDITEKLQSMLGLIDEEIDVTIPLRVYGLDSLTAMELTKWIESEMNIEFSQSQLLGDDITTEDLINIIMDGSSSAPVTESTPVAPAPEAPVVA

SEQ ID NO: 678 - protein, 99 aa, Neocallimastix californiae
  ACP-like
NKNKLTKDITDKLQSMLGLIDEEIDVTIPLRVYGLDSLTAMELTKWIESEMNIEFSQSQLLGDDITTEDLINIIMDGSSSAPVTESTPVAPAPEAPVVA

SEQ ID NO: 679 - protein, 89 aa, Neocallimastix californiae
  ACP-like
KDKLTKDITEKLQSMLGLIDEEIDVTIPLRVYGLDSLTAMELTKWIESEMNIEFSQSQLLGDDITTEDLINIIMDGSSSAPVTESTQVT

SEQ ID NO: 680 - protein, 91 aa, Neocallimastix californiae
  ACP-like
KDKLTKDITEKLQSMLGLIDEEIDVTIPLRVYGLDSLTAMELTKWIESEMNIEFSQSQLLGDDITTEDLINIIMDGSSSTSVTESTPVAPV

SEQ ID NO: 681 - protein, 109 aa, Neocallimastix californiae
  ACP-like
IYESIKEIIPSTPEFEKFDPESPFTVYSIDSLAIIKLTNILSRKFNERYSPAILFNYGTTSLLAQYITGHDSDNININKTMNNIQMPKESNSKTSDKIAIIGMALRLPG

SEQ ID NO: 682 - protein, 105 aa, Neocallimastix californiae
  ACP-like
SIKEIIPSTPDFEDFNINAPFTIYSIDSLATRKLTSVLNRKTLKPFSASTLFNYGTPYDLARYITGYDKKLKEKASPLSSLPKSIKDVSMDKRVAVIGMALRLPG

SEQ ID NO: 683 - protein, 104 aa, Neocallimastix californiae
  ACP-like
QSIKEIIPSTPDFEQFVPEKSFTMYGIDSLTTVKLTNLLSRKLKKNYSPSIIFNYASPLLLAKYLAQPTQLASSLKAGPTNDSSCCNRKSNAIAIIGMGLRLPG

SEQ ID NO: 684 - protein, 108 aa, Neocallimastix californiae
  ACP-like
IYQSIKEIIPSTPEFESFNPESPFTIYGIDSLSTIKLTNVLSRKLNKHYSPAILFNYGNTFELAKFLSGNVDQKNVSEIRESIPASLNEKQSNGKIAIIGMGLRLPGA

SEQ ID NO: 685 - protein, 107 aa, Neocallimastix californiae
  ACP-like
NKDKLTKDITEKLQSMLGLIDEEIDVTIPLRVYGLDSLTAMELTKWIESEMNIEFSQSQLLGDDITTEDLINVIMDGSSSAPAPAAAPIAQTKSFQPTPIAPVSQAK

SEQ ID NO: 686 - protein, 105 aa, Neocallimastix californiae
  ACP-like
NKDKLTKDITEKLQSMLGLIDEEIDVTIPLRVYGLDSLTAMELTKWIESEMNIEFSQSQLLGDDITTEDLINVIMDGSSSAPAPAAAPVSQAKPFQPTTVAPMAQ

SEQ ID NO: 687 - protein, 90 aa, Neocallimastix californiae
  ACP-like
KDKLTKDITEKLQSMLGLIDEEIDVTIPLRVYGLDSLTAMELTKWIESEMNIEFSQSQLLGDDITTEDLINVIMDGSSSASVPVQVAAPA

SEQ ID NO: 688 - protein, 81 aa, Neocallimastix californiae
  ACP-like
SKDNIFEIMETELKRILQYGENDEIDPYQSLTELGIDSLMMMEFRTILKNVTTVNIPLVVFSTQNICLFRLVEYVKGKLSK

SEQ ID NO: 689 - protein, 68 aa, Neocallimastix californiae
  ACP-like
NVIYSCMAEIIPSTVPFDEFNIYDTFTSSGFNSINSVKLIKLLNSKLKTNYSTVMLFNFNSPYELARA

SEQ ID NO: 690 - protein, 68 aa, Neocallimastix californiae; identical to SEQ ID NO: 689
  ACP-like

SEQ ID NO: 691 - protein, 68 aa, Neocallimastix californiae
  ACP-like
NVIYSCITEIIPSTVPFDEFNIHDTFTSSGFNSINSVKLIKLLNSKLKTKYSTVMLFNYNTPYELAKA

SEQ ID NO: 692 - protein, 110 aa, Anaeromyces robustus
  ACP-like
KLIYEAIKEIVPSTPEFEEFNINAPFTIYSIDSIGTRKLTNILGRRTGKPFTTSTLFNYGTTYDLAKYITGYTDKDKFGKDLIPKSIVANKKDINSNKIAIIGMALRLPG

SEQ ID NO: 693 - protein, 110 aa, Anaeromyces robustus
  ACP-like
KLIYESIKEIVPSTPEFEEFNINAPFTIYSIDSIGTRKLTNILARRTGKPFTSSTLFNYGTTYDLAKYITGYTDKDKFGKDLIPKSIASNKKDSDSNKIAIIGMALRLPG

SEQ ID NO: 694 - protein, 114 aa, Anaeromyces robustus
  ACP-like
IIYQSIKEIIPSTPSYEEFNPERPFNLYGIDSLATVKLTNVLSRKMGKRYSPAILFNYGNSLELAKFITNNENKKNTTNTKKDDLSAKESIPRSLNEGGVKEKIAIIGMSLRLP

SEQ ID NO: 695 - protein, 73 aa, Anaeromyces robustus
  ACP-like
TINEILKREVRRMLMYNDNDELDELQPLSELGLDSIMMMEFRQIIKAVTNIVVPLSIITSPNLNLKEIIQFLE

SEQ ID NO: 696 - protein, 88 aa, Anaeromyces robustus
  ACP-like
TEDNVYAIMESELKRILQYSENDEIDPYQSLTELGIDSIMMMELRTILRTATGVNIPLVVFSTQNICLSRLVDYVKSKLAKEKEEAAK

SEQ ID NO: 697 - protein, 58 aa, Anaeromyces robustus
  ACP-like
EFEDFNPERPFNFYGIDSLATIKLTNIISRKLGKRYTPAVLFNYGNALELAKFVTNNN

SEQ ID NO: 698 - protein, 28 aa, Anaeromyces robustus
  ACP-like
NTNNTIPRSLNDETHYEKIAIIGMALRL

SEQ ID NO: 699 - protein, 103 aa, Anaeromyces robustus
  ACP-like
YVAPETETEKLICNVYSKTLNIDESKIGKMSDFFELGGDSLNAIRIISMIEKELNIKLYIKDILSHPLVSEISEYIEDILTNNKNSYQMEVIKKYNSKEFPIT

SEQ ID NO: 700 - protein, 82 aa, Anaeromyces robustus
  ACP-like
IAPISKVEKIICKIYSNVFNINENSVGLMNEFYELGGDSLIVISILSLIEKELKIKLNVKDILSHPLIKDLCDYIETILSNN

SEQ ID NO: 701 - protein, 69 aa, Anaeromyces robustus
  ACP-like
NMIYSCIVEIIPSTVPFNEFNADEAFSSFGLNSINSIKLIKLLNSKLKTNYSTVMLFNYNSPTELAKAL

SEQ ID NO: 702 - protein, 92 aa, Piromyces finnis
  ACP-like
SEDNIYEIMEHELKNVLQYGENDEIDPYQSLTELGIDSIMMMELRTIMRTATGINIPLVVFSTQNICLYRLVEYVKSKMVNEKKEEADAKTP

SEQ ID NO: 703 - protein, 110 aa, Piromyces finnis
  ACP-like
AIRIIHESIKEIIPSTPDFLEFNAEAPFTIYGIESLATIKLANILSRKFNKRYSPAILFNYGTTMLLAKHITGYENTSYSSQLLDKIPKELDNKSSNKIAIIGMALRLPG

SEQ ID NO: 704 - protein, 104 aa, Piromyces finnis
  ACP-like
IKEIIPSTPDFELFNPENPFNIYGIDSLSTIKLTNILSRKLNKYFSPAILFNYGNTYALAKFITGNTEKRNKDFKESIPSSSPHEKKNSEKIAIIGMGLRLPGA

SEQ ID NO: 705 - protein, 70 aa, Piromyces finnis
  ACP-like
VQDILKKEIRRMLMYNEDDEIDEMQPLSELGMDSIMMMEFRQVIKAVTDIMIPLSIISSPNVYLSKIYQY

SEQ ID NO: 706 - protein, 91 aa, Piromyces finnis
  ACP-like
DKLTKDISEKLQSMLGLIDEEIDVTIPLRVYGLDSLTAMELTKWIESEMNIEFSQSQLLGDDITTEDLINVIMEGSSSAPVAAPVAAPVVA

SEQ ID NO: 707 - protein, 93 aa, Piromyces finnis
  ACP-like
DKLTKDISEKLQSMLGLIDEEIDVTIPLRVYGLDSLTAMELTKWIESEMNIEFSQSQLLGDDITTEDLINVIMEGSSSAPVAVPAVAPAPVAA

SEQ ID NO: 708 - protein, 93 aa, Piromyces finnis; identical to SEQ ID NO: 707
  ACP-like

SEQ ID NO: 709 - protein, 91 aa, Piromyces finnis; identical to SEQ ID NO: 706
  ACP-like

SEQ ID NO: 710 - protein, 91 aa, Piromyces finnis; identical to SEQ ID NO: 706
  ACP-like

SEQ ID NO: 711 - protein, 92 aa, Piromyces finnis
  ACP-like
DKLTKDISEKLQSMLGLIDEEIDVTIPLRVYGLDSLTAMELTKWIESEMNIEFSQSQLLGDDITTEDLINVIMEGSSSAPVAAPVAAPVVAQ

SEQ ID NO: 712 - protein, 85 aa, Piromyces finnis
  ACP-like
LKNEVITKLQDLLGLVDEEIDVNVPLQVYGLDSLTSMEIVKWIENDKNVDLPQTALLNSEITTEELINMIATKIVGEDTIKAPSY

SEQ ID NO: 713 - protein, 90 aa, Piromyces finnis
  ACP-like
DKLTKDISEKLQSMLGLIDEEIDVTIPLRVYGLDSLTAMELTKWIESEMNIEFSQSQLLGDDITTEDLINVIMEGSSSAPAAVSVASPIQ

SEQ ID NO: 714 - protein, 101 aa, Piromyces finnis
  ACP-like
QSIKEIIPSTPDFDQFDPEMSFTMYGIDSLSTVKLTNILSRKLKKNYSPSIIFNYASPLLLAQYLSQPTQINPVMKDTQKSFNSNKSNSIAIIGMGLRLPG

SEQ ID NO: 715 - protein, 118 aa, Neocallimastix californiae
  ACPS
GIGVDIELVTEVPITNENFLERNFTKEEIKYCMSRPDPQSSFAGRWSAKEAVIKAVSSRATSKVWTKGEAAPLIDIEILPGESGAPVVKFYNDAEKAVKDAGINNVKVTISHSGGFSC

SEQ ID NO: 716 - protein, 118 aa, Neocallimastix californiae
  ACPS
GIGVDIELVTEIPINNENFIERNFTKEEIKYCMSRPDPQSSFAGRWSAKEAVVKAVSSHSSSKVWTKGEAAPLIDIEILPGESGAPVVQFHNDAEKAVKEAGVKSVNVTISHSGGFSC

SEQ ID NO: 717 - protein, 120 aa, Anaeromyces robustus
  ACPS
GVGIDIALISELNVDNEGFIERNFTNNEIQYCEAKPDRRSSFAGKWAAKEAVIKAISSYSLEAQKIWEGAGAPLKDIEVVIAESGAPKVLLSPTLNEKVKSVGVNDVKVTISHSGQFAVA

SEQ ID NO: 718 - protein, 118 aa, Anaeromyces robustus
  ACPS
GIGVDVELVSEIPITNETFLERNFTKDEITYCMSRPDPQSSFAGRWSAKEAVIKAVSSRATSKVWTKGEAAPLVDIEILPGESGAPVVKFHNDAEKAVKDAGIKDVKVTISHSGGFSC

SEQ ID NO: 719 - protein, 118 aa, Piromyces finnis
  ACPS
GIGVDVELVTEIPISNQNFLERNFTPKEIEYCMSRPDPQSSFAGRWSAKEAVIKAVSSRSTSKVWTKGEAAPLVDIEILPGESGAPVVEFHGDAEKAVKEAGINSVKVTISHSGGFSC

SEQ ID NO: 720 - protein, 120 aa, Piromyces finnis
  ACPS
GVGVDVALISEINIENESFVERNFTSTEINYCKSKPDARSSFAGRWAAKEAVIKAISSYSLEAQKIWEGAGAPLKDIEVVMAESGAPKVLLSQELKDKIKSVGVNDVKVTISHSGQFAIA

SEQ ID NO: 721 - protein, 118 aa, Piromyces finnis; identical to SEQ ID NO: 719
  ACPS

SEQ ID NO: 722 - protein, 120 aa, Piromyces finnis; identical to SEQ ID NO: 720
  ACPS

SEQ ID NO: 723 - protein, 87 aa, Neocallimastix californiae
  Acyl_carrier_prot-like
RELNEDNIFEVMELELKKVLQYGENDEIDPYQSLSELGIDSIMMMELRTILKNVTGINIPLVVFSTQNICLYRLVEYVKTKLVKEKE

SEQ ID NO: 724 - protein, 89 aa, Neocallimastix californiae
  Acyl_carrier_prot-like
DAKKKSVTKDNIPEILKEEVRRMLMYNENDELDIFQPLSELGIDSIMMMELRQIIKAVTNITVPLSIITTPNLTLSKIFEYLKGKMNGN

SEQ ID NO: 725 - protein, 94 aa, Neocallimastix californiae
  Acyl_carrier_prot-like
IHESIKEIIPSTPEFNKFNPDAPFTVYGIDSLSVIKLTNVLSRKFNKKYSPAILFTYGTTASLAKYLKGYENISYLPSQEKDHGASSNKKIAII

SEQ ID NO: 726 - protein, 79 aa, Neocallimastix californiae
  Acyl_carrier_prot-like
RTSGLNKDKLTKDITEKLQSMLGLIDEEIDVTIPLRVYGLDSLTAMELTKWIESEMNIEFSQSQLLGDDITTEDLINII

SEQ ID NO: 727 - protein, 78 aa, Neocallimastix californiae
  Acyl_carrier_prot-like
TSGLNKDKLTKDITEKLQSMLGLIDEEIDVTIPLRVYGLDSLTAMELTKWIESEMNIEFSQSQLLGDDITTEDLINII

SEQ ID NO: 728 - protein, 79 aa, Neocallimastix californiae
  Acyl_carrier_prot-like
TSGINKDKLTKDITEKLQSMLGLIDEEIDVTIPLRVYGLDSLTAMELTKWIESEMNIEFNQSQLLGDDITTEDLINIIM

SEQ ID NO: 729 - protein, 76 aa, Neocallimastix californiae
  Acyl_carrier_prot-like
RALKNEVVEKLQDLLGLVDENIDTNVPLQVYGLDSLTSMEIVKWVENDKKVELPQSALLSSEITTEELVNMIASKI

SEQ ID NO: 730 - protein, 93 aa, Neocallimastix californiae
  Acyl_carrier_prot-like
LKNEICDRLQNMLGLVDEKIDPAIPLRVYGLDSLTTMELTNWIQSELKVTLPQSQLLSDEITTNELVSIIINLLANNNNNNNGTNFYNAPSNN

SEQ ID NO: 731 - protein, 80 aa, Neocallimastix californiae
  Acyl_carrier_prot-like
KPTSGLNKDKLTKDITEKLQSMLGLIDEEIDVTIPLRVYGLDSLTAMELTKWIESEMNIEFSQSQLLGDDITTEDLINII

SEQ ID NO: 732 - protein, 80 aa, Neocallimastix californiae
  Acyl_carrier_prot-like
SLNKNKLTKDITDKLQSMLGLIDEEIDVTIPLRVYGLDSLTAMELTKWIESEMNIEFSQSQLLGDDITTEDLINIIMDGS

SEQ ID NO: 733 - protein, 76 aa, Neocallimastix californiae
  Acyl_carrier_prot-like
NKDKLTKDITEKLQSMLGLIDEEIDVTIPLRVYGLDSLTAMELTKWIESEMNIEFSQSQLLGDDITTEDLINIIMD

SEQ ID NO: 734 - protein, 78 aa, Neocallimastix californiae
  Acyl_carrier_prot-like
NRDKLTKDITEKLQSMLGLIDEEIDVTIPLRVYGLDSLTAMELTKWIESEMNIEFSQSQLLGDDITTEDLINIIMDGS

SEQ ID NO: 735 - protein, 97 aa, Neocallimastix californiae
  Acyl_carrier_prot-like
ESIKEIIPSTPEFEKFDPESPFTVYSIDSLAIIKLTNILSRKFNERYSPAILFNYGTTSLLAQYITGHDSDNININKTMNNIQMPKESNSKTSDKIA

SEQ ID NO: 736 - protein, 108 aa, Neocallimastix californiae
  Acyl_carrier_prot-like
EEIQKAVMIVYESIKEIIPSTPDFEDFNINAPFTIYSIDSLATRKLTSVLNRKTLKPFSASTLFNYGTPYDLARYITGYDKKLKEKASPLSSLPKSIKDVSMDKRVAV

SEQ ID NO: 737 - protein, 84 aa, Neocallimastix californiae
  Acyl_carrier_prot-like
DFEQFVPEKSFTMYGIDSLTTVKLTNLLSRKLKKNYSPSIIFNYASPLLLAKYLAQPTQLASSLKAGPTNDSSCCNRKSNAIAI

SEQ ID NO: 738 - protein, 99 aa, Neocallimastix californiae
  Acyl_carrier_prot-like
KLIYQSIKEIIPSTPEFESFNPESPFTIYGIDSLSTIKLTNVLSRKLNKHYSPAILFNYGNTFELAKFLSGNVDQKNVSEIRESIPASLNEKQSNGKIA

SEQ ID NO: 739 - protein, 95 aa, Neocallimastix californiae
  Acyl_carrier_prot-like
SLNKDKLTKDITEKLQSMLGLIDEEIDVTIPLRVYGLDSLTAMELTKWIESEMNIEFSQSQLLGDDITTEDLINVIMDGSSSAPAPAAAPVSQAK

SEQ ID NO: 740 - protein, 104 aa, Neocallimastix californiae
  Acyl_carrier_prot-like
SLNKDKLTKDITEKLQSMLGLIDEEIDVTIPLRVYGLDSLTAMELTKWIESEMNIEFSQSQLLGDDITTEDLINVIMDGSSSAPAPAAAPIAQTKSFQPTPIAP

SEQ ID NO: 741 - protein, 84 aa, Neocallimastix californiae
  Acyl_carrier_prot-like
NKDKLTKDITEKLQSMLGLIDEEIDVTIPLRVYGLDSLTAMELTKWIESEMNIEFSQSQLLGDDITTEDLINVIMDGSSSASVP

SEQ ID NO: 742 - protein, 83 aa, Neocallimastix californiae
  Acyl_carrier_prot-like
KEISKDNIFEIMETELKRILQYGENDEIDPYQSLTELGIDSLMMMEFRTILKNVTTVNIPLVVFSTQNICLFRLVEYVKGKLS

SEQ ID NO: 743 - protein, 66 aa, Neocallimastix californiae
  Acyl_carrier_prot-like
MAEIIPSTVPFDEFNIYDTFTSSGFNSINSVKLIKLLNSKLKTNYSTVMLFNFNSPYELARALISP

SEQ ID NO: 744 - protein, 66 aa, Neocallimastix californiae; identical to SEQ ID NO: 743
  Acyl_carrier_prot-like

SEQ ID NO: 745 - protein, 66 aa, Neocallimastix californiae
  Acyl_carrier_prot-like
EIIPSTVPFDEFNIHDTFTSSGFNSINSVKLIKLLNSKLKTKYSTVMLFNYNTPYELAKALISLHT

SEQ ID NO: 746 - protein, 98 aa, Anaeromyces robustus
  Acyl_carrier_prot-like
IYEAIKEIVPSTPEFEEFNINAPFTIYSIDSIGTRKLTNILGRRTGKPFTTSTLFNYGTTYDLAKYITGYTDKDKFGKDLIPKSIVANKKDINSNKIA

SEQ ID NO: 747 - protein, 107 aa, Anaeromyces robustus
  Acyl_carrier_prot-like
EEIQEAIKLIYESIKEIVPSTPEFEEFNINAPFTIYSIDSIGTRKLTNILARRTGKPFTSSTLFNYGTTYDLAKYITGYTDKDKFGKDLIPKSIASNKKDSDSNKIA

SEQ ID NO: 748 - protein, 106 aa, Anaeromyces robustus
  Acyl_carrier_prot-like
IYQSIKEIIPSTPSYEEFNPERPFNLYGIDSLATVKLTNVLSRKMGKRYSPAILFNYGNSLELAKFITNNENKKNTTNTKKDDLSAKESIPRSLNEGGVKEKIAII

SEQ ID NO: 749 - protein, 88 aa, Anaeromyces robustus
  Acyl_carrier_prot-like
INEILKREVRRMLMYNDNDELDELQPLSELGLDSIMMMEFRQIIKAVTNIVVPLSIITSPNLNLKEIIQFLENKNQDKSTTGTSSTSN

SEQ ID NO: 750 - protein, 81 aa, Anaeromyces robustus
  Acyl_carrier_prot-like
VTEDNVYAIMESELKRILQYSENDEIDPYQSLTELGIDSIMMMELRTILRTATGVNIPLVVFSTQNICLSRLVDYVKSKLA

SEQ ID NO: 751 - protein, 84 aa, Anaeromyces robustus
  Acyl_carrier_prot-like
SVKEIIPSTPEFEDFNPERPFNFYGIDSLATIKLTNIISRKLGKRYTPAVLFNYGNALELAKFVTNNNDKKNTKLLNKKNNNDK

SEQ ID NO: 752 - protein, 66 aa, Anaeromyces robustus
  Acyl_carrier_prot-like
ICKIYSNVFNINENSVGLMNEFYELGGDSLIVISILSLIEKELKIKLNVKDILSHPLIKDLCDYIE

SEQ ID NO: 753 - protein, 66 aa, Anaeromyces robustus
  Acyl_carrier_prot-like
ICNVYSKTLNIDESKIGKMSDFFELGGDSLNAIRIISMIEKELNIKLYIKDILSHPLVSEISEYIE

SEQ ID NO: 754 - protein, 67 aa, Anaeromyces robustus
  Acyl_carrier_prot-like
IVEIIPSTVPFNEFNADEAFSSFGLNSINSIKLIKLLNSKLKTNYSTVMLFNYNSPTELAKALASSK

SEQ ID NO: 755 - protein, 88 aa, Piromyces finnis
  Acyl_carrier_prot-like
KKEISEDNIYEIMEHELKNVLQYGENDEIDPYQSLTELGIDSIMMMELRTIMRTATGINIPLVVFSTQNICLYRLVEYVKSKMVNEKK

SEQ ID NO: 756 - protein, 82 aa, Piromyces finnis
  Acyl_carrier_prot-like
LEFNAEAPFTIYGIESLATIKLANILSRKFNKRYSPAILFNYGTTMLLAKHITGYENTSYSSQLLDKIPKELDNKSSNKIAI

SEQ ID NO: 757 - protein, 83 aa, Piromyces finnis
  Acyl_carrier_prot-like
FELFNPENPFNIYGIDSLSTIKLTNILSRKLNKYFSPAILFNYGNTYALAKFITGNTEKRNKDFKESIPSSSPHEKKNSEKIA

SEQ ID NO: 758 - protein, 56 aa, Piromyces finnis; identical to SEQ ID NO: 659
  Acyl_carrier_prot-like

SEQ ID NO: 759 - protein, 97 aa, Piromyces finnis
  Acyl_carrier_prot-like
NKDKLTKDISEKLQSMLGLIDEEIDVTIPLRVYGLDSLTAMELTKWIESEMNIEFSQSQLLGDDITTEDLINVIMEGSSSAPVAAPVAAPVVAPVVA

SEQ ID NO: 760 - protein, 89 aa, Piromyces finnis
  Acyl_carrier_prot-like
NKDKLTKDISEKLQSMLGLIDEEIDVTIPLRVYGLDSLTAMELTKWIESEMNIEFSQSQLLGDDITTEDLINVIMEGSSSAPVAVPAVA

SEQ ID NO: 761 - protein, 89 aa, Piromyces finnis; identical to SEQ ID NO: 760
  Acyl_carrier_prot-like

SEQ ID NO: 762 - protein, 94 aa, Piromyces finnis
  Acyl_carrier_prot-like
NKDKLTKDISEKLQSMLGLIDEEIDVTIPLRVYGLDSLTAMELTKWIESEMNIEFSQSQLLGDDITTEDLINVIMEGSSSAPVAAPVAAPVVAQ

SEQ ID NO: 763 - protein, 97 aa, Piromyces finnis; identical to SEQ ID NO: 759
  Acyl_carrier_prot-like

SEQ ID NO: 764 - protein, 94 aa, Piromyces finnis; identical to SEQ ID NO: 762
  Acyl_carrier_prot-like

SEQ ID NO: 765 - protein, 91 aa, Piromyces finnis
  Acyl_carrier_prot-like
NKDKLTKDISEKLQSMLGLIDEEIDVTIPLRVYGLDSLTAMELTKWIESEMNIEFSQSQLLGDDITTEDLINVIMEGSSSAPAAVSVASPI

SEQ ID NO: 766 - protein, 78 aa, Piromyces finnis
  Acyl_carrier_prot-like
NLKNEVITKLQDLLGLVDEEIDVNVPLQVYGLDSLTSMEIVKWIENDKNVDLPQTALLNSEITTEELINMIATKIVGE

SEQ ID NO: 767 - protein, 88 aa, Piromyces finnis
  Acyl_carrier_prot-like
EIIPSTPDFDQFDPEMSFTMYGIDSLSTVKLTNILSRKLKKNYSPSIIFNYASPLLLAQYLSQPTQINPVMKDTQKSFNSNKSNSIAI

SEQ ID NO: 768 - protein, 291 aa, Neocallimastix californiae
  Acyl_transf_1
FTGQGSIKPGVGKELFRTQPVFRAAMEKCDAVVKKSTGISILDALYDQNQGHHLKKAQIAQPALFAYEYAMYMLWKSWGIKPVIVNGHSLGEIVAAAATGAIDIDLAIDFIIERARCMGEYGEKPGAMVSVFQSEDVVKEAIEEFGYEEEVSIAAINGVTHTVISGYEDEVDDLTEYFNEMKVKTKKLNVTDAFHSPLMDPAIEELNGWIEEKNDAQFRQTLKVKFISNVDSTIKPVGDRLEKDYWGKHARNAVRFVDGVKSMIESEKKLLAVIEVGPAATLTNMSSRFVR

SEQ ID NO: 769 - protein, 306 aa, Neocallimastix californiae
  Acyl_transf_1
FAFTGQGVAKVGMGKHFYQTQPVFREAMDRCDAVTRRLLGVSIVEVLYNVSNIPNGTEEGEKALKKSSVAQPALFAYEYAMSQLWISWGIKPSMVLGHSLGEIVATTIAGGIDFELAMEFIVERASCMEKYGIKPGAMVSIFTTEDVVKEAIEEFEFENVSIAAINGTTQIVISGNADEVKELEEYFIEQDIKAKQLNVTEAFHSALMDPAIEKLYEWIDSKPDEKFRQPLKYGLISNVTGKLIPAGERLPKNYWGEHARNAVQFVKAVETLLANSETLLNVIEVGPASVLTNMSSRILREKKVDK

SEQ ID NO: 770 - protein, 288 aa, Neocallimastix californiae
  Acyl_transf_1
FTFSGQGTQYPDMGRQLYHSNPYFANIIDYCNEIVLSISKKDLLKETGLFGDLPVNEENLMDPQYSFLAIGIIQLALVEFWKAYGVEPSLVFGHSMGEVAAAYAAGILTLEDAILLLYHYGLISQNLEENNEKSGLIALGCGVDEAKTEYIKDRKKVYIASINSYKDVTLGGDLNQLEEIMDQAKQKNVFTVMLKVNKAFHTPFILSAKEKFLKGIEGIHLRVQPPKIPFISSTHGNEYQGPFDANYWWSNIINPVNFSQAVKIAHTKVDKVLEISSTPVLGIYISSV

SEQ ID NO: 771 - protein, 290 aa, Neocallimastix californiae
  Acyl_transf_1
FAFSGQGSQFINMGRRMYQVNGLFKRIVDYCAAVLVTYNGGEDIFEKYHIFKGDVSQISEADLSLPQYSILAIGVAQIALTEIWKAMGVTPEAVFGHSMGEVAAAYAAGILTLEDAILLLYMRGHILAQLDGTGKGMLALGCSVEQAQYFMNNKPNVFISAVNSANSITLAGDISQINAIAQEAKAQNLFAVVLKVKQAFHSPYVEGAEQAFKESIRGISERTSAPKCKFISACFGQEYEGPFDENYWWANIRNPVSFYAAASIGTQFSKRVLEIGAHPVLSVYLKEIYG

SEQ ID NO: 772 - protein, 367 aa, Neocallimastix californiae
  Acyl_transf_1
YVFTGQGAQEVGMGQDLYNKSAVAKAVWDRADAYLMKKYGYSILEIVRTNPKSLTVYFGGEDGEKIRENYINMTCEIIDSNGKVQTKRMFPEIDENTLYYEYKSPTGLLNATQFTQPAITLTEKAAFEDMYEKGYICDDAVYAGHSLGEYAALSCVANTLSIESMAEIVFYRGLVMQSSVERDELNRSDYAMCAVNPVRVHPYFSFDLLVEVVKKINAEHGGLLEIVNYNVENYQYVVTGDLTSLEALKNLLTNLRAEAKKFITLYKEDATQAMELLNEKVRTYVKLAEERKAKEGFFNIERGAATIPLRGIDVPFHSSYLLWGVPTFRELLHQRVRREDVDVKCLVGRYIPNLMGEPFSVEKDYAI

SEQ ID NO: 773 - protein, 270 aa, Neocallimastix californiae
  Acyl_transf_1
TFVFRGMSQLNSNIGYSLYQYNQKFAEIVDYCDKVLEKVSGGVCSLKREFGLFQSENLNFLSLQNPKMSIIGNGMIQLALGHLLKSYGIKPSSVVGYNSGEIAAAYTAGIISLEDAILVLYQYSTILEKVPNKKNIFTLELGCSAGQAQTNIINQLSSTIYISGNNADNICTLCGSRESLNQAVSIAQQNGIPVLSNLIPGSCGICTPYLNDFKDEFFASLKGIGNNCKTPVIKFISTTLGQPFNGPLNEYYWWANLSSTVNFSHALSLA

SEQ ID NO: 774 - protein, 359 aa, Neocallimastix californiae
  Acyl_transf_1
YVFTGQGAQEVGMGMDLYEKSPVAREIWDRADAHLMENYGFSIIDIVKNNPTEITIYFGNVKGQQIRKNYQQMTYEHVNSDGVVESLSLFPEIDDDSVSYTFRHIGGLLSATQFTQPSLVLMEKAAFEEMRSRGFIQQNSAFAGHSLGEYAALTAIGDVLSIETLVDVVFYRGMTMQRAVQRDSKGRSDYAMCAVNPTRVSRTFNESALQYLVANIKKVTEGLIEIVNYNVDNWQYVVSGDLISLQVLTLVLNYLKAEKIDLTVLLNTLSVEEVQKQVNEIISTSFEKAKEQKKKHGYIKLERGAASIPLRGIDVPFHSSFLLRGVAPFRQYLMSKFDPNLIDVNRLIGNYIPNLTAEP

SEQ ID NO: 775 - protein, 359 aa, Neocallimastix californiae; identical to SEQ ID NO: 774
  Acyl_transf_1

SEQ ID NO: 776 - protein, 272 aa, Neocallimastix californiae
  Acyl_transf_1
DFYCNNSYFADCIDYCDQVLKMISGRSLLEDYGLFQSVKEEEKEKEKEKKNKLREDLLKDPTTTLLINGIIQLGLVALYRYYGISPNAVIGYGAGEIAAAYAAEKIDLKSAVQILYHYGRVLSMVKKDDNLSKVYSILVGCPVGKLSQVILSKLSPTEKELISISGVPSPTQCVLNGEMEILKKIMEQAKTEKIPILGSLMDSFAIHTKKISEAMKEELVKRLTNIKSKPSSIAMFSTTKFSKEGKPYTDALDGQYWWMNMRNPVLYAHSLS

SEQ ID NO: 777 - protein, 359 aa, Neocallimastix californiae
  Acyl_transf_1
YVFTGQGAQEVGMGMDLYEKSPVAREIWDRADAHLMESYGFSIIDIVKNNPTEITIYFGNVKGQQIRKNYQQMTYEHVNADGVIESLSLFPEIDDDSDSYTFHHIGGLLSATQFTQPSLVLMEKAAFEEMRTRGFIQQNSAFAGHSLGEYAALTAIGDVLSIETLVDVVFYRGMTMQRAVQRDSKGRSDYAMCAVNPTRVSRTFNESALQYLVANIKKVTEGLIEIVNYNVDNWQYVVSGDLISLQVLTLVLNYLKAEKIDLTVLLNTLSVEEVQKQVIEMITTAFEKAKDQKKRHGFIKLERGAASIPLRGIDVPFHSSFLLRGVAPFRQYLMSKFDPNLIDVNRLIGNYIPNLTAEP

SEQ ID NO: 778 - protein, 364 aa, Neocallimastix californiae
  Acyl_transf_1
YVFTGQGAQEVGMGQELYNKSAVAKAVWDRADAYLMKKYGYSILEIVRTNPKSLTVYFGGEEGEKIRENYINMTCEIIDSNGKVQTKRMFPEIDENTLYYEYKSPTGLLNATQFTQPAITLTEKAAFEDMLENGYICDDAVYAGHSLGEYAALSCVANTLSIESMAEIVFYRGLVMQSSVERDELNRSDYAMCAVNPVRVHPYFSYDLLVEVVKKINSEHGGLLEIVNYNVENYQYVVTGDLTSLEALKNLLTNLRAESKKFIALYKEDATQAMDLLNEKVCIYVKLAEERKAKEGFFNIERGAATIPLRGIDVPFHSSYLLWGVPTFRELLHQRVRREDVDVKCLVGRYIPNLMGEPFSVEKD

SEQ ID NO: 779 - protein, 259 aa, Neocallimastix californiae
  Acyl_transf_1
FTGQGSIKPGVGQELFRSQPVFHAAMEKCDAVVKKVTGVSIIDALYDQSQAHHLKKAQIAQPALFAYEYAMCMLWKSWGVEPVIVNGHSLGEIVAAAVTGAIDIDLAIDFIIERARCMGEYGEKPGAMVSIFQNEKTVKEAIEEFGYEEEVAIAAINGVTHTVISGYEEEVDDITQYFSEMNIKTKKLNVTDAFHSPLMDPAIEELNNWIEEKDDAKFRQSLKVKFISNLDGTIKPVGDRLEEDYWAKHARNAVRFVDG

SEQ ID NO: 780 - protein, 202 aa, Neocallimastix californiae
  Acyl_transf_1
IVQFSLVSLYKYYGITPSVVIGYGAGEITAAYAAEKIDLKDAVQILYHYGQVLSMANNSSPKVYSFLVGCPVGRLNHMMVSKLTPSEKDLISISGIPNPRQCILCGEMEILKKVMKMIKDEKVPILSGFMESFGIHSKIITEAMKDELTKRLENISSHSSSIAMFSTAKFNEKSEPYTGALDGSYWWMNMRNPVLYAHTLSQ

SEQ ID NO: 781 - protein, 365 aa, Anaeromyces robustus
  Acyl_transf_1
YVFTGQGAQEVGMGQELYNKSAVAKSVWDRADAYLMKKYGYSILEIVRTNPKSLTVYFGGEEGEKIRENYMNMTCEIIDSNGKVQTKRMFPEIDENTLYYEYKSPNGLLNATQFTQPAITLTEKAAFEDMLENGYICDDAVYAGHSLGEYAALSCVANTLSIESMAEIVFYRGLVMQSSVERDALNRSDYAMCAVNPVRVHPYFSYDLLVEVVKKINSEHDGGLLEIVNYNVENYQYVVTGDITSLEALKNLLTNLRAEAKKFITLYKEDASQAMDLLNEKVVHYVKEAEERKAKEGWFNLERGAATIPLRGIDVPFHSSYLLWGVPTFRELLHQRVRREDVDVKCLVGRYIPNLMGEPFSVEKD

SEQ ID NO: 782 - protein, 291 aa, Anaeromyces robustus
  Acyl_transf_1
FTFSGQATQYPDMGRQLYHSNPYFASIINYCNEIIIRLSQKDLIKDTGLFSDTPVDEEKLIDPQYSFLAIGIIQLALVEFWKLYGVEPALVFGHSMGEVAAAYAAGILTIEDAILLLYNYGLISQNVDDIHEKSGMLALGCSAEEAKTTYLNGKDKNRVYIASINSEKDITLGGDLNQLDAIMTQAKNNNVFTVMLKVKKAFHTPYIITAKQKFIQGIQGIGSRVNSPKIPFISSTYGKEYQGPFDEEYWWTNIINPVNFSQATKVARTKVEKVLEIGSTPVLGIYMSKIF

SEQ ID NO: 783 - protein, 306 aa, Anaeromyces robustus
  Acyl_transf_1
FAFTGQGVAKVGMGKHFYQTQPVFRKAMDKCDEVTRRLLNVSIVEVLYNISNAPNGIEKGENALKKSSVAQPALFAYEYAMSQLWISWGVEPSMVLGHSLGEIVATTIAGGIDFELAMEFIVQRASCMEKYGIKPGAMVSIFTTESAVKEAIEEFEFENVSIAAINGTTQTVISGNADEVKELEEYFIEQEIKAKPLNVTEAFHSALMNPAIEKLYEWIETKPDDKFRKPLKYGLISNVTGELIPAGERLPKNYWGEHARNAVQFVKAVETLLANSETLLNVIEVGPSNVLTNMSARILREKKIDK

SEQ ID NO: 784 - protein, 292 aa, Anaeromyces robustus
  Acyl_transf_1
FTGQGSIKPGVGQELYRSQPVFRDAIDKCDTVLKKVTGISLVDVLYNPQQAHHLKKAQIAQPALFAFEYAMCMLWKSWGVEPTIVNGHSLGEIVAAAVTGAMDIDLAIDFIVERARCIGEYGEKPGTMVSIFEKEDVVKKAIEEFDTQEEVAVAAINGVAHTVISGYEDEVDDITEYFKQMNVKTKKLNVTDAFHSPLMEPAIEELDKWIEGKDDEKFRQPLKVRFISNVDGKIKEVGERLDENYWAEHARSTVRFVDGVKSMIESENNNILAVIEVGPAATLSHMSARYVR

SEQ ID NO: 785 - protein, 357 aa, Anaeromyces robustus
  Acyl_transf_1
YVFTGQGAQEVGMGMDLYEKSAVAREIWDRADAHLMETYGFSIIDIVKNNPTEITIYFGNVKGQQIRKNYQQMTYEHVNADGVIESLSLFPEIDDDSTSYTFHHIGGLLSATQFTQPSLVLMEKAAFEEMRSRGFIQQNSAFAGHSLGEYAALTAIGDVLSIETLVDVVFYRGMTMQRAVQRDSKGRSDYAMCAVNPTRVSSTFNENALQYLVANIQKVTEGLIEIVNYNVDNWQYVVSGDLISLQVLTNVLNYLKAEKIDLTVLLNTLSVEEVQKQVIEIVTNAFEKAKEQKRKRGFINLERGAASIPLRGIDVPFHSSFLLRGVAPFRQYLMSKFDPNLIDVNRLIGNYIPNLTA

SEQ ID NO: 786 - protein, 272 aa, Anaeromyces robustus
  Acyl_transf_1
TFVFRGISELNSNFSYSLYKYNQKFAKIVDYCDKVLEKVSQGLSLKRDYGLFQKENFDETTLRDPKISVIGSGIIQLTMAHLLKSYAIIPSSVVGYSIGEISAAYAAGIISLEDAVLILYQYSSILEKVPGKEDIYTVELGCSSDQAQVNILSQLSAPVYIVSNSTSNICTLCGNSTFLNQAIQMAQQLNIPILSNLTPGSNGICTPYLNDFKDEFYESLRDIGSRCKDPVIPFISTTLGQPFNGPLNEFYWWANLTSTVNFSSALSLAMNE

SEQ ID NO: 787 - protein, 290 aa, Piromyces finnis
  Acyl_transf_1
FTGQGSIKSGVGLELYRTQPVFRDALNKCDVVVKKATGISLIDALYNPSQSHHLNKAQIAQPALFAYEYAMCMLWKSWGINPTIVNGHSLGEIVAAASTGAMDIDLAIDFIIERARCMGEYGEKPGTMVSVFEKEDVIKEAIEEFGYDEEVSVAAINGVTHTVISGYEDEVDDITEYFSQMNIKTKKLNVTDAFHSPLMDPAVSELNKWIERKDDSKFRQDLKVKFISNVDGNIKPVGSRLEEDYWGKHARNAVRFVDGVKSMIESEKKLLAVIEVGPAATLTNMSSRFV

SEQ ID NO: 788 - protein, 269 aa, Piromyces finnis
  Acyl_transf_1
TFVFRGISELKTNLGYSLYQNNKMFADVVDYCDKILEKISQGYSVKKNTGLFLKENLDAATLQSPKISVVGSGMIQLAMAHLLKTYGIVPSSVVGYNTGEIAAAYATGIISLEDAILILYQFSNILEKVPGKEDIYTLELGCSAEQAQSSIINQLSTSAYITGNNASNICTLCGSSAALNQAIQLAQQSNIPILSNLIPGSCGICTPFLNNFKNEFHEALKDIGSRCKAPATPFISTTLSQPFNGPLNEYYWWANFTSTVNFNVALSLA

SEQ ID NO: 789 - protein, 305 aa, Piromyces finnis
  Acyl_transf_1
FAFTGQGVAKVGMGKHFYQTQPVFRKAMDKCDEVTRRLLDVSIVEVLYNISNSPNGVEEGEKALKKSSVAQPALFAYEYAMSQLWISWGVEPSMVLGHSLGEIVATTIAGGIDFELAMEFIVQRASCMEKYGVKPGTMVSVFTTQDVVEEAIEEFGFENVSIAAINGTTQIVISGNTDEVKELEEYFTQQEIKAKQLNVTEAFHSALMDPAIEKLYEWINTKPDEKFRQPLKYGLISNVTGELIEAGERLPKNYWGEHARNAVQFVKAVETLLANSETLLNVIEVGPANVLTNMSSRILREKRID

SEQ ID NO: 790 - protein, 305 aa, Piromyces finnis; identical to SEQ ID NO: 789
  Acyl_transf_1

SEQ ID NO: 791 - protein, 267 aa, Piromyces finnis
  Acyl_transf_1
NLYCNNKYFSDCIDYCDGIFKALSQRSLLQDYGLFTTEMMDNNKFKKFNSDLRKDPLVMIMFGGMVQLTLSALLKYYGLFPNAVIGYGAGEIVAAYVADKMDLKTTVKVLYHYGRVLSHAYSQENKVYTLTLICPISKIKQTIFTKLNQDEKDGISISGIPSPKFCLLSGDYNIMKKVSDIAKSENIAIYGAMQNNYGLHSMMINDKMKEDLVNSLKDIPLQTSDIAFFTTTKLNKDGKPYEGKLDGEYWWMNMRNPVLYAHALSQT

SEQ ID NO: 792 - protein, 360 aa, Piromyces finnis
  Acyl_transf_1
YVFTGQGAQEVGMGMDLYEKSPVAREIWDRADKHLMENYGFSIIDIVKNNPTEITIYFGNVKGQQIRKNYQQMTYEHVNNEGVVESLSLFPEIDDDSVSYTFRHIGGLLSATQFTQPSLVLMEKAAFEEMRSRGYIQQNSAFAGHSLGEYAALTAIGDVLSIETLVDVVFYRGMTMQRAVQRDSKGRSDYAMCAVNPVRVGSTFNESALQYLVASIKKVTNGLIEIVNYNVDNWQYVVSGDLISLQVLTLVLNYLKFEKIDLTVLLKTLSEEELQKQVNEIINNAYVKAKDQKKKHGFIKLERGAASIPLRGIDVPFHSSFLLRGVAPFRQYLMSKFDPKLIDVNRLIGNYIPNLTAEPF

SEQ ID NO: 793 - protein, 360 aa, Piromyces finnis; identical to SEQ ID NO: 792
  Acyl_transf_1

SEQ ID NO: 794 - protein, 360 aa, Piromyces finnis; identical to SEQ ID NO: 792
  Acyl_transf_1

SEQ ID NO: 795 - protein, 360 aa, Piromyces finnis; identical to SEQ ID NO: 792
  Acyl_transf_1

SEQ ID NO: 796 - protein, 290 aa, Piromyces finnis
  Acyl_transf_1
FTFSGQGTQYPEMGLQLYNMNPYFASIIDYCNSIHTQISKKDLLKETGLFGKGPVNEEKLLDPQYSFPAIGIIELALVELWKRYGVEPALVFGHSMGEVAAAYAAGILTIEDAILLLYNYGQISENVVDAGAKSGMLAIGCSSEEAQSIYLKGKDKVFIASINSPKDITLGGDLEQLNEIMAEARKNNVFSVMLKVKKAFHTSYIITAKDKFLQSIQGIGNRVKAPKIPFISSTYGREYQGPFDEEYWWTNIISPVNFSQATKIARSKIDKVLEIGSTPVLGIYMSNDFH

SEQ ID NO: 797 - protein, 291 aa, Piromyces finnis
  Acyl_transf_1
FAFSGQGSQFINMGRRMYQTNDLFKKVVDYCAAVLVTINGGEDIFEKYSIFKGDVAQISETDLSLPQFSVLAIGIAQIALIEVWKSMGVTPKAVYGHSMGEVAAAYAAGVLTIDDAVLLLYMRGHILAQLDGTGKGMLALGCSVENAQRFMANKPNVFISAVNSANSITLAGDLEQINAVAREAQAEKLFAVVLKVKQAFHSPYVEGAEKAFKESIRGIGERTKAPNCKFVSACFGQEYEGPFDENYWWANIRNPVSFHAAASIATQFSKRVLEIGAHPVLGMYLKEIYGK

SEQ ID NO: 798 - protein, 150 aa, Piromyces finnis
  Acyl_transf_1
LYRTQPVYAKALEECDKIITELSNFKILLVNLVICMGELIQPELLQEYKKQVDEDPCMAQFIALSMNYALIKLLEHLSISPNLVVGYKFGEITAALACGKISLRNAFLIIHYICKIIRKNIQLSDETITSDITQLMIIKDESKAFSSAKN

SEQ ID NO: 799 - protein, 355 aa, Neocallimastix californiae
  ACYL-COA THIOESTERASE I
RNSSIRQIVRTSVEGEYLRFHFSNFLGNSNLELRSVHVAKSASQGTGKIIKDTDTVITFDGKESVTIPAQKEITSDTIKFSAPALTELAVTIYYGNIPNTMTSHVASRANSFIESGNAVSKESISTNNKTLHWYTLSAIDVFVNKNKDYKAVVCFGDSITDGRGVTNDKNNRWTDILATRLQQNPATKNIGVLNQGIGATTVAGTYYNPTSPAGQARFEKDVLKQTNVKYLIILYGVNDILYNNSNAQTIINVYKDLIKKAHNNGIKVFGGTILPFGKNSGFNSNKESQRTTVNNWIMNTPASQGGFDGYIDFASAVADKSNKQWLNTNWNFENDGLHPNAVGYEAMGKAIDLNL

SEQ ID NO: 800 - protein, 111 aa, Neocallimastix californiae
  ADH_N
DQIEVKVTHNGLCHSDIHMKDNDWGNSSYPFIPGHEVIGNVVALGANAEKLSGLKVGDRVGYGWIRDSCGFCECCIEGQENLCEKGYEGTIVGHHGGFQDRIRMPAKFAFK

SEQ ID NO: 801 - protein, 101 aa, Neocallimastix californiae
  ADH_N
AICKPLAIAVCTSDVHTVWEGAIGDRHDMILGHECCAEVVEVGSEVKDFKPGDRVIVPAITPDWNSLEAQAGYSMHSHGMLAGWKFSNIKDGVFSEYFHVN

SEQ ID NO: 802 - protein, 64 aa, Neocallimastix californiae
  ADH_N
DNEVLVKFLAAPINPSDINQIEGVYPIKPRFREYGAVGGNEGVAEVVAAGSKVKNLTIGDWVIP

SEQ ID NO: 803 - protein, 112 aa, Neocallimastix californiae
  ADH_N
DDVEIDIKYCGICHSDIMIVQINQPGKGVVPGHEITGVVKSVGKAVTNFKVGDHVGVGCFVNSCSNCEYCKRGDEQFCDKGVVVVFNSKDYDGAITYGGYTQTIIVKDKFVL

SEQ ID NO: 804 - protein, 112 aa, Neocallimastix californiae
  ADH_N
DDVEIDIKYCGICHSDIMIVQNNQPGNGIVPGHEIAGVVKSVGKAVTNFKVGDHVGIGCFVNSCSNCEYCKRGDEQFCDKGVVIVFNSKDYDGAITYGGYTQTIIVRDKFVL

SEQ ID NO: 805 - protein, 65 aa, Anaeromyces robustus
  ADH_N
DDEVLVKFLASPINPSDINQIEGVYPIKPRFKEYGAVGGNEGVAEVIAAGSKVKNLTVGDWVIPD

SEQ ID NO: 806 - protein, 64 aa, Anaeromyces robustus
  ADH_N
DNEVLVKFLASPINPSDINQIEGVYPIKPRFKEFGAVGGNEGVAEVIAAGPKVKNLVVGDWVIP

SEQ ID NO: 807 - protein, 64 aa, Piromyces finnis
  ADH_N
DDEVLVKFLAAPINPSDINQIEGVYPIKPRFKKYGAVGGNEGVAEVVAAGNKVKNLTVGDWVIP

SEQ ID NO: 808 - protein, 172 aa, Neocallimastix californiae
  adh_short
KVVIITGAGGGLGRAYAKHFAKLGASVVVNDLGVLLRGRGANTQVADSVVEEIKQMGGIAVPSYDSVEEGEKIVETAIKNFGRVDIIINNAGILRDRSFGRMTDTDWMMTYRVHLKGTYKVTRAAWPYMMKQKYGRIINITSAAGLFGNFGQSNYAAAKSGVIGLTNALALE

SEQ ID NO: 809 - protein, 171 aa, Neocallimastix californiae
  adh_short
VVVITGAGGGFGRAHAFLFASRGATLVLNDNAIISNNNGQPKYLVDDVVREITKAGFHAIANYEPIGNGDKIIEAAMNAFGRVDILINNAGVTCNKPFKEMSDKDWEYVHNVNLHGAYKVTKAVWPIMQKQKYGRIINIVSAAGLYGSYGQTNYSSAKMALHGFTLSLARE

SEQ ID NO: 810 - protein, 28 aa, Neocallimastix californiae
  ADH_SHORT
SAAGLYGSYGQTNYSSAKMALHGFTLSL

SEQ ID NO: 811 - protein, 28 aa, Neocallimastix californiae
  ADH_SHORT
SAAGLFGNFGQSNYAAAKSGVIGLTNAL

SEQ ID NO: 812 - protein, 171 aa, Neocallimastix californiae
  adh_short
VVIVTGAGGGLGRAYAKHFAKLGASVVVNDLGVLLRGRGANTQVADGVVEEIKKMGGIAVPSYDSVEEGEKIVETAIKNFGRVDIIINNAGILRDRSFARMTDTDWMMTYRVHLKGTYKVTRAAWPYMMKQKYGRIINITSAAGLFGNFGQSNYAAAKSGVIGLTNALALE

SEQ ID NO: 813 - protein, 171 aa, Neocallimastix californiae
  adh_short
VVVITGAGGGFGRAHAFLFASRGATLVLNDNAIISNSNGQKKYLVDDVVHEITKAGFHAIANYEPIGNGDKIIEAAMNAFGRVDILINNAGVTCNKPFKEMSDKDWEYVHNVNLHGAYKVTKAVWPIMQKQKYGRIINIVSAAGLYGSYGQSNYSSAKMALHGFTLSLARE

SEQ ID NO: 814 - protein, 28 aa, Neocallimastix californiae
  ADH_SHORT
SAAGLYGSYGQSNYSSAKMALHGFTLSL

SEQ ID NO: 815 - protein, 28 aa, Neocallimastix californiae
  ADH_SHORT
SAAGLFGNFGQSNYAAAKSGVIGLTNAL

SEQ ID NO: 816 - protein, 171 aa, Anaeromyces robustus
  adh_short
VVIVTGAGGGLGRAYAKHFAKLGASVVVNDLGVLLRGRGANTQVADSVVEEIKKMGGIAVPSYDSVEEGEKIVETAIKNFGRVDVIINNAGILRDRSFARITDTDWMMTYKVHLKGTYKVTKAAWPYMIKQKYGRIINITSAAGLFGNFGQSNYAAAKSGVIGFTNALALE

SEQ ID NO: 817 - protein, 171 aa, Anaeromyces robustus
  adh_short
VVVITGAGGGFGRAHAFLFASRGATLVLNDNAVVSHKKGQTKYVVDDVVNEITKAGFHAIANYEPIGNGDKIIEAAMNAFGRVDILINNAGVTCNKPFKDMTDKDWEYVHNVNLHGAYKVTKAVWPIMQKQKYGRIINIVSAAGLYGSYGQVNYSSAKMALHGFTLSLARE

SEQ ID NO: 818 - protein, 28 aa, Anaeromyces robustus
  ADH_SHORT
SAAGLFGNFGQSNYAAAKSGVIGFTNAL

SEQ ID NO: 819 - protein, 28 aa, Anaeromyces robustus
  ADH_SHORT
SAAGLYGSYGQVNYSSAKMALHGFTLSL

SEQ ID NO: 820 - protein, 171 aa, Piromyces finnis
  adh_short
VVVITGAGGGFGRAHAFLFASRGATLVLNDNAIISNNNGQPKYLVDDVVNEITKAGFHAIANYEPIENGDKIIEAAMNAFGRIDILINNAGVTCNKPFNEMSDKDWEYVQSVNLHGAYKVTKAVWPIMQRQRYGRIINIVSAAGLYGSYGQANYSSAKMALHGFTLSLARE

SEQ ID NO: 821 - protein, 171 aa, Piromyces finnis
  adh_short
VVIVTGAGGGLGRAYAKHFAKLGASVVVNDLGVLLRGRGANTQVADSVVEEIKSMGGIAVPSYDSVEEGEKIVETAIKNFGRVDVIINNAGILRDRSFARMTDTDWMMTYKVHLKGCYKVTKAAWPYMVKQKYGRIINITSAAGLFGNFGQSNYAAAKAGVIGLTNTLALE

SEQ ID NO: 822 - protein, 28 aa, Piromyces finnis
  ADH_SHORT
SAAGLFGNFGQSNYAAAKAGVIGLTNTL

SEQ ID NO: 823 - protein, 28 aa, Piromyces finnis
  ADH_SHORT
SAAGLYGSYGQANYSSAKMALHGFTLSL

SEQ ID NO: 824 - protein, 244 aa, Neocallimastix californiae
  adh_short_C2
RNSIGECVLKYLLAGGAKVVATTSSYRRATMEHFRSVYEQVGTKGSTLVVVPFNQGSKKDVNDLIEFIYSKDSRVNGLGWDLDLVIPFAAISENGRDISDLDGKSELAHRIMMTNVIRILGAVRTQKMKVGSLVSAQVILPLSPNHGTFGGDGLYGESKIGLENLLNRWRSETWSKYLSITGACIGWTRGTGLMNSNNLISEGIESQGTCRTFTTTEMAFNLIGLVSDVMVSLSRKSPIYADLN

SEQ ID NO: 825 - protein, 230 aa, Neocallimastix californiae
  adh_short_C2
RNSIGSQIIKGLLNGGAKIIATTSRFSKATMQYYRQLYEDHGSKGSCLIVVPFNAASVEDVNRLIDYIYSKDPKNGLGWDLDYVIPFAAISENGRTLENIDSRSELAHRIMLTNLLRMLGKIVSQKEAHKYDTRPAQCILPMSPNHGTFGGDGLYSESKIALETLFNRWHSEGWGGYLTVAGAVIGWTRGTGLMNSNNLVAEGIEMFGVHTFSTHEMAFNLIGLMHSDIC

SEQ ID NO: 826 - protein, 230 aa, Neocallimastix californiae
  adh_short_C2
RNSIGSQVIKGLLNGGAKIIATTSRFSKATMQYYRQLYEDHGSKGSCLIVVPFNAASVEDVNRLIEYIYSKDPKNGLGWDLDYVIPFAAISENGRTLENIDSRSELAHRIMLTNLLRMLGKIVTEKESHKYDTRPAQCILPMSPNHGTFGGDGLYSESKIALETLFNRWHSEGWGGYLTVAGAVIGWTRGTGLMNSNNLVAEGIEMFGVHTFSTHEMAFNLIGLMHSDIC

SEQ ID NO: 827 - protein, 241 aa, Anaeromyces robustus
  adh_short_C2
RNSIGENVLKYLIAGGAKVVATTSSYRRQTLEHFRSVYEQVGTKGSTLVVVPFNQGSKKDVNDLIEFIYSKDSRVNGLGWDLDLVIPFAAISENGRDISDLDGKSELAHRIMMTNVIRILGAIRNQKMKVRSLVSCQVVLPLSPNHGTFGGDGLYGESKIGLENLLNRWRSETWSNYLSITGACIGWTRGTGLMNSNNLISEGIESEGHCRTFTTTEMAFNLIGLVSDVMVSLSRKNPIYA

SEQ ID NO: 828 - protein, 240 aa, Anaeromyces robustus
  adh_short_C2
RNSIGSQVIKGLLNGGAKIIATTSRFSKATMQYYRQLYEDHGSKGSCLIVVPFNAASVEDVNHLIEYIYSKDPKNGLGWDLDYVIPFAAISENGRTLENIDSRSELAHRIMLTNLLRMLGKIVSEKEAHKYDTRPAQCILPMSPNHGTFGGDGLYSESKIALETLFNRWHSEGWGGYLTIAGAVIGWTRGTGLMNSNNLVAEGIEMFGVHTFSTHEMAFNLIGLMHSEICKMCLKNPVFA

SEQ ID NO: 829 - protein, 233 aa, Piromyces finnis
  adh_short_C2
RNSIGSQIIKGLLNGGAKIIATTSRFSKVTMQYYRQLYEDHGSKGSCLIVVPFNAASTEDVNRLIEYIYSKDPKNGLGWDLDYVIPFAAISENGRTLENIDSRSELAHRIMLTNLLRMLGKIVSEKEAHKYDTRPAQCILPMSPNHGTFGGDGLYSESKIALETLFNRWHSEGWGGYLTIVGAVIGWTRGTGLMNSNNLVAEGIEMFGVHTFSTHEMAFNLIGLMHNDICKMC

SEQ ID NO: 830 - protein, 233 aa, Piromyces finnis; identical to SEQ ID NO: 829
  adh_short_C2

SEQ ID NO: 831 - protein, 233 aa, Piromyces finnis; identical to SEQ ID NO: 829
  adh_short_C2

SEQ ID NO: 832 - protein, 233 aa, Piromyces finnis; identical to SEQ ID NO: 829
  adh_short_C2

SEQ ID NO: 833 - protein, 14 aa, Neocallimastix californiae
  ADH_ZINC
GHEVIGNVVALGAN

SEQ ID NO: 834 - protein, 14 aa, Neocallimastix californiae
  ADH_ZINC
GHEITGVVKSVGKA

SEQ ID NO: 835 - protein, 14 aa, Neocallimastix californiae
  ADH_ZINC
GHEIAGVVKSVGKA

SEQ ID NO: 836 - protein, 119 aa, Neocallimastix californiae
  ADH_zinc_N
GLGHLAVQFASKMGYEVTALSTSYNKKEEATGFGCHNFVLLKEAAEKVPNYFDLIINTSPYDMDWKMLLGLLRPNGKLCLIGIPAVDMKVPVMPIIFSQKTICGSIVAGRKFTNEMLEF

SEQ ID NO: 837 - protein, 120 aa, Neocallimastix californiae
  ADH_zinc_N
PVGLMSVAGASLRGASRIICVGTRKVCQDVARKYGATDFISYKNGTIEEQVMKLTDGKGVDRVCIAGGTVKTFESAIKCLKPGGKIGNVNYLGSGEFVTIPRVEWGVGMGHKDIRGGLMP

SEQ ID NO: 838 - protein, 135 aa, Neocallimastix californiae
  ADH_zinc_N
AVGQVVCQLAKLKGLRVVACASSPEKIGFLKQAIKVDEAFSYRDFPDKESFTAQLRKVCPNGIDIYYDNVGGYILDSALELMNIHGRVIMCGMISQYNLTEKYKYTLRDITSRRLTLQGCLFNDYFPQCMGEFMQ

SEQ ID NO: 839 - protein, 120 aa, Neocallimastix californiae
  ADH_zinc_N
AVGQSVIQIAKAWGIKTINVIRDRPNFEEVAGELHKLGATLVIKEEDLRSNSTRELVKNLGSPVRLALNCVGGKSASGITRLLGQNATIVTYGGMSKQPLTFGTGPFIFKNLRASGFWIS

SEQ ID NO: 840 - protein, 122 aa, Neocallimastix californiae
  ADH_zinc_N
GLGHLGVQFAHAMGAEVTVLGHSESKKEEAKKLGADCYEILKTDEDFKKYYRTFDFILNCATANLNLDNHFKLLKPNGVLCFVSIVPEEQRFSELNLFGNQASITVSNVGGIGITQEMLNFS

SEQ ID NO: 841 - protein, 114 aa, Neocallimastix californiae
  ADH_zinc_N
GVGQAAVKLCQLWGANIIASASASKQQFLRDTYGLEHVTNSRDPEEFYRDVMKWTDGKGVDFVLNSLSGKSLKMGIKCLKNGGKFVEIGKTDILNDSKLGLHCLLNNISFVSSH

SEQ ID NO: 842 - protein, 98 aa, Neocallimastix californiae
  ADH_zinc_N
GVGQAAIKLCQYWGAKIFVSTSAKKVQYLKDMYGLEYITNSRDSKTFYNDIMKWTNNEGVDFVLNALAGDGITYGLKCLKKGGHFVEIGKKNIIFNTP

SEQ ID NO: 843 - protein, 122 aa, Neocallimastix californiae
  ADH_zinc_N
GLGHLGVQFAHAMGAEVTVLGHSESKKEEAKKLGADCYEILKTDEDFKKYYRTFDFILNCATANLSLDNHIKLLKPNGVLCFVSIVPEEQKFTEMNLFGNQATITVSNVGGIDITQEMLNFS

SEQ ID NO: 844 - protein, 120 aa, Anaeromyces robustus
  ADH_zinc_N
AVGQSVIQIAKAWGIKTINVVRDRPNFDELASELHKLGATLVIKEEDLRANSTRELVKSLGSPVRLALNCVGGKSASGITRLLGHNATIVTYGGMSKQPLTFGTGPFIFKNLRACGYWNS

SEQ ID NO: 845 - protein, 122 aa, Anaeromyces robustus
  ADH_zinc_N
AVGQSVIQIAKAWGIKTINVVRDRPNFDEFAAELHKLGATLVIKEEDLRANSTRELVKNLGNPVRLALNCVGGKSASGITRLLGNNATIVTYGGMSKQPLTFGTGPFIFKNLRACGFWVSRW

SEQ ID NO: 846 - protein, 136 aa, Anaeromyces robustus
  ADH_zinc_N
AVGQVVCQLAKLKGLRVVACASSPEKIGFLKQALKVDEAFSYRDFPDKKSFTEQLRKVCPNGIDIYYDNVGGYILDSALEVMNIHGRVIMCGMISQYNLKDKYQYTLRDITSRRLTLQGCLFNDFFPQCMGEFMQD

SEQ ID NO: 847 - protein, 96 aa, Anaeromyces robustus
  ADH_zinc_N
GVGQAAIKLCKYWGAKIYVSTSTKKREYLKNLYGLEYITDSRNPKIFYEDIMKWTNNEGVDFVLNALAGDGITYGLKCLKKGGCFVEIGKKNIILN

SEQ ID NO: 848 - protein, 135 aa, Piromyces finnis
  ADH_zinc_N
AVGQVVCQLAKLKGLKVVACASSPEKIGFLKGAIKVDEAFSYRDFPDKESFVAQLRKVCPNGIDIYFDNVGGYILDSALQLMNVHGRVVMCGMISQYNLKDKYQYTLQDISNRRLTLQGCLFNDYFPRCMGEFMQ

SEQ ID NO: 849 - protein, 120 aa, Piromyces finnis
  ADH_zinc_N
AVGQAVIQIAKAWGIKTINVVRDRPNFDELADQLHKLGATLVIKEEDLRANSTRELVKNLGSPVRLGLNCVGGKSANGITRLLGHNASLVTYGGMSKQPLTFGTGPFIFKNLKACGFWNS

SEQ ID NO: 850 - protein, 91 aa, Piromyces finnis
  ADH_zinc_N
GVGQAAIKLCQYWGAKVYVSTSARKRKYLEDLYGLEHITDSRNPKTFYEDIMKWTNNEGVDFVLNALAGDGITYGLKCLKKGGRFIEIGKK

SEQ ID NO: 851 - protein, 114 aa, Piromyces finnis
  ADH_zinc_N
GVGQAAVKLCQLWGANIIASASASKQQFLRDTYGIEHVTNSRDPEQFYSDVMKWTNGKGVDFVLNSLSGKSLRMGIKCLKNGGKFVEIGKTDILNDSQLGLHCLLNNISFISSH

SEQ ID NO: 852 - protein, 337 aa, Neocallimastix californiae
  ALCOHOL DEHYDROGENASE RELATED
MATTFKAWAALNAKEKLQPYEYTPEPLADDQIEVKVTHNGLCHSDIHMKDNDWGNSSYPFIPGHEVIGNVVALGANAEKLSGLKVGDRVGYGWIRDSCGFCECCIEGQENLCEKGYEGTIVGHHGGFQDRIRMPAKFAFKIPEKLPSEYAAPLMCAGATVYNPLRLFIEKPNVKVGVIGIGGLGHLAVQFASKMGYEVTALSTSYNKKEEATGFGCHNFVLLKEAAEKVPNYFDLIINTSPYDMDWKMLLGLLRPNGKLCLIGIPAVDMKVPVMPIIFSQKTICGSIVAGRKFTNEMLEFAALNGVKPKIELMKLSQCNEAIEKVLANKARYRIVLE

SEQ ID NO: 853 - protein, 350 aa, Neocallimastix californiae
  ALCOHOL DEHYDROGENASE RELATED
MKGYAMVKIGEPGWVEKEKPKCGPMDAICKPLAIAVCTSDVHTVWEGAIGDRHDMILGHECCAEVVEVGSEVKDFKPGDRVIVPAITPDWNSLEAQAGYSMHSHGMLAGWKFSNIKDGVFSEYFHVNDADGNLAHLPSSINTVDACMLSDMVPTGFHAVELADIQFGDVVLQIGIGPVGLMSVAGASLRGASRIICVGTRKVCQDVARKYGATDFISYKNGTIEEQVMKLTDGKGVDRVCIAGGTVKTFESAIKCLKPGGKIGNVNYLGSGEFVTIPRVEWGVGMGHKDIRGGLMPGGRLRMEKLASLVVAGRLDLSPLSTHVYNGWEEVPKALQIMKDKPADLIKPVIK

SEQ ID NO: 854 - protein, 351 aa, Neocallimastix californiae
  ALCOHOL DEHYDROGENASE RELATED
MSLENVSCVLNHFPGEGMVKLDDMKIVKSVVPELGENDVLLKNLCCSVDPFMRGRMRKGVKSYVASFEEGKPMPVFSVTQVAKIGSAVTDINVGDKYMCFNGIEKYTVLPQQVIKGEGEKNLGSFNKIDPNNPLKDSFYLGLFGMPGMTAWAFFNKAGKPKEGETIFVTAAAGAVGQVVCQLAKLKGLRVVACASSPEKIGFLKQAIKVDEAFSYRDFPDKESFTAQLRKVCPNGIDIYYDNVGGYILDSALELMNIHGRVIMCGMISQYNLTEKYKYTLRDITSRRLTLQGCLFNDYFPQCMGEFMQDMIPKLQQGKLIYKEHIYKGVEKTPEAFLGLFNSENFGKVVIE

SEQ ID NO: 855 - protein, 346 aa, Neocallimastix californiae
  ALCOHOL DEHYDROGENASE RELATED
ISKAMVCSKYGQPKDVLSLKELKIPKIRDNEVLVKFLAAPINPSDINQIEGVYPIKPRFREYGAVGGNEGVAEVVAAGSKVKNLTIGDWVIPDSKAFGTWQTFAASSENELQKISKNGISKISAATISVNPPTAYRMLKDFVNLKKGDVVIQNGANSAVGQSVIQIAKAWGIKTINVIRDRPNFEEVAGELHKLGATLVIKEEDLRSNSTRELVKNLGSPVRLALNCVGGKSASGITRLLGQNATIVTYGGMSKQPLTFGTGPFIFKNLRASGFWISRWNKEASKKDKQYMFDDICELVRGGHLAEPWHEETKWETSDDNKTLNKKFMTALGKAGASFGNKKQILT

SEQ ID NO: 856 - protein, 342 aa, Neocallimastix californiae
  ALCOHOL DEHYDROGENASE RELATED
MTTKVKGYKVEGNQFSNFGVSLVERRALRDDDVEIDIKYCGICHSDIMIVQINQPGKGVVPGHEITGVVKSVGKAVTNFKVGDHVGVGCFVNSCSNCEYCKRGDEQFCDKGVVVVFNSKDYDGAITYGGYTQTIIVKDKFVLHIPDSLDLAVASPLLCAGITTYSPLKRYNIGKGSRVAIMGLGGLGHLGVQFAHAMGAEVTVLGHSESKKEEAKKLGADCYEILKTDEDFKKYYRTFDFILNCATANLNLDNHFKLLKPNGVLCFVSIVPEEQRFSELNLFGNQASITVSNVGGIGITQEMLNFSAEKGIKPMIEMIKVKDIPEAYQKIIDCKVHYRYVID

SEQ ID NO: 857 - protein, 329 aa, Neocallimastix californiae
  ALCOHOL DEHYDROGENASE RELATED
MTTKVKGYKVEGSQFSNFGVSLVERRALRDDDVEIDIKYCGICHSDIMIVQNNQPGNGIVPGHEIAGVVKSVGKAVTNFKVGDHVGIGCFVNSCSNCEYCKRGDEQFCDKGVVIVFNSKDYDGAITYGGYTQTIIVRDKFVLHIPESLDLAMASPLLCAGVTTYSPLKRYNIGKGSRVAIMGLGGLGHLGVQFAHAMGAEVTVLGHSESKKEEAKKLGADCYEILKTDEDFKKYYRTFDFILNCATANLSLDNHIKLLKPNGVLCFVSIVPEEQKFTEMNLFGNQATITVSNVGGIDITQEMLNFSAEKGIKPMIEMIKVKDIPEAYQK

SEQ ID NO: 858 - protein, 346 aa, Anaeromyces robustus
  ALCOHOL DEHYDROGENASE RELATED
ISKAMVCEKHGQPKDVLRLKEIKISKIKDDEVLVKFLASPINPSDINQIEGVYPIKPRFKEYGAVGGNEGVAEVIAAGSKVKNLTVGDWVIPDTKAFGTWQTYATSPENELQKISKNGISSISAATISVNPPTAYRMLKDFVNLKKGDVVIQNGANSAVGQSVIQIAKAWGIKTINVVRDRPNFDELASELHKLGATLVIKEEDLRANSTRELVKSLGSPVRLALNCVGGKSASGITRLLGHNATIVTYGGMSKQPLTFGTGPFIFKNLRACGYWNSRWNKEASKKDKQYMFDDICELIRGGHLAEPWHDETKWEVSDDNKTLNKKFMEALSKAGKSFGNKKQILT

SEQ ID NO: 859 - protein, 346 aa, Anaeromyces robustus
  ALCOHOL DEHYDROGENASE RELATED
ISKAMVCEKHGQPKDVLSLKELKISKIKDNEVLVKFLASPINPSDINQIEGVYPIKPRFKEFGAVGGNEGVAEVIAAGPKVKNLVVGDWVIPDTKAFGTWQTFAASPENEFQKINKNGISKISAATISVNPPTAYRMLKDFVNLKKGDVVIQNGANSAVGQSVIQIAKAWGIKTINVVRDRPNFDEFAAELHKLGATLVIKEEDLRANSTRELVKNLGNPVRLALNCVGGKSASGITRLLGNNATIVTYGGMSKQPLTFGTGPFIFKNLRACGFWVSRWNKEASKKDKQYMFDDICELIRGGHLAEPWHEETKWETSDDNKTLNKKFKSALSKAGASFGNRKQILT

SEQ ID NO: 860 - protein, 350 aa, Anaeromyces robustus
  ALCOHOL DEHYDROGENASE RELATED
MTLENVSCILNNYPDGMVTVDNMKVVKSPVPELGENDVLLKNLCCSIDPFMRGRMRENVKSYVPSFEKGKVMQVFSVTQVEKIGSAVTDINVGDKYMCFNGIEKYTVLPQQVIKGDGKQSLGSFTKIDQRNPIKDSFYLGLFGMPGMTAWAFFNKVGKPKEGETIFITAATGAVGQVVCQLAKLKGLRVVACASSPEKIGFLKQALKVDEAFSYRDFPDKKSFTEQLRKVCPNGIDIYYDNVGGYILDSALEVMNIHGRVIMCGMISQYNLKDKYQYTLRDITSRRLTLQGCLFNDFFPQCMGEFMQDMIPKLEKGQIIYKEDIYEGVEKAPEAFIGLFNSNNFGKVVIV

SEQ ID NO: 861 - protein, 351 aa, Piromyces finnis
  ALCOHOL DEHYDROGENASE RELATED
MTIENVSCTLNRYPEGMVKLDDFKIVQGPIPEISDNDVLLKVLCCSVDPFMRGRMKKDNPSSYVPPCQPGKVIQVFSITQVEKIGANVTDINVGDKYMCFNGIEKYTVVPQQAIKGDGQKNLGNYNKIDPNNPIKDSFYLGLFGMPGMTAWAFFNKVGKPKEGETIFVSAASGAVGQVVCQLAKLKGLKVVACASSPEKIGFLKGAIKVDEAFSYRDFPDKESFVAQLRKVCPNGIDIYFDNVGGYILDSALQLMNVHGRVVMCGMISQYNLKDKYQYTLQDISNRRLTLQGCLFNDYFPRCMGEFMQDMIPMVQSGKLIYKEDVYKGVEKTPEAFIGLFNSKNFGKVVIE

SEQ ID NO: 862 - protein, 345 aa, Piromyces finnis
  ALCOHOL DEHYDROGENASE RELATED
ISKAMVCEKHGKPKDVLRLKELTIPKIKDDEVLVKFLAAPINPSDINQIEGVYPIKPRFKKYGAVGGNEGVAEVVAAGNKVKNLTVGDWVIPDTKAFGTWQTFAASPENELQKISKNISKISASTISVNPPTAYRMLKDFVNLKKGDVIIQNGANSAVGQAVIQIAKAWGIKTINVVRDRPNFDELADQLHKLGATLVIKEEDLRANSTRELVKNLGSPVRLGLNCVGGKSANGITRLLGHNASLVTYGGMSKQPLTFGTGPFIFKNLKACGFWNSRWNKEASKKDKQYMFDDLCELIRGGYLAEPWHDETKWELSDDNKTLNRKFMKALSKAGASFGNKKQILT

SEQ ID NO: 863 - protein, 129 aa, Neocallimastix californiae
  Aldolase_TIM
SNPNTHKKWIDLASTMGWRFYILDEGWQPDSYDNDGSYYSGWFDWWPEVRDYAKRKGVQLIAWVHKNDVDTPEKRRKRFKEWSEEGIVGIKVDFFFNEAQSTLQLHQDIYKEAARYHLLVNVHGSNPPS

SEQ ID NO: 864 - protein, 264 aa, Neocallimastix californiae
  Aldolase_TIM
FAPKLVKSANNGKIYVETRFSRLLGKPPLMVGGMTPTTANENLVSACINAGYHIELAGGGQHSTQMIRDRIKKIMSKVPSGEGITMNIMFLNAFQWGFQYPLVQEMRKEGVPLDGLCIAAGVPSLDVANEILGNLKACGIKHVAFKPGSVSAIQQVIAIAKQNPDMPIIMQWTGGRAGGHHSFEDFHQPIIDTYASIRRQPNIIIVVGSGFGDAEGTLPYLTGEWARKFGYPPMPFDGILFGSRILVAAEAGTSEEVKKLLVKS

SEQ ID NO: 865 - protein, 264 aa, Neocallimastix californiae
  Aldolase_TIM
FAPKLVKSANNGKIYVETRFSRLLGKPPLMVGGMTPTTANENLVSACINAGYHIELAGGGQHSTQMIRDRIKKIMSKVPSGEGITMNIMFLNAFQWGFQYPLVQEMRKEGIPLDGLCIAAGVPSLDVANEILGNLKACGIKHVAFKPGSVSAIQQVIAIAKQNPDMPIIMQWTGGRAGGHHSFEDFHQPIIDTYASIRRQPNIIIVVGSGFGDAEGTLPYLTGEWASKFGYPPMPFDGILFGSRILVAAEAGTSEEVKKLLVES

SEQ ID NO: 866 - protein, 264 aa, Anaeromyces robustus
  Aldolase_TIM
FAPKLVKSANNGKIYVETRFSRLLGKPPLMVGGMTPTTANENLVSACINAGYHIELAGGGQHSTQMIRNRIKKIMSNVPCGEGITMNIMFLNAFQWGFQYPLVQEMRKEGIPLEGLCIAAGVPSLDVANEILSNLKACGIKHVAFKPGSVSAIKQVIAIARQNPDMPIIMQWTGGRAGGHHSFEDFHQPIIDTYAIIRRQPNIIIVVGSGFGNAEGTLPYLTGEWARKFGYPPMPFDGILFGSRILVAAEAGTSEEVKKLLVES

SEQ ID NO: 867 - protein, 253 aa, Piromyces finnis
  Aldolase_TIM
GKIYVETRFSRLIGKPPLMVGGMTPTTANENLVGACINAGYHIELAGGGQHSTQMIRDRIKKIMSKVPSGEGITMNIMFLNAFQWGFQYPLVQEMRKEGIPLEGLCIAAGVPSLDVANEILANLKACGIKHVAFKPGSVSAIQQVIAIAKQNPDMPIIMQWTGGRAGGHHSFEDFHQPIIDTYAAIRRQPNIIIVVGSGFGDAEGTLPYLTGDWARKFGYPPMPFDGILFGSRILVAAEAGTSEEVKKLLVAS

SEQ ID NO: 868 - protein, 253 aa, Piromyces finnis; identical to SEQ ID NO: 867
  Aldolase_TIM

SEQ ID NO: 869 - protein, 253 aa, Piromyces finnis; identical to SEQ ID NO: 867
  Aldolase_TIM

SEQ ID NO: 870 - protein, 253 aa, Piromyces finnis; identical to SEQ ID NO: 867
  Aldolase_TIM

SEQ ID NO: 871 - protein, 792 aa, Neocallimastix californiae
  ALPHA-L-FUCOSIDASE 2
QWSNGGERSNQTWLFEKVEGPSEEDLHPKAALKLWYDSPARAWTDALPVGNSHLGGMVYGGAQRDEIQLNEDTFWAGGPHNNIPRNAASALPQARRMIFEGRFGQAQDYIDKNFFTGQNGMGYLTLGSLFINFSDVSGFSNYYRDLDLNNAIATSKFTANGSNIERSLFASMADDVIVYNIATDGKPLNFSVNHKCPLQTNASSSGNRLILKIRGKDQEGVGAKLNAYVIVEIVSDGRVSASGSSLNVSNAKEATILISAATNFVNYHDVSGDAAKKAEAALSKVKNVDYSTLKSKHIEAYKKQFDRVKISLPTSSASADQTVNRILNFNRSDDQDLVALMFQYGRYLLITSSQPGGQAANLQGIWNDSTDAPWDSKYTININAQMNYWPAEVTNLSECHEPMFDLIRDLSVTGKEAASKIYGAEGWMAHHNTDIWRVTGPIDGAFWGMWPNGGGWLSTHIWQHYLFTGDKDFLKNNYAILRDSAKFYVTSMQKDPNTGFLVTVPSTSPEHGYSSDGSSMTAGCTMDNQIAFDVLNQALLAAQTLGVDESFQSTLKSTMNNIAPMKVGQYNQLQEWFVDADNPRDDHRHVSHLYGLYPSGQISPFKQPLLFEAAKNTLNQRGDMATGWSIGWKINLWARLLDGNHAYKIIQNMINLVRDNDGGNGRVYTNLFDAHPPFQIDGNFGFCAGIAEMLLQSHDGAVHLLPALPNVWKEGSVSGLVARGGFEVSMDWKNGKISKATIKSKIGGSLRIRSNTPLSGQGIKTAQGTCKNALLLSPDVKKPEISNKSSIK

SEQ ID NO: 872 - protein, 790 aa, Anaeromyces robustus
  ALPHA-L-FUCOSIDASE 2
QWVNGGEKDNQIWIFEAIKAPSEEDLEVKSAGLKLWYNNPAGEWTEALPVGNSHLGAMIYGGAQRDELQLNEDTFWAGGPHNNIPGNAANALPQARQMIFEGRFGQAENYINQNFFTGQNGMGYLTLGSLFINFSDIKDYSNYYRELDISNAIATTTFNANGGSMERTLFASMTDDVLVYHISSEKATSFSLSHKCALSTSVSSSGNRLIIQVRGKDQEGVRGQLSAYGIAEVVTDGRVSASGSSLSVSGAKEAMIIFSAATNFVNYRDVSGDAKKKVEATLQKVKNVAYETLKERHIEAYKKQFDRVKIALPVNSSAQNPTMDRLANFNRSGDQDLVALMFQYGRYLLISSSQPGGQPANLQGIWNDSTDAPWDSKYTININAQMNYWPAEVTNLSECHEPLFSLIRDLSVTGKEAASRIYKAEGWMAHHNTDIWRISGPVDGAFWGMWPNGGGWLSTHIWQHYLFTGDKDFLEEYYPILRDAAKFFVSSMVKDPNTGYLVTVPSTSPEHGYSSDGSSMTAGCTMDNQIAYDVLNQALLAAKTLGVDDSFQKTLQNTMNNIAPMQVGQYNQLQEWFVDADNPRDDHCHVSHLYGLYPSGQISPFKQPLLFEASKNTLTQRGDMATGWSIGWKINLWARLLDGNHAYKIIQNMLVLIRSGVDGRVYGNMFDAHPPFQIDGNFGFCAGIAEMLLQSHDGAVHLLPALPSVWSDGSISGLVARGGFEVSITWKSGKVTKASIKSKIGGFLRVRSNTPLSGKNVTTASGDCKNPLLLSVSVKDPKISSRASIG

SEQ ID NO: 873 - protein, 791 aa, Anaeromyces robustus
  ALPHA-L-FUCOSIDASE 2
QWTNGGEKNHQVWTFESVSAPSEKDLKAKSMKLWYDIPAREWTEALPVGNSHLGAMIYGGVQRDELQLNEETFWGGGPHNNVVNNAFPKIQQARQMIFDGKFMQAENYINQNCLSGIDGMPYLPLGSLFINYSDIKEYSNYYRELDISNAMTTTKFTANGVNMERTLFASMTDDVLVYHITSDPKKPISFSLSYQFPRLTNSISTSGNRLIIKVNGKDHEGVKGRVTAYGIAEVVTDGKVNGNGSTLSVSGANEAIIFFSAATNFVNYKDVSGDPKKKAEAALEKVINTSYETLKKRHIEAYKKQFDRVKLSLPMNAYALNPTMDRLANFNKSGDQDLVTLMFQYGRYLLISSSQPGGQPATLQGIWNDNIDAPWDSKYTININIQMNYWPAEVTNLSECHEPLFELIRDLSVSGRESASKLYNAEGWMAHHNTDVWRISGPIEGAYWGIWPNGGAWLSTHIWQHYLFTGDKEFLKDYYEVLKGAAQFFVTDLVRDPNTGFLVTVPSGSPEHGYSADGSAMTAGCTMDNQIAYDTMNQALQAAKILGLDQDFQKTLQQTMDGLAPMQVGQYNQLQEWYVDADNPRDDHRHVSHLYGLYPSAQISPFKQPLLFEASKNSLTQRGDMATGWSIGWKINLWARLFDGNHAYKIIKNLLNLIRSGVDGRVYANMFDAHPPFQIDGNFGFCAGIAEMLVQSHDGAVHLLPALPDVWGDGSVSGLMARGGFEVSITWKSGKVTKASIKSKIGGSLRVRSNVQLSGKGVKTAEGDCKNPLLLSSDVKTPRISPRSNIG

SEQ ID NO: 874 - protein, 794 aa, Piromyces finnis
  ALPHA-L-FUCOSIDASE 2
VQWTGGGEKGNQTWLFESVSAPTEEETHPKADLKLWYNSPANAWTEALPVGNSHLGGMVFGGAQTDEIQLNEETFWAGGPHNNIPQRANSVLSQARQLIFSSKFGDAQNLIDKNFFSGQNGMGYLTLGSLYIKFSDVKDVSNYYRDLDLNTAIATSKFTSNGMNVERSLFASMADNVLAYKITNENKPISFTVSHKCQLSTSVSTSNNRMILKIRGKDQEGVGSKLSAYGIVEIVTDGRVSASGSSLSVSGAYDTVIYITAATNFVSYNDVSGDAQKKAEAAIQSALKSTYSSLKDKHLAAYKKQFDRVKISLPVNSNAENQTVDRLANFNRSGDQDLIALMFQYGRYLLITSSQPGGQPANLQGIWNDSIDAPWDSKYTININTEMNYWPAEVTNLSECHDPLFSLIRDLSVTGREAASKIYNAEGWMAHHNTDIWRITGPVDGAYWGMWPNGGGWLSTHIWQHYLFTGDKDFLNQNYSILKEAAKFFVSSMVKDPNTGYLATVPSTSPEHGYSYDGSSMTSGCTMDNQIAFDVLNQALLAAKTLGVDESFQKTLQNTINSIAPMKVGQYNQLQEWFVDADNPKDDHRHVSHLYGLYPSGQISPFKQPLLFEAAKNTLTQRGDMATGWSIGWKINLWARLLDGNHAYKIIQNMLNLLPTGQDNSNGRVYANLFDAHPPFQIDGNFGFCAGIAEMLLQSHDGAVHLLPAIPDVWNEGSISGLIARGGFEVDMIWKSKKITKATIKSKIGGVLRIRSNTQLSGEGLKTAEGTCKNPLLLSSDVKKPEISSKASIK

SEQ ID NO: 875 - protein, 49 aa, Neocallimastix californiae
  alpha/beta-Hydrolases
SNYCGQATKEIFDALGATDKYTYTQEGGHMHCSLPNGQFDEVKDFVNKF

SEQ ID NO: 876 - protein, 185 aa, Neocallimastix californiae
  alpha/beta-Hydrolases
WTCRREEIAATFEKIMFGEKPRNPDKVEGRKSGNKYTVTVTNKGNTASFDVTISNAGTAAKPKPAIIGLDQGFGMGGSLGASTNGLDVASITFNTNNLAPENNPRSGAFFKANPSSNAGTIMAWAWGVSRLIDALEKDSSVGIDVKHLAVTGCSRLGKAALAIGAFDERIALTIPQESGSGGASL

SEQ ID NO: 877 - protein, 159 aa, Neocallimastix californiae
  alpha/beta-Hydrolases
VKFPNGYRGDKPTPLLINYHPIMGSASQWEGGSQTAKAALNDGAIVAFMDGAQGPMGQAWNVGPCCTDADDVKFTRDFIKEITNKACVDPKRIYAAGFSMGGGMSNYAGCYLSDVIAAAAPSAFDLAKEIVDAGKCKPSRPFPILNFRGTSDQIVMYNG

SEQ ID NO: 878 - protein, 23 aa, Neocallimastix californiae
  alpha/beta-Hydrolases
CEMYENCNGGVKVGLCTINGGGH

SEQ ID NO: 879 - protein, 176 aa, Neocallimastix californiae
  alpha/beta-Hydrolases
LRGIIQFPWSGGRRKVIIDLPDNYDKNKPYRLIFGMQCMGGSSDNVRSEGYYGLKPLDTGKTSIFVAPEGNGQQLPWGEADYRLFDELLDKLKEDLCIDESRVFSTGFSYGSMYSNGLSWNHQKVLRGVAVYETAERNIWLPKHTGEPIAWMGVLGFDDGLCTPEMGRHARDIILE

SEQ ID NO: 880 - protein, 171 aa, Neocallimastix californiae
  alpha/beta-Hydrolases
WSGGRRTVRIDIPNNYNNQNPYRLVFGMHCMGGWAGGVQQEGYYGLKPLDTGKTTIFVAPEGNGNVAPWGQGDYKLFDELLEKMKNDLCIDESRVFSTGFSYGSMFSNGLSWDHQKVLRGVAVYETAERNIWLPRHTGLPIAWMGVLGFDDNVCTPEMGRHARDIILEHNS

SEQ ID NO: 881 - protein, 30 aa, Neocallimastix californiae
  alpha/beta-Hydrolases
VRWCTQSGGHLWDHKDPGQNQSWVPKATWE

SEQ ID NO: 882 - protein, 238 aa, Neocallimastix californiae
  alpha/beta-Hydrolases
NKPAWVYLPAGYDANDKDTKYPLVILMHGYGMTEDSWGLTDKSSGGRIKSMMDRGMAKSKDEEDYVEKFILVVPTGLASKDYRNNNDYNYTDPWYAFGGELRNDLIPFMRSKYNIKDGRENVAMAGLSMGAEETLNLGIGECLDLISYFGAFSFPFGETMIEKAEKAFPDKSLTIKTLYTICGDNDSIAYDKYGDAVEKMSKWDRVEDGKFKSEIYVGGTHDFPVWFRGFEHFIPLLF

SEQ ID NO: 883 - protein, 160 aa, Neocallimastix californiae
  alpha/beta-Hydrolases
IVKFPSGFSGDKAAPLLINYHPIMGSASQWEGGSQTAKAALSDGAIVAFMDGAQGPMGQAWNVGPCCTDADDVQFTRDFIKEITSKACVDPKRIYAAGFSMGGGMSNYAGCFLSDVIAAAAPSAFDLAKEIVDAGKCKPTRAFPILNFRGTQDNIVMYNG

SEQ ID NO: 884 - protein, 23 aa, Neocallimastix californiae
  alpha/beta-Hydrolases
CEMYENCKDGAKVGLCTINGGGH

SEQ ID NO: 885 - protein, 161 aa, Neocallimastix californiae
  alpha/beta-Hydrolases
VIVKFPSGYTGNEATPLLINYHPIGGSASQWEGGSQTAKAALSDGAIVAFMDGAQGPMGQAWNVGPCCTDADDVQFTRNFIKEITSKACVDPKRIYAAGFSMGGGMSNYAGCYLADVIAAAAPSAFDLAKEVVDAGKCKPARPFPILNFRGTQDPIVMYNG

SEQ ID NO: 886 - protein, 284 aa, Neocallimastix californiae
  alpha/beta-Hydrolases
PNPPQSVKATYSGGTLTVVVNDNGGSLTLTSKITVPSGNGPFPVIIGMNSATGSLGSNLFSGFIQVPFMHDQCATYSMNGQKNTNAPFYKMYPNLKQAGDYIAWSWGVSRLIDGLEQVKSQIHADMAHIGVTGCSYAGKMALFAGAFDERIALTIPQESGGGGINAWRVSDTIGNVEKIDNTNYSWFMQALKNNFGSNKAGKLPYDHHEAIAMIAPRAVFAMGNPDYEWLGDKSGYTSAMAAYEVWKAMGVEDRFGFNFIGNHMHCSAHNNQNSDVTKFIDKFL

SEQ ID NO: 887 - protein, 167 aa, Neocallimastix californiae
  alpha/beta-Hydrolases
YEQEGISYGTLQRITYYSENTKSNRPMNILLPPNYNPEKKYPILYLLHGILSDQNSLIKSKYGTPNIAGYLMNKGMAKEMIIAYPYTYAPKDGIEVEPGFTKEHAAGYDNFINELLFNIMPYMEKNYPILTGRDNTAIAGFSMGGRNSLYIGYSKPELFGYIGAFSP

SEQ ID NO: 888 - protein, 238 aa, Neocallimastix californiae
  alpha/beta-Hydrolases
SGINGGNSLNVYLPYGYDKNKQYNIFYLMHGGGENENTIFSNDVKLQNIIDHLIMNGELEPLIIVTPTFNKCEARTFYKEFRESVIPFVEGKYSTYAKSVSPSDIKASRMHRAFGGFSMGSASTWAVLVNCLDIVAYYMPLSGDNWEANGGYGKAKSVADAINRAGLKSNEFFIFCATGSEDIAYPNMNPQMDEMKKMQPFIYTSDFSKGNFYYLVAPGKTHWWGYVKHYIYDALPSF

SEQ ID NO: 889 - protein, 174 aa, Neocallimastix californiae
  alpha/beta-Hydrolases
SFEFNWSGGKRTVRIDIPNNYDNKHPYRLVFGMHCMGGWAGGVQQEGYYGLKPLDTGKTTIFVAPEGNGQQAPWGQADYQLFDQLLEKLKNDLCIDESRVFSTGFSYGSMFSNGLSWNHQKVLRGVAVYETAERNIWLPKHTGEPIAWMGVLGLDDGLCTPEMGRKARDIILEH

SEQ ID NO: 890 - protein, 171 aa, Neocallimastix californiae
  alpha/beta-Hydrolases
WSGGSRKVLIDIPQNYDSSHPYRLVFGMQCMGGSAGNVRNEGYYGLKPLDTGKTTIFVAPEGNGQQLPWGEADYKLFDELLEKLKGDLCIDESRVFSTGFSYGSMFSNGLSWNHQKVLRGVAVYETAERNIYLPTHTGDGIGWMGVLGFDDNLCTPEMGRAARDIILSHNS

SEQ ID NO: 891 - protein, 33 aa, Neocallimastix californiae
  alpha/beta-Hydrolases
VRWCTQSGGHLWDHKDPGQGQSWVPQATWEFIN

SEQ ID NO: 892 - protein, 251 aa, Neocallimastix californiae
  alpha/beta-Hydrolases
RKDGVEYPAIENISYYSTTTQSERPLVVVLPPNYNEKKKYPVVYILHGIMTDGSFMLQEGFGTVTIPGNLFHKHMAKEFIMVLPNQYAPAPGTEVEPNLNEEYFAGYNNFINDLVNDIMPYMKKHYSIATGKKNTAICGYSFGGRNSLYIGLKRPDLFGYVGSFSPAPGILPGDDVFTGHHNGLFKEEKDVVFAGKPPYLTMISCGTNDTVVGTFPKSYHEALTHNNQQHIWYEMTGLDHADDAAINSPYY

SEQ ID NO: 893 - protein, 126 aa, Neocallimastix californiae
  alpha/beta-Hydrolases
IVKFPSGYSGDKNVPLLINYHPIGGSATQWEGGSQTAKAALNDGAIVAFMDGAQGPMGQAWNVGPCCTDADDVQFTRDFIKEITSQACVDTNRIYAAGFSMGGGMSNYSGCMLADVIAAAAPSAFD

SEQ ID NO: 894 - protein, 171 aa, Neocallimastix californiae
  alpha/beta-Hydrolases
WSGGRRTVRIDIPNNYNNQNPYRLVFGMHCMGCWAGGVQQEGYFGLKPLDTGKTTIFVAPEGNGNQAPWGQGDYKLFDELLSKLKNDLCIDESRVFSTGFSYGAMFSNGLSWDHQKDLRAVAVYETAERNIWLPRHTGLPIGWMGVLGFDDNVCTPEMGRHARDIILEHNS

SEQ ID NO: 895 - protein, 12 aa, Neocallimastix californiae
  alpha/beta-Hydrolases
VRWCTQSGGHLW

SEQ ID NO: 896 - protein, 171 aa, Neocallimastix californiae
  alpha/beta-Hydrolases
WSGGKRTVRIDVPDNYNNKNPYRLVFGMHCMGGWAGGVQQEGYYGLKPLDTGKTTIFVAPEGNGNQAPWGEGDYKLFDELLEKLKGEFCIDESRVFSTGFSYGSMFSNGLSWNHQKVLRGVAVYETAERNIYLPKHTGDGIGWMGVLGFNDNVCTPEMGRHARDIILEHNS

SEQ ID NO: 897 - protein, 32 aa, Neocallimastix californiae
  alpha/beta-Hydrolases
VRWCTQSGGHIWDHKDPGSNQSWVPQATWEFI

SEQ ID NO: 898 - protein, 253 aa, Neocallimastix californiae
  alpha/beta-Hydrolases
KKEGVEYPTVKNLTYYSTTTKSERPLHVLLPPSYDGKKKFPVVYLLHGVMTNGEFMLQEGFGTIAIPGNLFHKHMAKEFIMVLPDQYAPAPGTEVEPNLNEEYFAGYNNFINDLVNDIMPYMKKNYRIFTGKKNTAICGYSFGGRNSLYIGLMRPDLFGFVGAFSPAPGILPAEDMFTHHNGLFKEEKDVVFQGKPPYLTMISCGTNDFVVGTFPKSYHEALEHNHQEHIWYEMTGLDHGDNESVTSPLYNFF

SEQ ID NO: 899 - protein, 253 aa, Neocallimastix californiae
  alpha/beta-Hydrolases
AQENITYGTLQRITYYSSNTKTDRPMNILLPPNYDPENKKYPVLYLLHGILSDQNSLIKPKYSTPNIAGYLMHEGLAKEMIIVFPYTYAPKDGIEVEPGFTEEHYAGYNNFINELLDVIMPYMNENYPILTGRDNTAIAGFSMGGRNSLYIGYTKPELFGYIGAFSPAPGVLPEEGKKGLLTEETFRIEDKQYTPYVTLVCTGTEDDVVAEYPSIYHGVLTNNEQPHLWYEVPTGGHDGITVSSGVYNFMQTL

SEQ ID NO: 900 - protein, 175 aa, Neocallimastix californiae
  alpha/beta-Hydrolases
GSFEFNWSGGKRTVRIDIPDNYDNKKAYRLVFGMHCMGGWAGGVQQEGYYGLKPLDTGKTTIFVAPEGNGQQAPWGQADYQLFDQLLEKLKNDLCIDESRVFSTGFSYGSMFSNGLSWNHQKVLRGVAVYETAERNIWLPKHTGEPIAWMGVLGLDDNLCTPEMGRKARDIILEH

SEQ ID NO: 901 - protein, 240 aa, Neocallimastix californiae
  alpha/beta-Hydrolases
TYNKPAWVYLPAGYDPEDKDTKYPLFILMHGFGQTEDNWGLTDQGSGGKIKGMMDRGMAKPKDEEGSVEKFILVVPTGMATRNYRENGNYDYTEPYYRFGGELRNDLIPYMKKNYNIKEGRENMAMAGLSMGGFQTLYIGIGECLDIMSYFGFFSYPFTDDLKEKIETNFPEKDLTIKRLYTICGDNDPTPFSDFYNYVDVLSKWDKVEDGNFSYEVYPGGTHDFPVWYRGFEHFIPQLF

SEQ ID NO: 902 - protein, 245 aa, Neocallimastix californiae
  alpha/beta-Hydrolases
RIVKEYYNGINGNNALNVYLPYGYDSKKQYNIFYLMHGGGENENTIFSNDVKLQPIIDNMIMNGELEPLIIVTPTFNKCEARTFYKELRESVIPFVEGKYSTYAKSTSPSDIRASRMHRAFGGFSMGSASTWAVFVNCLDIVAYYMPLSGDNWEANGGYGKAKNVADAVSRFGIKSNEFFIFCATGSEDIAYPNMNPQMDEMKKMQPFIYTSDFSKGNFYYLVAPGKTHWWGYVKHYIYDALPSF

SEQ ID NO: 903 - protein, 246 aa, Neocallimastix californiae
  alpha/beta-Hydrolases
GRIVKEYYNGINGSNSLNVYLPYGYNSNQQYNIFYLMHGGGENENTIFGSDVYLQYIIDHLIMNGELEPLIIVTPTFNKCEAQTFYKEFRSSVIPFVEGKYSTYAKSTSESDIRASRMHRAYGGFSMGSVSTWAVLINCLDIVGYFMPLSGDCWEANDAYGKAKAVADAINRSGLRSNEYFIFCATGSDDIAYPNVTPQIEQMKKMSQFIYTSDFSKGNFYYLVAPGKTHWWGYVKHYIYDALPSF

SEQ ID NO: 904 - protein, 285 aa, Neocallimastix californiae
  alpha/beta-Hydrolases
KPNPPQSIKATYSGGTLTVVVNDNGGSLTLTSKLSVPSGSGPFPVIIGMNSGTGSLGGNLFSGFIQVPFNHDQCAQYSMNGQKNTNAPFYRMYPNLKQAGDYIAWSWGVSRLIDGLEKVKDQIHADLSHIGVTGCSYAGKMALFAGAFDERIALTIPQESGGGGINAWRVSDTIGNVEKIDNTNYSWFMQALKNNFGSNRAGKLPYDHHEAIAMIAPRAFFTMGNPDYEWLGDKSGYTSAMAAYEVWKAMGVEDRFGFNIVGGHMHCSAAGSQNNDVSKFIDKFL

SEQ ID NO: 905 - protein, 175 aa, Neocallimastix californiae
  alpha/beta-Hydrolases
GSFDFQWSGGKRTVRIDVPDNYNNNNPYRLIFGMHCMGGWAGGVQQEGYYGLKPLDTGKTSIFVAPEGNGNQAPWGQGDYQLFDQLLDKLKNEFCIDESRVFSTGFSYGSMFSNGLSWNHQKVLRGVAVYETAERNIWLPKHTGEPIAWMGVLGLDDGLCTPEMGRHARDIILEH

SEQ ID NO: 906 - protein, 234 aa, Neocallimastix californiae
  alpha/beta-Hydrolases
FTIYRPENLKEAVDAEGRLPVILFGNGGCGRISFSYGNFLTELASYGYVVAAVGPWVGEDNTDYLSLSLDFSEETINGFKADANSLIDVALSWLEKENKERTSIFYKTLNTNKVSAMGQSCGGLQALIISTKNDKRIKTTVALNSGANSPGDLLDSLIVKDELQKLTQPIIYIIGGEEDIAHYNALDDFSLIKKVPVAVACKADAGHMGTYSEPNGGTFGKMTLAWLDYILKND

SEQ ID NO: 907 - protein, 249 aa, Neocallimastix californiae
  alpha/beta-Hydrolases
KQDGVKYPTSEKITYHSNTTGTDRQMNIILPVDYDGTKKYPVVYYLHGIFGNEDSMLDETAIALPVNLYNEGKAKEAIFVLPNTYAPPPGKEVVPDFNQDYFDGYDNFINELIDDIMPYVEQNYSVLTGKENTGLCGFSMGGRNSLYIGYKRPDLFGYVGAFSPAPGVTPGDDFSGHHPGLFQESEFRTDVPPFVTLVSCGTNDSVVGTFPKSYHEILTTNGQEHIWFEVPGADHDDKAIAAGLYNYLS

SEQ ID NO: 908 - protein, 241 aa, Neocallimastix californiae
  alpha/beta-Hydrolases
KEGVEYPKVENITYYSTTTESKRPLIVVLPPNYSKSKKYPVLYLLHGIMTDGSFMLQEGFGTITIPGNLIHEHKAKELIMVLPNQYAPAPGTEVEPALNEKYFAGYNNFINDLINDIMPYMKKNYSIATGKENTAIAGYSFGGRNSLYIALQRPDLFGFVGAFSPAPGLLPADDIFSGHHIGLYQEEKEIHYTGEAPYLTMISCGTNDTVVGTFPESYHNAFAKNNEDHVWYQITGADHID

SEQ ID NO: 909 - protein, 251 aa, Neocallimastix californiae
  alpha/beta-Hydrolases
FRGIMYAQPEKVTYFSNTTHTERQMNIILPPDYSKEKKYPVLYYLHDLLSDENGLLEKSIGTLEIYSNLVNLGKAKDMIIVLPNCIVPADGAKIEPGNSEEYNAAYDNFINELLQDVMPFIESNYSVDSGRENTAIAGFGQGGRSSLYIGYKHPELFGYLGAFSPTQGLLPYNKEQGLMKPEELQVEDAELQPIVTMITVGAKDTEAQESAKLYHETLASNEQPHIWFTVPDALHDSDACSASYYNFISTL

SEQ ID NO: 910 - protein, 258 aa, Neocallimastix californiae
  alpha/beta-Hydrolases
RREGVAYGEAEKITYFSTTAQMDRKMNVILPAGYTEDKKYPVLYYLHGLSGNEDSLLAKERATIEIYGNLVSEGKAKEMIIVLPDCYVPLDGVFDRPQFSPEYLKAYDNFLYELIDDVMPYIESHYSVALGRENTALAGFSQGGRNTIYIGYKHPELFGYLGAFSPAQGIFPCYDIMAGHQPGLMKPEELQADAEVQPIVSMITVGTKDFAVQKNPKLYHEALATNGQPHIWFTVPGALHDDLACTTGYYNFLSTLWG

SEQ ID NO: 911 - protein, 159 aa, Neocallimastix californiae
  alpha/beta-Hydrolases
IVKFPSGFSGNKAVPLLINYHPIGGSASQWEGGSQTARAALSDGAIVAFMDGAQGPMGQAWNVGPCCTDADDVQFTRNFIKEITSKACVDPKRIYAAGFSMGGGMSNYAGCFLSDVIAASAPSAFDLAKEIVDAGKCKPSRPFPILNFRGTQDPIVMYN

SEQ ID NO: 912 - protein, 243 aa, Neocallimastix californiae
  alpha/beta-Hydrolases
ENDKYNKPAWVYLPAGYDPEDKNTKYPLVILMHGFGQNEDNWGLTDQGTGGKIKGMMDRGMAKAKDEEGSVEKFVLIVPTGMASKDFRDNNNYGNTEPWYKFGNEIRNDIIPYMRSHYNIKEGRENVAMAGLSMGGMQTLNLGIGECLDLISYFGAFSFPFGADIFEKTETNFPDKNLTIKGLYTICGDADAGAFAGYGPAVEAFEKWDRIDEGKFKSEIYPGGTHDFPVWYRGFEHLIPLLF

SEQ ID NO: 913 - protein, 284 aa, Neocallimastix californiae
  alpha/beta-Hydrolases
KPAPPKSIKATYSGGTLTVVVNDNGGSLTLTSKISVPNGNGPFPVIIGMNSNTGSLSTNQFSGFIQVPFMHDQCAQYSMNGQKNTNSPFYKLYPNLKQAGDYIAWSWGVSRLIDGLEQVKSQIHADMEHIGVTGCSYAGKMALFAGAFDERIALTIPQESGGGGINSWRVSDTIGNVEKIANTNYSWFMQALKNNFNGKASKLPYDHHELVAMIAPRAFFTLGNPDYEWLGDKSGYTSVMAALEVWKAMGVEDRFGFNFVGGHTHCSAAGSQNNDVNKFIDRFL

SEQ ID NO: 914 - protein, 235 aa, Neocallimastix californiae
  alpha/beta-Hydrolases
NGGNTLNVYLPYGYDKNKQYNIFYLMHGGGENENTIFSNDVNLHNILDNMIMKGELEPLIVVTPNFNKCDARTFYKELRESVIPFVEGKYSTYAKSTSPADIKASRMHRAFGGFSMGSASTWAVLINCLDIVAYYMPLSGDNWEANGGYAKAKSVADAIDKSGLQKNQYFIFCATGSEDIAYNNMNPQIDEMKKMSQFVYTSDFSKGNFYYLVAQGKTHWWGYVRHYIYDALPSF

SEQ ID NO: 915 - protein, 174 aa, Neocallimastix californiae
  alpha/beta-Hydrolases
SFEFNWSGGRRTVRIDIPDNYDNKNPYRLIFGMHCMGGWAGGVQQEGYYGLKPLDTGKTTIFVAPEGNGNQAPWGQGDYTLFDELLEKLTNDLCIDVSRVFSTGFSYGSMFSNGLSWNHQKVLRGVAVYETAERNIWLPKNTGEPIAWMGVLGLDDGLCTPEMGRNARDIILKN

SEQ ID NO: 916 - protein, 161 aa, Neocallimastix californiae
  alpha/beta-Hydrolases
VIVKFPSGYKGDKPVPLLINYHPIMGSASQWENGSQTAKAALSDGAIVAFMDGAQGNMGQAWNVGPCCTDADDISFTRNFIKEITNKACVDPKRIYAAGFSMGGGMSNYVGCYLADVIAAAAPSAFDLAKEVVDGGKCKPSRPFPILNFRGTQDNIVMYNG

SEQ ID NO: 917 - protein, 231 aa, Neocallimastix californiae
  alpha/beta-Hydrolases
SLNVYLPYGYDKNKQYNIFYLMHGGGENENTIFSRDVNLQPIIDNLIMNGELEPLIIVTPTFNKCEARTFYREFRESVIPFVEGKYSTYAKSTSANDIKASRMHRAFGGFSMGSASTWAVLVNCIDIVGYFMPLSGDNWEADGGYGKAKSVADAINRAGFKKDEFYIFAATGSEDIAYPNMNPQMDEMKKMDPFVYTSDFSKGNFYYLVAPGKTHWWGYVKHYIYDALPSF

SEQ ID NO: 918 - protein, 231 aa, Neocallimastix californiae
  alpha/beta-Hydrolases
SLNVYLPYGYTDSKQYNIFYLMHGGGENENTIFGSDVYLQYILDNLIMNGELEPLIVVTPTFNRCEAGTFYREFRESVVPFVEGKYSTYAKSTSAADLKASRMHRAYGGFSMGSVSTWAVLINCLDYVGYFMPLSGDNWVGNGGYGKAKSVADAIDKFGYRTDEYFIFCATGSDDIAYPNMNPQIDEMKKMKQFIYTSDFSQGNFYYLVAPGKTHWWGYVKHYIYDALPYF

SEQ ID NO: 919 - protein, 255 aa, Neocallimastix californiae
  alpha/beta-Hydrolases
KAEGVTVEKKSYYSNITKGYRKLNVVLPPNYSTEKKYPVLYLLHGIYGDEDSMLNNGMGTLNVPANLAKENKAKEMIIVLPNEVALLPGTDPNITKNFSLEHLKVYDNFINELLNNIMPFIEYEYSVATGRDNTAIAGFSMGGRTALYIGYTRPDLFGYVAGFSPAWGLTPGGMDILPGVFPRDEDFKIQNPSEYTPYVTLISTGTADGVVEDYPASYHEILEKNQQNHIWIEIEGADHDESAVIVGLYNFVATL

SEQ ID NO: 920 - protein, 173 aa, Neocallimastix californiae
  alpha/beta-Hydrolases
GRFILVCVTGVASRNWGPNGAGNDVNGFNAFKGELRDDIIPYMRSKFNIKSGRDNVALAGLSMGGGQTFNIGIAECLDLISNFAGFSGAMFSGADEFKRNVDNKREFNGLKIHNLYMTCGDKDDLVYSSFPGYVRSMKSWSRVENFKDYTYPGGTHDFPVWYKGFNDFIHMIF

SEQ ID NO: 921 - protein, 274 aa, Neocallimastix californiae
  alpha/beta-Hydrolases
LSGNTLTVTVNDNGGSLTLTSKISVPSGNGPFPIIIGMNSNTGSLSAGQFNGFIQVPFNHDQCAKYSMDGRKDTNAPFYRMYPNLRQAGDYIAWSWGVSRLIDGLEQVKNQIHADLEHIGVTGCSYAGKMALFAGAFDERIALTIPQESGGGGINSWRVSDTIGNVEKIDNTNYSWFMQALKNNFGNGKATRLPYDHHEAIAMIAPRAFFTMGNPDYEWLGDKSGYTSAMAAYEVWKAMGVEDRFGFNFIGNHMHCSAASSQTNDVNKFIDRFL

SEQ ID NO: 922 - protein, 174 aa, Anaeromyces robustus; identical to SEQ ID NO: 915
  alpha/beta-Hydrolases

SEQ ID NO: 923 - protein, 161 aa, Anaeromyces robustus; identical to SEQ ID NO: 916
  alpha/beta-Hydrolases

SEQ ID NO: 924 - protein, 231 aa, Anaeromyces robustus; identical to SEQ ID NO: 917
  alpha/beta-Hydrolases

SEQ ID NO: 925 - protein, 231 aa, Anaeromyces robustus; identical to SEQ ID NO: 918
  alpha/beta-Hydrolases

SEQ ID NO: 926 - protein, 34 aa, Anaeromyces robustus
  alpha/beta-Hydrolases
VKWCTQSGGHQWEHKDPGSWQTWVPQETWDFITK

SEQ ID NO: 927 - protein, 166 aa, Anaeromyces robustus
  alpha/beta-Hydrolases
RLVHIDLPNNYDNNHPYRLVFGMQCMGGSGANVRNEQYYGLKPLDTGKTTIFVAPEGNGQQLPWGQEDYQLFDELLEKLKTDLCIDESRVFSTGFSYGSMFSNGLAWDHQKVLRGVAVYETAAVNIWLPKNTGLPIAWMGVLGFDDGLCTPQMGRQARDVILKNNS

SEQ ID NO: 928 - protein, 148 aa, Anaeromyces robustus
  alpha/beta-Hydrolases
HVYAPSNLAAKSPLLLSLHGMDQDPNYQQSNTHWETLADTEGFVVVYPRGGTGMSTWDIQGDKDTKWVLQIIDQMAKDYDIDRNRVYLSGFSMGGMFTYHAMSKIGDKIAAFAPCSGPNVFGASKAMRPVPIFHVHGTNDDVLNYNQV

SEQ ID NO: 929 - protein, 37 aa, Anaeromyces robustus
  alpha/beta-Hydrolases
LYSWGPCDQGVYIKHLKLVGRGHSPSKADIGDIWNFV

SEQ ID NO: 930 - protein, 242 aa, Anaeromyces robustus
  alpha/beta-Hydrolases
DQSRAQKYNKHGWVYLPAGYDADDKNTQYPLFVLLHGFGQNENTWGLSNKGRGGKIKGFMDRGMASGDVGRFILVCVTGVASRNWGPNGAGNDVNGFNAFKGELRDDIIPYMRSKFNIKSGRDNVALAGLSMGGGQTFNIGIAECLDLISNFAGFSGAMFSGADEFKRNVDNKREFNGLKIHNLYMTCGDKDDLVYSSFPGYVRSMKSWSRVENFKDYTYPGGTHDFPVWYKGFNDFIHMIF

SEQ ID NO: 931 - protein, 159 aa, Anaeromyces robustus
  alpha/beta-Hydrolases
IVKFPNGYKGDKPVPLLINYHPIMGSASQWESGSQTAKAALNDGAIVAFMDGAQGNMGQAWNVGPCCTDADDVSFTRNFIKEITNKACVDPKRIYAAGFSMGGGMSNYAGCYLADVIAAAAPSAFDLAKEVVDGGKCKPSRPFPILNFRGTADNVVSYN

SEQ ID NO: 932 - protein, 274 aa, Anaeromyces robustus; identical to SEQ ID NO: 921
  alpha/beta-Hydrolases

SEQ ID NO: 933 - protein, 274 aa, Anaeromyces robustus; identical to SEQ ID NO: 921
  alpha/beta-Hydrolases

SEQ ID NO: 934 - protein, 159 aa, Anaeromyces robustus
  alpha/beta-Hydrolases
IVKFPNGFSGDKPAPLLINYHPIMGSASQWESGSQTAKAALNDGAIVAFMDGAQGPMGQAWNVGPCCTDADDVSFTRNFIKEITSKACVDPKRIYAAGFSMGGGMSNYAGCFLADVIAAAAPSAFDLAKEIVDGGKCKPARAFPILNFRGTQDNVVAYN

SEQ ID NO: 935 - protein, 235 aa, Anaeromyces robustus
  alpha/beta-Hydrolases
NGRNSLNVYLPYGYDEKKQYNIFYLMHGGSENENTIFNNEVQLNNILDNMIMKGELEPLIVVTPTFNRCECRTFYKEFRESVIPFVEGKYSTYAKSTSAADIKASRMHRGFGGFSMGSASTWAVFINCLDICAYYMPLSGENWEADGAYMKAKTVADAVDKLGLKKNQYFIFCATGSEDIAYPNMNPMMNEMKKMSQFVYTSDFSKGNFYYLVANGKTHWWGYVRHYIYDALPSF

SEQ ID NO: 936 - protein, 33 aa, Anaeromyces robustus
  alpha/beta-Hydrolases
VRWCTQSGGHQWEHKDPGQMQTWVPKETWDFIN

SEQ ID NO: 937 - protein, 169 aa, Anaeromyces robustus
  alpha/beta-Hydrolases
NKNRLVHIDIPDNYNNSKPYRLVFGMQCMGGSGANVRNEQYYGLKPLDTGKTTIFVAPEGNGQQLPWGQEDYQLFDDLLEKLKNDLCIDESRVFSTGFSYGSMFSNGLSWNHQKVLRGVAVYETAERNIWLPQNTGLGIGWMGVLGFDDNLCTPEMGRKARDIILKNNS

SEQ ID NO: 938 - protein, 252 aa, Anaeromyces robustus
  alpha/beta-Hydrolases
RDCPQPGKIIKEYYNGINGANSLNVYLPYGYDKNKQYNIFYLMHGGGENENTIFSVDVHLQPIIDHLIMNGELEPLIIVTPTFNKCEARTFYKEFRESVIPFVEGKYSTYAKSTSPADIRASRMHRAYGGFSMGSASTWAVLINCLDIVGYFMPLSGDNWEANGGYGKAKSVADAINRAGLKKNEFFIFCATGSDDIAYPNMNPQMDEMKKMEPFVYTSDFSKGNFYYLVAPGKTHWWGFVKHYIYDALPSF

SEQ ID NO: 939 - protein, 159 aa, Anaeromyces robustus
  alpha/beta-Hydrolases
IVKFPNGFKGDKPVPLLINYHPIMGSASQWENGSQTARAALNDGAIVAFMDGAQGPMGQAWNVGPCCTDADDVSYTRNFIKEITSKACVDPKRIYAAGFSMGGGMSNYAGCYLADVIAAAAPSAFDLAKEIVDAGKCKPARPFPILNFRGTQDNIVMYN

SEQ ID NO: 940 - protein, 245 aa, Anaeromyces robustus
  alpha/beta-Hydrolases
KQQGVNYPSAKKVTYHSKTTNNDRKMNVILPIGYTESKKYPVLYLLHGIMGNEDSMLSTNMGSITIPTNLLREGKAKEMIIVLPNEYAPEGGKEVPAGINQAYFEGYDNFINDLIGSIMPYMEKNYSVATGRENTAIAGFSMGGRNSLYIGYKRSDLFGYIGAFSPAPGVVPGLFRNENQFRTDQPPIVSLISCGTDDSVVGTNPKNYHNVLTKNNQDHIWFEVPGADHDAKAVTAGYYNFIQTC

SEQ ID NO: 941 - protein, 306 aa, Anaeromyces robustus
  alpha/beta-Hydrolases
ADWECRRNEIKAEIENYELGKKPAPPQNVKATYSGGTLTVVINDNNGSATLTSKLNVPSGNGPFPIIIGMNSGTGSLSASQFSGFIQVPFNHDQCAKYSMNGQKDTNAQFYKMYPNLKQAGDYIAWSWGVSRLIDGLEQVKDQIHADISHIGVTGCSYAGKMALFAGALDERVALTIAQESGGGGINSWRVSDTIGNVEKIDNTNYSWFMQALKNNFGNGKATKLPYDHHELVAMIAPRAFFTLGNPDYEWLGDKSGYTSAMAAYEVWKAMGVEDRFGFNFVGGHTHCSAAGSQVNDVNKFIDRFL

SEQ ID NO: 942 - protein, 162 aa, Anaeromyces robustus
  alpha/beta-Hydrolases
VLVRFPNGYKGDKPVPLLINYHPISGSAAAWEYGSQTARAALNDGAVVAYMDGAVGPGGQAWNVGPCCTDADDVQYTRDFIKEITSKACVDPKRIYAAGFSMGGGMSNYAGCKLADVIAAAAPSAFDLSKEVVQSGQCTPARPFPILNFRGTSDFVVPYSGG

SEQ ID NO: 943 - protein, 125 aa, Anaeromyces robustus
  alpha/beta-Hydrolases
QEGIEYPTPQKITYYSKVTESERKMNVILPVGYDENKKYPVVYFLHGLMSDEDGMLGDESTIAIPTNLIKEGKAKEMIMVLPDIYAPVPGTAVEPNYDPEYYKGYDNFINELTEVIMPYMEEHYP

SEQ ID NO: 944 - protein, 252 aa, Anaeromyces robustus
  alpha/beta-Hydrolases
QEGIEYPTPQKITYYSKVTESERKMNVILPVGYDENKKYPVVYFLHGLMSDEDGMLGDESTIAIPTNLIKEGKAKEMIMVLPDIYAPVPGTAVEPNYDPEYYKGYDNFINELTEVIMPYMEEHYPILTGRENTAICGFSMGARTSLYIGYMKSDLIGYTGAFAPAPGITPGEDSFSGKHPGLITEDEFRAEIPPIVSLIDCGTNDSVVGQFPKSYHEILTRNGQEHIWFEVPYADHDWNAISAGLYNFLQTT

SEQ ID NO: 945 - protein, 254 aa, Anaeromyces robustus
  alpha/beta-Hydrolases
QENITYGELQRITYYSENTKSDRPMNILLPPNYDPDNKKYPVLYLLHGILSDQNSLIKPKYSTPNIAGYLMNEGLAKEMIIVYPYTYAPKDGIEVEPGFSEEHAAGYNNFINELLYNIMPYMEKNYPILTGRDNTAIAGFSMGGRNSFYIGLNKPELFGYIGAFSPAPGVLPEEGKTSLFPSEDDFLVKDKQLTPYVTLVCTGTDDDVVAEYPIHYHNVFTKNNHPHLWYEVPTGGHDGITVSSGVYNFLQTLF

SEQ ID NO: 946 - protein, 171 aa, Anaeromyces robustus
  alpha/beta-Hydrolases
WSGGKRTVRIDLPDNYDNKKPYRLVFGMQCAGGWAGGVQQEGYYGLKPLDTGKTTIFIAPEGNGQQLPWGEADYKLFDELLDKLTNDLCIDISRVFSTGFSYGAMFSNGLSWNHQKVLRGVAVYETAERNIYLPKHTGDGIGWMGVLGFDDNICTPEMGRHARDIMLEHNS

SEQ ID NO: 947 - protein, 31 aa, Anaeromyces robustus
  alpha/beta-Hydrolases
VRWCTQSGGHLWDHKDPGQNQSWVPKATWEF

SEQ ID NO: 948 - protein, 252 aa, Anaeromyces robustus
  alpha/beta-Hydrolases
YKQNNIQYPSPQKITYFSSNTNSERKMNIILPVGYDESKKYPIVYFLHGIFGDEDSMLDESTIAIPTNLLKEGKAKEFIMVLPSEYAPTPGNEVEPGFSQKYFDGYDNFINELVDVIMPYMEQNYPILTGKDNTALCGFSMGGRNSLYIAYKRSDLFGYVGAFSPAPGVTPGDDFSGHHPGLFTEEQFRSDDPPYVTLISCGTNDSVVHEFPKSYHEILTRNNQKHIWFEVPGADHNEDAISAGLYNFVQTI

SEQ ID NO: 949 - protein, 168 aa, Anaeromyces robustus
  alpha/beta-Hydrolases
KEGVEYPSINQLTYYSTTTESERPLIVLLPPNYTETKKYPVLYLLHGIMGTGMFMLQEGFGTVAIPGNLYAKNMAKEMIIVLPDQYAPAPGTEVEPDLNEEYFAGYNNFINDLINDIMPFLEKNYSIATGRENTALCGYSFGGRNSLYIGLKRPDLFGYIGAFSPAPG

SEQ ID NO: 950 - protein, 235 aa, Piromyces finnis
  alpha/beta-Hydrolases
NGGNTLNVYLPYGYDKNKQYNIFYLMHGGGENENTIFSDDVKLQNILDHQIMNGELEPLIVVTPTFNKCEARTFYKEFRESVIPFVEGKYSTYAKSTSASDIKASRMHRAYGGFSMGSASTWAVLVNCLDICAYYMPLSGDNWEANGGYGKAKSIADAVNRFGLKKNEFFIFCATGSEDIAYPNMNPQMDEMKKMDPFVYTSDFSKGNFYYLVAPGKTHWWGYVKHYIYDALPSF

SEQ ID NO: 951 - protein, 249 aa, Piromyces finnis
  alpha/beta-Hydrolases
RPGVQYPTAKKIYYFSKITQSYRPLNVILPVGYTESKQYPVLYLLHGIMCNEDSMLEAEMGSLTIPTNLFNDGRAKEMIIVLPYEYAPEAGKEVEAAFNQAYFDGYDNFINELTDVIMPYVKANYSIKTGRENTAICGFSMGGRNSLYIGFKRSDLFGYVGAFSPAPGVTPGTDSSGYHKGLFTEDSFRAEISPIVALINCGTSDSVVGQFPKSYHEILTRNNQEHIWFEVQGADHNGVAVSAGFYNFI

SEQ ID NO: 952 - protein, 178 aa, Piromyces finnis
  alpha/beta-Hydrolases
PKTGSFEFKWGNNKRTVRIDIPDNYDKSKPYRLVFGMHCMGGWAGGVQQEGYYGLKPLDTGKTTIFVAPEGNGQQLPWGEADYYMFDELLAKLKGDLCIDESRVFSTGFSYGSMFSNGLSWNHQKVLRGVAVYETAERNIWLPKHTGEPIGWMGVLGFDDGLCTPEMGRHARDIILEH

SEQ ID NO: 953 - protein, 177 aa, Piromyces finnis
  alpha/beta-Hydrolases
KTGSFEFSWSGGRRTVRIDIPDNYNNNNPYRLIFGMHCMGGWAGGVQQEGYYGLKPLDTGKTTIFVAPEGNGQQLPWGEADYYMFDELLAKLKGDLCIDESRVFSTGFSYGSMFSNGLSWNHQKVLRGVAVYETAERNIWLPKHTGEPIGWMGVLGFDDGLCTPEMGRHARDIILEH

SEQ ID NO: 954 - protein, 178 aa, Piromyces finnis; identical to SEQ ID NO: 952
  alpha/beta-Hydrolases

SEQ ID NO: 955 - protein, 161 aa, Piromyces finnis
  alpha/beta-Hydrolases
VIVKFPNGYKGDKAVPLLINYHPIMGSASQWEGGSQTAKAALNDGAIVAFMDGAQGPMGQAWNVGPCCTDADDVTYTRNFIKEITQKACVDPKRIYAAGFSMGGGMSNYAGCYLSDVIAAAAPSAFDLAKEIVDSGKCKPSRPFPILNFRGTSDNVVMYNG

SEQ ID NO: 956 - protein, 25 aa, Piromyces finnis
  alpha/beta-Hydrolases
CEMYENCNGGVKVGLCTINGGGHSE

SEQ ID NO: 957 - protein, 161 aa, Piromyces finnis; identical to SEQ ID NO: 955
  alpha/beta-Hydrolases

SEQ ID NO: 958 - protein, 161 aa, Piromyces finnis; identical to SEQ ID NO: 955
  alpha/beta-Hydrolases

SEQ ID NO: 959 - protein, 25 aa, Piromyces finnis
  alpha/beta-Hydrolases
CEMYENCNGGVKVGLCTINGGGHSE

SEQ ID NO: 960 - protein, 25 aa, Piromyces finnis
  alpha/beta-Hydrolases
CEMYENCNGGVKVGLCTINGGGHSE

SEQ ID NO: 961 - protein, 161 aa, Piromyces finnis; identical to SEQ ID NO: 955
  alpha/beta-Hydrolases

SEQ ID NO: 962 - protein, 274 aa, Piromyces finnis
  alpha/beta-Hydrolases
YSGGTLTVTVNDNGGSLTLTSKISVPSGNGPFPIIIGMNSNTGSLSASQFNGFIQVPFNHDQCAQYSMSGQKNTNSPFYKLYPNLKQAGDYIAWSWGISRLIDGLEQVKNQIHADMEHIGVTGCSYAGKMALFGGAFDERIALTIPQESGGGGINSWRVSDTIGNVEKIDNTNYSWFMQALKNNFGSGKSTRLPYDHHELIAMVAPRAFFTMGNPDYEWLGDKSGYTSAMAALEVWKAMGVEDRFGFNFVGNHMHCSAANSQVSDVNKFIDRFL

SEQ ID NO: 963 - protein, 252 aa, Piromyces finnis
  alpha/beta-Hydrolases
GVTKEKVYYYSSFSQSQRPLNVILPPNYSTDKKYPVLYLLHGVAANEDIMVEEYNGALNIPPNLAKQGKAKEMIIVSPRVNIYPPGVDEVEFAFSTEYLSGFDNFINDLIDSIMPFIETHYSVLTGRNNTAIAGFSMGGRTALYIGYSKPELFGYVCGLSPAFGLTPIEGSSVYHSLFPSEEDVKIRNVNKTPYVTLISWGNIDTVVNPYPFIYHKVLTNNNQPHLYMEVIGANHDEIAITHGLYNFVMTLF

SEQ ID NO: 964 - protein, 256 aa, Piromyces finnis
  alpha/beta-Hydrolases
EIKKGVNYPTVDSLTYYSTTTETNRTLTVLVPPNYSPKKKYPVLYLLHGIMTDGAWMIQDGFGTIAIPGNLAHQKKAKEMFIVLPDQYAPSPGTEVEPALNQEFFNGYDNFINDLVNDIMPFMKKQYSIKTDRKNTAISGYSFGGRNSLYIGITRSDLFGYVGSFSPAPGLVPGDDIFTGHFDGLYQEKELKFKHQPYLTMLSCGTNDTVVFDFPKQYHEILKTNKQEHIWYEITGHDHMDNESFSSPYHNFLTSI

SEQ ID NO: 965 - protein, 78 aa, Piromyces finnis
  alpha/beta-Hydrolases
EGVTKEKVYYYSSFSQSQRPLNVILPPNYSTDKKYPVLYLLHGVAANEDIMVEEYNGALNIPPNLAKQGKAKEMIIVS

SEQ ID NO: 966 - protein, 251 aa, Neocallimastix californiae
  alpha/beta-Hydrolases
WIVMVPGCEQISDPLNIFIFFPSADEGEIDYESYVENMEESLLFTLNLPGYGVRKDEPLITDWDLLVKNVTKAIIQTAASDKFKQCNTIHFVGNGFGAILAWKTLLQIQAYEDENKEVPPISTLIISRAMAPSVPRPIQLAEQVLSELPLEGIATFLGMTESKVDFEGEKSYLLPIIQNEYRMIDSVTNESNIKIRSKLLMFSGKQDKIIDENNAALWKKEVSDEYSEFTQHIRMRGNHWFMMKNTAKYLK

SEQ ID NO: 967 - protein, 273 aa, Neocallimastix californiae
  alpha/beta-Hydrolases
IDFDNLNDYGDWIVRLDTNKDTTNSFFLIPAAGSSINMYNSWSKYMNKSALFAISYPGHLARIDETPIDDFKVLVKSIGEEILNNIKNGKISKDKPIYFFGHSLGALVSYETVLYLQNERKKGNPNAPVVTALVVSASPSPVFPRPITIKHDENGNPVHFTDLAPEELPAFLTNLGGANKDSMSNNKQFQKLIPSIVADFKLTDEYRRFTDKDHQLECALYDIGGISDPIISVASRSRWDLENAEGYPIVRIEFEGDHWFIQENVEVVLERLK

SEQ ID NO: 968 - protein, 229 aa, Neocallimastix californiae
  alpha/beta-Hydrolases
VFIFFPSAEEGEIDYSSYVEEMEDSLLFTINLPGYGERKGEAVITDWDLLVKNVTKVILQTAADSEKFKQCNTIHFVGNGFGALLAWKTLLQIQIYEDEDKDVPIISTLIISRVVAPTAERPIQLAGEVISKLPPEGIRLFLEMIGSKVDFEGEKAYLLPIIHNEYAMMDSVTNENDMKIRSKLLVLSGKQDKIINENNTSLWKKEVSDEFSEFTQHIKMRGDHWFMMK

SEQ ID NO: 969 - protein, 270 aa, Anaeromyces robustus
  alpha/beta-Hydrolases
NDINNYGDWLIRLDMNKSTNNTFILFPAAGSSINMYSNWNKYLTNSTLLAVSLPGHLIRLEEKPIDNMEDLVDNIYKEIIKNVKNGNIPKDQPLYLFGHSLGALVGYEVAMTLQNERKKGNPDIPNITALISSGSPAPIFPRPVVIRYENDKPIHFTDLVPEQYPEELSRLGGANSESLQSKQFQKLIPSIAADFILTDNYKRFSEKDHQLEVPIYDIGANSDYVAPKDSRTNWDIEIANGYPLKRMNFEGGHWFIQDNLEVVMDYLKKE

SEQ ID NO: 970 - protein, 239 aa, Anaeromyces robustus
  alpha/beta-Hydrolases
EDPLNVFIFFPSADEGEIDYSEYVEKMEDSLLFTVNLPGYGVRKDEPFINDWDLLIKNITKAIIQTDISGKFKECKTIHFVGNSFGGIVAWKTLLQIQAYEDEDKEVPIISTLIISRAIAPTAKRPIELGGEVLSNLPNEGIATFLKGIESKVDFSDDKAYLLPIIHNEYLMNDAVTNESNMKIRSKLLMFSGKQDKIIDDNNTSLWKKEVSDEFSEFTQHIKMRGNHWFVMKDTSKYL

SEQ ID NO: 971 - protein, 206 aa, Piromyces finnis
  alpha/beta-Hydrolases
DSLLFTVNLPGYGVRKDEPLVTDWDLLVKNVTKAIIKSDESEKFKDCNAIHFIGNGFGALLAWKTLLQIQIYEDEDKDVPIISTLIISRALAPSVKRPIEFNGEVMAKYSPEQIASYLEKTECQVEFTGDNEYLLPVIKNEYAMIDSITNENDMKIRSKLLMFSGKQDKIIDDNNTSLWKKEVSDEFSEFTQHIKMRGNHWFMIKD

SEQ ID NO: 972 - protein, 268 aa, Piromyces finnis
  alpha/beta-Hydrolases
MKDYGEWLIRLDTNNNITNSFFLFPAAGSSISMYGNWNSYMKNSALFGVSYPGHLVRLDETPIDDLKTLVSAIAKEIMENIKNGNIPKDQPLYCFGHSLGALVSYEVVMLLQNERKNGNPNAPVFAGLIVSASPAPIYPRPIPLRKVNGKPIHFTDLSPEQFPEELAILGGANKESLQSKQFQKLIPSIAADFKITDNYKRITDKDHQLECPLYDIGGVSDPMVNPDSRKNWELEVTEETPLVRITFEGGHWFIQENMESVLERLKKE

SEQ ID NO: 973 - protein, 251 aa, Neocallimastix californiae
  Aminotran_1_2
NIANVALFTTLVTRSDYIFYDSSSSKHVLDAISFSKAKTLSYSHVNAIENIENQVKLVHEKFPKSKKVIVSSSIFMNEGDICQLKDIHRIAQNYQCIVVIDDTFGCGFFDGSSNNILEFFKFKGQIDFITGSFSGIMESNGGFIVYGENQKSFMNSLKINYERDAILPNTAGALLASYQCLETPLNTSSSGKINRRLQLFKNILHWKNGLKRIGLDIPNHSKSTVIPIFMPTNESGIAVQKALQTQGLYVS

SEQ ID NO: 974 - protein, 343 aa, Neocallimastix californiae
  Aminotran_1_2
RKINFCSTSYLGLNQDPRMKQAAYEAIEQYGLSPLGSAPFGGLTNLHEKLGYRLGKIYGLPYGITTSGATLANMTIIPLIVGAKDFVFSDELNHTTIIDGIDLSKAKMIKYKHNDMEDLEKNVKLIHEKFPNSVKLIIFDGVFSMEGDVCDLPNIVRIAKKYNCKTMIDECHALGIIGPHGYGTLDYFNMPGSVDFVTGTLVKSLCSHGGYICCRRDYQNKLENSSGIIFSTNNTPAYAATSLKALDLIEEEGPNSVRARLQRNVKHWKEGVRNLGFEIIEGVSCVCPIMIYDEINGLKFQKRLYEEGLNFSAVAFPAVPKNMARLRTTVLGSLTDEDIDEAL

SEQ ID NO: 975 - protein, 263 aa, Neocallimastix californiae
  Aminotran_1_2
GNSFIIPLIVGKNDAIFIDECAKTSINDSAELSNSKIYYYKHNNASGLEACLLKASQELPNSKKLIIIEGVYNITGEISNLVEFINVSKKFGGIVLVDESHALGVLGKEGKGSLEYANIHEGVDVITGSLEYSLCSNGSYILLNNELSKQFNDLIFINDTITPLSAAISSTTLDILRQDSKTVDQLKNNVSWWRSHCQQNGIELIDSNSAISAIRIDDKGILLNLQRRLYDEGLNVMVSTRPYGLLKFILSASLTEDLLEEAM

SEQ ID NO: 976 - protein, 316 aa, Neocallimastix californiae
  Aminotran_1_2
KFINFNSTSYLSLNKELKVKLVAERVIKEYGIGSYGIFTPYHVELYQHLKEIYGEDYDHIQTYQGDIRDVFFSKLFDSNDFIFYDEQLNSSFRQVLRALHFKKNQLVEFNHNDAFDLSEKLEAIDLISPDAHKYIITEGVFELQGDLCHLQDIFNISKKYDCYVILDESNALGVIGKEGLGSYNYHQCQEKADIVFCSMDKVLCASGQFYVFNQRISTLLARRLTDLFNETIYPPVSTLAAAVAKTVLDIIVEDSVDFKNVGEDTTGVHAQLMDKIKYWKKKCQSIGLKFIESPSPMTCMILDEIDTESLAQLLFK

SEQ ID NO: 977 - protein, 256 aa, Anaeromyces robustus
  Aminotran_1_2
TVFSGANICNVALFTTLATKNDYIFYDSSSSKHVLDAISFSKAKILSYSHVNAIENLEKQVKIVHEKFPNSKKIIVSSSVFINEGDICQLNDINKIAQSYQCIVVIDDTFGCGYFDGSANNILEFYKLKGQIDFICGSFSGIMESNGGFIVYGENQKSFMDLISKNYERDAILPNIASAILASYECLEVPLNSSIGKINRRLQLFKNMLQWKNGLKKIGLDIPSHSKSATLPIFMPSDDIGMAVQKALQEEGLYVS

SEQ ID NO: 978 - protein, 240 aa, Anaeromyces robustus
  Aminotran_1_2
TSIKDGAELSNANVYYYKHNDISSLEASLVKANQELPNGKKLITVEGVYEITGEVVNLSEFITVAKKYGGLVLLDESHALGVLGAKGKGSMENANIHDGVDIITGSLEYSLCSNGSYFLLNQNLSQQFSDLIFINDIITPLSAAISSTTLEILRQDAKMIQQLKDNISWWRSHCQQNGIELIDSNSAIAAIRIDDDSVLLNLQKRLYEEGLNVMVSNNPYGLLKFIFSASLTEDLLEEAM

SEQ ID NO: 979 - protein, 266 aa, Piromyces finnis
  Aminotran_1_2
SGDGNSFVIPLMVGKGDAIFVDVEAKTSIKDGSELSNATVYYYSHNDPISLESCLLKANQEVPNGKKLVVIEGVYKISGDVAKLNEFIPIAKKYDATILVDESHALGVLGARGRGSLEQFNVREGVDIITGSLEYSLCSNGSYFLLNKQLTQQFSGFISINDTITPLSAAIASTTLDILRQDTKMIEQLKSNISWWRTNCQQNGIELIDSTSSITAIKIDDENVLLNLQKRLFEEGLNVMVSTSPYGLLKFILSASLTEDLLEKAM

SEQ ID NO: 980 - protein, 225 aa, Piromyces finnis
  Aminotran_1_2
VSSQDFIFIDEQLNTSFKQTIKSLFLEKGHIIEYTHNTPLDLKSQLKAIQLKFPTVNKFIITEGVFENIGDVCYLNDIMDISKEFGCTLVLDESNALGVIGQKGFGSYDYHQCQQKADIIFCSMDKTLCSSGQFYVFNNKSISILLKNNTSLFDESIYYPINALSAAVAKTVLNIIFENTTDFKNITSSIDVHTQLVDNINYWKQKCQSIGLKLIDSPSAITSII

SEQ ID NO: 981 - protein, 330 aa, Piromyces finnis
  Aminotran_1_2
KIDKVKKAAIEAIEKYGLNSDIQCPLKIQLEQKLSKDYGYQYAATFSGANVANISLFTTLVTRMDYIFYDSSSSKNVIDAVLFSKAKTLSYSHANAIENLEKQVKLVHEKFPKSKKVIASSSIFVNEGDICQLKEINRIAQTYQCIVVIDDTFGCGFFDGSSNNILEFYKLKGQVDFITGSFSGIMESNGGFIAYGENQKEFMDRIIKRNEKEVILPNTANALLASYSSLEEPMNLSSGRITRRHQLFKNILQWKNGLKGIGLDVPSHSKSATIPIFMPTDDAGIAFHKALQEQGLYVSYESSERDAIHKYKILTTVQANKTKDEIDSAL

SEQ ID NO: 982 - protein, 344 aa, Piromyces finnis
  Aminotran_1_2
RKINFSSTSYLGLNQDPRMKEAAYKAIEQYGLSPLGSAPFGGLTNLHEKLGYRLGKIYGLPYGITTSGATLANMTIIPLIVGAKDFVFSDELNHTTIIDGIDLSKAKMIKYKHNDMEDLEKNVKLIHEKFPDRVKLIIFDGVFSMEGDVCDLPNIVRIAKQYNCKTMMDECHALGIIGPHGYGTLDYFNMPGSVDFVTGTLVKSLCAHGGYICCRRDYQNKLENSSGIIFSTNNTPAYAATSLKALDLIEEEGPNSVRARLQRNIKHWKDGIRNLGFKIIEGVSCVCPIMIYDEINGLKFQRRLYEEGLNFSAVAFPAVPKNQARLRTTILASLTDDDIDEALS

SEQ ID NO: 983 - protein, 11 aa, Anaeromyces robustus
  AMP_BINDING
VFFTSGTTGKP

SEQ ID NO: 984 - protein, 11 aa, Anaeromyces robustus
  AMP_BINDING
VLFTSGTTGKP

SEQ ID NO: 985 - protein, 448 aa, Neocallimastix californiae
  AMP-binding
PWLTVTYNEFGSLIKACAYVLKKKYDLYPNSRIGIIGTYTPMNQLLIYALWYLRCAVVQIPIKLGNDVKQFWCRLLNLKMIFYDVNFIPFDNKEDIEMMEENDEWIWKWQYPLTENEMNLEAGLEGILAINLYGEEFRNEILEAKNKGLSFERQGLATDIIYIIGTSSTSQAIIKNGHCTEMKFVPITTTSGGECYNNYIYRGMKNKPTFMINIPVSHLLGFYGCVFHTIQYGGPVAYHTQNLRDIGFIPEIILDDMIEVKMDRTILFPFHFNEFKKLFDDHHPHCEKWKKFISSRNPYCFRNGGAPLSNSIDDWFNDTFGIRTCQDYGSSETGAILTSDFNSKPLPGEETYLSKFPHCELYLKPLDDNDPSVGELFVHSPTLTTGYISKAKPGEFYESDMPGMRTDIDADKLFVYFEGKKFLKTNDIVIRSPKSGKYKYVSRSDDVL

SEQ ID NO: 986 - protein, 448 aa, Neocallimastix californiae
  AMP-binding
PWLTVSYREFGALVKACAYVLKKKYDLYPNSRVGIIANFTPLNHLLVYALWYNRCAVVQIPVKLGNDVKQFWTRILNLKMIFYDVNFKPFDDEENIKMMEENDEWIWKWQHPLTENEMNLDSGKDGILSVNLYGESFRNEILKAKNQGKSFERKCYETDIIYIIGTSSSTQAIIKNGQCSKMKFVPMTTMQSGECYNYCVQQGLKYKPTFMINAPASHDLGYKKCVLHNIQMGGAVVYHTQQLRDIGFIPEIILDDMVETNVDHTLLFPFHIAEIKKLFDSHHPHCEKWKKFLCSRSKYFLNTGGAPMSDKIDNWFFETFGFRTTQIYGSSESGPVMISDFSVPALPGEETYLTKYPHIDIYFKPIDNNDPNIGELYVHSPTLTTGYIRKAEKDEFYESNVPGMRTDIEADDLFIYINGEKFYKTNDIWNRSPKSGKYKYISRLDDII

SEQ ID NO: 987 - protein, 449 aa, Neocallimastix californiae
  AMP-binding
PSPWTCVSYKQFFRLVKACAYVLKKRFDLPPQSRVGVVANTLPLNILIIYALWYIRCTPVAVPPKLGNDVKQFWARMLDISMFIYDINVNIFDEEKQNQLNESGEWIWEWEYPLREDEYNLSAGFKGIPMFCMNNSEFLEEIYQCSLEGKTYARPGLKDDVVMVIGTSSSTQAIIKNGHCSKMKFIPVRLIQCGSLFQNILLTRKISLKYSVLASIPSYHMMGFTWIGVHHMNTGGALIFHTQKLHDIGFVPEVLLDDIVETKPGVIPLFPFNYAEIKRLFDEHHPRCEVWEKAIQACPKNCFRTGGAPIGYDLLHWFNQTFKILINNEYGSSETGIMMYKQFDKDLVPGEEGYLTRVPWQYFHFKLIDENNPNEGELFIYNPFAITGYIGRAKKGEFYESAVPGMRCDYEHDNLYETIDGIEYYRTNDIWTRSTISGDYKYVSRVDDI

SEQ ID NO: 988 - protein, 443 aa, Neocallimastix californiae
  AMP-binding
YPWLSVSFSEFEALAKAMAYVINKRYHLEPQSRVAIIANSLPKNQLLTIALWYLRVITVEITPKIGNDVKQCWMRMLDMSMGFYDCVFKPFYQDHQEEEEWTWPWIYPITPDENLVSGKEGIRMVNMDGEAFMQEVLDAKEQGLFYERVGDNDDLITIGGTSSSAQAIIKNGQSSEMKFVGLHHRKAGHTFNSYLYKNLPLETNFLLVSPFHHLLGICQGLLHPIYNGGPLVYRTQSLDDIGVIAEMLLDDIMEKGVNETLIFSFQYAEWKKLKESGHPKWPIWEKAIRSKPIGCFQTGGAPPIPEVTKWLARELQLFPAEQYGSSESGVMMYCTGEPPLRGEEGYLKRIPWVDVYLNPLSEDDPNVGEAFIYSEQNFTGYIRRVEKGETAKNSPAPGLHVDIKADEVFVEIDGKKFYKTNDIFRRSPITGNYKYVSRMDDVI

SEQ ID NO: 989 - protein, 449 aa, Neocallimastix californiae
  AMP-binding
ENWKTIPFYQLFDLVKATAYVLKKRYDFAPGTRVGIIANTLPFTQLMIYALWNLRCVVVTFPPRLGNDVKQYWVKHCDIKMIFYDVNFRLYDDYEKNEKLNKQGQWIWKWIHPLTEEDEGLCAGKEGVKMCFIYSDELCKEIYQAKAEGKAYQRKGDPDDVLLVMGTSSSSQAIIKNGQCTKMKFVPWQFKQCVDKYKQFLTPQNRLYTDLFVNIPFHQSFGAICALSYCVTGASGLIFKTQQLSDIGFVPEMILDDMAETKAQSVCHFPFQYAEYKKLFDENHPRKKIWADYFREDHEHKVFKTGGAPLNPVVAKWYKDTFDILIMNGLGSTEGGHVLHDIMEGEILPGEEGYYMRVPWVDFYFKPLNDDDPTIGELYTHSSANVTGYFGRAKPGEFYDSPVPGMRCDVGKEDLFVDIDGVPYFKTNDVLKRSPKSGYYKYVTRIDSI

SEQ ID NO: 990 - protein, 443 aa, Neocallimastix californiae
  AMP-binding
PYLSVTYSEFSNLAKSYAYVLKHKYNIPSHSRIGIIGEASPIHHLLLTYTVWYLRGTIVDISTGVGEEVVQAWMTTTDVILTLYDSGLPPFPSIQSININEELEWTWTWTSKIGNEDEINKTKSMTMVNIENDILNTEVLSAYKSGNFFEEELSPDDYVSIIGTSSSTQAVVKDGVYTKMKFVAAKSPVLLNTEYFRKIATYKNKPTALFNLGYGSAIGQRHSFMYAIMCGGPIVFGTKNKENIGLIPEVVLDDIDTIKPDICFIFPYMFSIWKNFADDNHPNWPRWKSALESRPKWCFSTGGAPVDPEILHWLRKDLNIQLNNIYGTSEAGLVFTRNEYTVDVEGEEGYVSELPGVEYYLDPIDGNENEGELYVHSPLVFSGYVDKAKEGDPNSCYGIVVNKWREENFRTFNGKEYYKTNDIWRRCPKTGNYCYVSRVDDTL

SEQ ID NO: 991 - protein, 443 aa, Neocallimastix californiae
  AMP-binding
PYLSVTYSEFANLAKSYAYVIKQKYNVPSHSRIGIIGEANPIHHLLLTYAVWYLRGTIVDISTGVGEEVVQAWMTTTDVTLTFYDSGLPSFPSLQSINPMDKSDWVWSWSSKIGNENDKNEIKTMTMVNLESDILNAEVLSAYKSENFFEEALSPDDYVSIIGTSSSTQAIVKDGVYTTMKFVAAKSPVILNLEYFRKIATYKNKPRVLFNLGFGSAIGQRHSFMYAIMCGGPIIFGTKNKKNIGLIPEVVLDDIDTVKPDICFIFPYMFSIWKSFKDNKHPDWPRWRNALRSRPKWCFSTGGAPVDPEILRWLRKDLYIQLNNIYGTSEAGLVFTRNEYTVDVEGEESYVSALPGVEYYLDPVNENENEGELYVHSPLVFSGYVDKAKEGDPNSYYGIVVNKWHDENFKTINGKEYYKTNDLWKRCPKTGNYCYISRVDDTL

SEQ ID NO: 992 - protein, 245 aa, Anaeromyces robustus
  AMP-binding
ENLHPKVMVVAPLYHSLGSAWSIAQIMNTGSPLIFRTQKKYDIGFVAENILDDIIETRPDVIPLFPINFVEFKRLFDENHPKCEIWAKGISSLSRRCFLSAGAPPNYEVMCWFENKFKIPVNNVCGATEAGLFLYKDIDKPQVPGETNYVSRCPWIHFHMEHMSDDPNEGELYIYNPFGIYGYATKAKKGEFYESTLPKIRIDLEHDDLYKTINGLEYYKTNDIWRRSTVSGDYVYVARADDVIN

SEQ ID NO: 993 - protein, 447 aa, Anaeromyces robustus
  AMP-binding
DPWLTVSFKEFHSLIKALAYVLKKRYDFRVGDRVGITANTLPMTQLYLYALFFLRCVVVLIPPKLGNDVKQYWVRHNDIRMIFYDFSLRISDNDEENQKLNDQGEWTWPWTYPLTEEDAGLSAGEEGIPMCFMYNKDLCNEIYQTKLDGKEYYRKGDRNDVLMILGTSSTSQAIIKNGQCSKMKFVTYQVTRVGTIYQKVLMPNVKHYTNFYLNCPFHHGMGANNAVGFSIVNGGPLVYHTQKLYDVGFIPEIMLDDMTEVNAVNTLQFPFHYEGYKKLFDENHPKCPIWAKYLSKHDKHRIFKFGGALLNPVVKEWYKEKFGIHIVNDFGSSEGGNTLVEDIENVLPGEEGYFKRIPWVDFCLKPLNENEPNIGELYTHSNIMTLGYVGRAKPGEFYDSPIPGMTCDIDADTLFTYIDGVKYYKTNDVFMRSPVSGKYKFVTRMDG

SEQ ID NO: 994 - protein, 450 aa, Anaeromyces robustus
  AMP-binding
EPWVTVSFKEFHALIKAMAYVIKRRFDFAPGTRVGVIANSLPITHLLVYTLWTLRCIVVFIPPKIGNDVKQYWVRHIDIKMIFYDINFRPFDDDNINKELNEQCQWIWKWTYPLTEEDEGISAGKEGINMFYFYDEDFRNEIYNIKLEGKGYYRKGCSEDVLTVVGTSSSSQAIIKNGQCSKMKFVPWQMVHLGNFSQKSLTIQYEYFSPFFLDIPYHHSMGITCALSYNINCGGPIVYHTQQLYEVGFIPEMVLTDIVETKSKVIQLFPFHFVAFKKLFDDKHPKCEYWSKYLGNGDKSKLFRSGGAPLNPMVKKWFKDTFDIQIITGCGSSEGGYILHEIVDDEVLPGEESYIWRRVPWVDFLILPLNENEPNIGELYTRNEANVPGYIGRPKPGEFYDSPVPGMRIDINADELYVEIDGEKYFKTNDVVRRSPLSGKYKYVSRIDSI

SEQ ID NO: 995 - protein, 409 aa, Anaeromyces robustus
  AMP-binding
FSKVAKEIPNKCAIVCNNNEITFKKLDEMSNSLAHYLRKENIGRGDIVPIISERSHYFVIATLAIMKSGAAFLPIDPDFPKERIEYMINEVNAKFILKYITNIETERKIKFDNVIEYELQKHNYKDNVFEITNINNSDDLCYVLFTSGTTGKPKGTMMTHNNLINYSLYSQTYNGKEIYTNDFNNALSAAKFTFDMSLCEILYPLIKGKCVFICDDNEYNNPQLIGEKILKYNIDYIFSTPSRIENYMKNKTYMKALKNLKCILIGGEGCNIKTVENIIKNTNANIYNLYGPTETTIMCTVSELSNLYKQNKLNVITIGKPLCNCKLYILDEYLKPVPIGVEGEIYIGGYGVGKGYLNREQLTREKFVDCPFNIKNGLPNQMYSTGDLGKWTEKGEIICSGRADFQVKI

SEQ ID NO: 996 - protein, 280 aa, Anaeromyces robustus
  AMP-binding
NNSDDLCYVFFTSGTTGKPKGTMMTHNNMTNFCLYSQHFNGNENIYDYGFENALAFSKFTFDMSLIEIYYPLYKRCRVVLCNDEEFNNSEMLSDLIIKYNVNYICSVQSRIKNYIKDEGFKKALKNVKWIGLGGEKLNSDIIQDIKNCSKATLINYYGPTETTVCCTLKKFENNELNNFENNNTSITIGKPLCNCKIYILDKYLKPVPIGVEGEIFIGGNCVGKGYLNREDLTKEKFVNCPYYNSINGSSNKMYRTGDLGKWTKEGEIICLGRADFQVKI

SEQ ID NO: 997 - protein, 41 aa, Anaeromyces robustus; identical to SEQ ID NO: 600
  AMP-binding

SEQ ID NO: 998 - protein, 147 aa, Piromyces finnis
  AMP-binding
FKTGGAPMSDEIDNWLFETFGIRSFQDYGSSEAGSIMNSDFSKPALPGEETYLSKRPWADIYLKPIDDDPNIGELHVRSPTNTTGYIRKAEIGEFYESSMPSMRTDIGAESLFTYINGEKFLKINDIWRRSPKSGKYKYISRIDDVI

SEQ ID NO: 999 - protein, 442 aa, Piromyces finnis
  AMP-binding
PWLTVSFNEFEKLAKAMAYVINKRYHLEPQSRVAIIANSLPKNHLLSIALWYLRVVTVEITPKIGNDVKQCWMRMLNMSMGFYDCVFKPFYQDHKNEEEWVWPWIYPPTSNENLVAGNEGVLMVDMDSESFIQEVIEARDQGLTFEREGDWDDLLTIGGTSSSAQAIIKNGQCSEMKFVGVHHRKAGSCYEKYLHKHLPEETNFLLVSPFHHLLGICQGMLHPIYDGGPLIYRTQSVDDVGVISEMLLDDIAEIDVTETLIFSFQFAEWKKLKEAGHPKWPIWEKAIRSRPIGCFQTGGAPPIPEVTKWLARELQLFPAESYGSSEGGVMMYTEGLPPLRGEEGYLKRIPYVDIYLKPLNEDDPNIGEAYIHSAQNFTGYVRRIESGETCENSPCPGLRVDIKADECFVEIDGKKFFKTNDIFRRSPITGDYKFVSRVDDII

SEQ ID NO: 1000 - protein, 73 aa, Anaeromyces robustus
  AMP-binding_C
EIENTIKKIKGIKYSIVIDKIKENNDKYLMCYYITDENINSGDIRNYLKNKLPIYMIPSYFKKIDNIPVTSNG

SEQ ID NO: 1001 - protein, 73 aa, Anaeromyces robustus
  AMP-binding_C
EIENTMKEINGIDYAIVIDNNKENGNKYLTGYYISKNNITGKDIRKSLKLKLPSFMIPNYFIRIYNLPITSSG

SEQ ID NO: 1002 - protein, 303 aa, Neocallimastix californiae
  Arabinanase/levansucrase/invertase
ATSNHNPIITQKYSADPGVMVYNGRVYVYATNDGDAGTRYNSENTYGQINTINVMSSADLVNWMDHGSIPAAGGGGAARWASNSWAPCAAWKKINGKDKFFLYFANNASGIGVLTADSPTGPFKDPIGRALISRQTPNSNVEWLFDPAVIVDTDGTGYLYYGGGVPQGQNANPRTIRVAKLGNDMTSIQGTPQMIDAPWVFEDSGINKIGNTYVYSYCTNWAGGPYGNARIAYMTSNNPMSGFKYQGTCFNNPGDFFQTTGNNHHTIIEFKNKYYIFYHAEWLNKQILGGQKGYRTTHVDELP

SEQ ID NO: 1003 - protein, 103 aa, Neocallimastix californiae
  Arabinanase/levansucrase/invertase
FEDSGINKIGNTYVYSYCTNWAGGPYGNARIAYMTSNNPMSGFKYQGTCFNNPGDFFQTTGNNHHTIIEFKNKYYIFYHAEWLNKQILGGQKGYRTTHVDELP

SEQ ID NO: 1004 - protein, 281 aa, Neocallimastix californiae
  Arabinanase/levansucrase/invertase
NNPIIWADVPDPDIIRVDDTYYMVSTTMYFTPGAPIMKSKDLVSWEIVTYTYDILANGDVQTLSRGQHDYSHGSWAASLRYNKGIFYVFFGSYGTNKSYIFKTKDIESGKWERFEINGMYHDASILFDDDGRNYLVYGGGGEIKIKEFNAEMTNFKWGGLDKTLFRTNLSGLAGEGSHVMKINGYYYVFIIAWPSGKGRIEICYRSKDLTGYYENKTVLDSGLGSYGSGVAQGGIVDTPDGKKWFGLLFQDHGAVGRIPVLVPVNWQNGWPMMGVNGKAPL

SEQ ID NO: 1005 - protein, 330 aa, Neocallimastix californiae
  Arabinanase/levansucrase/invertase
VFSTFASAADSSAFNGINLAKSYKDIKNHNPINTIKYSADPGVMVYDGRVYVYGTNDGYAGELGRNPQDNTYGQINTINVMSSDDLVNWIDHGTIPAAGRNGAAKWAGNSWAPCATHKKINGKEKFFLYFANSGNGIGVLTSDSPTGPFVDPIGHALISRSTPNCSNIVWLFDPAVFVDDDGTGYLYFGGGVPDNQSSNPKTVRAVKLGNDMTSLAGNPVTIDAPWVFEDSGINKSGDTYFYSYCTNWNGGPYGNAKIAYMTSKNPLGPFTMQGTVLNNPGDFFGTTGNNHHTIIEFKDQWYIFYHAEWLNKQEFGSQKGYRTSHVDVLP

SEQ ID NO: 1006 - protein, 301 aa, Neocallimastix californiae
  Arabinanase/levansucrase/invertase
SNHNPTITHRYSADPGVMVYNGRVYVYATNDGDAATRYNSENTYAQINTINVMSSADLVNWMDHGSINATGGGGAAKWAKNSWAPAAAWKKINGKDKFFLYFADNASGIGVLTADSPTGPFRDPIGRALISRQTPNSNVEWLFDPAVFVDSDGTGYLYYGGGVPKGREANPNTIRVAKLGGDMTSISGTPANIDAPWVFEDSGINKIGNTYVYSYCTNWNGGPYGNARIAYMTSNNPMGKFTFQGTCFNNPGDFFQTTGNNHHTIIEFKNKYYIFYHAEWLNKQILGGQKGYRTTHVDELP

SEQ ID NO: 1007 - protein, 116 aa, Neocallimastix californiae
  Arabinanase/levansucrase/invertase
VHDPSIVKSGNKYYIFGSHMDAAYTTDLWKFTKLYTGVDENNKMFTNLFSKSNYDAFKFVGKNSDGGYSVWAADVMYNKKMKKWVQYFCTSSTYIKSSLCYGIADKVEGPYTYKSC

SEQ ID NO: 1008 - protein, 200 aa, Neocallimastix californiae
  Arabinanase/levansucrase/invertase
YPNAIDPNAFYDFNGRLWLAYGSWSGGIYILELDESTGLPKHNISNGNNVDKYYGKKLAGGGHQSIEGPYILPYKAAGYYYLFVSYGTLTSNGGYQIRLFRSKNPDGPYTDVAGKEFMSGTNSNFGVKIMGNYGIPGREKAYMAPGHNSVLIDDDGKILLCYHTRFNDGQEYHEPRVHQMFLNKEGWLTAAPYAYTGETI

SEQ ID NO: 1009 - protein, 222 aa, Neocallimastix californiae
  Arabinanase/levansucrase/invertase
VNPIIKDMYTADPAPMVYGDTLYLYTTHDEDVLKNNFYTMENWYVFSTKDMVNWTNHGQILSLDDIEWADERAWAPQTVEKDGKFYFYFPAHKIDGGMAIGVAVADSPIGPFKEIGHPIVYEDDWNDFDPTVFIDDDGKAYLYFGNPELRYVVLNDDMISYDEEIGVVKVPMTEESFGKGSHDTGTSYAEGPYFYKRNGLYYMVYAAFREGSHTESLAYSTS

SEQ ID NO: 1010 - protein, 291 aa, Neocallimastix californiae
  Arabinanase/levansucrase/invertase
VNPIIKDMYTADPAPMVYGDTLYLYTTHDEDVLKNNFYTMENWYVFSTKDMVNWTNHGQILSLDDIEWADERAWAPQTVEKDGKFYFYFPAHKIDGGMAIGVAVADSPIGPFKEIGHPIVYEDDWNDFDPTVFIDDDGKAYLYFGNPELRYVVLNDDMISYDEEIGVVKVPMTEESFGKGGHDTGTSYAEGPYFYKRNGLYYMVYAAFREGSHTESLAYSTSEKPTGPWKYGGVLMTEGTAFTNHPGIADFNGKSYFFYHTDELPGGGDFHRSVCVTEFEYKEDGSIETIP

SEQ ID NO: 1011 - protein, 289 aa, Neocallimastix californiae
  Arabinanase/levansucrase/invertase
VNPIIKDMYTADPAPMVYGDTLYLYTTHDEDVLKNNFYTMENWYVFSTKDMVNWTNHGQILSLDDIEWADERAWAPQTVEKDGKFYFYFPAHKIDGGMAIGVAVADSPIGPFKEIGHPIVYEDDWNDFDPTVFIDDDGKAYLYFGNPELRYVVLNDDMISYDEEIGVVKVPMTAESFGKNGDRTTYGEGPYFYKRNGLYYMVFAAFREGAFTESLGYATSEKPTGPWKYGGVLMTEGTAFTNHPGIADFNGKSYFFYHTDELPGGGDFHRSVCVTEFEYKEDGSIETIP

SEQ ID NO: 1012 - protein, 291 aa, Neocallimastix californiae
  Arabinanase/levansucrase/invertase
INPIIKDMYTADPAPMVYGDTLYLYTSHDETELKNNFYTMENWYVFSTKDMVNWTNHGQILSLDDIEWADERAWAPQTVEKNGKFYFYFPAHKIDGGMAIGVAVADSPIGPFKEIGHPIVYEDDWNDFDPTVFIDDDGKAYLYFGNPELRYVVLNDDMISYDEEIGVVKVPMTEESFGKGSHDTGTSYAEGPYFYKRNGLYYLVYAAFREGSQTESLAYATSEKPTGPWKYGGVLMTEGTAFTNHPGIADFNGKSYFFYHTDELPGGGDFHRSVCVTEFEYKEDGSIETIP

SEQ ID NO: 1013 - protein, 306 aa, Neocallimastix californiae
  Arabinanase/levansucrase/invertase
ANHNPLFTHRYSADPGVMVYNNRVYVYATNDGDVATKFTDDNTYSHINSLNVMSSEDLVNWTDHGSILVAGNNGAAKWAGNSWAPCATYKKINGKDKFFLYFANNANGIGVLTSDSPTGPFKDPIGKALITRQTPNCGDVAWLFDPAVLVDTDGTGYLYFGGGVPDGKDAAPKTIRVVKLGADMVSLAGTPQLIDTPYVFEDSGINKIGNTYYYSYCTNWSAGEPYGQARIVYMTSSNPMGPFTYQGVCLNNPGEDFQTYGNNHHTIIEFKNKYYIFYHTEWLNKQVFGTQKGYRTSFVNEITFSN

SEQ ID NO: 1014 - protein, 280 aa, Neocallimastix californiae
  Arabinanase/levansucrase/invertase
RNPIIWADVPDDDIIRVDDTYYMVSTTMFFSPGAPIMKSKDLFSWEICNYVYDILADGDVQTLKNGKHDYSHGQWAASLRYHEGTFYVFFGSYGTNKSYIFKTKDIEKGTWTRNEIFGMYHDASILFDDDGRKYLVYGGSGEIKIKEFNNEMTDFKRGGADKVLFRTGLSGLAGEGSHIQKIGKYYYIFIIAWPNGKGRIEICYRSRDLLGNYENKIVLDSGLGSYGSGVAQGGIVDTPDGKWYGLLFQDHGSVGRIPVLVPVNWQNDWPIMGVNGKAPL

SEQ ID NO: 1015 - protein, 237 aa, Neocallimastix californiae
  Arabinanase/levansucrase/invertase
TGCLRDPYIFKGEDGFYYLLATDMKSSLGWNSNRNLLSAKSMDLIHWTGITIIEIANKYPLMKGADRAWAPQAIYDREKGSYMIYYAARVPGRDNRTIMYYAYSKDMKRLETDPQVLFAPANGNDAIDSDIIFQNGKYYMYYKNETNKRIYLATASHANGPYSEIKQISEGNIGVEGPNIYKLNNSNKWLLMSDAYNSGYYIVQETTDLVNFRTVNRNNYSFNFTPRHGYVIPINGY

SEQ ID NO: 1016 - protein, 301 aa, Neocallimastix californiae
  Arabinanase/levansucrase/invertase
GNKNPLITHRYSADPGVMVYNGRVYVYATNDGDVANRNVGENKYDQINTINCMSSDDLINWMDHGPIPAAGGNGAAKWAKNSWAPTAAWKKINGKDKFFLYFANNASGIGVLTADSPTGPFKDPIGRALISRQTPNSNVEWLFDPAVFVDTDGTGYLYYGGGVPQGQNANPRTIRVAKLGNDMTSIQGTPQMIDAPWVFEDSGINKIGNTYVYSYCTNWAGGPYGNARIAYMTSNNPMSGFKYQGTCFNNPGDFFQTTGNNHHTIIEFKNKYYIFYHAEWLNKQVFGSQKGYRTTHVDELP

SEQ ID NO: 1017 - protein, 66 aa, Neocallimastix californiae
  Arabinanase/levansucrase/invertase
KGAYLFAFFQGNAPEKEQLSYALSIDGYNFSILNNGRSIWKSNVGTGCIRDPFILKGQDGYYYMLA

SEQ ID NO: 1018 - protein, 230 aa, Neocallimastix californiae
  Arabinanase/levansucrase/invertase
TGCIRDPFILKGQDGYYYMLATDMRSYSGWDSNRNILSAKSKDLIHWNDVTSIEIANKYPLTQGADRAWAPQAIYDHEKNSYMIYFAVRVPNRGNKTIMYYAYSKDMKKLDTAPALLFQPRNGNEAIDSDIIFQNNKYYMYYKDETRKTICLATADHASGPYQEIKQLSDNGIEVEGCNIYNIIGTNKWLMMSDAYVNQYFVLQETTDLVNFRTLNRNTYGFNFTPRHGY

SEQ ID NO: 1019 - protein, 306 aa, Neocallimastix californiae
  Arabinanase/levansucrase/invertase
KNHNPINVLKYSADPGVMVYDGRVYVYATNDGIGENIGNNPRDNDYSHINTINVMSSSDMVNWVDHGTIPAAGNSGAAKWAGNSWAPCAAHKKINGKEKFFLYFANSGNGIGVLTSDSPTGPFVDPIGGPLVSRSTLNCNSIVWLFDPAVMVDDDGTGYLYFGGGVPENAKSNPKTVRAVKLGNDMISLAGTPQTIDAPWVFEDSGINKAGNTYFYSYCTNWDNGPYGNAKIAYMTSSSPLGPFQYQGTVLNNPGDFFGTVGNNHHTIINFKNKWYIFYHAEWLNKQVFGSQKGFRTSHVDELPFS

SEQ ID NO: 1020 - protein, 198 aa, Neocallimastix californiae
  Arabinanase/levansucrase/invertase
YPNAIDPNAFYDFKGKLWLVYGSWSGGIYILELDESTGLPKHNISNGNNTDRYYGKKLAGGNHQSIEGPFILPHKAVGYYYLFVSYGSLTSNGGYQIRMFRSKNPDGPYTDVAGKEFMSGNNSSFGVKVMGNYNIPGREQAYMAPGHNSALLDDDGKVLIFYHTRFNDGQEYHEPRIHQMFLNKEGWLCAAPYAYTGE

SEQ ID NO: 1021 - protein, 116 aa, Neocallimastix californiae
  Arabinanase/levansucrase/invertase
VHDPSVVKYGNKYYIFGSHMDTAYTTDLWKFTKLYTGVNDNNKMFTNLFSKSNYGAFNFVGKNSDGGYSVWAPDIIYNNRMKKWVQYFCTSSTYIKSSICYALADNVEGPYTYKNC

SEQ ID NO: 1022 - protein, 40 aa, Neocallimastix californiae
  Arabinanase/levansucrase/invertase
YSSGVSVHDPSVVKYGNKYYIFGSHMDTAYTTDLWKFTKL

SEQ ID NO: 1023 - protein, 279 aa, Neocallimastix californiae
  Arabinanase/levansucrase/invertase
SPLVSNMYTADPAPMVYGDTLYLFTSHDENNIQNNFYTMLNWHLFSTKDMINWTSHGQVFSLDDISWADDRAWAPQAIARNDKFYLYVPVHKRNGGMAIAVGVSDKPTGPYKDIGHPLVDEGDWNDIDPTVFIDDDGQAYLYFGNPELRYVLLNEDMVSYNKSVGVKKIPMTADSFGRGEGSRTTYGEGPFFYKRKDMYYMAYAAFRPNKGSEHLAYSYSNSPTGPWKYGGVLMTEDGGTYTNHPGIARFKGRSYLFYHTGQLPGGGAYHRSVCFTEFK

SEQ ID NO: 1024 - protein, 306 aa, Anaeromyces robustus; identical to SEQ ID NO: 1019
  Arabinanase/levansucrase/invertase

SEQ ID NO: 1025 - protein, 289 aa, Anaeromyces robustus
  Arabinanase/levansucrase/invertase
SPLVSNMYTADPAPMVYGDTLYLFTSHDENNIQNNFYTMLNWHLFSTKDMINWTSHGQVFSLDDISWADDRAWAPQAIARNDKFYLYVPVHKRNGGMAIAVGVSDKPTGPYKDIGHPLVDEGDWNDIDPTVFIDDDGQAYLYFGNPELRYVLLNEDMVSYNKSVGVKKIPMTADSFGRGEGSRTTYGEGPFFYKRKDMYYMAYAAFRPNKGSEHLAYSYSNSPTGPWKYGGVLMTEDGGTYTNHPGIARFKGRSYLFYHTGQLPGGGAYHRSVCFTEFKYNKDGSIDTI

SEQ ID NO: 1026 - protein, 279 aa, Anaeromyces robustus
  Arabinanase/levansucrase/invertase
NPIIWADVPDPDIIRVDDTYYMVSTTMFFNPGAPIMKSKDLVSWKICNYVYDKLADGDVQNLARGQHDYSHGQWATSLRYHKGTFYVFFGSYGTNKSYIFKTKDIENGPWTRTELGGMYHDASMIFDDDGRNYLVYGAGGEIRIKEFNSEMTDFKRGGADKILFRTNLSGLAGEGSHVQKINNYYYIFIIAWPNGKGRIEICYRSKDILGNYESRTVLDSGVGSYGSGVAQGGIVDTPEGKWYGLLFQDHGSVGRIPVLVPVNWQSDWPMMGVNGRAPV

SEQ ID NO: 1027 - protein, 303 aa, Anaeromyces robustus
  Arabinanase/levansucrase/invertase
KNHNPVVSHRYSADPGAMVYDGRVYIYGSNDGNVAERQGKTNDYSQIKTINLLSSSDLVNWMDHGPIPATGQSGIAKFASNSWAPAACHKKINGKEKFFVYFANNASGICVLESDSPTGPFKDPLGKPLITRQTPNSNVEWLFDPACLVDDDGTGYLYFGGGVPNGQAANPRTVRVVKLGADMKSLAGTPQTIDAPWVFEDSGINKVGNTYYYNYCTNFNGGPYGNGRIAYMSSNSPMGPFSYKGTCFNNQGDFLQDGGGNNHHTIIEFKNKFYMVYHAQWLDMKVKGKSNGYRTTHIDELPM

SEQ ID NO: 1028 - protein, 127 aa, Anaeromyces robustus
  Arabinanase/levansucrase/invertase
GVSVHDPSVIKNGNKYYIFGSHMDTAYTTDLWKFTKLYTGVNENNRMFTNLFSKSNYGAFNFVGKNSEGGYSVWAPDVMYNKKMRKWVQYFCTSSTYIKSSICYALADNVEGPYTYQSCFIFSGMDS

SEQ ID NO: 1029 - protein, 187 aa, Anaeromyces robustus
  Arabinanase/levansucrase/invertase
PNAIDPNVFYDFNGRLWLAYGSWSGGIYILELDESTGLPKHNISNGTNIDKYYGKKLAGGGHQSIEGPYILPYKAAGYYYLFVSYGTLTSNGGYQIRLFRSKNPDGPYTDPAGNEFMGGTNSNFGLKLMGNYNIPGRSQAYMAPGHNSAMIDDNGKVLMFYHTRFNDGQEYHEPRVHQLFLNKEGWF

SEQ ID NO: 1030 - protein, 245 aa, Anaeromyces robustus
  Arabinanase/levansucrase/invertase
CLRDPYIFKGEDGLYYLLATDMKSALGWNSNRNLLSAKSKDLINWYDTTSIEIANKYPLMQGADRAWAPQAIYDPEKKSYMIYYAARVPGRDNRTIMYYAYSKDMKKLDTAPALLFAPSNGNDAIDSDIIFQNGKYYMYYKNETNKRIYLATSDHANGPYKEIKQVSEGNIGVEGPNIYKLLNSNKWLLMSDAYYDHYYVMQETTDLQNFKTVNRNSYSFNFTPRHGYVIPITAQQYNALLAAYP

SEQ ID NO: 1031 - protein, 68 aa, Anaeromyces robustus
  Arabinanase/levansucrase/invertase
TEGDAYLFAYFLGNAPEQERLSYAVSIDGYNFKALNNGKEVWKSNIGTECLRDPYIFKGEDGLYYLLA

SEQ ID NO: 1032 - protein, 308 aa, Anaeromyces robustus
  Arabinanase/levansucrase/invertase
KNHNPLITHRYSADPGVMIYNDRVYVYSTNDGDVDLNNKNVNGNTYDHIKSLNVMSSSDLVNWQDHGSINVAGGAAKWAQYSWAPCATYKKINGKDKFFLYFANNANGVGVLTSDSPTGPFTDPIGKALISRDTPNCGDVTWLFDPAVLVDDDGTGYLYFGGGVPNGMDANPKTIRVVKLGSDMISLAGQPQLIDAPYVFEDSGINKIGNTYFYSYCTNWTGGQYGGANIAFMTSNSPMGPFKAGSSCFKNPGEFLGNYGNNHHTIIQFKNKWYIFYHTEWLNKIVYGDQKGYRTGHLDEFPVTNNNF

SEQ ID NO: 1033 - protein, 254 aa, Anaeromyces robustus
  Arabinanase/levansucrase/invertase
TGCLRDPFILKGEDGTYFLLATDMRSYSGWDSNRNILTARSTDLIHWTNVSLIEVCNKYPIFQRGDRAWAPQAIYDPEKQAYMIYFAVRVPSNGNKTIMYYAHSKDMTRFDTTPQLLFAPKNGNEAIDADIIYQGGRYYMYYKDETRKTINLALAEHASGPYQEIKQLSDNGIEVEGCNIYPVVGTNKWLMMSDAYVNGYFVLQETTDLVNFRTLNRNTYGFNFTPRHGYVIPVSPSQYNALLKAYPSRGMYTI

SEQ ID NO: 1034 - protein, 305 aa, Anaeromyces robustus
  Arabinanase/levansucrase/invertase
PVSNKNPLITHRYSADPGVMVYNDRVYVYATNDGDVANRNVGDNTYEQINTINCMSSDDLVNWTDHGPIAAAGQGGAAKWAKNSWAPTAAHKTINGKEKFFLYFANSGAGIGVLVSDSPTGPFTDPIGKALITPQTPNCASVTWLFDPAVLVDTDGTGYLYFGGGVPQGQDANPKTIRVVKLGPDMTSLAGNPETIDAPWVFEDSGINKIGNTYVYSYCTNWANGPHGNARIGYMTSNSPMGPFTFQGTCFNNPGDFFQTTGNNHHTIIEFKGKYYIFYHTEWLNKQVLGSQKGYRTTHVNEMPV

SEQ ID NO: 1035 - protein, 304 aa, Anaeromyces robustus
  Arabinanase/levansucrase/invertase
VSNKNPIITHRYSADPGVMVYNGRVYVYATNDGDVANRNVGDNTYEQINTINCMSSDDLVNWTDHGPIKAAGQGGAAKWAKNSWAPHAAHKTINGKEKFFLYFANSGAGIGVLVSDSPTGPFTDPIGKALVTPQTPNCSSVTWLFDPAVLVDSDGTGYLYFGGGVPQGQNSNPKTIRVVKLGPDMTSLAGNPQTIDAPWVFEDSGINKVGNTYVYSYCTNWANGPYGNARIAYMTSNSPMGPFQYQGTCFNNPGDFFQTTGNNHHTIIEFKDKYYIFYHTEWLNKQVLGSQKGYRTTHVNEMPM

SEQ ID NO: 1036 - protein, 285 aa, Anaeromyces robustus
  Arabinanase/levansucrase/invertase
SMYTADPAPLIVDDTLYIYTTHDEDVLINNFYTMRDWYVFSTKDMVNWTNHGPILSLDDITWADDRAWAPQTIERNGKYYFYYPAHKIDGGMAVGVAIGDSPVGPFKDIGEPLVYQDDWIDFDPTVFIDDDGQAYLYFGNPQLRYVLLNEDMVSYNEEVGIVDVELTVEGFGEGNNNPTSYDEGPFFYKRNGIYYMLFSGFRKGYESEYIGYATSTSPTGPWKYGGILMEEHEDKTFTNHSSIVEFNGHTYFFFHTGDLPDGGDFHRSVAYIEFEYNEDGSINPI

SEQ ID NO: 1037 - protein, 285 aa, Anaeromyces robustus; identical to SEQ ID NO: 1036
  Arabinanase/levansucrase/invertase

SEQ ID NO: 1038 - protein, 173 aa, Piromyces finnis
  Arabinanase/levansucrase/invertase
VSFDVPNCGDIVWLFDPAVFVDDDGTGYLYFGGGVPEGQASDPRTTRAAKLGDDMISIDGIPQTIEAPWVFEDSGINKVGDSYVYSYCVNWDNGPYGNAKIAYMTSENPLGPFTFQGTLLNNPGDFFGTTGNNHHTIIEFKGKWYIFYHAEWLNVQVYGSQKGYRTTHVDELP

SEQ ID NO: 1039 - protein, 78 aa, Piromyces finnis
  Arabinanase/levansucrase/invertase
ILNTGSSSNTNSGGAYLFTYFLGNAPEQERLSYAVSTDGYHFKALNNGKEVWKSSVGTGCLRDPYIFKGKDGYYYLLA

SEQ ID NO: 1040 - protein, 252 aa, Piromyces finnis
  Arabinanase/levansucrase/invertase
TGCLRDPYIFKGKDGYYYLLATDMKSALGWNSNRNILSAKSSDLIHWTNESSIEIANKYPLMQGADRAWAPQAIYDPEKDSYMIYFAARVPGRDNRTIMYYAYSKNMQKLDTAPQLLFAPSNGNDAIDSDIIFQNNKYYMYYKNETNKRIYLATASHASGPYSEIKQVSEGNIGVEGPNIYQLQGTNKWLMMSDAYGNGYYVMQETTDLVNFKTVNRNSYSFNFTPRHGYVIPINSSQYNALLSAYPSNGIA

SEQ ID NO: 1041 - protein, 238 aa, Piromyces finnis
  Arabinanase/levansucrase/invertase
TGCIRDPFILKGQDDYYYLLATDMKSYLGWDSNRNILTAKSKDLIHWNDVTSIEIANKYPLTQAADRAWAPQAIYDPEKKSYMIYFAVRTPGNGNKTIMYYAYSKDMKKLDTAPALLFAPRNGNEAIDSDIIFQNNKYYMYYKDETKKTICLATADHASGPYQEIKQLSDRGIEVEGCNIYPVVGTNKWLMMSDAYVNGYFVLQETTDLVNFRTLDRKTYGFNFTPRHGYVIPISNNQ

SEQ ID NO: 1042 - protein, 75 aa, Piromyces finnis
  Arabinanase/levansucrase/invertase
NSSNNNSNVNGAFLFAFFQGNAPEKEQLSYALSTDGYHFNILNYGRSIWKSNVGTGCIRDPFILKGQDDYYYLLA

SEQ ID NO: 1043 - protein, 290 aa, Piromyces finnis
  Arabinanase/levansucrase/invertase
SPLITNMYTADPAPMVYGDTLYLYTTHDENNLKNNFYTMLDWYVFSTKDMVNWTNHGKIFSLDDISWADDRAWAPQAIERNGKFYLYCPVHKTNGGMAIAVGVSDKPTGPFKDIGHPLVDEGDWNDIDPTVFIDDDGQAYLYFGNPELRYVLLNEDMISINKSVGVKKIKMTEEAFGKGSHDTGTTYGEGPYFYKRNGIYYMAYAAFRQGKNIESLGYSTSTSPTGPWKYGGPLMTEEGGAFTVHPGIVDFKGHSYLFYHTGELPGGGDFHRSVGFAEFRYNKDGSIPVV

SEQ ID NO: 1044 - protein, 127 aa, Piromyces finnis
  Arabinanase/levansucrase/invertase
GVSVHDPSVVKNGNKYYIFGSHMDTAFTTDLWKFTKLYTGVNENNKMFSNLFSKSNYGAFNFVGKNSEGGFSVWAPDVMFNKRMNKWVQYFCTSSTYIKSSICYALADNIEGPYTYKDCFIFSGMDS

SEQ ID NO: 1045 - protein, 187 aa, Piromyces finnis
  Arabinanase/levansucrase/invertase
PNAIDPNAFYDFNGKLWLAYGSWSGGIYILELDESTGLPKHNINNGNNIDKYYGKKLAGGNHQSIEGPYILPHKAAGYYYLFVSYGTLTSNGGYQIRLFRSKNPDGPYTDAAGREFMSGTNSNFGVKIMGNYNIPGRSQAYMAPGHNSALIDDNGKILLFYHTRFNDGQEYHEPRIHQMFLNKEGWL

SEQ ID NO: 1046 - protein, 302 aa, Piromyces finnis
  Arabinanase/levansucrase/invertase
KNHNPVNTLKFSADPGVMVYDGRVYVYATDDGHVDQLGNNPETNTYGQINTINVMSSDDLVNWIDHGSIPAAGRNGAAKWANNSWAPTAAHKKINGKEKFFLYFANSGNGVGVLSSDSPTGPFVDPIGGPLVSFDVPNCGDIVWLFDPAVFVDDDGKGYLYFGGGVPTGQDANPKTIRVVQLGDDMTSIVGTPQLIDAPYVFEDSGINKIGNTYIYSYCTNWANGPYGSANIAYMTSSSPMGPFKMQKSCFKNPGEYFGNYGNNHHTMIEFKGKNYIFYHTEWLNKEVFGTQKGYRTSHVDE

SEQ ID NO: 1047 - protein, 303 aa, Piromyces finnis
  Arabinanase/levansucrase/invertase
TNHNPLMTYRYGADPGVFVYDGRVYVFTTNDGDVDLTNKNIAENTYSHIQTLNLISSADLVNWTDHGSISVAGNNGAAKWAQYSWAPCATYKKINGKDKFFLYFANNANGIGVLTSDSPTGPWKDPIGKALITRQTPNCNVEWLFDPAVFVDDDGTGYLYFGGGVPEGQASDPRTTRAAKLGDDMISIDGIPQTIEAPWVFEDSGINKVGDSYVYSYCVNWDNGPYGNAKIAYMTSENPLGPFTFQGTLLNNPGDFFGTTGNNHHTIIEFKGKWYIFYHAEWLNVQVYGSQKGYRTTHVDELP

SEQ ID NO: 1048 - protein, 302 aa, Piromyces finnis
  Arabinanase/levansucrase/invertase
SNKNPLITHRYSADPGVMVYDGRVYVYGTNDGHADELGDNPEDNTYQQINTINVMSSDDLINWVDHGSIPAAGENGAAKWAVNSWAPAAAHKKINGKEKFFLYFANSGNGVGVLSSDSPTGPFVDPIGGPLVSFDVPNCGDIVWLFDPAVFVDDDGKGYLYFGGGVPTGQDANPKTIRVVQLGDDMTSIVGTPQLIDAPYVFEDSGINKIGNTYIYSYCTNWANGPYGSANIAYMTSSSPMGPFKMQKSCFKNPGEYFGNYGNNHHTMIEFKGKNYIFYHTEWLNKEVFGTQKGYRTSHVDE

SEQ ID NO: 1049 - protein, 304 aa, Piromyces finnis
  Arabinanase/levansucrase/invertase
KNHNPVNTLKFSADPGVMVYDGRVYVYATDDGHVDQLGNNPETNTYGQINTINVMSSDDLVNWIDHGSIPAAGRNGAAKWANNSWAPTAAHKKINGKEKFFLYFANSGNGVGVLSSDSPTGPFVDPIGGPLVSFDVPNCGDIVWLFDPAVFVDDDGTGYLYFGGGVPEGQASDPRTTRAAKLGDDMISIDGIPQTIEAPWVFEDSGINKVGDSYVYSYCVNWDNGPYGNAKIAYMTSENPLGPFTFQGTLLNNPGDFFGTTGNNHHTIIEFKGKWYIFYHAEWLNVQVYGSQKGYRTTHVDELP

SEQ ID NO: 1050 - protein, 302 aa, Piromyces finnis; identical to SEQ ID NO: 1046
  Arabinanase/levansucrase/invertase

SEQ ID NO: 1051 - protein, 303 aa, Piromyces finnis; identical to SEQ ID NO: 1047
  Arabinanase/levansucrase/invertase

SEQ ID NO: 1052 - protein, 304 aa, Piromyces finnis
  Arabinanase/levansucrase/invertase
SNKNPLITHRYSADPGVMVYDGRVYVYGTNDGHADELGDNPEDNTYQQINTINVMSSDDLINWVDHGSIPAAGENGAAKWAVNSWAPAAAHKKINGKEKFFLYFANSGNGIGVLSSDSPTGPFTDPLGGPIISRSLPNCNNIVWLFDPAVFVDDDGTGYIYFGGGVPEGQSSNPKTVRAAKLSDDMIRISGTPQTIDAPWVFEDSGIHKYGDTYFYSYCTNWDNGPYGNAKIAYMTSKSPLGPFTYQGTLFNNPGEFFGTTGNNHHTIIEFKGKWYIFYHAEWLNVQVYGSQKGYRTTHVDELP

SEQ ID NO: 1053 - protein, 301 aa, Piromyces finnis
  Arabinanase/levansucrase/invertase
TNHNPLMTYRYGADPGVFVYDGRVYVFTTNDGDVDLTNKNIAENTYSHIQTLNLISSADLVNWTDHGSISVAGNNGAAKWAQYSWAPCATYKKINGKDKFFLYFANNANGIGVLTSDSPTGPWKDPIGKALITRQTPNCNVEWLFDPAVFVDDDGKGYLYFGGGVPTGQDANPKTIRVVQLGDDMTSIVGTPQLIDAPYVFEDSGINKIGNTYIYSYCTNWANGPYGSANIAYMTSSSPMGPFKMQKSCFKNPGEYFGNYGNNHHTMIEFKGKNYIFYHTEWLNKEVFGTQKGYRTSHVDE

SEQ ID NO: 1054 - protein, 305 aa, Piromyces finnis
  Arabinanase/levansucrase/invertase
KNHNPVNTLKFSADPGVMVYDGRVYVYATDDGHVDQLGNNPETNTYGQINTINVMSSDDLVNWIDHGSIPAAGRNGAAKWANNSWAPTAAHKKINGKEKFFLYFANSGNGVGVLSSDSPTGPFVDPIGGPLVSFDVPNCGDIVWLFDPAVFVDDDGKGYLYFGGGVPTGQDANPKTIRVVQLGDDMTSIVGTPQLIDAPYVFEDSGINKIGNTYIYSYCTNWDNGPYGNARIAYMTSNSPMGPFSYKGTCFNNPGDFFQTTGNNHHTIIEFKNKYYIFYHTEWLNKQVFGSQKGYRTTHVNEMPV

SEQ ID NO: 1055 - protein, 304 aa, Piromyces finnis; identical to SEQ ID NO: 1049
  Arabinanase/levansucrase/invertase

SEQ ID NO: 1056 - protein, 304 aa, Piromyces finnis
  Arabinanase/levansucrase/invertase
KNHNPLSTLKYSADPGVMVYDGRVYVYGTNDGHADELGDNPEDNTYQQINTINVMSSDDLINWVDHGSIPAAGENGAAKWAVNSWAPAAAHKKINGKEKFFLYFANSGNGVGVLSSDSPTGPFVDPIGGPLVSFDVPNCGDIVWLFDPAVFVDDDGTGYLYFGGGVPEGQASDPRTTRAAKLGDDMISIDGIPQTIEAPWVFEDSGINKVGDSYVYSYCVNWDNGPYGNAKIAYMTSENPLGPFTFQGTLLNNPGDFFGTTGNNHHTIIEFKGKWYIFYHAEWLNVQVYGSQKGYRTTHVDELP

SEQ ID NO: 1057 - protein, 304 aa, Piromyces finnis; identical to SEQ ID NO: 1052
  Arabinanase/levansucrase/invertase

SEQ ID NO: 1058 - protein, 305 aa, Piromyces finnis; identical to SEQ ID NO: 1054
  Arabinanase/levansucrase/invertase

SEQ ID NO: 1059 - protein, 108 aa, Neocallimastix californiae
  ARF/SAR SUPERFAMILY PROTEIN-RELATED
NNNNNNNNNNNSNNNNNNNNNNNNNNNNNNNNNNNNNNNNNSNQQTYSFGYGLKNDPVPSKGCGKNPSLPKTGSFEFNWSGGKRTVRIDIPDNYDNKKAYRLVFGMHC

SEQ ID NO: 1060 - protein, 870 aa, Neocallimastix californiae
  ARF/SAR SUPERFAMILY PROTEIN-RELATED
DFVDRERFDDTREEWNAFKIKWDNEIRDNFKQISVFSGDNESMLNFGWYSTEDTKPVIRFGTQEDMSDAKEFTGNVEYYKNLLIGSRKYSIYSNQVTVSGLERNNTYYYQRYIDGKWEKSVKFVTRDPDNFNFIFVGDPQIGGSHGKPNFLDMSKELTNDEATRNDAFNWERTMNKAFELKSNNPPSLLLSAGDQADDEKLQDYLDETQFSALLQPAVLKGIPHAMTVGNHEQYNENFRHHFNTPNSFTEIERSDREVIPGFNYFFRFNNVLVVVLDTNEPSTYDYSHTMKNAVTKYPDTTWRIVMFHHDLFGIGRTHSQGTYIVNKLRPILNPLLAKYKVDLVINGHDHYYSTSHFVSFDGVNYDISEISENKTFNNPKGILYITANCATGSKLNPRNDAKVDYIYHSNQTYTATFGIIDFEKDIEKQVNRITINYYDVESLDVTDGSYIIEKDLDYVREEEPEPECWAEEFGYECCLFSSMVSYVDDKGRYWDFQNGNWCGVTNKPMIINKSKIPYKPNKCWSLERGIQCCPSSIKSTSYINDGVYGVVNENNGIGFRYCGIQLPVISDIEPNNNTPVSQESTCWANDYGYDCCGPEIVKGNYIDNDGIWYQNDSYWCGLVTYNKNDIEIVNDQCWPDNKFKCCSPGTKVEYTDEEALWGVENGNWCYITRFTSPPVTTTPATTAPTTTTTTTTTTTTTTTTTTTTTTTTSSINTPVNYQCWPGEYECCSPGTKVEYTDEEALWGVENGNWCYITRFTSPPVTTTSTTTIPTTTTTTTTTTTTTTTTTTSSINTPVNDQCWPGEYECCSPGTKVEYTDEEALWGVENGNWCYITRFTSPPITTTPTTTIPTTTTTTTTTTTTTTTTTT

SEQ ID NO: 1061 - protein, 247 aa, Neocallimastix californiae
  AT18611P-RELATED
EPTIRSIDEMKLVFSDEFDGDELDKSVWDVEVNCWGGGNGEKQCYVDHEENIFVKDGQLHIKAIPKGEYKLTDEEKKSCTNNNENSCGWTQSVTSGRIRTYKSGHAWKYGKVRVKAKLPAGPYLWPAIWMLPQDDVYGTWAASGEIDIMEARGQVPDAVGHAIHYGGQWPNNVFSSETASVKDVINDFHVYGLDWEENFLIFSVDEVEYFTVDLRKSFYSGKGSNPYKDIRQPFDEKFHLLLNVAVG

SEQ ID NO: 1062 - protein, 553 aa, Anaeromyces robustus
  AT18611P-RELATED
EPTIRSVDEMKLVFSDEFEGNELDRSVWDVEVNCWGGGNGEKQCYVDHDENIFVKNGQLHIKAVPKGQYKLTDQEMKTCTNNNENSCGWTQSTTSGRIRTYKSGNAWKYGKIRVKAKLPAGPYLWPAIWMLPQDDVYGTWAASGEIDIMEARGQVPDAVGHAIHFGGQWPDNDFMSETASIKNVINDFHVYGLDWEENFLIFTVDEKPYYTVDLRKSFWSGKGTNPYKKIRQPFDEKFHLLLNVAVGGNYFNGIGEFDYGRDTPQWTRPEMIIDYVRVYQLPRHVNEPEPIQTLPTTPPEDSKAPSIPSMDDYKLVFSDEFEGNKLDRSVWDVEVNCWGGGNGEKQCYVDHDENIFVKNGQLHIKAVPKGQYKLTDQEMKTCTNNNEDSCGWTQSTTSGRIRTYKSGNAWKYGKIRVKAKLPAGPYLWPAIWMLPQDDVYGTWAASGEIDIMEARGQVSNAIGNAIHFGGQWPNNDFVDKTYNLSNIINDFHVYGLDWEEDYLLFSVDEEVTFFVDLRRSFWSGKGNNPYKKIRQPFDEKFHLLLNVAVGGNY

SEQ ID NO: 1063 - protein, 16 aa, Neocallimastix californiae
  B_KETOACYL_SYNTHASE
GPSYTIDTACSTGSSA

SEQ ID NO: 1064 - protein, 16 aa, Neocallimastix californiae
  B_KETOACYL_SYNTHASE
GPSICTNTACSASMTA

SEQ ID NO: 1065 - protein, 16 aa, Neocallimastix californiae
  B_KETOACYL_SYNTHASE
GPIRTPVGACASAVES

SEQ ID NO: 1066 - protein, 16 aa, Neocallimastix californiae
  B_KETOACYL_SYNTHASE
GPSFTIDTACSTGSSA

SEQ ID NO: 1067 - protein, 16 aa, Neocallimastix californiae
  B_KETOACYL_SYNTHASE
GPIKTPVGACATAVES

SEQ ID NO: 1068 - protein, 16 aa, Neocallimastix californiae
  B_KETOACYL_SYNTHASE
GPSFTIDTACSTGASA

SEQ ID NO: 1069 - protein, 16 aa, Neocallimastix californiae
  B_KETOACYL_SYNTHASE
GPSLSTNTACSSSMTA

SEQ ID NO: 1070 - protein, 16 aa, Neocallimastix californiae
  B_KETOACYL_SYNTHASE
GPSVTVDTACSTGATA

SEQ ID NO: 1071 - protein, 16 aa, Neocallimastix californiae
  B_KETOACYL_SYNTHASE
GPSFTMDTACSTGASA

SEQ ID NO: 1072 - protein, 16 aa, Neocallimastix californiae
  B_KETOACYL_SYNTHASE
GPIKTPVGACATAVES

SEQ ID NO: 1073 - protein, 16 aa, Neocallimastix californiae
  B_KETOACYL_SYNTHASE
GPAISMDTACSTGATA

SEQ ID NO: 1074 - protein, 16 aa, Neocallimastix californiae
  B_KETOACYL_SYNTHASE
GPAISMDTACSTGATA

SEQ ID NO: 1075 - protein, 16 aa, Neocallimastix californiae
  B_KETOACYL_SYNTHASE
GPAISIDTACSTGATA

SEQ ID NO: 1076 - protein, 16 aa, Neocallimastix californiae
  B_KETOACYL_SYNTHASE
GPSFTIDTACSTGSSA

SEQ ID NO: 1077 - protein, 16 aa, Anaeromyces robustus
  B_KETOACYL_SYNTHASE
GPIRTPVGACASAVES

SEQ ID NO: 1078 - protein, 16 aa, Anaeromyces robustus
  B_KETOACYL_SYNTHASE
GPSFTIDTACSTGASA

SEQ ID NO: 1079 - protein, 16 aa, Anaeromyces robustus
  B_KETOACYL_SYNTHASE
GPSFTIDTACSTGASA

SEQ ID NO: 1080 - protein, 16 aa, Anaeromyces robustus
  B_KETOACYL_SYNTHASE
GPSLTMDTACSTGGSA

SEQ ID NO: 1081 - protein, 16 aa, Anaeromyces robustus
  B_KETOACYL_SYNTHASE
GPSDTIDTACSSGLND

SEQ ID NO: 1082 - protein, 16 aa, Anaeromyces robustus
  B_KETOACYL_SYNTHASE
GPIKTPVGACATAVES

SEQ ID NO: 1083 - protein, 16 aa, Anaeromyces robustus
  B_KETOACYL_SYNTHASE
GPSYTMDTACSTGASA

SEQ ID NO: 1084 - protein, 16 aa, Anaeromyces robustus
  B_KETOACYL_SYNTHASE
GPAISIDTACSTGATA

SEQ ID NO: 1085 - protein, 16 aa, Piromyces finnis
  B_KETOACYL_SYNTHASE
GPSYTIDTACSTGSSA

SEQ ID NO: 1086 - protein, 16 aa, Piromyces finnis
  B_KETOACYL_SYNTHASE
GPSFTIDTACSTGATA

SEQ ID NO: 1087 - protein, 16 aa, Piromyces finnis
  B_KETOACYL_SYNTHASE
GPSDTVDTACSSGLND

SEQ ID NO: 1088 - protein, 16 aa, Piromyces finnis
  B_KETOACYL_SYNTHASE
GPSLSTNTACSSSLTA

SEQ ID NO: 1089 - protein, 16 aa, Piromyces finnis
  B_KETOACYL_SYNTHASE
GPIKTPVGACATAVES

SEQ ID NO: 1090 - protein, 16 aa, Piromyces finnis
  B_KETOACYL_SYNTHASE
GPIKTPVGACATAVES

SEQ ID NO: 1091 - protein, 16 aa, Piromyces finnis
  B_KETOACYL_SYNTHASE
GPIKTPVGACATAVES

SEQ ID NO: 1092 - protein, 16 aa, Piromyces finnis
  B_KETOACYL_SYNTHASE
GPIKTPVGACATAVES

SEQ ID NO: 1093 - protein, 16 aa, Piromyces finnis
  B_KETOACYL_SYNTHASE
GPSICTNTACSASMTA

SEQ ID NO: 1094 - protein, 16 aa, Piromyces finnis
  B_KETOACYL_SYNTHASE
GPSVTVDTACSTGATA

SEQ ID NO: 1095 - protein, 207 aa, Neocallimastix californiae
  Barwin-like endoglucanases
TGKTTRYWDCCLASCSWQENTKKAGASGVVRSCSKDGMTPFTDLSNLWRVKSGCEGGSVYMCNDQQPWAVNDNVAYGFVASHEKCCTCQRLKFTSGPVAGKQMIVQTTNTGGDLSSNHFDIQMPGGGFGIFDGCTSQFGGGHNWGERYGGIKSASECANLPSVLKQGCEWRFNWFKNADNPNVVFERVQCPKELTDITGCVPNDDSS

SEQ ID NO: 1096 - protein, 23 aa, Neocallimastix californiae
  Barwin-like endoglucanases
EWKYSRSTHYGLTYAGACAFGVY

SEQ ID NO: 1097 - protein, 163 aa, Neocallimastix californiae
  Barwin-like endoglucanases
PVDTKLSLRGNFIAPNGNYYTQFWPSLQGDYDNYLSCGECYELEITQEDGSLYPEDNRRSENIIAQIVDSCPCSANAKWCCGSGIDHCNEIDFKYGCPIPEGSVHFDLSDIAMARLQTNDPNGGMVEGVIPIRYKRVPCPVKGNIYIRILPGANQWYFAINVV

SEQ ID NO: 1098 - protein, 210 aa, Neocallimastix californiae
  Barwin-like endoglucanases
PWKYSRSTHFGLTYGGACGFGLYGLCTTKFNETGELCVRFCEHYPDLCKDPDDITLRGNFCAPNGNYYTQFWSSLPGDYDNYLSCGECYEVERTLPDGSSYPAGEGTDHILLQVVDSCPCTANAKWCCGSGVDHCNEIDFKYGCPIPEGSWHVDLSDIAMSRLQTNDPYGVMVDGVIPIKYRRVPCPVKGNIHVWLRPGAGPWYFALTVV

SEQ ID NO: 1099 - protein, 153 aa, Neocallimastix californiae
  Barwin-like endoglucanases
SSAFAWKWAKEGIASMTWYTDFSHENLACNCVPNAMVVGPTVALAEVAYGAFDHFGSGPACGLCYRLSPYATADGTPLSPIPEPIVFRVTDECPHQSNAEWCPGPEGGKNAHGFEDHFDVNIDSWGGKLRDWFQGGHMQAKYELVSCEEWPGW

SEQ ID NO: 1100 - protein, 202 aa, Neocallimastix californiae
  Barwin-like endoglucanases
KGTTTRYWDCCKPSCAWPGKFEYKTNIKLCAADGSALLDNNLISGCEGGPTYTCEDQTPWAVDDVTAYGYAAANIPGLTEADWCCTCYALTFTSFPIKGKQMIVQITNTGGDLGEGHFDLQIPGGGFGLFNGCSPRYPDIPDEDWGDRNGGVTSREGCYKLPVSMQEGCLFKFDWFRGADNPEVTYVKVDCPQELIDVSGCT

SEQ ID NO: 1101 - protein, 202 aa, Neocallimastix californiae
  Barwin-like endoglucanases
EGTTTRYWDCCKPSCSWPDKAPVSAPVRQCKADGFTALTNYNAKSGCEGGESYMCSDQRPWAVSEVLSYGYAAASIKGLTEKEWCCRCYALTFTSGPVKGKQMVVQVTNTGGDLGDNHFDIQIPGGGFGIFNGCSAQFNTPDEVWGTRYGGVASRDDCEGLPEAIKESCYWRFDWFLNADNPTMVFDEVECPVELTRNTDCI

SEQ ID NO: 1102 - protein, 159 aa, Neocallimastix californiae
  Barwin-like endoglucanases
VSGEASMTHYELNGGGGSCNVSAMGNAAGPTAAISGLSYGSWSGLGGGPACGLCYALTVYGSYDGQADPALFPKCSIVVRITDQCPYPDNKEWCPGPEQPESEGFLNPRGMRYHFDVNISSGQGEAREWFPRDASGNLLGTGKVYFEMVSCREWSGWKY

SEQ ID NO: 1103 - protein, 210 aa, Neocallimastix californiae
  Barwin-like endoglucanases
EGVTTRYYDCCKPSCSWPGKADVFHPVRHCTVDGTTLIEDQEAPSACQKDVVGTAHMCENQQPWAVSDSLSYGFAAAALPGGESVSCCKCYALTFIDPPIRGKQLVVQVTNTGADVGSNQFDLQIPGGGVGIFDACTNMYGLPAGSNGWGKQYGGITGIEDCETFPESLKEGCKWRFNWLLGADNPRMKFAEVDCPKELTDITGCIRKDA

SEQ ID NO: 1104 - protein, 164 aa, Neocallimastix californiae
  Barwin-like endoglucanases
KDPAGRTYRGNFAAPQGNYYTQFWGALEGDQDNYLSCGECFEVYKTKPDGSDYKPGEDGYQPPVLLSVIDSCPCNANGKWCCGSEWDQCQEIDFKYGCPVPKDSIHLDLSDIAMARLQSGSSNGHMEAGVIPNKYRRVPCPRLGNMYIWLRKDAGPYWFAFSVV

SEQ ID NO: 1105 - protein, 24 aa, Neocallimastix californiae
  Barwin-like endoglucanases
EFHYSRSTHFGLTFGGACGFGLYQ

SEQ ID NO: 1106 - protein, 106 aa, Neocallimastix californiae
  Barwin-like endoglucanases
AYTGDGTTYGDPLTGGYCMMPDSEAYTKDMMFAAMNLPQYNISAGCGSCLILAQADKPERVIRVRVVDRCGECPKGDIDLSNTAWKALTGDFIPGRVKIIWSIVPC

SEQ ID NO: 1107 - protein, 159 aa, Neocallimastix californiae
  Barwin-like endoglucanases
VSGEASMTHYELNGGGGSCNVSAMGNAAGPTAAISGLSYGSWSGLGGGPACGLCYALTVYGSYDGQADPALFPKCSLVVRVTDQCPYPDNKEWCPGPEQPESEGFLNPRGMRYHFDINISSGQGEAREWFPRDASGNLLGTGKVYFEMVSCREWSGWKY

SEQ ID NO: 1108 - protein, 207 aa, Neocallimastix californiae
  Barwin-like endoglucanases
KGVTTRYYDCCKPSCSWPGKADVTQPVRQCAVDGKTLLTDFSAPSACQTDVEGISHMCEDQQPWAVSDVLSYGFAAAALPGGESKSCCACYAITFSEPPIRGKQIVVQVTNTGSDVGSNQFDLQIPGGGVGIFDACTNMYGLPAGSNGWGKKYGGISSIEDCDSFPEALQAGCRWRFEFLLGADNPKMTFVEVECPKVLTDITGCIR

SEQ ID NO: 1109 - protein, 168 aa, Neocallimastix californiae
  Barwin-like endoglucanases
KKGKASVTRYGSMGILSCNCKISAMEVGPACAINENAYGGYDGLGSGVACGMCYKLTPYGTSETDQWPKSEADLPGPMVFKVTDICPYNANPAWCPSQESAPKNSVGMEYHFDINVDSWQPETLLKWFANGTLGTMNVEFELVSCEEWIGWSKKGKFEGLGDNPWWGC

SEQ ID NO: 1110 - protein, 200 aa, Neocallimastix californiae
  Barwin-like endoglucanases
GKTTRYWDCCKPSCAWNYKANVSKEVNSCYRDGSIVSIPWITSGCGGGDAFMCNDQQPWAINDKLSYGFAAANISGSDEEHWCCACFKITFTSTSIAGKEMIVQVTNTGGDLGENHFDIQMPGGGLGLFDGCSPQFGVDASKWGERYGGLTSEAGCDNLPKVLQPGCHWRFGWFENADNPAMEFEEVECPAELIKITGCA

SEQ ID NO: 1111 - protein, 130 aa, Neocallimastix californiae
  Barwin-like endoglucanases
LSCGECFEVYKTKPDGSDYKPGEDGYQPPVLLSVIDSCPCNANGKWCCGSEWDQCQEIDFKYGCPVPKDSIHLDLSDIAMARLQSGSSNGHMEAGVIPNKYRRVPCPKLGNMYIWLREDAGPYWFAFSVV

SEQ ID NO: 1112 - protein, 52 aa, Neocallimastix californiae
  Barwin-like endoglucanases
EFHYSRSTHFGLTFGGACGFGLYQVCGSDHNYTGEFATLCDAFCKAYPTLCK

SEQ ID NO: 1113 - protein, 210 aa, Neocallimastix californiae
  Barwin-like endoglucanases
EGVTTRYYDCCKPSCSWPGKADVFHPVRHCKVDGTTLIEDQEAPSACQKDVVGTAHMCENQQPWAVSDSLSYGFAAAALPGGESVSCCKCYALTFTDPPIRGKQLVVQVTNTGSDVGSNQFDLQIPGGGVGIFDACTNMYGLPAGSNGWGKQYGGITGIEDCESFPESLKEGCKWRFNWLLGADNPKMKFAEVECPKVLTDITGCIRKDA

SEQ ID NO: 1114 - protein, 210 aa, Neocallimastix californiae
  Barwin-like endoglucanases
PWKYSRSTHFGLTYGGACGFGLYGLCTTKFNETGELCVRFCEHYPDLCKDPDDITLRGNFCAPNGNYYTQFWSSLPGDYDNYLSCGECYEVERTLPDGSSYPAGEGTDHIILQVVDSCPCTANAKWCCGSGVDHCNEIDFKYGCPIPEGSWHVDLSDIAMSRLQTNDPYGVMVDGVIPIKYKRVPCPVKGNIHVWLRPGAGPWYFALTVV

SEQ ID NO: 1115 - protein, 210 aa, Neocallimastix californiae
  Barwin-like endoglucanases
TGKTTRYWDCCLASCSWSENTNASHPVNACQKDGKTVFNKFDWTIGSACSGGQGYMCTDNQPWAINDNVSYGFVAAGFSSGSQKDWCCTCQRLEFTSGPVAGKQMVVQITNTGGDLSNNHFDIQMPGGGVGIFNGCQSQFGAPSDGWGERYGGVKSASDCSSLPAELQDGCKWRFDWFKNADNPSVTFERVQCPKELTDITGCIPVDDAS

SEQ ID NO: 1116 - protein, 202 aa, Neocallimastix californiae
  Barwin-like endoglucanases
EGTTTRYWDCCKPSCSWPDKAPVSAPVRQCKADGFTALTNYNAKSGCEGGESYMCSDQRPWAVSEVLSYGYAAASIKGLTEKEWCCRCYALTFTSGPVKGKQMVVQVTNTGGDLGDNHFDIQIPGGGFGIFNGCSAQFNTPDEVWGTRYGGVASRDDCEGLPKEIQESCYWRFDWFLNADNPTMVFDEVECPAELTKNTDCI

SEQ ID NO: 1117 - protein, 210 aa, Neocallimastix californiae
  Barwin-like endoglucanases
TGKTTRYWDCCLASCSWSENTNAKHPVNACQKDGKTVINNFSYLIGSACSGGSGYMCSNNQPWAINDNVSYGFVAAGFSSGSQKDWCCTCQRLEFTSGPIAGKQMVVQITNTGGDLSNNHFDIQMPGGGVGIFNGCSSQFGAPNDGWGERYGGVKSAADCSQLPTELQEGCKWRFNWFKNADNPSVTFERVQCPKELTDITGCVPADDAS

SEQ ID NO: 1118 - protein, 164 aa, Neocallimastix californiae
  Barwin-like endoglucanases
KDPEGYTYRGNFAAPQGNYYTQFWGSLEGDQDNYLSCGECFEVYKTKPDGSDYQPGEEGYQPPVLLSVIDSCPCNANGKWCCGSEWDQCQEIDFKYGCPVPKDSIHLDLSDIAMARLQSGSSNGHMEAGVIPNKYRRVPCPRLGNMYIWLREDAGPYWFAFSVV

SEQ ID NO: 1119 - protein, 23 aa, Neocallimastix californiae
  Barwin-like endoglucanases
EFHYSRSTHFGLTFGGACGFGLY

SEQ ID NO: 1120 - protein, 138 aa, Neocallimastix californiae
  Barwin-like endoglucanases
MTWYTDYSHENLACNCVPNAMVVGPTVALAEVAYGAFDHFGSGPACGLCYRLSPYATADGTPLSPIPEPIVFRVTDECPHQSNTEWCPGPEGGKNAHGFEDHFDVNIDSWGGKLRDWFQGGHMQAKYELVSCEEWPGW

SEQ ID NO: 1121 - protein, 165 aa, Neocallimastix californiae
  Barwin-like endoglucanases
QDPEGLTYRGNFAAPQGNYYTQFWGILEGDQDNYLSCGECFEVYKTKEDGTDYKPGEEGYTPPVLLSVIDSCPCSANGKWCCGSEWDQCQEVNNFKYGCPVPKDSIHLDLSDVAMARLQSGTPDGHMPAGVIPNKYRRVPCPRLGNMYIWLRQNASPYWFSFTVV

SEQ ID NO: 1122 - protein, 23 aa, Neocallimastix californiae
  Barwin-like endoglucanases
FHYSRSTHFGITVAGACGFGLYQ

SEQ ID NO: 1123 - protein, 203 aa, Neocallimastix californiae
  Barwin-like endoglucanases
TGTTTGYWDCCVASCSWDGNVEGSKPVKACKKDGVSLITEELWKVKSVCDNEGDGYMCNDNQPIVINDNLALGFAASHEKCCSCQLLQFTSSNVKGKKMIVQVTNTGSDIGSNHFDLQIPGAGVGIFNGCSKQWGAPGDGWGRRYGGVTTKAECSQLPAQLRAGCEWRFGWFASSDNPGVVYERVQCPKQLTDITGCVLPDDA

SEQ ID NO: 1124 - protein, 168 aa, Neocallimastix californiae
  Barwin-like endoglucanases
KKGKASVTRYGSMGILSCNCKISAMEVGPACAINENAYGGYDGLGSGVACGMCYKLTPYGTSETDQWPKSEADLPGPMVFKVTDICPYNANPAWCPSQESAPKNSVGMEYHFDINVDSWQPETLIKWFGNGSLGTMNVDFELVSCEEWIGWSKKGQFEGLGDNPWWGC

SEQ ID NO: 1125 - protein, 202 aa, Neocallimastix californiae
  Barwin-like endoglucanases
KGTTTRYWDCCKPSCAWPGKFEYKTNIKLCAADGSPLLDNNLISGCEGGPTYTCEDQTPWAVDDVTAYGYAAANIPGLTEADWCCTCYALTFTSFPIKGKQMIVQITNTGGDLGDGHFDLQIPGGGFGLFNGCSPRYPDIPDEDWGDRNGGVISREGCYKLPKSMQEGCLFKFDWFRGADNPDVTYVKVDCPQELLDVSGCT

SEQ ID NO: 1126 - protein, 105 aa, Neocallimastix californiae
  Barwin-like endoglucanases
IYSGDGTAYGDATSGGNCLFPKKEYYNDMMYAALNNKQYNTDMGCGLCAVVVSTSNPYKPIRVRIIDQCPECAHGSLDFSDKAFKALSNKTPDRIKITWALIPCD

SEQ ID NO: 1127 - protein, 201 aa, Neocallimastix californiae
  Barwin-like endoglucanases
TGKTTGYWDCCVASCSWDANVPGAKPVRACRKNGVSLITEELWKVKSVCDNGEGYMCNNNQPIVINDKLAYGFAASHEKCCTCQRLQFTSGNVKGKQMIVQITNTGSDLGSNHFDLQIPGAGVGIFNGCTKQWGAPNDGWGRRYGGVTSKSQCSQLPSQLRAGCEWRFGWFEGSDNPDVVFERVRCPKALTDITGCILPDE

SEQ ID NO: 1128 - protein, 210 aa, Neocallimastix californiae
  Barwin-like endoglucanases
TGKTTRYWDCCLASCSWSENVGASHPVNACKKDGTTLITDISNLWRIKSGCQGGEAYMCNAQQPWIINDKVSYGFVAAGFDSGNQKQWCCSCQKLQFTSGPVAGKQMIVQVTNTGTDLSENHFDIQMPGGGVGIFNGCSSQWNAGSDGWGQRFGGISSVSECSQLPAELRDGCKWRFDWFKNADNPAVVFERVQCPKELTDITGCIPPDD

SEQ ID NO: 1129 - protein, 23 aa, Neocallimastix californiae
  Barwin-like endoglucanases
DWHYSRSTHYGLTYAGACAFGVY

SEQ ID NO: 1130 - protein, 163 aa, Neocallimastix californiae
  Barwin-like endoglucanases
PVDTKLSLRGNFIAPNGNYYTQFWSSLPGDYDNYLSCGECYELEITQEDGSLYPEKQRRSENIIAQIVDSCPCSANAKWCCGSGIDHCNEIDFKYGCPIPEDSVHFDLSDIAMARLQTNDPNGGMVEGVIPIRYKRVPCPVKGNIYIRILPGANQWYFAINVV

SEQ ID NO: 1131 - protein, 210 aa, Neocallimastix californiae
  Barwin-like endoglucanases
PWKYSRSTHFGLTYGGACGFGLYGLCTTKYNETGALCQKFCKNYPDLCKDPDNISLRGNFCAPNGNYYTQFWSSLPGDYDNYLSCGECYEVERTQPDGSSYPKDTKTDNILLQVVDSCPCTANAKWCCGSGVDHCNEIDFKYGCPIPEGSWHVDLSDIAMSRLQTNDPYGTMFDGVIPIRYKRVPCPVKGNIHVWLRPGAGPWYFALTVV

SEQ ID NO: 1132 - protein, 210 aa, Anaeromyces robustus; identical to SEQ ID NO: 1128
  Barwin-like endoglucanases

SEQ ID NO: 1133 - protein, 23 aa, Anaeromyces robustus
  Barwin-like endoglucanases
DWHYSRSTHYGLTYAGACAFGVY

SEQ ID NO: 1134 - protein, 163 aa, Anaeromyces robustus; identical to SEQ ID NO: 1130
  Barwin-like endoglucanases

SEQ ID NO: 1135 - protein, 198 aa, Anaeromyces robustus
  Barwin-like endoglucanases
GQTTRYWDCCKPSCAWNYKAKVTHEVYSCRKDGSIEPVVYATSGCGGGQAFMCNDQQPWEINDKLSYGFAAANISGSDEEHWCCACFKLTFTSTSIAGKQMIVQVTNTGGDLGNNHFDIQMPGGGLGLFDGCSPQFGVDASKWGNKYGGLTSESQCSLLPKVLQPGCHWRYGWFEDADNPAMEFEEVQCPQELVDITG

SEQ ID NO: 1136 - protein, 210 aa, Anaeromyces robustus; identical to SEQ ID NO: 1131
  Barwin-like endoglucanases

SEQ ID NO: 1137 - protein, 22 aa, Anaeromyces robustus
  Barwin-like endoglucanases
FHYSRSTHFGLTFGGACGFGLY

SEQ ID NO: 1138 - protein, 165 aa, Anaeromyces robustus
  Barwin-like endoglucanases
KDPVGRSYRGNFAAPQGNYYTQFWGSLEGDQDNYLSCGECFEVYKTKEDGSDYKPGEEGYQPPVLLSVIDSCPCSANGKWCCGSEWDQCQEVNNFKYGCPVPKDSIHLDLSDIAMARLQSGSSNGHMEAGVIPNKYRRVPCPRLGNMYIWLRKDAGPYWFSFSVV

SEQ ID NO: 1139 - protein, 202 aa, Anaeromyces robustus
  Barwin-like endoglucanases
KGTTTRYWDCCKPSCAWPGKFEYKTNIKLCNADNSPLLDNNLKSGCEGGPTYTCEDQTPWAVDEVTAYGFAAASIPNQTEADWCCTCYALTFTSFPIKGKQMIVQVTNTGGDLGEGHFDIQIPGGGFGLFNGCSPRYPEIPDEDWGDRNGGVTSRENCYKLPKTMQEGCLFKFDWFRGADNPDVTYVKVDCPKELLEVSGCT

SEQ ID NO: 1140 - protein, 106 aa, Anaeromyces robustus
  Barwin-like endoglucanases
AYTGDGTTYGDPVTGGYCMMPDSEAYTKDMMFAAMNLPQYNISAGCGSCLILAQADKPDRVIRVRVVDRCGECPKGDIDLSNTAWKALTGDFIPSRVKIIWSIVPC

SEQ ID NO: 1141 - protein, 202 aa, Anaeromyces robustus
  Barwin-like endoglucanases
KGNTTRYWDCCKPSCSWPEKALVSQPVQQCKKDGITPITNFNAKSGCEGGESFMCLNQQPWAVSEVLSYGYAAASIAGLTEADWCCRCYALTFTTGPAKGKQIVVQVTNTGGDLGENHFDLQIPGGGVGIFNGCSTQFNTDTDGWGERYGGIGKRSDCEMLPEEIRQACYWRFDWFLGSDNPEMVFDEVECPIELTQNTGCI

SEQ ID NO: 1142 - protein, 210 aa, Anaeromyces robustus
  Barwin-like endoglucanases
EGVTTRYYDCCKPSCSWPGKADVFHPVRHCAVDGTTLIDDQEAPSACQKDVKGTAHMCENQQPWAINDHLSFGFAAAALPGGESVSCCKCYALTFTDPPIRGKQLVVQVTNTGADVGSNQFDLQIPGGGVGIFDACTNMYGLPAGSNGWGKQYGGITSIEDCESFPESLKEGCKWRFNWLLGADNPKMKFAEVDCPKELTDITGCIRKDA

SEQ ID NO: 1143 - protein, 168 aa, Anaeromyces robustus
  Barwin-like endoglucanases
KKGKASVTRYGSMGILSCNCKISAMEVGPACAINENAYGGYDGLGSGVACGMCYKLTPYGTAETDQWPKSEADLPGPMVFKVTDICPHNANPAWCPSQESAPKNSVGMEYHFDINVDSWQPETLLKWFANGTLGTMYVDFELVSCEEWIGWSKKGQFEGLGDNPWWGC

SEQ ID NO: 1144 - protein, 159 aa, Anaeromyces robustus
  Barwin-like endoglucanases
VSGEASMTHYELNGGGGSCNVSAMGNAAGPTAAISGLSYGSWSGLGGGPACGLCYALTVYGSYDGQADPALFPKCSIVVRITDQCPYPDNKEWCPGPEQPESEKFLNPRGMRYHFDINISSGQGEAREWFPRDASGNLLGTGKVYFQMVSCREWSGWKY

SEQ ID NO: 1145 - protein, 154 aa, Anaeromyces robustus
  Barwin-like endoglucanases
SSALAWTWAKEGIASMTWYTDYSHQNLACNCVPNAMVVGPTVALAEVAYGAFDHFGSGPACGLCYRLSPFATADGTPLNPKPEPIVFRVTDECPHQSNAEWCPGPEGGKNAHGFEHHFDVNIDSWEGKLRDWFQGGHMQANFELVSCEEWPGWS

SEQ ID NO: 1146 - protein, 200 aa, Anaeromyces robustus
  Barwin-like endoglucanases
GQTTRYWDCCKPSCAWNYKAKVTHEVYSCRKDGSIEPVVYATSGCGGGEAFMCNDQQPWAINDKLSYGFAAANISGSDEEHWCCACFKLTFTSTSIAGKQMIVQVTNTGGDLGNNHFDIQMPGGGLGLFDGCSPQFGVDASKWGNKYGGLTSESQCSLLPKVLQPGCHWRYGWFEDADNPAMEFEEVQCPQELVDITGCA

SEQ ID NO: 1147 - protein, 105 aa, Anaeromyces robustus
  Barwin-like endoglucanases
IYSGDGTAYGDATSGGNCLFPKKEYYNDMMYAALNNKQYNLDMGCGLCAVVVSTSNPYKAIRVRIIDQCPECEHGSLDFSDKAFKALSNMDPARIKITWALIPCD

SEQ ID NO: 1148 - protein, 202 aa, Anaeromyces robustus
  Barwin-like endoglucanases
TGTTTGYWDCCVASCSWENNVKGGGQPVKACKKDGMTLVTEELWKVKSVCDNGDAYMCNDQQPIVVNDQLALGFAASHEPCCTCQLLQFTSSNVKGKKMIVQVTNTGDDIGNNHFDLQIPGAGVGIFNGCSKQWGAGNDGWGRRYGGVTSQAECSQLPSELRAGCEWRFGWFASSDNPTVTYERVQCPQQLTSITGCVLSDD

SEQ ID NO: 1149 - protein, 100 aa, Piromyces finnis
  Barwin-like endoglucanases
SGVTTAYWDCCVASCSWDANVSGSKPVKACRKDGVSLVTEELWKVKSVCDNGDAYMCNDQQPIVINEKLSYGFAASHDPCCSCQRLQFTSGPIKGKQMIV

SEQ ID NO: 1150 - protein, 168 aa, Piromyces finnis
  Barwin-like endoglucanases
KKGKASVTRYGSMGILSCNCKISAMEVGPACAINENAYGGYDGLGSGVACGMCYKLTPYGTSETDQWPKSEADLPGPMVFKVTDICPYNANPKWCPSQESAPKNSVGMEYHFDINVDSWQPETLIKWFGNGSLGTMNVEFELVSCEEWLGWSKKGKFEGLGDNPWWGC

SEQ ID NO: 1151 - protein, 207 aa, Piromyces finnis
  Barwin-like endoglucanases
EGVTTRYYDCCKPSCSWPGKADVTQPVRQCAMDGKTLLTDFSSPSACQTDVEGISHMCEDQQPWAVSDVLSYGFAAAALPGGESVSCCACYAITFSEPPIRGKQIVVQVTNTGADVGSNQFDLQIPGGGVGIFDACTNMYGLPSGSNGWGKKYGGIDKIEDCDSFPEALQAGCRWRFEFLLGADNPKMTFVEVECPKVLTDITGCIR

SEQ ID NO: 1152 - protein, 207 aa, Piromyces finnis
  Barwin-like endoglucanases
KGVTTRYYDCCKPSCSWPGKADVTQPVRQCAMDGKTLLTDFSSPSACQTDVEGISHMCEDQQPWAVSDVLSYGFAAAALPGGESVSCCACYAITFSEPPIRGKQIVVQVTNTGADVGSNQFDLQIPGGGVGIFDACTNMYGLPSGSNGWGKKYGGIDKIEDCDSFPEALQAGCRWRFEFLLGADNPKMTFVEVECPKVLTDITGCIR

SEQ ID NO: 1153 - protein, 159 aa, Piromyces finnis
  Barwin-like endoglucanases
TSGEASMTHYELNGGGGSCNVSAMGNAAGPTAAISGLSYGSWSGLGGGPACGLCYALTVFGSYDGQADPELFPKCSIVVRITDQCPYPDNKEWCPGPEQPESEGFLNPRGMRYHFDINISSGQGEAREWFPRDASGNLLGTGKVYFEMVSCREWSGWKY

SEQ ID NO: 1154 - protein, 210 aa, Piromyces finnis
  Barwin-like endoglucanases
PWKFSRSTHFGLTYGGACGFGLYGLCTTKYNETGELCMRFCDKYPDLCADPPNISLRGNFCAPNGNYYTQFWSSLPGDYDNYLSCGECYEVERTQPDGSSYPEGEGTDNILLQVVDSCPCTANAKWCCGSGVDHCNEIDFKYGCPIPEGSWHVDLSDIAMSRLQTNDPYGGMVDGVIPIRYKRVPCPVKGNIHVWLRPGAGQWYFALTVV

SEQ ID NO: 1155 - protein, 153 aa, Piromyces finnis
  Barwin-like endoglucanases
SALAWTWAKEGIASMTWYTDYSHENLACNCVPNAMVVGPTVALAEVAYGAFDHFGSGPACGLCYRLSPFATADGKPLSPIPEPIVFRVTDECPHQSNMEWCPGPEGGLNDHGFANHFDVNIDSWGGKLRDWFQGGHMQANFELVSCEEWPGWS

SEQ ID NO: 1156 - protein, 106 aa, Piromyces finnis
  Barwin-like endoglucanases
AYTGDGTTYGDPVTGGYCMMPDSEAYTKDMMFAAMNLPQYNISAGCGSCLILAQADKPERVIRVRVVDRCGECPKGDIDLSNTAWKALTGDFIPGRVKIIWSIVPC

SEQ ID NO: 1157 - protein, 105 aa, Piromyces finnis
  Barwin-like endoglucanases
IYSGDGTAYGDATSGGNCLFPKKEYYNDMMYAALNNKQYNDDMGCGLCAVVVSTSNPYKAIRVRIIDQCPECEHGSLDFSDKAFKALSNKTPDRIKITWALIPCD

SEQ ID NO: 1158 - protein, 208 aa, Neocallimastix californiae
  Barwin-like_endoglucanase
TGKTTRYWDCCLASCSWQENTKKAGASGVVRSCSKDGMTPFTDLSNLWRVKSGCEGGSVYMCNDQQPWAVNDNVAYGFVASHEKCCTCQRLKFTSGPVAGKQMIVQTTNTGGDLSSNHFDIQMPGGGFGIFDGCTSQFGGGHNWGERYGGIKSASECANLPSVLKQGCEWRFNWFKNADNPNVVFERVQCPKELTDITGCVPNDDSSV

SEQ ID NO: 1159 - protein, 122 aa, Neocallimastix californiae
  Barwin-like_endoglucanase
NGNYYTQFWPSLQGDYDNYLSCGECYELEITQEDGSLYPEDNRRSENIIAQIVDSCPCSANAKWCCGSGIDHCNEIDFKYGCPIPEGSVHFDLSDIAMARLQTNDPNGGMVEGVIPIRYKRV

SEQ ID NO: 1160 - protein, 28 aa, Neocallimastix californiae
  Barwin-like_endoglucanase
DATNQEWKYSRSTHYGLTYAGACAFGVY

SEQ ID NO: 1161 - protein, 121 aa, Neocallimastix californiae
  Barwin-like_endoglucanase
NGNYYTQFWSSLPGDYDNYLSCGECYEVERTLPDGSSYPAGEGTDHILLQVVDSCPCTANAKWCCGSGVDHCNEIDFKYGCPIPEGSWHVDLSDIAMSRLQTNDPYGVMVDGVIPIKYRRV

SEQ ID NO: 1162 - protein, 27 aa, Neocallimastix californiae
  Barwin-like_endoglucanase
STDQPWKYSRSTHFGLTYGGACGFGLY

SEQ ID NO: 1163 - protein, 203 aa, Neocallimastix californiae
  Barwin-like_endoglucanase
KGTTTRYWDCCKPSCAWPGKFEYKTNIKLCAADGSALLDNNLISGCEGGPTYTCEDQTPWAVDDVTAYGYAAANIPGLTEADWCCTCYALTFTSFPIKGKQMIVQITNTGGDLGEGHFDLQIPGGGFGLFNGCSPRYPDIPDEDWGDRNGGVTSREGCYKLPVSMQEGCLFKFDWFRGADNPEVTYVKVDCPQELIDVSGCTR

SEQ ID NO: 1164 - protein, 202 aa, Neocallimastix californiae; identical to SEQ ID NO: 1101
  Barwin-like_endoglucanase

SEQ ID NO: 1165 - protein, 211 aa, Neocallimastix californiae
  Barwin-like_endoglucanase
EGVTTRYYDCCKPSCSWPGKADVFHPVRHCTVDGTTLIEDQEAPSACQKDVVGTAHMCENQQPWAVSDSLSYGFAAAALPGGESVSCCKCYALTFIDPPIRGKQLVVQVTNTGADVGSNQFDLQIPGGGVGIFDACTNMYGLPAGSNGWGKQYGGITGIEDCETFPESLKEGCKWRFNWLLGADNPRMKFAEVDCPKELTDITGCIRKDAK

SEQ ID NO: 1166 - protein, 104 aa, Neocallimastix californiae
  Barwin-like_endoglucanase
YTGDGTTYGDPLTGGYCMMPDSEAYTKDMMFAAMNLPQYNISAGCGSCLILAQADKPERVIRVRVVDRCGECPKGDIDLSNTAWKALTGDFIPGRVKIIWSIVP

SEQ ID NO: 1167 - protein, 207 aa, Neocallimastix californiae; identical to SEQ ID NO: 1108
  Barwin-like_endoglucanase

SEQ ID NO: 1168 - protein, 200 aa, Neocallimastix californiae; identical to SEQ ID NO: 1110
  Barwin-like_endoglucanase

SEQ ID NO: 1169 - protein, 211 aa, Neocallimastix californiae
  Barwin-like_endoglucanase
EGVTTRYYDCCKPSCSWPGKADVFHPVRHCKVDGTTLIEDQEAPSACQKDVVGTAHMCENQQPWAVSDSLSYGFAAAALPGGESVSCCKCYALTFTDPPIRGKQLVVQVTNTGSDVGSNQFDLQIPGGGVGIFDACTNMYGLPAGSNGWGKQYGGITGIEDCESFPESLKEGCKWRFNWLLGADNPKMKFAEVECPKVLTDITGCIRKDAK

SEQ ID NO: 1170 - protein, 27 aa, Neocallimastix californiae
  Barwin-like_endoglucanase
STDQPWKYSRSTHFGLTYGGACGFGLY

SEQ ID NO: 1171 - protein, 121 aa, Neocallimastix californiae
  Barwin-like_endoglucanase
NGNYYTQFWSSLPGDYDNYLSCGECYEVERTLPDGSSYPAGEGTDHIILQVVDSCPCTANAKWCCGSGVDHCNEIDFKYGCPIPEGSWHVDLSDIAMSRLQTNDPYGVMVDGVIPIKYKRV

SEQ ID NO: 1172 - protein, 210 aa, Neocallimastix californiae; identical to SEQ ID NO: 1115
  Barwin-like_endoglucanase

SEQ ID NO: 1173 - protein, 201 aa, Neocallimastix californiae
  Barwin-like_endoglucanase
EGTTTRYWDCCKPSCSWPDKAPVSAPVRQCKADGFTALTNYNAKSGCEGGESYMCSDQRPWAVSEVLSYGYAAASIKGLTEKEWCCRCYALTFTSGPVKGKQMVVQVTNTGGDLGDNHFDIQIPGGGFGIFNGCSAQFNTPDEVWGTRYGGVASRDDCEGLPKEIQESCYWRFDWFLNADNPTMVFDEVECPAELTKNTDC

SEQ ID NO: 1174 - protein, 210 aa, Neocallimastix californiae; identical to SEQ ID NO: 1117
  Barwin-like_endoglucanase

SEQ ID NO: 1175 - protein, 204 aa, Neocallimastix californiae
  Barwin-like_endoglucanase
TGTTTGYWDCCVASCSWDGNVEGSKPVKACKKDGVSLITEELWKVKSVCDNEGDGYMCNDNQPIVINDNLALGFAASHEKCCSCQLLQFTSSNVKGKKMIVQVTNTGSDIGSNHFDLQIPGAGVGIFNGCSKQWGAPGDGWGRRYGGVTTKAECSQLPAQLRAGCEWRFGWFASSDNPGVVYERVQCPKQLTDITGCVLPDDAQ

SEQ ID NO: 1176 - protein, 203 aa, Neocallimastix californiae
  Barwin-like_endoglucanase
KGTTTRYWDCCKPSCAWPGKFEYKTNIKLCAADGSPLLDNNLISGCEGGPTYTCEDQTPWAVDDVTAYGYAAANIPGLTEADWCCTCYALTFTSFPIKGKQMIVQITNTGGDLGDGHFDLQIPGGGFGLFNGCSPRYPDIPDEDWGDRNGGVISREGCYKLPKSMQEGCLFKFDWFRGADNPDVTYVKVDCPQELLDVSGCTR

SEQ ID NO: 1177 - protein, 102 aa, Neocallimastix californiae
  Barwin-like_endoglucanase
SGDGTAYGDATSGGNCLFPKKEYYNDMMYAALNNKQYNTDMGCGLCAVVVSTSNPYKPIRVRIIDQCPECAHGSLDFSDKAFKALSNKTPDRIKITWALIPC

SEQ ID NO: 1178 - protein, 203 aa, Neocallimastix californiae
  Barwin-like_endoglucanase
TGKTTGYWDCCVASCSWDANVPGAKPVRACRKNGVSLITEELWKVKSVCDNGEGYMCNNNQPIVINDKLAYGFAASHEKCCTCQRLQFTSGNVKGKQMIVQITNTGSDLGSNHFDLQIPGAGVGIFNGCTKQWGAPNDGWGRRYGGVTSKSQCSQLPSQLRAGCEWRFGWFEGSDNPDVVFERVRCPKALTDITGCILPDESQ

SEQ ID NO: 1179 - protein, 212 aa, Neocallimastix californiae
  Barwin-like_endoglucanase
TGKTTRYWDCCLASCSWSENVGASHPVNACKKDGTTLITDISNLWRIKSGCQGGEAYMCNAQQPWIINDKVSYGFVAAGFDSGNQKQWCCSCQKLQFTSGPVAGKQMIVQVTNTGTDLSENHFDIQMPGGGVGIFNGCSSQWNAGSDGWGQRFGGISSVSECSQLPAELRDGCKWRFDWFKNADNPAVVFERVQCPKELTDITGCIPPDDAQ

SEQ ID NO: 1180 - protein, 122 aa, Neocallimastix californiae
  Barwin-like_endoglucanase
NGNYYTQFWSSLPGDYDNYLSCGECYELEITQEDGSLYPEKQRRSENIIAQIVDSCPCSANAKWCCGSGIDHCNEIDFKYGCPIPEDSVHFDLSDIAMARLQTNDPNGGMVEGVIPIRYKRV

SEQ ID NO: 1181 - protein, 27 aa, Neocallimastix californiae
  Barwin-like_endoglucanase
ARNHDWHYSRSTHYGLTYAGACAFGVY

SEQ ID NO: 1182 - protein, 121 aa, Neocallimastix californiae
  Barwin-like_endoglucanase
NGNYYTQFWSSLPGDYDNYLSCGECYEVERTQPDGSSYPKDTKTDNILLQVVDSCPCTANAKWCCGSGVDHCNEIDFKYGCPIPEGSWHVDLSDIAMSRLQTNDPYGTMFDGVIPIRYKRV

SEQ ID NO: 1183 - protein, 27 aa, Neocallimastix californiae
  Barwin-like_endoglucanase
ASDQPWKYSRSTHFGLTYGGACGFGLY

SEQ ID NO: 1184 - protein, 212 aa, Anaeromyces robustus; identical to SEQ ID NO: 1179
  Barwin-like_endoglucanase

SEQ ID NO: 1185 - protein, 122 aa, Anaeromyces robustus; identical to SEQ ID NO: 1180
  Barwin-like_endoglucanase

SEQ ID NO: 1186 - protein, 27 aa, Anaeromyces robustus
  Barwin-like_endoglucanase
ARNHDWHYSRSTHYGLTYAGACAFGVY

SEQ ID NO: 1187 - protein, 198 aa, Anaeromyces robustus; identical to SEQ ID NO: 1135
  Barwin-like_endoglucanase

SEQ ID NO: 1188 - protein, 121 aa, Anaeromyces robustus; identical to SEQ ID NO: 1182
  Barwin-like_endoglucanase

SEQ ID NO: 1189 - protein, 27 aa, Anaeromyces robustus
  Barwin-like_endoglucanase
ASDQPWKYSRSTHFGLTYGGACGFGLY

SEQ ID NO: 1190 - protein, 203 aa, Anaeromyces robustus
  Barwin-like_endoglucanase
KGTTTRYWDCCKPSCAWPGKFEYKTNIKLCNADNSPLLDNNLKSGCEGGPTYTCEDQTPWAVDEVTAYGFAAASIPNQTEADWCCTCYALTFTSFPIKGKQMIVQVTNTGGDLGEGHFDIQIPGGGFGLFNGCSPRYPEIPDEDWGDRNGGVTSRENCYKLPKTMQEGCLFKFDWFRGADNPDVTYVKVDCPKELLEVSGCTR

SEQ ID NO: 1191 - protein, 104 aa, Anaeromyces robustus
  Barwin-like_endoglucanase
YTGDGTTYGDPVTGGYCMMPDSEAYTKDMMFAAMNLPQYNISAGCGSCLILAQADKPDRVIRVRVVDRCGECPKGDIDLSNTAWKALTGDFIPSRVKIIWSIVP

SEQ ID NO: 1192 - protein, 202 aa, Anaeromyces robustus; identical to SEQ ID NO: 1141
  Barwin-like_endoglucanase

SEQ ID NO: 1193 - protein, 211 aa, Anaeromyces robustus
  Barwin-like_endoglucanase
EGVTTRYYDCCKPSCSWPGKADVFHPVRHCAVDGTTLIDDQEAPSACQKDVKGTAHMCENQQPWAINDHLSFGFAAAALPGGESVSCCKCYALTFTDPPIRGKQLVVQVTNTGADVGSNQFDLQIPGGGVGIFDACTNMYGLPAGSNGWGKQYGGITSIEDCESFPESLKEGCKWRFNWLLGADNPKMKFAEVDCPKELTDITGCIRKDAK

SEQ ID NO: 1194 - protein, 200 aa, Anaeromyces robustus; identical to SEQ ID NO: 1146
  Barwin-like_endoglucanase

SEQ ID NO: 1195 - protein, 205 aa, Anaeromyces robustus
  Barwin-like_endoglucanase
TGTTTGYWDCCVASCSWENNVKGGGQPVKACKKDGMTLVTEELWKVKSVCDNGDAYMCNDQQPIVVNDQLALGFAASHEPCCTCQLLQFTSSNVKGKKMIVQVTNTGDDIGNNHFDLQIPGAGVGIFNGCSKQWGAGNDGWGRRYGGVTSQAECSQLPSELRAGCEWRFGWFASSDNPTVTYERVQCPQQLTSITGCVLSDDAQQ

SEQ ID NO: 1196 - protein, 100 aa, Piromyces finnis; identical to SEQ ID NO: 1149
  Barwin-like_endoglucanase

SEQ ID NO: 1197 - protein, 151 aa, Piromyces finnis
  Barwin-like_endoglucanase
YAWKWAKKGKASVTRYGSMGILSCNCKISAMEVGPACAINENAYGGYDGLGSGVACGMCYKLTPYGTSETDQWPKSEADLPGPMVFKVTDICPYNANPKWCPSQESAPKNSVGMEYHFDINVDSWQPETLIKWFGNGSLGTMNVEFELVSC

SEQ ID NO: 1198 - protein, 207 aa, Piromyces finnis; identical to SEQ ID NO: 1151
  Barwin-like_endoglucanase

SEQ ID NO: 1199 - protein, 207 aa, Piromyces finnis; identical to SEQ ID NO: 1152
  Barwin-like_endoglucanase

SEQ ID NO: 1200 - protein, 130 aa, Piromyces finnis
  Barwin-like_endoglucanase
LLASAAKAWEWDWATSGEASMTHYELNGGGGSCNVSAMGNAAGPTAAISGLSYGSWSGLGGGPACGLCYALTVFGSYDGQADPELFPKCSIVVRITDQCPYPDNKEWCPGPEQPESEGFLNPRGMRYHFD

SEQ ID NO: 1201 - protein, 121 aa, Piromyces finnis
  Barwin-like_endoglucanase
NGNYYTQFWSSLPGDYDNYLSCGECYEVERTQPDGSSYPEGEGTDNILLQVVDSCPCTANAKWCCGSGVDHCNEIDFKYGCPIPEGSWHVDLSDIAMSRLQTNDPYGGMVDGVIPIRYKRV

SEQ ID NO: 1202 - protein, 27 aa, Piromyces finnis
  Barwin-like_endoglucanase
AQDQPWKFSRSTHFGLTYGGACGFGLY

SEQ ID NO: 1203 - protein, 106 aa, Piromyces finnis; identical to SEQ ID NO: 1156
  Barwin-like_endoglucanase

SEQ ID NO: 1204 - protein, 103 aa, Piromyces finnis
  Barwin-like_endoglucanase
YSGDGTAYGDATSGGNCLFPKKEYYNDMMYAALNNKQYNDDMGCGLCAVVVSTSNPYKAIRVRIIDQCPECEHGSLDFSDKAFKALSNKTPDRIKITWALIPC

SEQ ID NO: 1205 - protein, 367 aa, Neocallimastix californiae
  Beta_cellobiohydrolase
FTISGNPFSGVEFYINPYYVEEVDGAIAQMSDSSLIAKAEKMKTYSNAIWLDTIKNMQSWLESNLQGAQSQHQSSGKDVLTVFVVYDLPGRDCHALASNGELLANDGDFTRYKSEYIDVIEGHLKTYKSQPVVLIVEPDSLANMVTNLDSTPACRDSEKYYMDGHAYLIKKFGVLPHVAMYLDIGHAFWLGWDDNREKAGKVYAKVISSGAPGKVRGFTDNVANYTPWEDPTLSRGPETEWNPCPDEKRYLQAIQKDFKSAGIQSVYFVCDTSRNGKKVDRKHPGEWCNQTGVGIGARPQASPVSGMEYLDAFYWIKPLGESDGTSDESAARFDGYCGHETAMKPAPEAGQWFQKHFEQGIKNANPP

SEQ ID NO: 1206 - protein, 360 aa, Neocallimastix californiae
  Beta_cellobiohydrolase
NVYEDAEEFYVFPDYQKQVKSSYDKLMAEGETEIAELVAKVARYPTPTWLANTAASKLVPKVLAQVTEQMKKTGKKVLTSFIIYNLPNRDCSAVASRGELGIEHLGVYKEWIDEIAGYFAAHEGPIVAIIEPDALGNMVSNSNSELCAEAFETQMEALVYAITKLNLPNVGVYQDVAQVGWLGWGGNMNLLIPILEQLLNKVGTGVLRGFSSNISNNQPLVRPDPPERTLSGNSSQSEYEYSLKVRENLKKVGMVDFGWVVDTSRNGVPNIKTKGENWCNIKGAGIGRRPEASPADLPGLDAVYWFKPPGESDGSDRVGQWGYDPSCASEDSLTDSPMAGQWFHKQFVELAVNANPSFKD

SEQ ID NO: 1207 - protein, 107 aa, Neocallimastix californiae
  Beta_cellobiohydrolase
EQFTHNGNPFANKEFYINPYYVKEVEGAIAQMSDSSLIAKAEKMKTFSNAIWLDSIKNMQSWLESNLKGALAQQNASGKDVLTVFVVYDLPGRDCHALASNGELLAN

SEQ ID NO: 1208 - protein, 368 aa, Neocallimastix californiae
  Beta_cellobiohydrolase
EQYTHNGNPFSDVEFFINPYYTAEVDAAIAQMSDSSLIAKAEKMKTYSNAIWLDTIKNMNEWLEKNLKGALAQQSGSKKVLTVFVVYDLPGRDCHALASNGELLANDGDLARYKSEYIDVIEGHLKTYKSQPVVLIVEPDSLANLVTNLESTPACADSEKYYLDGHAYLIQKFGILPHVAMYLDIGHAFWLGWDDNREKAAKVYSKVISSGSPGKVRGFTDNVANYTPWEDPTLSRGPDTEWNPCPDEKRYLEAMHKDFKAAGISSVYFVCDTSRNGKKVDRKHPGEWCNQTGVGIGARPQASPVSGMEYLDAFYWIKPLGESDGTSDESAARFDGYCGHETAMKPAPEAGQWFQKHFEQGIKNANPP

SEQ ID NO: 1209 - protein, 329 aa, Neocallimastix californiae
  Beta_cellobiohydrolase
EQYTISGNPFKGVEFYINPYYVEEVDGAIAQMSDSSLIAKAEKMKTYSNAIWLDTIKNMQSWLESNLQGAQSQHQSSGKDILTVFVVYDLPGRDCHALASNGELLANDGDLARYKSEYIDVIEGHLKTYKSQPVVLIVEPDSLANLVTNLESTPACADSEKYYLEGHAYLIKKLGVLPHVAMYLDIGHAFWLGWDDNREKAGKVYAKVISSGAPGNVRGFTDNVSNYTPWEDPTLSRGPETEWNPCPDEKRYLEAISKDFKSAGIKSVYFVSDSSRNGKKVDRKHPGEWCNQTGVGVGARPQASPISSMEYLDAFYWIKPLGESDGTSD

SEQ ID NO: 1210 - protein, 331 aa, Neocallimastix californiae
  Beta_cellobiohydrolase
TPSFFSTGNIYSNSQYQGEVQSSINKLSGELQQQANRVKYTPTAVWLAWDGAPGEVPKHLGAAGGNTAVFMMYWIPTRDCNSNASQGGASDLNSYKNYVDSVYNSFRSYGNSKIVVVVEPDTLGNMVTSQGNENCRRTAVIHKQALAYAINKFGSLNNVQVYLDAGHSQWLTGYEDETAEIIKEILDMAPQGKIRGFSTNVSNFQPVQREYEYHTRLYDALEKVGVKNMRFIVDTSRNGVDISEEFAKTKTWCNFVGTGFGERPKGNPDPVNMPLLDAYMWLKPPAESDGSSTGARADPVCARSDSLPGAPDAGQWFHEYFVQLLKNANPK

SEQ ID NO: 1211 - protein, 368 aa, Neocallimastix californiae
  Beta_cellobiohydrolase
QYTINGNPFANVEFYINPYYVEEVDNAISQMSDSSLIAKAEKMKTYSNAIWLDNIKNMQSWLQPNLEGALSQQNSGGTPVLTVFVVYDLPGRDCHALASNGELLANDSDMERYKSEYIDVIEGHLKTYKSQPVVLVIEPDSLANMVTNIESTPACADSQNYYFDGHAYLLKKLGVFPNVALYLDIGHAFWLGWDDNREKAAKVYAKVIQSGAPAKVRGFVDNVANYTPWEDPTLSRGPDTEWNPCPDEKRYLEAMHKDFTSAGIQSVYFFSDSSRNGKKTDRKHPGEWCNQTGCGIGARPKASPISGMEYLDAFYWVKPIGESDGTSDTSAKRYDGYCGHETAMKPAPEAGQWFQKFFEEGLKNANPP

SEQ ID NO: 1212 - protein, 208 aa, Neocallimastix californiae
  Beta_cellobiohydrolase
YTISGNPFKGVEFYINPYYVDEVDGAIAQMSDSSLIAKAEKMKTYSNAIWLDTIKNMQSWLESNLKGALAEHNSTGKDILTVFVVYDLPGRDCHALASNGELLANSGDMERYKSEYIDVIEGHLKEYNSQPVVLIVEPDSLANLVTNLESTPACRDSEKYYLDGHAYLIQKLGVLPHVAMYLDIGHAFWLGWDDNREKAGKVYAKVIQ

SEQ ID NO: 1213 - protein, 297 aa, Neocallimastix californiae
  Beta_cellobiohydrolase
EQYTINGNPFKGVEFYINPYYVDEVNGAIAQMSDSSLIAKAEKMKTYSNAIWLDTIKNMQSWLESNLEGALSQQESTGKKVLTVFVVYDLPGRDCHALASNGELLANSGDMERYKTEYIDVIEGHLKKYKSQPVVLIVEPDSLANMVTNIETTPACADSQNYYYDGHAYLLKKFGVLPHVAMYLDIGHAFWLGWDDNREKAGKVYAKVIQSGSPGKVRGFTDNVSNYTPWEDPTLSRGPETEWNPCPDEKRYLEAMHKDFKAAGIESVYFVSDTSRNGHKTDRKHPGEWCNQTGVGI

SEQ ID NO: 1214 - protein, 150 aa, Neocallimastix californiae
  Beta_cellobiohydrolase
EQYTISGNPFKGVEFYINPYYVEEVDGAIAQMSDSSLIAKAEKMKTYSNAIWLDTIKNMQSWLESNLQGAQSQHQSSGKDILTVFVVYDLPGRDCHALASNGELLANDGDLARYKSEYIDVIEGHLKTYKSQPVVLIVEPDSLANLVTNL

SEQ ID NO: 1215 - protein, 323 aa, Neocallimastix californiae
  Beta_cellobiohydrolase
QSVAPTENFFDNELYISPNYVKEIESTIPDLSPELQAKAKNVEKVSSAVWLAYEGAPNDVAPHLKAAGSKTVTFILYMIPTRDCNSLASAGGVSDLDKYKGYVDKIANTIKKFPESKVVMVIEPDTLGNLITGETEACKNVHTLHKQALAYAANVFGNMSNVSAYLDAAHSKWLGWAADKVAAVVKEILDNAPNANIRGFSTNVSNYMPIEAEYEYHQKLHDALEEVGIKDKRFIVDTGRSGVDVREEFDVNQTWCNLIYAGLGEPSRGSPDPENMPLLDAFMWLKPPGEADGSDTGSRADPVCGREDSFPGSPDAGSWFGEY

SEQ ID NO: 1216 - protein, 100 aa, Neocallimastix californiae
  Beta_cellobiohydrolase
QYTISGNPFKGVEFYINPYYVEEVDGAIAQMSDSSLIAKAEKMKTYSNAIWLDTIKNMQSWLESNLQGAQSQHQSSGKDILTVFVVYDLPGRDCHALASN

SEQ ID NO: 1217 - protein, 367 aa, Neocallimastix californiae
  Beta_cellobiohydrolase
YTIEGNPFANVEFYINPYYVEEVDNAISQMSDSSLIAKAEKMKTYSNAIWLDNIKNMQSWLEPNLKGALSQQNSGGTPVLTVFVVYDLPGRDCHALASNGELLANDSDMERYKSEYIDVIEGHLKTYKSQPVVLVIEPDSLANMVTNIESTPACADSQTYYYDGHAYLLKKLGVFPNVALYLDIGHAFWLGWDDNREKAAKVYSKVIQSGSPAKVRGFVDNVANYTPWEDPTLSRGPDTEWNPCPDEKRYLEAMHKDFKAAGIQSVYFFSDSSRNGKKTDRKHPGEWCNQTGCGVGARPKASPISGMEYLDAFYWVKPIGESDGTSDTSAKRYDGYCGHETAMKPAPEAGQWFQKFFEEGIKNANPP

SEQ ID NO: 1218 - protein, 90 aa, Neocallimastix californiae
  Beta_cellobiohydrolase
GEQYTHNGNPFANKDFYINPYYVEEIEGAIAQMSDSSLIAKAEKMKTYSNAIWLDSIKNMQSWLETNLKGALSQQNASGKDVLTVFVVYD

SEQ ID NO: 1219 - protein, 362 aa, Neocallimastix californiae
  Beta_cellobiohydrolase
LEGSGNPFKDAEFYINPYYTTEVDAAITKISNASLIAKAEKMKEFSNAIWLDSIKNMNELLESSLNGALAQQESGYKKVLTVFVVYNLPGRDCHALASNGELLANDADFDRYKSEYIDVIEGHLKTYKSQPVVLIVEPNSLTNLVTNLESTPACSDSEKYYREGNAYLIKKFGVLPHVALYLDIGHAYLLGWDDTREKAARLYHDVIRSGAPGNIRGFADNIGGFVPWDDPNLSNGPETEWNPCPDEKRYLKAMYSDFVSAGIHSVKFVTDTSHNGKKFDYSDRELWCKSTSAGVGARPMAIPITTIDYLDAFYWIKPFGNVSELPNQSSFDNVCKDGLEIYSSDTWSQKVFEEGIRNANPP

SEQ ID NO: 1220 - protein, 360 aa, Neocallimastix californiae
  Beta_cellobiohydrolase
NVYEDAEDFFVFPDYQKQVKSSYDKLIAEGETEVAEIVAKVARYPTPTWLANTAASKLVPKVLAQVTEQMKQTGKKILTSFIIYNLPNRDCSAVASRGELGTEHLGVYKEWIDEIAGYFAAHEGPIVAIIEPDALGNMVGNSNSELCAEAFETQMEALVYAITKLNLPNVSVYQDVAQVGWLGWGGNMRLLIPILEQLLNKVGTGVLRGFSSNISNNQPLTKPDPPEKTLSGCTSQSEYEYSLNVREALRKVGMVDFGWVVDTSRNGVPNIKTKGENWCNIKGAGIGRRPEATPEDLPGLDAVYWFKPPGESDGSDREGQFGYDPMCASEDSLTDSPRAGQWFHKQFVELAVNANPSFKD

SEQ ID NO: 1221 - protein, 330 aa, Neocallimastix californiae
  Beta_cellobiohydrolase
IGDNFFENELYSNFKFQGEVDSSIKKLSGNVKQKAEKVKYVPTAAWLAWEGAPNEVPQYLDEAGSKTVVFVLYMIPTRDCNANASAGGTANIDKYKSYVDKIYNTINKYPNSRIVMILEPDTIGNLVTANNANCRNVQNMHKQALSYAISKFGTQSNVRVYLDAAHGAWLNPHADKTAQVIKEILNNAGNGKLRGISTNVSNYQSVASEYKYHQNLNRALENLGVRGLKFIVDTSRNGANVEGAFNASGTWCNFKGAGLGERPKGNPNPGSMPLLDAYMWIKTPGEADGSSQGSRADPVCARGDSLQGAPDAGSWFHDYFVMLINNANPP

SEQ ID NO: 1222 - protein, 330 aa, Neocallimastix californiae
  Beta_cellobiohydrolase
PSFFSSGNIYSNSQYQSEVQSSINKLSGELQQQASRVKYTPTAVWLAWYGAPNEVPKHLGAAGGNTAVFIMYWIPTRDCNSNASQGGASDLNSYKNYVDSVYNTFRSNGNSRIVIVIEPDTIGNIVTSQGNENCRRTAIIHKEALAYAVNKFGSLNNVQVYLDAGHSQWLTGYEDETAAIIKEILDMAPQGKIRGFSTNISNFQPVQREYEYHTRLYDALEKVGISNMRFIVDTSRNGVDISEAFAKTKTWCNFVGTGFGERPKGNPDPINMPLLDAYMWLKPPAESDGSSQGMRADPVCARPDSLPGAPEAGQWFHDYFVQLLRNANPK

SEQ ID NO: 1223 - protein, 368 aa, Neocallimastix californiae
  Beta_cellobiohydrolase
QITLNGNPFANKIFYINPYYVEEVDGAIAQMIDASLISKAEKMKTFSNAIWLDTIKNMQSWLEPNLKGALAQQKSAGKEVLTVFVVYDLPGRDCHALASNGELLANKGDWARYKSEYIDVIEEKLRTYKSQPVVLIVEPDSLANMVTNLDSTPACRDSERYYMDGHAYLIQKFGVLPHVAMYLDIGHAFWLGWDDNRQKAGKVYSKVIQSGAPGKVRGFTDNVANYTPWEDPTLSRGPETEWNPCPDEKRYLEAIHKDFTAVGIPSVYFVCDTSRNGKKVDRKHPGEWCNQTGVGIGARPQASPISGMPYLDAFYWIKPLGESDGTSDTSAARFDGYCGHETAMKPAPEAGQWFQKHFEQGLKNANPP

SEQ ID NO: 1224 - protein, 370 aa, Neocallimastix californiae
  Beta_cellobiohydrolase
QYSLSGNPFAGHKFYVNPYYVDKVDKAIAQMHDYDSSLKFKAEKMKEYSNAIWLDTINNMEAWLERNLKGALAQQNAEGSRVLTVFVVYDLPGRDCQALASNGELLANNGDMKRYKSEYIDIIDRRLSTYKSQPIVLVIEPNSLANLVTNLENIPACADSEKYYLDGHAYLIKKFGSHPHVAMYLDIGHAFWLGWDDKRASAAKIYSKVINPGAPGKVRGFASNVANYTPWEDPELSRGPDTEWNPCPDEKRYIKAMYKEFKAAGISSVYFIEDTSRNGHKTYRNHSGEWCNQMGSGIGARPKAYPVSGMEYLDAFYWVKPYGESDGTSDESDKSFDGYCGHATAMKPAPEAGQWFQKFFEEGLMNANPP

SEQ ID NO: 1225 - protein, 367 aa, Neocallimastix californiae
  Beta_cellobiohydrolase
QYKINGNPFKGVDFYLNPYYVEEVENALNNLIDSSLRSKVEKMKTFSNAIWLDTINNMQSWLEPNLKGALAQHQSTGKDVLTVFVVYDLPGRDCHALASNGELLANDADAQRYKTEYIDVIESHLKQYTAQPVVLIIEPDSLANMVTNLDDPHCSQSESYYMDGHAYLLKKFGVLDHVAMYLDIGHAFWLGWDDNREKAAKLYKKVIDSASPGKVRGFVDNVANYTPWEDPTLSRGPDTDWNPCPDEKRYLEAVKKDFTSAGIKSVYFVSDTSRNGHKTDRKHPGEWCNQTGVGVGARPQASPVSGMDYLDAFYWIKPLGESDGTSDESAVRFDGYCGHDTAMKPAPEAGQWFQAHFEQGVENANPP

SEQ ID NO: 1226 - protein, 368 aa, Neocallimastix californiae
  Beta_cellobiohydrolase
QFKISGNPFKGVDFYLNPYYVEEVENAIKQMTSSSLKAKAEKMKTYSNAIWLDNIKNMQSWLEPNLKGALAQHQSTGKDVLTVFVVYDLPGRDCHAMASNGELLANDSDAQRYKTEYIDVIESHLKKYTAQPVVLIIEPDSLANMVTNIENTPACAESETYYYDGHAYLLKKFGVLDHVAMYLDIGHAFWLGWDDNREKATKVYKKVIDSGSPGKVRGFVDNVANYTPWEDPTLSRGPDTEWNPCPDEKRYLEAMYKDFTSAGIKSVYFVSDSSRNGHKTDRKHPGEWCNQTGVGIGARPQASPISGMDYLDAFYWIKPLGESDGTSDESADRFDGYCGHDTAMKPAPEAGQWFQKHFEQGLENANPP

SEQ ID NO: 1227 - protein, 368 aa, Neocallimastix californiae
  Beta_cellobiohydrolase
QYKISGNPFSGVEFYLNPYYVEEVENAIKQMTSSSLKAKAEKMKTYSNAIWLDNIKNMQSWLEPNLKGALSQHQSTGKDVLTVFVVYDLPGRDCHALASNGELLANDSDAQRYKTEYIDVIEKQLKQYTAQPVVLIIEPDSLANMVTNIETTPACAESQDYYFDGHAYLLKKFGVLDHVAMYLDIGHAFWLGWDDNREKASKVYKKVIDSGSPGKVRGFVDNVANYTPWEDPTLSRGPETEWNPCPDEKRYLQAMYKDFTAAGIKSVYFVSDSSRNGHKTDRKHPGEWCNQTGVGIGARPQASPISGMSYLDAFYWIKPLGESDGTSDESAARFDGYCGHDTAMKPAPEAGQWFQKHFEQGLENANPP

SEQ ID NO: 1228 - protein, 364 aa, Neocallimastix californiae
  Beta_cellobiohydrolase
DQYSHNGNPFKDVEFFINPYYTAEVDAAIAQMSDSSLISKAEKMKTFSNAIWLDTIKNMNEWLEKNLKGALAQQTGNKKVLTVFVVYDLPGRDCHALASNGELLANDSDWARYKTEYIDVIEEKLKTYKSQPVVLIIEPDSLANLVTNLDSTPACRDSEKYYLDGHAYLIQKFGVLKHVAMYLDIGHAFWLGWDDNREKAAKVYSKVISSGAPGEVRGFTDNVANYTPWEDPTLSRGPDTEWNPCPDEKRYLEAIHKDFVSAGIKSVYFVSDTSRNGKKVDRKHPGEWCNQTGVGVGARPQANPVSGMDYLDAFYWIKPLGESDGTSDESAARFDGYCGHETAMKPAPEAGQWFQKHFEQGIKN

SEQ ID NO: 1229 - protein, 368 aa, Neocallimastix californiae
  Beta_cellobiohydrolase
DQYSHNGNPFKDVEFFINPYYTAEVDAAIAQMSDSSLISKAEKMKTFSNAIWLDTIKNMNEWLEKNLKGALAQQTGNKKVLTVFVVYDLPGRDCHALASNGELLANDSDWARYKTEYIDVIEEKLKTYKSQPVVLIIEPDSLANLVTNLDSTPACRDSEKYYLDGHAYLIQKFGVLKHVAMYLDIGHAFWLGWDDNREKAAKVYSKVISSGAPGEVRGFTDNVANYTPWEDPTLSRGPDTEWNPCPDEKRYLEAIHKDFVSAGIKSVYFVSDTSRNGKKVDRKHPGEWCNQTGVGVGARPQANPVSGMDYLDAFYWIKPLGESDGTSDESAARFDGYCGHETAMKPAPEAGQWFQKHFEQGIKNANPP

SEQ ID NO: 1230 - protein, 369 aa, Neocallimastix californiae
  Beta_cellobiohydrolase
EQYTHNGNPFANKIFYINPYYVEEVDGAIAQMSDSSLISKAEKMKTYSNAIWLDSIKNMQSWLESNLKGALSQQNASGQDVLTVFVVYDLPGRDCHALASNGELLANDSDWARYKTEYIDVIEGHLKTYKSQPVVLIIEPDSLANMVTNLDSTPACRDSEKYYMDGHAYLIQKFGVLPHVAMYLDIGHAFWLGWDDNRQKAGKVYSKVISSGAPGKVRGFTDNVANYTPWEDPTLSRGPETEWNPCPDEKRYLEAMYKDFKAAGIESVYFVCDSSRNGKKVDRKHPGEWCNQTGAGVGYRPQANPISGMSYLDAFYWIKPLGESDGTSDESAARFDGYCGHETAMKPAPEAGQWFQKFFEEGLKNANPA

SEQ ID NO: 1231 - protein, 334 aa, Neocallimastix californiae
  Beta_cellobiohydrolase
TTRRPAQTSDNFFENELYSNFKFQGEVDTSIAKLSGQLQEKAKKVKYVPTAAWLAWEGATNEVPQYLNEAGDKTVVFVLYMIPTRDCNANASVGGSGSLDKYKGYVDNIYNTINRYPNSRIVMILEPDTIGNLVTANNDNCRNVQNMHKQALSYAISKFGTQSNVRVYLDAAHGAWLNSHADRTAQVIAEILRNAGNGKIRGISTNISNYQQVSDEYQYHQNLNRALESQGFRGMKFIVDTSRNGQNVTAAFSRNNTWCNFKGAGLGPRPQANPNPNMPLLDAYMWIKTPGEADGSATGSRADPVCARQDSLQGAPDAGSWFHDYFVMLLQNAN

SEQ ID NO: 1232 - protein, 311 aa, Neocallimastix californiae
  Beta_cellobiohydrolase
RKFENFFENELYINQDYVKKIESTLKDMTPELQAKAKNVEKVATAVWLAWEGAPGEVEPHLKAAGNKTITFILYMIPTRDCNSLASAGGAADFEKYQGYVDSIAATIKKYPDAKVNMVIEPDTLGNLITGETEACKKVHDLHRKALSYAVNVFGNMSNVNAYLDAAHHKWLGWGTDKVAALIKDILDNAPDGDIRGISTNVSNYQSIDNEYQYHTDLHAALEAVGITGKKFIVDTGRSGVDVTEEFNVNQTWCNLIYAGLGEKSRGNPDPEKYPLLDAFMWLKPPAESDGSDVGSRADPVCAREDSFPGAP

SEQ ID NO: 1233 - protein, 360 aa, Neocallimastix californiae
  Beta_cellobiohydrolase
NAFAEADDFYVFPDYQKQVKSSYDQLIAEGQNDVAEIVAKVARYPTPTWLANTQASKLVPKVLAQVTEQMKATGKKILTAFIIYNLPNRDCSAVASRGELGIEHLGVYKEWIDEIAGYFKAHEGPIVAIIEPDALGNMVSNSNSELCAEAFDTQMEAIVYAINKLSLPNVSVYQDVAQVGWLGWTGNMNILVPILEQILNKVGTGKLRGFSSNISNNQPLVKPDPPEATLSGNKSQSEYEYSLNVREALRKVGIADMGWVVDTSRNGRTNIKTRGENWCNIKGAGIGRRPEANPADLPELDAVYWFKPPGESDGSDRKGQWGYDPSCASEDSLTDSPMAGQWFHKQFVELAVNAVPSFED

SEQ ID NO: 1234 - protein, 158 aa, Neocallimastix californiae
  Beta_cellobiohydrolase
SFSGNPFAGHKFYINPYYVDEVDKAIAQMNGSLRIKAEKLKEYSNAIWLDTIHKMEVRLERNLRGALAQQNAEGSRVLTVFVVYDLPGRDCQALASNGELLANDGDMKRYKTEYIDIIDSVLISYHSQPIVLVIEPNSLANLVTNLENIPACADSEKY

SEQ ID NO: 1235 - protein, 115 aa, Anaeromyces robustus
  Beta_cellobiohydrolase
QYKISGNPFSGVEFYLNPYYVEEVENAIKQMTSSSLKAKAEKMKTYSNAIWLDNIKNMQSWLEPNLKGALSQHQSTGKDVLTVFVVYDLPGRDCHALASNGELLANDSDAQRYKT

SEQ ID NO: 1236 - protein, 368 aa, Anaeromyces robustus
  Beta_cellobiohydrolase
QYRHNGNPFKGVEFFINPYYVDEVDKAIAQMTNSSLKAKAEKMKTFSNAIWLDTIKNMNEWLERNLKGALAQQNASNKNVLTVFVVYDLPGRDCHALASNGELLANDSDFARYKSEYIDVIETHLKKYTAQPVVLIIEPDSLANMVTNIENTPACAESETYYYDGHAYLLKKFGVLDHVAMYLDIGHAFWLGWDDNREKATKVYKKVIDSGSPGKVRGFVDNVANYTPWEDPTLSRGPDTEWNPCPDEKRYLEAMYKDFTSAGIKSVYFVSDSSRNGHKTDRKHPGEWCNQTGVGIGARPQASPISGMSYLDAFYWIKPLGESDGTSDESAARFDGYCGHDTAMKPAPEAGQWFQKHFEQGLENANPP

SEQ ID NO: 1237 - protein, 322 aa, Anaeromyces robustus
  Beta_cellobiohydrolase
TTRRPAQTSDNFFENELYSNFKFQGEVDTSIAKLSGQLQEKAKKVKYVPTAAWLAWEGATNEVPQYLNEAGDKTVVFVLYMIPTRDCNANASVGGSGSLDKYKGYVDNIYNTINRYPNSRIVMILEPDTIGNLVTANNDNCRNVQNMHKQALSYAISKFGTQSNVRVYLDAAHGAWLNSHADRTAQVIAEILRNAGNGKIRGISTNISNYQQVSDEYQYHQNLNRALESQGFRGMKFIVDTSRNGQNVTAAFSRNNTWCNFKGAGLGPRPQANPNPNMPLLDAYMWIKTPGEADGSATGSRADPVCARQDSLQGAPDAGSWF

SEQ ID NO: 1238 - protein, 101 aa, Anaeromyces robustus
  Beta_cellobiohydrolase
QYKINGNPFKGVDFYLNPYYVEEVENALNNLIDSSLRSKVEKMKTFSNAIWLDTINNMQSWLEPNLKGALAQHQSTGKDVLTVFVVYDLPGRDCHALASNG

SEQ ID NO: 1239 - protein, 360 aa, Anaeromyces robustus; identical to SEQ ID NO: 1233
  Beta_cellobiohydrolase

SEQ ID NO: 1240 - protein, 217 aa, Anaeromyces robustus
  Beta_cellobiohydrolase
TKPVTSNSENFFDNELYINQDYVKKIESSLKSMSPELQAKAKNVEKVATAVWLAWEGAPGEVAPHLKAAGNKTITFILYMIPTRDCNSLASAGGAADFEKYQGYVDSIAATIKKYPNAKVNMVIEPDTLGNLITGETEACKKVHDLHRKALSYAVNVFGNMSNVNAYLDAAHHKWLGWGTDKVAALIKDILDNAPDGDIRGISTNVSNYQSIENEYQ

SEQ ID NO: 1241 - protein, 327 aa, Anaeromyces robustus
  Beta_cellobiohydrolase
RKFENFFENELYINQDYVKKIESTLKDMTPELQAKAKNVEKVATAVWLAWEGAPGEVEPHLKAAGNKTITFILYMIPTRDCNSLASAGGAADFEKYQGYVDSIAATIKKYPDAKVNMVIEPDTLGNLITGETEACKKVHDLHRKALSYAVNVFGNMSNVNAYLDAAHHKWLGWGTDKVAALIKDILDNAPDGDIRGISTNVSNYQSIDNEYQYHTDLHAALEAVGITGKKFIVDTGRSGVDVTEEFNVNQTWCNLIYAGLGEKSRGNPDPEKYPLLDAFMWLKPPAESDGSDVGSRADPVCAREDSFPGAPDAGSWFKEYFIAMLEK

SEQ ID NO: 1242 - protein, 253 aa, Anaeromyces robustus
  Beta_cellobiohydrolase
EQYTISGNPFSGVEFYINPYYVEEVDNAIAQMTDSSLKAKAEKMKTYPNAIWLDNIKNMQSWLQPNLEKALAQQSGSKKVLTVFVVYDLPGRDCHAMASNGELLANDSDAQRYKTEYIDVIEEQLKKYKSQPIVLIIEPDSLANMVTNIETTPACAESQDYYFDGHAYLLKKFGVLQHVAMYLDIGHAFWLGWDDNREKAAKVYKKVIDSGSPGKVRGFVDNVANYTPWEDPTLSRGPDTEWNPCPDEKRYLE

SEQ ID NO: 1243 - protein, 336 aa, Anaeromyces robustus
  Beta_cellobiohydrolase
KTYPTVNPSFFSGNIYSNYQYQSEVQSSINKLSGNLQQQANRVKYVPTAVWLAWDGAPKEVQRHLSSANGSTAVFIMYWIPTRDCNSNASQGGANDLNAYKSYVDDVANTFRSNQGSRIVIVVEPDTIGNMVTSQNNENCRRTAVIHKQALAYAVNRFGSLNNVQVYLDAGHSQWLTGYEDETAAVIKEILDMANQGKIRGFSTNVSNFQPIDKEYEYQTRLYDALENVGITDMRFVIDTSRNGQDISEAFAKTKTWCNLVGTGFGERPKGNPDPINMPLLDAYMWLKPPAESDGSSQGMRADPVCARSDSLPNAPEAGSWFHDYFVQLLRNANPP

SEQ ID NO: 1244 - protein, 360 aa, Anaeromyces robustus
  Beta_cellobiohydrolase
NVYEDAEEFYVFPNYQKQVKSSYDQLIAEGEPEIAEIVAKVAKYPTPTWLTNTDAAKLVPQVLSQVTKQMKKTGKKILTSFIIYNLPNRDCSAVASRGELGIEHLGVYKEWIDEIAGYFKNHEGPIVAVVEPDAFGNMINSNDNELCKEAFDTQMEALVYAITHLNAPNVGVYLDLAQVGWLGWSGNMRFLIPLLEEVLNKVGTGILRGFTSNISNYQPLVKPEVPEVTLSGNPSQSEYEYSLNVREALKKIGMVDFGWVVDTSRNGVSNIKTKGESWCNIKGAGIGRRPEANPPDLPGLDAVYWFKPPGESDGSDRKGQWGYDPSCESVDSLTDSPMAGQWYHKQFVELAVNANPSFKD

SEQ ID NO: 1245 - protein, 317 aa, Anaeromyces robustus
  Beta_cellobiohydrolase
TSNNVNPFAESELYVDPNYQQELDNLSSTIKDPTVIEKVEKMKQYSTGIWLDSIQSVNELLESNLDNAYAQQVESGKNVLTTFVLYNLPGRDCHAITTNGELLAKDSDLERYKHEYIDVIEEIIKKHNNQPIAFVVEPTSLPSIATFKKSTPACADTEKYYLEGHSYLIKKLGVLPNVFLYLDVGHAFWLGWDDLREETAKLYAKVIQSGAPGIVRGFADNISNYVPWDDANLTNGPNTEYNPYPDSKRYIESLRKDFVSVGIKNVNFISDTSLTTINNGSSPVEDWCYNAPLGIGARPQANPVSDMSYLDAFVWIK

SEQ ID NO: 1246 - protein, 335 aa, Anaeromyces robustus
  Beta_cellobiohydrolase
ASNDDPDNFFNNKIYCNQDRKDRVQSSINRLSGELKAKAQKIQDAPTAIWLSWDKAPETVSFHLDEAGNQTAVFILYWIPTRDCNSIASQGGAQSMDEYHTYVNRIVNGFKSHPNSKIVVVVEPDTLGNMITSQSNDNCKKVHNLHKQAIAYAIDTFGQIDNVRTYIDAAHGRWLGSHADEAAAIIKEIIDMAPNSNVRGLSTNVSNYQPTEDEYAYHQKLSAELEKLGVHNMKFIVDTARNGVDVAESLVKTGTWCNVKGTGFGERPRGSPDPVNKPLLDAYMWLKPGGDSDGSSTGDHADPVCEHEDSLPGAGDPGDWFHEYFVQLLTNANPP

SEQ ID NO: 1247 - protein, 38 aa, Piromyces finnis
  Beta_cellobiohydrolase
GYDPVCASEDSLTDSPRAGQWFHKQIVELAVNANPSFA

SEQ ID NO: 1248 - protein, 175 aa, Piromyces finnis
  Beta_cellobiohydrolase
IYDDAEEFYVFPDYQKQIKSSYDKLIAEGENEVAEIVAKVARYPTPTWLASTDSVKLVPKVLAQVTEQMKKTGKKVLTSFIIYNLPNRDCSAQASRGELGIEHLGKYKEWIDEIAGYFAAHEGPIVAIVEPDAMGNMVSHNDNPVCEEAFDTQMEALVSAITKLNMKNVGVYMDL

SEQ ID NO: 1249 - protein, 358 aa, Piromyces finnis
  Beta_cellobiohydrolase
IYDDAEEFYVFPDYQKQIKSSYDKLIAEGENEVAEIVAKVARYPTPTWLASTDSVKLVPKVLAQVTEQMKKTGKKVLTSFIIYNLPNRDCSAQASRGELGIEHLGKYKEWIDEIAGYFAAHEGPIVAIVEPDAMGNMVSHNDNPVCEEAFDTQMEALVYAITKLNMKNVGVYMDLAQVGWLGWSGNMRFLIPILEQLLNKVGTGVLRGFSSNISNTQPLVRPETLDVTLAGNPSQSEYEYSLNVREELKKIGMVDFGWVVDTSRNGVSNIKTKGEYWCNIKGSGIGRRPEANPADLPGLDAVYWFKPPGESDGSDNKNIIGYDPVCASEDSLTDSPRAGQWFHKQIVELAVNANPSFA

SEQ ID NO: 1250 - protein, 358 aa, Piromyces finnis; identical to SEQ ID NO: 1249
  Beta_cellobiohydrolase

SEQ ID NO: 1251 - protein, 215 aa, Piromyces finnis
  Beta_cellobiohydrolase
NNAPTENFFDNELYISPRYVEEIESSMPDMSDELKAKAKNVMNVSSAVWLAWEGAPNEVEGHLKAAGSKTITFILYMIPTRDCNSLASAGGASDLKKYQGIVDKIANTISKYPDVKVAMVIEPDTLGNLITGSTEACKNVHTLHKNALSYAANVFGNMSNVSAYLDAAHGKWLGWAADKTAAVIKEILDNAPNANIRGFSTNVSNYQSIEKEYAY

SEQ ID NO: 1252 - protein, 328 aa, Piromyces finnis
  Beta_cellobiohydrolase
GSSQNFFLNEIYANPRFIEEIDSSIPKLSGDLAAKAEKVKQVPTAVWLAWDGAPGEVEGHLAAAGSKTVVFILYMIPTRDCNSLASAGGASDLKKYQGIVDKIANTISKYPDVKVAMVIEPDTLGNLITGSTEACKNVHTLHKNALSYAANVFGNMSNVSAYLDAAHGKWLGWAADKTAAVIKEILDNAPNANIRGFSTNVSNYQSIEKEYAYHEALNAALEKLGITGKKFIVDTGRSGVDVTEEFDVNQTWCNFVYAGLGEPSRGSPDLEKMPLLDAYMWLKPPGEADGSDVGSRADPVCGREDSFPGSPDAGSWFSEYFISMLEKS

SEQ ID NO: 1253 - protein, 329 aa, Piromyces finnis
  Beta_cellobiohydrolase
NAPTENFFDNELYISPRYVEEIESSMPDMSDELKAKANNVMNVSSAVWLAWEGAPNEVEGHLKAAGSKTITFILYMIPTRDCNSLASAGGASDLKKYQGIVDKIANTISKYPDVKVAMVIEPDTLGNLITGSTEACKNVHTLHKNALSYAANVFGNMSNVSAYLDAAHGKWLGWAADKTAAVIKEILDNAPNANIRGFSTNVSNYQSIEKEYAYHEALNAALEKLGITGKKFIVDTGRSGVDVTEEFDVNQTWCNFVYAGLGEPSRGSPDLEKMPLLDAYMWLKPPGEADGSDVGSRADPVCGREDSFPGSPDAGSWFSEYFISMLEKS

SEQ ID NO: 1254 - protein, 328 aa, Piromyces finnis
  Beta_cellobiohydrolase
NAPTENFFDNELYISPRYVEEIESSMPDMSDELKAKANNVMNVSSAVWLAWEGAPNEVEGHLKAAGSKTITFILYMIPTRDCNSLASAGGASDLKKYQGIVDKIANTISKYPDVKVAMVIEPDTLGNLITGSTEACKNVHTLHKNALSYAANVFGNMSNVSAYLDAAHGKWLGWAADKTAAVIKEILDNAPNANIRGFSTNVSNYQSIEKEYAYHEALNAALEKLGITGKKFIVDTGRSGVDVTEEFDVNQTWCNFVYAGLGEPSRGSPDLEKMPLLDAYMWLKPPGEADGSDVGSRADPVCGREDSFPGSPDAGSWFSEYFISMLEK

SEQ ID NO: 1255 - protein, 207 aa, Piromyces finnis
  Beta_cellobiohydrolase
EPDTLGNLVTGSSEACKTVHTLHKNALSYAVNVFGAMSNVSVYLDAAHGKWLGGVTDKVATVVKEILDGAPNGKIRGLSTNVSNYQPVSAEYGYHQKLASSLSAVGVSDMHFIVDTGRNGVDVSSTFSINETWCNFVGTGFGERPQGNPSGMPLLDAYMWLKPPGEADGSDVGSRADPVCGREDSFPGSPDAGSWFSEYFISMLEKS

SEQ ID NO: 1256 - protein, 368 aa, Piromyces finnis
  Beta_cellobiohydrolase
QYTHSGNPFKGHKFFINPYYTAEVDAAIAQMSNSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQAFFEEGLKNANPP

SEQ ID NO: 1257 - protein, 368 aa, Piromyces finnis
  Beta_cellobiohydrolase
QYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQKHFEQGLENANPP

SEQ ID NO: 1258 - protein, 368 aa, Piromyces finnis; identical to SEQ ID NO: 1256
  Beta_cellobiohydrolase

SEQ ID NO: 1259 - protein, 368 aa, Piromyces finnis; identical to SEQ ID NO: 1256
  Beta_cellobiohydrolase

SEQ ID NO: 1260 - protein, 368 aa, Piromyces finnis
  Beta_cellobiohydrolase
QYTHSGNPFKGHKFFINPYYTAEVDAAIAQMSNSSLIAKAEKMKEYSNAIWLDTIENMNNWLERNLKTALAEQNQTGKTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQAFFEEGLKNANPP

SEQ ID NO: 1261 - protein, 368 aa, Piromyces finnis
  Beta_cellobiohydrolase
QYTHSGNPFKGHKFFINPYYTAEVDAAIAQMSNSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQKHFEQGLENANPP

SEQ ID NO: 1262 - protein, 368 aa, Piromyces finnis
  Beta_cellobiohydrolase
QYTHSGNPFKGHKFFINPYYTAEVDAAIAQMSNSSLIAKAEKMKEYSNAIWLDTIENMNNWLERNLKTALAEQNQTGKTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQKHFEQGLENANPP

SEQ ID NO: 1263 - protein, 368 aa, Piromyces finnis
  Beta_cellobiohydrolase
QYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQAFFEEGLKNANPP

SEQ ID NO: 1264 - protein, 368 aa, Piromyces finnis; identical to SEQ ID NO: 1263
  Beta_cellobiohydrolase

SEQ ID NO: 1265 - protein, 368 aa, Piromyces finnis; identical to SEQ ID NO: 1263
  Beta_cellobiohydrolase

SEQ ID NO: 1266 - protein, 368 aa, Piromyces finnis; identical to SEQ ID NO: 1256
  Beta_cellobiohydrolase

SEQ ID NO: 1267 - protein, 368 aa, Piromyces finnis; identical to SEQ ID NO: 1257
  Beta_cellobiohydrolase

SEQ ID NO: 1268 - protein, 368 aa, Piromyces finnis; identical to SEQ ID NO: 1261
  Beta_cellobiohydrolase

SEQ ID NO: 1269 - protein, 368 aa, Piromyces finnis; identical to SEQ ID NO: 1261
  Beta_cellobiohydrolase

SEQ ID NO: 1270 - protein, 368 aa, Piromyces finnis; identical to SEQ ID NO: 1256
  Beta_cellobiohydrolase

SEQ ID NO: 1271 - protein, 368 aa, Piromyces finnis; identical to SEQ ID NO: 1263
  Beta_cellobiohydrolase

SEQ ID NO: 1272 - protein, 368 aa, Piromyces finnis; identical to SEQ ID NO: 1256
  Beta_cellobiohydrolase

SEQ ID NO: 1273 - protein, 368 aa, Piromyces finnis; identical to SEQ ID NO: 1260
  Beta_cellobiohydrolase

SEQ ID NO: 1274 - protein, 330 aa, Piromyces finnis
  Beta_cellobiohydrolase
PTSDNFFDNTLYSNFKFQAEVQSSINKLSGSLAEKAKKVKYVPTAAWLAWEGAPAEVPQYLDEAGSNTVVFVLYMIPTRDCNANASAGGSSNIEKYKGYVDKIYNTINQYPNSRIVMILEPDTIGNLVTANNDNCRNVQNMHKQALSYAISKFGTQSNVRVYLDAAHGAWLSSHADKTAQVIKEILNNAGNGKLRGISTNVSNYQTVNDEYNYHMRLNSALENLGVRGMKFIVDTSRNGANISGAFNASGTWCNFKGAGLGARPQGSPDPSKPLLDAYMWIKTPGEADGSSSGSRADPVCARYDSLQGAPDAGSWFHDYFVMLVQNANPA

SEQ ID NO: 1275 - protein, 368 aa, Piromyces finnis
  Beta_cellobiohydrolase
QYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRYDGYCGHRTAMKPAPEAGQWFQAFFEEGLKNANPP

SEQ ID NO: 1276 - protein, 368 aa, Piromyces finnis
  Beta_cellobiohydrolase
QYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNIESTPACAKSEKYYYDGHAYLIKKFGVLPHVSMYLDIGHAFWLGWDDNREKAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRYDGYCGHRTAMKPAPEAGQWFQAFFEEGLKNANPP

SEQ ID NO: 1277 - protein, 368 aa, Piromyces finnis; identical to SEQ ID NO: 1275
  Beta_cellobiohydrolase

SEQ ID NO: 1278 - protein, 368 aa, Piromyces finnis; identical to SEQ ID NO: 1276
  Beta_cellobiohydrolase

SEQ ID NO: 1279 - protein, 368 aa, Piromyces finnis; identical to SEQ ID NO: 1276
  Beta_cellobiohydrolase

SEQ ID NO: 1280 - protein, 368 aa, Piromyces finnis; identical to SEQ ID NO: 1275
  Beta_cellobiohydrolase

SEQ ID NO: 1281 - protein, 368 aa, Piromyces finnis; identical to SEQ ID NO: 1275
  Beta_cellobiohydrolase

SEQ ID NO: 1282 - protein, 368 aa, Piromyces finnis; identical to SEQ ID NO: 1275
  Beta_cellobiohydrolase

SEQ ID NO: 1283 - protein, 368 aa, Piromyces finnis; identical to SEQ ID NO: 1275
  Beta_cellobiohydrolase

SEQ ID NO: 1284 - protein, 368 aa, Piromyces finnis; identical to SEQ ID NO: 1275
  Beta_cellobiohydrolase

SEQ ID NO: 1285 - protein, 368 aa, Piromyces finnis; identical to SEQ ID NO: 1276
  Beta_cellobiohydrolase

SEQ ID NO: 1286 - protein, 368 aa, Piromyces finnis; identical to SEQ ID NO: 1275
  Beta_cellobiohydrolase

SEQ ID NO: 1287 - protein, 254 aa, Neocallimastix californiae
  Beta-D-glucan exohydrolase, C-terminal domain
VVLLKNDEDILPISGDKYKKIAIIGDGALPTKQCTDNGCSEGKMSGVVALGWGSGTTNMENISDPLSALTERAEKDGITITSFTDDDSDTDKAAEVAADADLAIVVVVADSGEEYISVEGNKGDRKNLDLWHNGNELVSAVAAANKNTVVVIYSPGVVNLPFIDEVNGLVYAGMPGQEAGHGLADILFNDVAPSGKLPFTWGKKREDYCCDVVTGGKGKTQVPYEEGYYIGYKWFDKKNIEPHFSFGHGLTYAK

SEQ ID NO: 1288 - protein, 22 aa, Neocallimastix californiae
  Beta-D-glucan exohydrolase, C-terminal domain
RWFDKKGIVPTFPFGHGLSYTT

SEQ ID NO: 1289 - protein, 200 aa, Neocallimastix californiae
  Beta-D-glucan exohydrolase, C-terminal domain
VLLKNADSILPLTNKYKKIAIIGKDADKAQKCNDSACTNGNIIQGWGSGTTDFVGVSDPFSAIKNRASKDGISVVSSLSDNSSEGANAARGADVALVFVRASSGEEYIVVDNNKGDRNNLDLWHGGNDLVKSVAAVNKNTIVVIHAPATVNLPFLDNVKAVIHAGMPGAESGNAIASILFGDSNPSGHLPFTWAPREDYC

SEQ ID NO: 1290 - protein, 254 aa, Neocallimastix californiae
  Beta-D-glucan exohydrolase, C-terminal domain
VVLLKNDEEILPISADKYKKIAIIGNGALPTEVCTDNGCKSQISGVVALGWGSGTTNMENISDPLSALTERAEKDGITITSFTEDDSDTEKAAEVAADADLAIVVVVADSGEGYLTVEGNSGDRKDLDLWHNGNDLVAAVAAANKNTVVVIYSPGVVNLPFLDDINGLVYAGMPGQEAGHGLADVLFNDVAPSGKLPFTWGKKREDYCCDIVPGRGNEITQVKYTEGYYIGYKWFDKEKIEPHFSFGHGLTYAK

SEQ ID NO: 1291 - protein, 254 aa, Neocallimastix californiae
  Beta-D-glucan exohydrolase, C-terminal domain
VVILKNDDDVLPISPKKYKKIAIIGDGALPMKLCEDNGCKDKISGVVALGWGSGTTNMENISDPLSAITERAEKDGITITSFTEDDDDTDKAAEVAADADLAIVVVVADSGEGYLTVEGNSGDRKDLDLWHNGNELVAAVAAANKNTVVVIYSPGVVNLPFVDDVKTILYAGMPGQEAGHGLADILFNDVAPTGKLPFTWGKKREDYCCDVVKGKGNSITQVEYSEGYYIGYKWFDKQNIKPLFPFGHGLTYAK

SEQ ID NO: 1292 - protein, 254 aa, Anaeromyces robustus; identical to SEQ ID NO: 1291
  Beta-D-glucan exohydrolase, C-terminal domain

SEQ ID NO: 1293 - protein, 22 aa, Anaeromyces robustus
  Beta-D-glucan exohydrolase, C-terminal domain
RWFDKKGTKPIYPFGHGLSYTT

SEQ ID NO: 1294 - protein, 200 aa, Anaeromyces robustus
  Beta-D-glucan exohydrolase, C-terminal domain
ILLKNDDNVLPLTKKYRKIAVIGKDADKAESCTDTACTNGNIIQGFGSGTTDFTGITDPYSSIKNRASKEGITVVGSISDSANEGANAARDADVAIVFVRATSGEEYIVVDNNKGDRNNLDLWHGGNDLVKSVAAVNKNTIVVIHAPATVNLPFINNVKAIIHAGMPGAESGNAIASVLFGDHNPSGHLPFTWAKREEYC

SEQ ID NO: 1295 - protein, 254 aa, Anaeromyces robustus
  Beta-D-glucan exohydrolase, C-terminal domain
VVLLKNDEDILPISPKKYKKIAIIGDGARPTKPCTDNGCAQGKMSGVVVLGWGSGTTNMENISDPLSALTERAEKDGITITSFTEDDSDTDKAAEVAADADLAIVVVTASSGEEYITVEGNQGDRKNLDLWHNGNELVSAVAAANKNTVVVIYSPGVVNLPFLDDIKGLVYAGMPGQEAGHGLADILFNDVAPSGKLPFTWGKKREDYCCDIVYGNDKIIDIPYSEGFYLGYKWFDKEKIEPHFSFGHGLTYAK

SEQ ID NO: 1296 - protein, 254 aa, Piromyces finnis
  Beta-D-glucan exohydrolase, C-terminal domain
VVLLKNDKDILPISGKKYGKIAIIGDGALPTKLCTDNGCTQGKMSGVVALGWGSGTTNMEDISDPLSALTERAEKDGITVTSFTDDDEDTEKAAQVASDADLAIVVVTANSGEGYLTVEGNSGDRKNLDLWHNGNELVAAVAAANPNTVVVIYSPGVVNLPFIDDVDGLVYAGMPGKEAGHGLADILFHDVSPSGKLPFTWGKKREDYCCDVVYGNDKIIDVPYTEGFYLGYKWFDKEKIEPHFSFGHGLTYAK

SEQ ID NO: 1297 - protein, 254 aa, Piromyces finnis
  Beta-D-glucan exohydrolase, C-terminal domain
VVLLKNDKDILPISGKKYGKIAIIGDGALPTKLCTDNGCTQGKMSGVVALGWGSGTTNMEDISDPLSALTERAEKDGITVTSFTDDDEDTEKAAQVASDADLAIVVVTANSGEGYLTVEGNSGDRKNLDLWHNGNELVAAVAAANPNTVVVIYSPGVVNLPFIDDVDGLVYAGMPGKEAGHGLADILFHDVSPSGKLPFTWGKKREDYCCDIVSNNDVYPKIEYSEGFYLGYKWFDKEKIEPHFSFGHGLTYAK

SEQ ID NO: 1298 - protein, 1013 aa, Neocallimastix californiae
  BETA-GALACTOSIDASE
NENWDLVVVQNSNQAQSHINSGCFKSDFRPSADHGWKTVQLPKSWTCQGFDFSIYTNVNQPWQSRYDSYVPVPEAPVNYNPVGLYRKKFTLDSSMRKSGRRIYIEFDGVESAYYVYVNGQAVGYSEDTFSPHRFDITDVLSSGENTLAVEVHKFCDGTWFEDQDMIYDGGIFRDVFLVSAPDVQIRDYTVRTDLDSSFTNANLEISMDIRNLSGGEKSGWGVIAEAYDEAGNNILKGASIKLDRLNTNKDNTFVLKTSVNSPKLWSAEIPNLYALVLKLTDNSGNVQEILSTQLGFRKIGFTRAEVNWAYQLTTNNWQPITINGKRLLIKGVNRHDSDPFNGRAVPQQTLREDIALMKKHNINAIRTSHYSNDSYLYWLCNKYGMYVMGETNLESHALQNNHDAKAKFYELGMDRTETAYKRLKNNPSIFAWSIGNEMAYTNNPNDAGGLFRDMIWYFKKNDSSRPVHSEGQGSSMGVDMSSNMYPGSDGLGVHAGRGKMPYIMCEYDIASGNAIGALKEYWDVIRSADNMLGGFIWDWVDQSRAKTLNGGWDYYSQSYAITNLYSEEIKGKFYAYGGDWGDWPNDNSFCVNGLINPDRTPQPELAEVKFQYQSFWFSADASQLDNKQVSVYNENNFLNLNDFDVSWTLLKNGIAIKTGNVKNANVAPLTKGTLKVPFEIPQDSLAGDEFYLDMSVKVKNGSDLLPEGTEISYGQFHLYSTGKPVKYDKGSDSITIDNNSSSYSISGKNFNFIIDKSTGTLKNYKYKGETLINEGPTPNFFRGYVENDYNGSNWAKTFDPNWRNAMNGARVNSIDVKNGVGSEKIIVSHLSLPKAGNTKVDITYTIQSNGSIDVELNVDGTRAGLGNYLRVGSIMILPKGAEKLSWYGNGPVETFNDRKTNGRKGVWENTVSGMFYPFMKADDCGNLTDIKWIAVQNNGKGASLLIAADGTVEASALHFTPEDLMRADHPFKLKPRKETILSVDYGSMGTGSATCGQATLDKYRLPSGKQYRW

SEQ ID NO: 1299 - protein, 1013 aa, Neocallimastix californiae; identical to SEQ ID NO: 1298
  BETA-GALACTOSIDASE

SEQ ID NO: 1300 - protein, 1029 aa, Neocallimastix californiae
  BETA-GALACTOSIDASE
YNAREDSSYLQMLTGKNQNWDLVVEQNAQKAQNHINNGCFKPNYQPSSNNGWKTVQLPKSWTCQGFDFSIYTNVGQPWQSNYDGYVPVPQAPTNYNPVGLYRKKFTVDSTMRQSGRRIYIEFDGVESAYYVYVNGQAIGYSEDTFSPHRFDITDALTNGENTLAVEVHKFCDGTWFEDQDMIYDGGIFRDVFLVSAPSVQIRDYTVRTDLDSSFSNASLEISMDIRNLSGGAKSGWSVTAEAYDEAGKNILSGATVKLDNLANGRDTTSVLKTSVKSPKLWSAETPNLYALVLKLTDDKGTVQEILSAQLGFRKIGFTKAEVDRSYRVTTSNWQPITINGKRLLLKGVNRHDTDPFNGKAIPQATMEMDITLMKTNNINAIRTSHYSNDSYLYWLCNKYGMYVMGETNMESHALMDNNDAKALFYEVGLDRTETAYKRLKNHPSIVAWSIGNEMAYTSNPSDAGGLFRDMIWYFKKNDNSRPVHSEGQGGSMGVDMSSNMYPSSDGIRGNAGKGKMPYVMCEYDHAMGNSVGALKEYWDGIRSADNMLGGFIWDWVDQSRATPLKGGWDYYSESYAKTNLYAEEIKGKFYGYGGDWGDWPNDNSFCVNGLISPDRTPQPELAEVKYQYQSFWFSADASQLEKQEVSVYNENNFLNINEFDITWTVLKNGIAISNGVVQNANVGPLTKGTLKVPFEVPEKPLAGDEFFLDMSVKVKKGTKMLPEGTEIAYGQIPITVIGTSAKLNKAADAVNVSETSNGFSVSGKNFQFTVDKSTGTIKSYTYNGATLITEGPTPNFWRGYVENDNNGGGWVKAFDPSWRSAMEGARCDGVSTKNGSDGDKIITSRLTLPKAGSTKVDITYTIHGDGSVDVEFNVDASRAGLGNFLRVGSIMKLPTGAEKLSWYGNGPVETFNDRKTNGRMGVWESTVTDMFFPYMKADDTGNLTDLKWISVQNEKKSASILIAAEGKVEGSALHFTPEDLMRADHPFKLSPRKETYLSVDYGSMGTGSATCGQGTLDKYRLPSNRQYNW

SEQ ID NO: 1301 - protein, 1029 aa, Neocallimastix californiae; identical to SEQ ID NO: 1300
  BETA-GALACTOSIDASE

SEQ ID NO: 1302 - protein, 1029 aa, Piromyces finnis
  BETA-GALACTOSIDASE
YNAREQSDYLQMLTGKNENWDLVVEQNSNKAQTHINSGCFKPDYKPSSSWKTVQLPKSWTCQGFDFSIYTNIGQPWQSNYDTDIPVPHAPTNYNPVGLYRKKFMVDSTMRQSGRRIYIEFDGVESAYYVYVNGQGVGYSEDTFSPHRFDITDFLVNGENTLAVEVHKFCDGTWFEDQDMIYDGGIFRDVFLVSAPAVQIRDYTVRTDLDNSFSTANLEISMEIRNLSGSSKNGWSVIAEAYDEAGYNILSGASVKLGGLSNGKDSNAVLKTSVKSPKLWSAETPNIYALVLKLIDENGRTQEILSTQLGFRKIGFTRAEVDWSYSVTTKNWQPITINGKRLLLKGVNRHDTDPFNGKAIPQETMREDITLMKKNNINAIRTSHYSNDSYLYWLCNKYGMYVMGETNMESHALMDNNDGKALFYELGLDRTETAYKRLKNNPSIVAWSIGNEMAYTGNPSDAGGLFRDMIWYYKKNDNTRPVHSEGQGGGMGVDMSSNMYPSSDGIRGNAGKGKMPYVMCEYDHAMGNSVGALKEYWDAIRSADNMLGGFIWDWVDQSRAVPIKSGGWDYYSESYAKTNLYSSEIKGKFYGYGGDWGDRPNDNSFCVNGLINPDRTPQPELAEVKFQYQSFWFSADASQLDNQEVSVYNENNFLNINQFDVTWTLLKNGIAIDSGIVRNANVAPLSKGTLKVPFVIPMDSLAGDEYYLDMSVKVKNGTDMLPEGTEIAYGQIALASKGMTAKYNKGNDSISVTENQNSYILSGKNFEFLINKSSGLLSTYKYRGETIITEGPTPNFWRGYVENDNNGAGWAKTFDSNWRNAMNGARCDKIEVNNGSDSSEKIIVSHLTLPKVGSTKVDITYTVHCDGSVDVEFNVDATRSDLGNFLRVGSMMKLPEGFEKLSWYGNGPVETFNDRKTNGRMGVWESTVTDMFYPYMKADDCGNLTDLKWISVQSKKRSASILVVAEGAVEGSALHFAPEDLMRADHPYKLRPLKTTILSVDYGSMGTGSATCGQATLDKYRLPSDRPYNW

SEQ ID NO: 1303 - protein, 1029 aa, Piromyces finnis; identical to SEQ ID NO: 1302
  BETA-GALACTOSIDASE

SEQ ID NO: 1304 - protein, 114 aa, Neocallimastix californiae
  beta-Galactosidase/glucuronidase domain
VQIRDYTVRTDLDSSFTNANLEISMDIRNLSGGEKSGWGVIAEAYDEAGNNILKGASIKLDRLNTNKDNTFVLKTSVNSPKLWSAEIPNLYALVLKLTDNSGNVQEILSTQLGF

SEQ ID NO: 1305 - protein, 110 aa, Neocallimastix californiae
  beta-Galactosidase/glucuronidase domain
KFQYQSFWFSADASQLDNKQVSVYNENNFLNLNDFDVSWTLLKNGIAIKTGNVKNANVAPLTKGTLKVPFEIPQDSLAGDEFYLDMSVKVKNGSDLLPEGTEISYGQFHL

SEQ ID NO: 1306 - protein, 109 aa, Neocallimastix californiae
  beta-Galactosidase/glucuronidase domain
KYQYQSFWFSADASQLEKQEVSVYNENNFLNINEFDITWTVLKNGIAISNGVVQNANVGPLTKGTLKVPFEVPEKPLAGDEFFLDMSVKVKKGTKMLPEGTEIAYGQIP

SEQ ID NO: 1307 - protein, 114 aa, Neocallimastix californiae
  beta-Galactosidase/glucuronidase domain
VQIRDYTVRTDLDSSFSNASLEISMDIRNLSGGAKSGWSVTAEAYDEAGKNILSGATVKLDNLANGRDTTSVLKTSVKSPKLWSAETPNLYALVLKLTDDKGTVQEILSAQLGF

SEQ ID NO: 1308 - protein, 111 aa, Piromyces finnis
  beta-Galactosidase/glucuronidase domain
KFQYQSFWFSADASQLDNQEVSVYNENNFLNINQFDVTWTLLKNGIAIDSGIVRNANVAPLSKGTLKVPFVIPMDSLAGDEYYLDMSVKVKNGTDMLPEGTEIAYGQIALA

SEQ ID NO: 1309 - protein, 114 aa, Piromyces finnis
  beta-Galactosidase/glucuronidase domain
VQIRDYTVRTDLDNSFSTANLEISMEIRNLSGSSKNGWSVIAEAYDEAGYNILSGASVKLGGLSNGKDSNAVLKTSVKSPKLWSAETPNIYALVLKLIDENGRTQEILSTQLGF

SEQ ID NO: 1310 - protein, 78 aa, Neocallimastix californiae
  beta-N-acetylhexosaminidase-like domain
SLNTTIGEEAAVIFGTVGKSNLFEGVDVSAIKDKYESYVFNVQGNRIYIAGSDKRGTIYGLFHLSELMGVSPFVDWLD

SEQ ID NO: 1311 - protein, 50 aa, Neocallimastix californiae
  beta-N-acetylhexosaminidase-like domain
LKGRWESYQMQVIKNPINGVSEALVIVGSDKRGTLYGMFHISEMMGVSPW

SEQ ID NO: 1312 - protein, 132 aa, Neocallimastix californiae
  BETA/GAMMA CRYSTALLIN
LINRRSNKALAVQNDSKDNAANVVQWTESNKTSQQWKITEDGGYRILNVNADKALDVERDSTQNGGNIIIWPDTGNLNQRWTIEDAGNGYVEIVNLSSGKALDVENESTADGANVCQWDAHGSQNQQWKLVP

SEQ ID NO: 1313 - protein, 133 aa, Neocallimastix californiae
  BETA/GAMMA CRYSTALLIN
LINRNSGKALGVDGDSTSNAANVHQWTDNGKTSQQWIITDEGYGYKIMNVNANKALDVNENSTKNGGNVIIWSDNGNLNQRWYIEEIGDGYITLQNINSGLLLDVEKSSTSDGGNVLQWENNGNSNQQWKLIR

SEQ ID NO: 1314 - protein, 133 aa, Anaeromyces robustus; identical to SEQ ID NO: 1313
  BETA/GAMMA CRYSTALLIN

SEQ ID NO: 1315 - protein, 133 aa, Piromyces finnis
  BETA/GAMMA CRYSTALLIN
IINRQSGKVLSVNNDSTANAANVIQWSESNKSSQQWVISEEGDYFSLINVNAKKALDVNENSTENGGNVIIWPDTGALNQRWSIQSTGDGYYTITNANSGKNLDVEKGSMSDGGNVLQWGNNGGANQQWKLVR

SEQ ID NO: 1316 - protein, 133 aa, Piromyces finnis; identical to SEQ ID NO: 1315
  BETA/GAMMA CRYSTALLIN

SEQ ID NO: 1317 - protein, 274 aa, Neocallimastix californiae
  Bgal_small_N
SISGKNFNFIIDKSTGTLKNYKYKGETLINEGPTPNFFRGYVENDYNGSNWAKTFDPNWRNAMNGARVNSIDVKNGVGSEKIIVSHLSLPKAGNTKVDITYTIQSNGSIDVELNVDGTRAGLGNYLRVGSIMILPKGAEKLSWYGNGPVETFNDRKTNGRKGVWENTVSGMFYPFMKADDCGNLTDIKWIAVQNNGKGASLLIAADGTVEASALHFTPEDLMRADHPFKLKPRKETILSVDYGSMGTGSATCGQATLDKYRLPSGKQYRWKFTI

SEQ ID NO: 1318 - protein, 272 aa, Neocallimastix californiae
  Bgal_small_N
ISGKNFNFIIDKSTGTLKNYKYKGETLINEGPTPNFFRGYVENDYNGSNWAKTFDPNWRNAMNGARVNSIDVKNGVGSEKIIVSHLSLPKAGNTKVDITYTIQSNGSIDVELNVDGTRAGLGNYLRVGSIMILPKGAEKLSWYGNGPVETFNDRKTNGRKGVWENTVSGMFYPFMKADDCGNLTDIKWIAVQNNGKGASLLIAADGTVEASALHFTPEDLMRADHPFKLKPRKETILSVDYGSMGTGSATCGQATLDKYRLPSGKQYRWKFT

SEQ ID NO: 1319 - protein, 274 aa, Neocallimastix californiae
  Bgal_small_N
SVSGKNFQFTVDKSTGTIKSYTYNGATLITEGPTPNFWRGYVENDNNGGGWVKAFDPSWRSAMEGARCDGVSTKNGSDGDKIITSRLTLPKAGSTKVDITYTIHGDGSVDVEFNVDASRAGLGNFLRVGSIMKLPTGAEKLSWYGNGPVETFNDRKTNGRMGVWESTVTDMFFPYMKADDTGNLTDLKWISVQNEKKSASILIAAEGKVEGSALHFTPEDLMRADHPFKLSPRKETYLSVDYGSMGTGSATCGQGTLDKYRLPSNRQYNWKFTI

SEQ ID NO: 1320 - protein, 272 aa, Neocallimastix californiae
  Bgal_small_N
VSGKNFQFTVDKSTGTIKSYTYNGATLITEGPTPNFWRGYVENDNNGGGWVKAFDPSWRSAMEGARCDGVSTKNGSDGDKIITSRLTLPKAGSTKVDITYTIHGDGSVDVEFNVDASRAGLGNFLRVGSIMKLPTGAEKLSWYGNGPVETFNDRKTNGRMGVWESTVTDMFFPYMKADDTGNLTDLKWISVQNEKKSASILIAAEGKVEGSALHFTPEDLMRADHPFKLSPRKETYLSVDYGSMGTGSATCGQGTLDKYRLPSNRQYNWKFT

SEQ ID NO: 1321 - protein, 275 aa, Piromyces finnis
  Bgal_small_N
ILSGKNFEFLINKSSGLLSTYKYRGETIITEGPTPNFWRGYVENDNNGAGWAKTFDSNWRNAMNGARCDKIEVNNGSDSSEKIIVSHLTLPKVGSTKVDITYTVHCDGSVDVEFNVDATRSDLGNFLRVGSMMKLPEGFEKLSWYGNGPVETFNDRKTNGRMGVWESTVTDMFYPYMKADDCGNLTDLKWISVQSKKRSASILVVAEGAVEGSALHFAPEDLMRADHPYKLRPLKTTILSVDYGSMGTGSATCGQATLDKYRLPSDRPYNWKFTI

SEQ ID NO: 1322 - protein, 273 aa, Piromyces finnis
  Bgal_small_N
LSGKNFEFLINKSSGLLSTYKYRGETIITEGPTPNFWRGYVENDNNGAGWAKTFDSNWRNAMNGARCDKIEVNNGSDSSEKIIVSHLTLPKVGSTKVDITYTVHCDGSVDVEFNVDATRSDLGNFLRVGSMMKLPEGFEKLSWYGNGPVETFNDRKTNGRMGVWESTVTDMFYPYMKADDCGNLTDLKWISVQSKKRSASILVVAEGAVEGSALHFAPEDLMRADHPYKLRPLKTTILSVDYGSMGTGSATCGQATLDKYRLPSDRPYNWKFT

SEQ ID NO: 1323 - protein, 9 aa, Neocallimastix californiae
  BNR
YSTDGGYTW

SEQ ID NO: 1324 - protein, 10 aa, Neocallimastix californiae
  BNR
YYTTDNGATW

SEQ ID NO: 1325 - protein, 44 aa, Neocallimastix californiae
  Carb_bind
SCGKQCYSPQNYVCLANDLLCPVGLKGCNGGCYDPAVYSCVNNE

SEQ ID NO: 1326 - protein, 44 aa, Anaeromyces robustus
  Carb_bind
SCGKQCYSPQEYVCYKNDLLCPVGTKGCNIACYNPAIYSCVNNE

SEQ ID NO: 1327 - protein, 44 aa, Piromyces finnis
  Carb_bind
SCGKQCYSPENYICYSNNLLCPLGTKGCNDACYDPLLYSCVNNS

SEQ ID NO: 1328 - protein, 93 aa, Neocallimastix californiae
  Carbohydrate-binding domain
ITKTWTGDTTTYSECTGEIINASKLKINNWYIEVPFDSADHQFYGSWGCEVDVQSDKLVLTGEVTNAVLKVLTNTTFGFIVSSNGKKFDVEQA

SEQ ID NO: 1329 - protein, 85 aa, Neocallimastix californiae
  Carbohydrate-binding domain
EIKIGKSWETDNVSYVQYDGEINNASKLKINNWYIEIPYNKGKNKLHGNWGCEIEEQADKIILTGGDVNGVIKVSTVATFGFIVS

SEQ ID NO: 1330 - protein, 78 aa, Neocallimastix californiae
  Carbohydrate-binding domain
SECTGEIINASKLKLNNWYIEVPFSGDKNKFLGSWGCVVDVQSDKLVLTGEVTNAVLKVLTNTTFGFIVSSEGSKFDV

SEQ ID NO: 1331 - protein, 98 aa, Anaeromyces robustus
  Carbohydrate-binding domain
GFEIKVGKSWSGDGTTYTQAEGEIINASKLKINNWYIEVPFDGSDQRFLGSWGCVVEEKDDKLILTGEVTNQVIKVLTNTTFGFIVASTNTKFDVETA

SEQ ID NO: 1332 - protein, 95 aa, Anaeromyces robustus
  Carbohydrate-binding domain
FEIKVAKSWTSDSISFTQFDGIIDNSSKLKINSWYIEIPYDKKVNDLHGNWGCEIEVKDDKIVLTGGETNQVIKVYTSASFGFIVSSPGKNFDVE

SEQ ID NO: 1333 - protein, 90 aa, Piromyces finnis
  Carbohydrate-binding domain
SISKSWTGDTTTYSQAEGKIVNASKLKLNNWYIEVPFDPDHQKFQGSWGCEVEEKEDKLVLTGEVTNKTLKVLTETTFGFIIASTGVKFD

SEQ ID NO: 1334 - protein, 103 aa, Neocallimastix californiae
  CarboxyPept_regulatory_dom
KQRGKVTGKLTIKNQLDNSVFKLDDAVVTLVQPESNSESIPNQQWRHYSFWTHSISGVSPNFTINNVIPGTYQLRAWSKGVVGEFILNKTITVTAGQTTNLGE

SEQ ID NO: 1335 - protein, 101 aa, Anaeromyces robustus
  CarboxyPept_regulatory_dom
VPKAKRGSVSGKLVIKDPLYGSLKISDATVTLVQPESSTEPIHPQQWHKMSHWVTHVTGDFKIENVVPGTYQLRAWSKGIVGEFYTTNTITVTSGQETKLG

SEQ ID NO: 1336 - protein, 100 aa, Piromyces finnis
  CarboxyPept_regulatory_dom
VPKNKRGSVSGKLVINDPLYGNLKLSDATVTLVQPESSNEPIHPQQWHKMSHWVTHITGDFKIENVVPGTYELRAWCKGIVGEFYTTNTITVTSGQETRL

SEQ ID NO: 1337 - protein, 100 aa, Piromyces finnis
  CarboxyPept_regulatory_dom
KERGKVTGTLAINNPLTNTRLPLEDAVVTLVQPQSATEPIPNQQWRHMSFWTHSLSGATPNFVIYNVIPGTYELHAWAKGVVGEFVLDKLVTVKAGEVVN

SEQ ID NO: 1338 - protein, 76 aa, Neocallimastix californiae
  CBD_carb-bd_dom
EFSIATGSGMRCSGWCLSFTSSTYKIDQSSDCTPLKLESPNYTLCNKRENNSLDGEGTVRTVKFQGSGSGLPTEFT

SEQ ID NO: 1339 - protein, 81 aa, Anaeromyces robustus
  CBD_carb-bd_dom
IEKSWMDVYRIIADVETKLPTPAWEVEFTLPEGHIFDDFSATNCYVVNYDEKTRVLRFKNTPWNGPLTANLTQSFGFQCHG

SEQ ID NO: 1340 - protein, 92 aa, Anaeromyces robustus
  CBD_carb-bd_dom
KVAKSWTSDSISFTQFDGIIDNSSKLKINSWYIEIPYDKKVNDLHGNWGCEIEVKDDKIVLTGGETNQVIKVYTSASFGFIVSSPGKNFDVE

SEQ ID NO: 1341 - protein, 89 aa, Piromyces finnis
  CBD_carb-bd_dom
ISISKSWTGDTTTYSQAEGKIVNASKLKLNNWYIEVPFDPDHQKFQGSWGCEVEEKEDKLVLTGEVTNKTLKVLTETTFGFIIASTGVK

SEQ ID NO: 1342 - protein, 76 aa, Piromyces finnis
  CBD_carb-bd_dom
GELSIATGSGMRCSGWCVSFTSSSYKITQTSDGNIVNSGPEYTICNKRENNALDGKGTAHIVTFQASGSSLPTEFT

SEQ ID NO: 1343 - protein, 76 aa, Piromyces finnis; identical to SEQ ID NO: 1342
  CBD_carb-bd_dom

SEQ ID NO: 1344 - protein, 76 aa, Piromyces finnis; identical to SEQ ID NO: 1342
  CBD_carb-bd_dom

SEQ ID NO: 1345 - protein, 118 aa, Neocallimastix californiae
  CBD_IV
NVNGSALNYAASMAWQSGISVKGQGAVTQVNYGRGSWTGVSNVALGNAKTITLRASSSSGATVKICAGSENGTVLGYVDIPAGGSLQNVTGNLSGASGTKNLFFIASGNLTIESWQLD

SEQ ID NO: 1346 - protein, 118 aa, Neocallimastix californiae; identical to SEQ ID NO: 1345
  CBD_IV

SEQ ID NO: 1347 - protein, 121 aa, Neocallimastix californiae
  CBD_IV
KVNAYNTNYASMMAWQGGVSTNGLGHTTVTYNRGEWTGVSNVDFGEAATSVKITAASNNGAVIRITTGSPNGDVVGYVSIPATGGNSNFKTVTADINTVSGTKHVFFVASGDVVVDTWQFI

SEQ ID NO: 1348 - protein, 118 aa, Neocallimastix californiae
  CBD_IV
NVDGSALNYAASFAWQSGISVKGQGAVTQVNYGRGAWTGVSNVNLGNAKSITLKASSSGGATVKICAGSENGTVLGYVDIPAGGSLQNVSGNLSGASGTKNLFFIASGNLTIESWQLG

SEQ ID NO: 1349 - protein, 118 aa, Neocallimastix californiae
  CBD_IV
DVDGSKVNNASSFAWQYGITIKGQDNVLPVNYVKGAWTGISNVDLGNAKSITLKAYAPNGATIKVCVGSENGTVLGYVDIPKGNSLQNVTGNLDNASGTKNLFLVSSGDATIESWQLT

SEQ ID NO: 1350 - protein, 118 aa, Neocallimastix californiae
  CBD_IV
DVDGSALNYAASFAWQSGISVKGQGAVTQVNYGRGAWTGVSNVALGNAKSITLKASSSSGATVKICAGSENGTVLGYVDIPAGGSLQNVTGNLSGASGTKSLFFIASGNLTIESWQLG

SEQ ID NO: 1351 - protein, 121 aa, Neocallimastix californiae
  CBD_IV
NVDAFKTYYASMMAWEGGVSINGLGHTTVTYNKGDWTGVSNVDFGNGAYGIKVSAASRNGAVIKIAAGSETGNALGYINIPATGGTNSFKTVTASLSKITGVKNIFFIASGDVVLDTWQFT

SEQ ID NO: 1352 - protein, 107 aa, Neocallimastix californiae
  CBD_IV
SMAWQSGISVEGHGAVTQVKYGRGAWTGVSNVDLGSASSITLKASSRSGATIKVCTDSENGNALGYVEIPAGGSLQNVTGQLSGATGTKNLFFVSSGDAVIESWQLS

SEQ ID NO: 1353 - protein, 121 aa, Anaeromyces robustus; identical to SEQ ID NO: 1351
  CBD_IV

SEQ ID NO: 1354 - protein, 118 aa, Anaeromyces robustus
  CBD_IV
NVDGSKLNYAASMAWQSGISVEGHGAVTQVKYGRGAWTGVSNVDLGSASSITLKASSRSGATIKVCTDSENGNALGYVEIPAGGSLQNVTGQLSGATGTKNLFFVSSGDAVIESWQLS

SEQ ID NO: 1355 - protein, 114 aa, Anaeromyces robustus
  CBD_IV
SAVNPAANMAWQNGISVKGQGAVLPVSYTRGAWTGVSNVALGGASSITLKASSQSGATIKICTESENGQAIGYVDIPAGGSLQNVSGTLSGATGTKNLFFVSSGDATIESWQLG

SEQ ID NO: 1356 - protein, 118 aa, Anaeromyces robustus
  CBD_IV
DVDGFAVNPAANMAWQYGISVNGQGAVVPVNYNRGAWTGVSNVALGGATSITLKASSKSGATIKICTESENGQALGYVDIPAGGSLQNVSGTLSGATGTKNLFFVSSGDATIESWQLG

SEQ ID NO: 1357 - protein, 118 aa, Piromyces finnis
  CBD_IV
NVDAYSTNYASMMAWQAGVSVYGLGHTTVTYRKGTWTGVSGVEFGDNATSVKISAASANGATIRITSGSENGEVIGYVTVPATGDEFVTVTADVSVSGVKDIFFVASDEVVVDTWQFV

SEQ ID NO: 1358 - protein, 118 aa, Piromyces finnis
  CBD_IV
DVDGTSLNLAASFAWQSGIKIKGQGAVTTVEIPRGGWTGVSHVALGNAKSITIKASSSSGATIKVCTGNEKGDVLGYVEIPAGGSLQEVTAEISNASGTKDLFFVASNSVSMESWQLK

SEQ ID NO: 1359 - protein, 118 aa, Piromyces finnis; identical to SEQ ID NO: 1357
  CBD_IV

SEQ ID NO: 1360 - protein, 118 aa, Piromyces finnis; identical to SEQ ID NO: 1358
  CBD_IV

SEQ ID NO: 1361 - protein, 120 aa, Piromyces finnis
  CBD_IV
NVDAYSTNYASMMAWQAGVSVNGLGHTTVSYNRGDWTGVSNVDFGDSATSVKISAASSNGATIRITSGSENGDVIGYVTIPATGGDKNFKTVTANVKASGTKNIFFVASGDVTIDTWQFI

SEQ ID NO: 1362 - protein, 118 aa, Piromyces finnis; identical to SEQ ID NO: 1358
  CBD_IV

SEQ ID NO: 1363 - protein, 120 aa, Piromyces finnis; identical to SEQ ID NO: 1361
  CBD_IV

SEQ ID NO: 1364 - protein, 120 aa, Piromyces finnis; identical to SEQ ID NO: 1361
  CBD_IV

SEQ ID NO: 1365 - protein, 118 aa, Piromyces finnis; identical to SEQ ID NO: 1358
  CBD_IV

SEQ ID NO: 1366 - protein, 118 aa, Piromyces finnis
  CBD_IV
DVDGSALNYAASFAWQYGISVKGQAAVTTVNYSRGGWTGVSNVALGNAQSITLKASSKSGATVKICTGSENGQAIGYVDIPAGGSLQNVTGSISGASGTKNLFFVASGDLSIESWQLG

SEQ ID NO: 1367 - protein, 120 aa, Piromyces finnis; identical to SEQ ID NO: 1361
  CBD_IV

SEQ ID NO: 1368 - protein, 118 aa, Piromyces finnis; identical to SEQ ID NO: 1357
  CBD_IV

SEQ ID NO: 1369 - protein, 118 aa, Piromyces finnis; identical to SEQ ID NO: 1357
  CBD_IV

SEQ ID NO: 1370 - protein, 118 aa, Piromyces finnis; identical to SEQ ID NO: 1366
  CBD_IV

SEQ ID NO: 1371 - protein, 27 aa, Neocallimastix californiae
  CBM_1
WQQCGGQNYNGPTCCEAGTTCVKLSDY

SEQ ID NO: 1372 - protein, 27 aa, Neocallimastix californiae
  CBM_1
LYDQCGGEGYFGPTKCCKGKCISQGPY

SEQ ID NO: 1373 - protein, 27 aa, Neocallimastix californiae
  CBM_1
YAQCGGLGYEGSTCCQAGTICTVVNEH

SEQ ID NO: 1374 - protein, 27 aa, Neocallimastix californiae
  CBM_1
LYDQCGGDGYFGPTECCKGKCISQGPY

SEQ ID NO: 1375 - protein, 26 aa, Neocallimastix californiae
  CBM_1
YGKCGGNDWTGSTCCMVGTSCQKINE

SEQ ID NO: 1376 - protein, 28 aa, Neocallimastix californiae
  CBM_1
FDQCGGVGYNGPTNCCNPDYKCKEYGTY

SEQ ID NO: 1377 - protein, 27 aa, Neocallimastix californiae
  CBM_1
YAQCGGIGYEGPNCCQAGTVCTEINEH

SEQ ID NO: 1378 - protein, 28 aa, Neocallimastix californiae
  CBM_1
YEMCGGTLFPNQPTCCEPGNTCVIMNPR

SEQ ID NO: 1379 - protein, 27 aa, Neocallimastix californiae
  CBM_1
WGQCGGEGWNGPTCCNSGSVCVVTNQY

SEQ ID NO: 1380 - protein, 28 aa, Neocallimastix californiae
  CBM_1
WAQCGGIDFNGPTTCCDPSAVCKYLNDY

SEQ ID NO: 1381 - protein, 28 aa, Neocallimastix californiae
  CBM_1
KWDQCGGMNWAGPNCCVEGTYCTFVNPY

SEQ ID NO: 1382 - protein, 28 aa, Neocallimastix californiae
  CBM_1
KWTQCGGQGYTGPTCCKSGSTCHEINKY

SEQ ID NO: 1383 - protein, 23 aa, Neocallimastix californiae
  CBM_1
CGGSEYPDASPCCEEGFTCRAYN

SEQ ID NO: 1384 - protein, 28 aa, Neocallimastix californiae
  CBM_1
YQPCGGNDYPNAPTCCEAGFACLMKNPN

SEQ ID NO: 1385 - protein, 26 aa, Neocallimastix californiae
  CBM_1
YRPCGGSYFQDGPNCCEPGFICVDAN

SEQ ID NO: 1386 - protein, 28 aa, Neocallimastix californiae
  CBM_1
RYAQCGGVNYHGSTKCCGNLTCVYRGEY

SEQ ID NO: 1387 - protein, 28 aa, Neocallimastix californiae
  CBM_1
PYGQCGGINYNGPTCCPSGYTCKFISDY

SEQ ID NO: 1388 - protein, 26 aa, Neocallimastix californiae
  CBM_1
FDQCDGINYNGPKCCSVGKCVRLNDY

SEQ ID NO: 1389 - protein, 27 aa, Neocallimastix californiae
  CBM_1
QWAQCGGIGFNGPTCCSSGKCVKLNDW

SEQ ID NO: 1390 - protein, 28 aa, Neocallimastix californiae
  CBM_1
HWDQCGGVNHRGPFCCESGLTCVFVNDY

SEQ ID NO: 1391 - protein, 26 aa, Neocallimastix californiae
  CBM_1
YEICGGKNYPNAPKCCEPGSKCVHFS

SEQ ID NO: 1392 - protein, 27 aa, Neocallimastix californiae
  CBM_1
FGQCGGTDYRGSTKCCENLRCVYLNDY

SEQ ID NO: 1393 - protein, 27 aa, Neocallimastix californiae
  CBM_1
YEYCGGINYPKAPKCCKPGSKCVKFNE

SEQ ID NO: 1394 - protein, 27 aa, Anaeromyces robustus
  CBM_1
YAQCGGKEYTGPNCCQAGTICTEINEH

SEQ ID NO: 1395 - protein, 27 aa, Anaeromyces robustus
  CBM_1
LYDQCGGEGYFGPTECCKGKCTSQGPY

SEQ ID NO: 1396 - protein, 24 aa, Anaeromyces robustus
  CBM_1
CGGKSYPDASPCCEEGYRCEAVNE

SEQ ID NO: 1397 - protein, 27 aa, Anaeromyces robustus
  CBM_1
WDQCGGATYYGPTCCESNSRCIVHNEY

SEQ ID NO: 1398 - protein, 25 aa, Anaeromyces robustus
  CBM_1
VCGGSSFPDASPCCEEGYVCEFQNE

SEQ ID NO: 1399 - protein, 26 aa, Anaeromyces robustus
  CBM_1
YNPCGGINYPDASPCCEEGYRCEVYN

SEQ ID NO: 1400 - protein, 25 aa, Anaeromyces robustus
  CBM_1
YNVCGGTNYPNAPKCCESGSTCVAF

SEQ ID NO: 1401 - protein, 26 aa, Anaeromyces robustus
  CBM_1
PYQPCGGIYYQNSPKCCKSGSTCVKN

SEQ ID NO: 1402 - protein, 27 aa, Anaeromyces robustus
  CBM_1
WNQCGGKEYTGPTCCNENYHCIYVNEY

SEQ ID NO: 1403 - protein, 27 aa, Anaeromyces robustus
  CBM_1
YDQCGGIGFRGPTCCEPGTTCEFVVDY

SEQ ID NO: 1404 - protein, 24 aa, Anaeromyces robustus
  CBM_1
YDACGGSNYPNSPRCCIEGLTCVY

SEQ ID NO: 1405 - protein, 27 aa, Anaeromyces robustus
  CBM_1
YGQCGGINYTGPTCCPSGYSCKKHNDY

SEQ ID NO: 1406 - protein, 28 aa, Anaeromyces robustus
  CBM_1
YEKCGGIGYNGPTCCENPNFKCEVINEY

SEQ ID NO: 1407 - protein, 27 aa, Anaeromyces robustus
  CBM_1
WQQCGGVGYNGPTCCKGDYYCKSYSDY

SEQ ID NO: 1408 - protein, 32 aa, Anaeromyces robustus
  CBM_1
AWGQCGGTVNGKKYNGSTCCVSGYKCKEYNTN

SEQ ID NO: 1409 - protein, 28 aa, Anaeromyces robustus
  CBM_1
YQQCGGLNYKGTISCCEEGYFCHKNDEH

SEQ ID NO: 1410 - protein, 23 aa, Anaeromyces robustus
  CBM_1
CGGTNYPNAPKCCESGSTCVAFS

SEQ ID NO: 1411 - protein, 14 aa, Anaeromyces robustus
  CBM_1
WGQCGGINYNGLTC

SEQ ID NO: 1412 - protein, 20 aa, Anaeromyces robustus
  CBM_1
ICGGKLFPDAPTCCEQGSKC

SEQ ID NO: 1413 - protein, 26 aa, Anaeromyces robustus
  CBM_1
FAQCDGDGYNGPKCCQSGQCVKVNNW

SEQ ID NO: 1414 - protein, 27 aa, Anaeromyces robustus
  CBM_1
YEQCGGFYFSGPNCCEEGSRCIYQNDY

SEQ ID NO: 1415 - protein, 28 aa, Piromyces finnis
  CBM_1
KWQQCGGIGYSGPTQCESGSECVATNEF

SEQ ID NO: 1416 - protein, 27 aa, Piromyces finnis
  CBM_1
YAQCGGLGYEGSTCCQAGTICTVVNEH

SEQ ID NO: 1417 - protein, 26 aa, Piromyces finnis
  CBM_1
YGKCGGKDWTGSTCCMVGTSCKEVNE

SEQ ID NO: 1418 - protein, 27 aa, Piromyces finnis
  CBM_1
LYDQCGGDGYFGPTECCKGKCISQGPY

SEQ ID NO: 1419 - protein, 27 aa, Piromyces finnis
  CBM_1
AYGKCGGKDWTGSTCCMVGTSCKEVNE

SEQ ID NO: 1420 - protein, 28 aa, Neocallimastix californiae
  CBM_10
PCCSSPNAEVYYTDNDGKWSVENNDWCG

SEQ ID NO: 1421 - protein, 36 aa, Neocallimastix californiae
  CBM_10
ECWAKKLGYSCCTSTSRVEYTDNDGKWGIENGNWCG

SEQ ID NO: 1422 - protein, 33 aa, Neocallimastix californiae
  CBM_10
CTGNGAYQCCNSCTTTYTDNDGRWGYENGDWCG

SEQ ID NO: 1423 - protein, 37 aa, Neocallimastix californiae
  CBM_10
CWAQSQGYKCCDNPGSTKVEFSDGSGQWGIQNGDWCG

SEQ ID NO: 1424 - protein, 33 aa, Neocallimastix californiae
  CBM_10
CTGNGNYPCCNTCTATYTDGEGKWAIENGNWCG

SEQ ID NO: 1425 - protein, 32 aa, Neocallimastix californiae
  CBM_10
IAQGYNCCKSCGTVYFEDGDGKWGVENNNWCG

SEQ ID NO: 1426 - protein, 37 aa, Neocallimastix californiae
  CBM_10
CPASITRQGYKCCRVGCTVEYTDNDGEWGVEDGDWCG

SEQ ID NO: 1427 - protein, 31 aa, Neocallimastix californiae
  CBM_10
NQGYKCCSTCGTVYYTDADGDWGVENNDWCG

SEQ ID NO: 1428 - protein, 37 aa, Neocallimastix californiae
  CBM_10
CSAAITAQGYKCCSNNCEVVYSDDDGDWGVENNQWCG

SEQ ID NO: 1429 - protein, 37 aa, Neocallimastix californiae
  CBM_10
CSAAITAQGYKCCSANCVVEYTDADGDWGVENGQWCG

SEQ ID NO: 1430 - protein, 37 aa, Neocallimastix californiae
  CBM_10
CPASITNQGYPCCSSCGTVYYTDNDGLWGVENNDWCG

SEQ ID NO: 1431 - protein, 37 aa, Neocallimastix californiae
  CBM_10
CSAAITNQGYKCCSANCEVVYTDGDGDWGVENNEWCG

SEQ ID NO: 1432 - protein, 31 aa, Neocallimastix californiae
  CBM_10
NQGYKCCSSCSTVYYSDNDGDWGVENNDWCG

SEQ ID NO: 1433 - protein, 37 aa, Neocallimastix californiae
  CBM_10
CPASITNQGYKCCSSCSTVYYTDNDGAWGVENNDWCG

SEQ ID NO: 1434 - protein, 31 aa, Neocallimastix californiae
  CBM_10
AQGYKCCSANCEVVYTDNDGDWGVENGQWCG

SEQ ID NO: 1435 - protein, 37 aa, Neocallimastix californiae; identical to SEQ ID NO: 1431
  CBM_10

SEQ ID NO: 1436 - protein, 31 aa, Neocallimastix californiae; identical to SEQ ID NO: 1432
  CBM_10

SEQ ID NO: 1437 - protein, 25 aa, Neocallimastix californiae
  CBM_10
CWSEKLGYPCCQNTSSVVYTDNDGN

SEQ ID NO: 1438 - protein, 35 aa, Neocallimastix californiae
  CBM_10
SCFSVNLGYSCCNGCEVAYTDSDGKWGVENGNWCG

SEQ ID NO: 1439 - protein, 36 aa, Neocallimastix californiae
  CBM_10
FADMAPNGFPYCQYCEVGATGGDGSLWGWENEQSCV

SEQ ID NO: 1440 - protein, 31 aa, Neocallimastix californiae
  CBM_10
APNGFPYCQYCEVGATGGDGSLWGWENEQSC

SEQ ID NO: 1441 - protein, 36 aa, Neocallimastix californiae
  CBM_10
SCWSESLGFPCCQNTKEVYYTDNDGNWGVENNNWCG

SEQ ID NO: 1442 - protein, 34 aa, Neocallimastix californiae
  CBM_10
CFSINLGYKCCSGCDIVYVDQDGNWGVENDQWCG

SEQ ID NO: 1443 - protein, 37 aa, Neocallimastix californiae
  CBM_10
CNANIIAQGYKCCKSCGTVYYEDGDGQWGVENNDWCG

SEQ ID NO: 1444 - protein, 37 aa, Neocallimastix californiae; identical to SEQ ID NO: 1426
  CBM_10

SEQ ID NO: 1445 - protein, 35 aa, Neocallimastix californiae
  CBM_10
ACFAERLGYPCCKGNTVAYTDNDGKWGVENGNWCG

SEQ ID NO: 1446 - protein, 37 aa, Neocallimastix californiae
  CBM_10
ACWSTSLGYPCCSSSSAQVYYTDNDGKWGVENGDWCG

SEQ ID NO: 1447 - protein, 37 aa, Neocallimastix californiae
  CBM_10
ACWAEALGYKCCTPGAYTPVLLTDESGDWSAENGEWC

SEQ ID NO: 1448 - protein, 35 aa, Neocallimastix californiae
  CBM_10
CFAKSDGYDCCFDNEVVYEDETGKWGINDEGEWCG

SEQ ID NO: 1449 - protein, 37 aa, Neocallimastix californiae
  CBM_10
ECWANAYGYDCCVDGTLTYLEDETGKWGVTSDYQWCG

SEQ ID NO: 1450 - protein, 37 aa, Neocallimastix californiae
  CBM_10
ACWSLSQGYPCCSSSNAEVWYTDASGKWGVENGDWCG

SEQ ID NO: 1451 - protein, 26 aa, Neocallimastix californiae
  CBM_10
PCCSGNDVVYTDNDGKWGVENGNWCG

SEQ ID NO: 1452 - protein, 38 aa, Neocallimastix californiae
  CBM_10
CISEFLGYPCCSSSNTPVYYKDDDGDWGIDSATGDWCG

SEQ ID NO: 1453 - protein, 36 aa, Neocallimastix californiae
  CBM_10
SCWSTKFGYPCCKKTCTAIEKDKDGSWAIEGSHWCG

SEQ ID NO: 1454 - protein, 36 aa, Neocallimastix californiae
  CBM_10
SCWSTKLGYPCCKKTCTAIEKDNDGAWAIEGSHWCG

SEQ ID NO: 1455 - protein, 39 aa, Neocallimastix californiae
  CBM_10
KCVSEFLGYPCCSSSNTLVYYKDDDGDWGVDPATGDWCG

SEQ ID NO: 1456 - protein, 35 aa, Neocallimastix californiae
  CBM_10
TCKFEALGYKCCSHCVSYLEDEDGLWGVENGEWCG

SEQ ID NO: 1457 - protein, 35 aa, Neocallimastix californiae
  CBM_10
ECWSNKFGYPCCDTCDVFLTDESGDWGVKDLDWCG

SEQ ID NO: 1458 - protein, 36 aa, Neocallimastix californiae
  CBM_10
TCWSESLGYPCCSSNTGVAYIDNDGEWGVENGGWCG

SEQ ID NO: 1459 - protein, 36 aa, Neocallimastix californiae; identical to SEQ ID NO: 1458
  CBM_10

SEQ ID NO: 1460 - protein, 37 aa, Neocallimastix californiae
  CBM_10
ACWSQKLGYPCCSSSSAEVWYTDNDGKWGVENNDWCG

SEQ ID NO: 1461 - protein, 36 aa, Neocallimastix californiae
  CBM_10
SCWAEALGFKCCETTNEVVFTDDSGKWGVENGEWCG

SEQ ID NO: 1462 - protein, 36 aa, Neocallimastix californiae
  CBM_10
SCFSEKMGIQCCPEGTEIYYTDNDGNWGIYKNDWCG

SEQ ID NO: 1463 - protein, 37 aa, Neocallimastix californiae
  CBM_10
ACWSESQGYKCCKNSNTKVEFTDDSGEWGIENNDWCG

SEQ ID NO: 1464 - protein, 20 aa, Neocallimastix californiae
  CBM_10
CWATKLGYPCCKTTTTTEYT

SEQ ID NO: 1465 - protein, 39 aa, Neocallimastix californiae
  CBM_10
KCWSMKLNPPIPCCTGKDLKVIEEDSNGKWSEENGEKCG

SEQ ID NO: 1466 - protein, 39 aa, Neocallimastix californiae
  CBM_10
KCWSLELANPFPCCSDPNATVEYTNDKGDWGVENGQWCG

SEQ ID NO: 1467 - protein, 36 aa, Neocallimastix californiae
  CBM_10
TCWSLPDYPCCSDPNTTPIEIDGSGEWGVENGEWCG

SEQ ID NO: 1468 - protein, 40 aa, Neocallimastix californiae
  CBM_10
ECWSEKYGYPCCERLNHSYIEQGTEEENAYWAIENGNYCG

SEQ ID NO: 1469 - protein, 35 aa, Neocallimastix californiae
  CBM_10
CWSLPDYPCCSDPNTTPIETDDSGEWGLENGDWCG

SEQ ID NO: 1470 - protein, 36 aa, Neocallimastix californiae
  CBM_10
KCWSEAEGYPCCSSNTAVVLTDSKGKWGIENGDWCG

SEQ ID NO: 1471 - protein, 37 aa, Neocallimastix californiae
  CBM_10
SCWASGLGYKCCSGCDVILSDSNGKWGFDFETNDWCG

SEQ ID NO: 1472 - protein, 32 aa, Neocallimastix californiae
  CBM_10
ATKDGFSCCKKCDVVLVDDNGKWGVEDNQWCG

SEQ ID NO: 1473 - protein, 36 aa, Neocallimastix californiae
  CBM_10
SCWSEAEGYPCCSSNTAVVLTDSKGKWGIENGDWCG

SEQ ID NO: 1474 - protein, 26 aa, Neocallimastix californiae
  CBM_10
SCWASGLGYKCCSGCDVILSDSNGKW

SEQ ID NO: 1475 - protein, 35 aa, Neocallimastix californiae
  CBM_10
SCWASGLGYKCCSGCDVILSDSNGKWGIENGDWCG

SEQ ID NO: 1476 - protein, 37 aa, Neocallimastix californiae
  CBM_10
ACWSTSLGYPCCSSSSAQVYYTDNDGKWGVENNDWCG

SEQ ID NO: 1477 - protein, 35 aa, Neocallimastix californiae
  CBM_10
ACFSQSLGYPCCSGNDVVYIDNDGKWGVENGNWCG

SEQ ID NO: 1478 - protein, 37 aa, Neocallimastix californiae
  CBM_10
ACWSQPLGYPCCSSPNAEVYYTDNDGKWSVENNDWCG

SEQ ID NO: 1479 - protein, 32 aa, Neocallimastix californiae
  CBM_10
ASKDGYPCCKGCSVVDQDGSGKWGIENGNWCG

SEQ ID NO: 1480 - protein, 35 aa, Neocallimastix californiae
  CBM_10
SCWASSQGYNCCSGCDPILTDGSGKWGFENGNWCG

SEQ ID NO: 1481 - protein, 36 aa, Neocallimastix californiae
  CBM_10
SCWAAAEGYPCCTSTTTVEIVDSKGKWGIENGNWCG

SEQ ID NO: 1482 - protein, 36 aa, Neocallimastix californiae
  CBM_10
CWATSLGYKCCSNPNTESVYEDESGEWGVENNDWCG

SEQ ID NO: 1483 - protein, 35 aa, Neocallimastix californiae
  CBM_10
CWSEKLGYKCCSTCTQVYYNDQDGSWGVENNDWCG

SEQ ID NO: 1484 - protein, 36 aa, Neocallimastix californiae
  CBM_10
SCWSIALGYPCCEVNDFVVQTDENGDWSVENNDWCG

SEQ ID NO: 1485 - protein, 38 aa, Neocallimastix californiae
  CBM_10
KCFSLNLGYPCCENDSDDNIIFTDENGDWGIENNNWCG

SEQ ID NO: 1486 - protein, 36 aa, Neocallimastix californiae
  CBM_10
ACWSTALGFPCCEVNKFIVFSDENGDWSVENNNWCG

SEQ ID NO: 1487 - protein, 35 aa, Neocallimastix californiae
  CBM_10
CWSTVLGYPCCEVNDFIVNTDEYGSWSVENNDWCG

SEQ ID NO: 1488 - protein, 36 aa, Neocallimastix californiae
  CBM_10
ACWSTALGFPCCEVNDNVVHSDEYGDWGVENNDWCG

SEQ ID NO: 1489 - protein, 35 aa, Neocallimastix californiae
  CBM_10
ACWSQALGYPCCKSTSDVYYTDDDGNWGVENGNWC

SEQ ID NO: 1490 - protein, 35 aa, Neocallimastix californiae
  CBM_10
ECFSIALGYPCCKGNDIVYTDDDGNWGVENNEWCG

SEQ ID NO: 1491 - protein, 34 aa, Neocallimastix californiae
  CBM_10
CWATKLGYPCCKTTTTTEYTDADGEWGIENGNWC

SEQ ID NO: 1492 - protein, 38 aa, Neocallimastix californiae
  CBM_10
SCWAKNLGYPCCSTNTCRTVYYTDADGKWDVENNDWCG

SEQ ID NO: 1493 - protein, 36 aa, Neocallimastix californiae
  CBM_10
SCWSQRLGYPCCTNNSAVYFTDNDGKWGIQNDDWCG

SEQ ID NO: 1494 - protein, 37 aa, Neocallimastix californiae
  CBM_10
TCWSKKLGYPCCSNKNASVEYTDGDGQWGIENGDWCG

SEQ ID NO: 1495 - protein, 34 aa, Neocallimastix californiae
  CBM_10
CWAKALGYPCCTQATEVVYTDSNGQWGIQNNDWC

SEQ ID NO: 1496 - protein, 37 aa, Neocallimastix californiae
  CBM_10
CWARSLGYNCCSTSTCRNAQFSDNDGQWDIENGNWCG

SEQ ID NO: 1497 - protein, 35 aa, Neocallimastix californiae
  CBM_10
KCFSVALGYPCCKGSEVVYTDNDGKWGFENGQWCG

SEQ ID NO: 1498 - protein, 31 aa, Neocallimastix californiae
  CBM_10
DGYKCCTQSNPTVVYTDASGEWAVENGDWCI

SEQ ID NO: 1499 - protein, 34 aa, Neocallimastix californiae
  CBM_10
CPDYKNGYPVCKKTTTVVYTDSEKWGVENNDWCI

SEQ ID NO: 1500 - protein, 28 aa, Neocallimastix californiae
  CBM_10
GDYPCCNECDVVYTDDSGDWGIENNDWC

SEQ ID NO: 1501 - protein, 29 aa, Neocallimastix californiae
  CBM_10
EGYSKCSNCDVQYSDGSGDWGVENGDWCG

SEQ ID NO: 1502 - protein, 34 aa, Neocallimastix californiae
  CBM_10
CFAKALGYECCNDNEIVTSDESGDWGVKDGEWCG

SEQ ID NO: 1503 - protein, 36 aa, Neocallimastix californiae
  CBM_10
SCWSERLGYPCCQSTSSVVYTDNDGKWGVENGNWCG

SEQ ID NO: 1504 - protein, 35 aa, Neocallimastix californiae
  CBM_10
SCFSVNLGYSCCNGCEVVYTDSDGKWGVENGNWCG

SEQ ID NO: 1505 - protein, 35 aa, Neocallimastix californiae; identical to SEQ ID NO: 1504
  CBM_10

SEQ ID NO: 1506 - protein, 36 aa, Neocallimastix californiae; identical to SEQ ID NO: 1503
  CBM_10

SEQ ID NO: 1507 - protein, 33 aa, Neocallimastix californiae
  CBM_10
CWSLPEYPCCVGSKVIETDKQGDWGYEDNHWCG

SEQ ID NO: 1508 - protein, 33 aa, Neocallimastix californiae
  CBM_10
CWSLPDYPCCKGNDIITTDSQGDWGYEDKHWCG

SEQ ID NO: 1509 - protein, 34 aa, Neocallimastix californiae
  CBM_10
CWSTVLGYDCCKGCHVYEEDTDGKWGYENKKWCG

SEQ ID NO: 1510 - protein, 33 aa, Neocallimastix californiae; identical to SEQ ID NO: 1507
  CBM_10

SEQ ID NO: 1511 - protein, 33 aa, Neocallimastix californiae; identical to SEQ ID NO: 1508
  CBM_10

SEQ ID NO: 1512 - protein, 34 aa, Neocallimastix californiae; identical to SEQ ID NO: 1509
  CBM_10

SEQ ID NO: 1513 - protein, 35 aa, Neocallimastix californiae
  CBM_10
CWALAEGYNCCSPGTPVSITDSKGKWGIENEEWCG

SEQ ID NO: 1514 - protein, 35 aa, Neocallimastix californiae
  CBM_10
SCWAEAEGFRCCKGCEAIYIDGDKRWGVENMEWCG

SEQ ID NO: 1515 - protein, 30 aa, Neocallimastix californiae
  CBM_10
KDGYNCCSGCSVSYEDETGKWGIENGQWCG

SEQ ID NO: 1516 - protein, 37 aa, Neocallimastix californiae
  CBM_10
ECWSEKYGYECCSPNNTKVVVSDESGKWGVENGNWCG

SEQ ID NO: 1517 - protein, 35 aa, Neocallimastix californiae
  CBM_10
TCWSLPFGYPCCPHCKALTKDENGKWGELNGEWCG

SEQ ID NO: 1518 - protein, 35 aa, Neocallimastix californiae
  CBM_10
TCWSLPFGYPCCPHCNSLTKDENGKWGELNGEWCG

SEQ ID NO: 1519 - protein, 37 aa, Neocallimastix californiae
  CBM_10
ECWSEKYGYECCSPNNTKVVVSDENGKWGVENGNWCG

SEQ ID NO: 1520 - protein, 36 aa, Neocallimastix californiae
  CBM_10
SCNEQPDDDYPTCSANIEIAYVDDRIWGIENGDWCI

SEQ ID NO: 1521 - protein, 28 aa, Neocallimastix californiae
  CBM_10
GYKCCETCEVQYSDDTGSWGIENNDWCG

SEQ ID NO: 1522 - protein, 35 aa, Neocallimastix californiae
  CBM_10
ACFAERLGYPCCSGNEVVYTDNDGKWGVENGNWCG

SEQ ID NO: 1523 - protein, 37 aa, Neocallimastix californiae
  CBM_10
TCWSLSQGYPCCSSSNAEVWYTDASGKWGVENGDWCG

SEQ ID NO: 1524 - protein, 31 aa, Neocallimastix californiae
  CBM_10
NGYPCCDKTTEVVYEDEDGKWGVQNGDEWCL

SEQ ID NO: 1525 - protein, 37 aa, Neocallimastix californiae
  CBM_10
ECWSKALGYPCCTTTKEVVYTDESGKWGLEGNDEWCG

SEQ ID NO: 1526 - protein, 29 aa, Neocallimastix californiae
  CBM_10
QEYGECTSCVVQYKDQDGNWGYENDDWCL

SEQ ID NO: 1527 - protein, 35 aa, Neocallimastix californiae
  CBM_10
TCTGKSEGYKCCDNCDVVYTDDSGAWGIMNGDWCG

SEQ ID NO: 1528 - protein, 26 aa, Neocallimastix californiae
  CBM_10
YPCCSSCTVVYNDSDGDWGVENGNWC

SEQ ID NO: 1529 - protein, 34 aa, Neocallimastix californiae
  CBM_10
CFSLALGYPCCSGTTVEYSDNDGDWGFENGDWCG

SEQ ID NO: 1530 - protein, 29 aa, Neocallimastix californiae
  CBM_10
GLYPCCTSCNSVYEDDDGKWGVENDDWCL

SEQ ID NO: 1531 - protein, 36 aa, Neocallimastix californiae
  CBM_10
ECWSKALGYDCCKEGTEVVYTDESGKWGVTGDNWCG

SEQ ID NO: 1532 - protein, 29 aa, Neocallimastix californiae
  CBM_10
DGYECCKSCDVELTDDDGEWGIENNQWCG

SEQ ID NO: 1533 - protein, 36 aa, Neocallimastix californiae
  CBM_10
TCWSLKLGYPCCQNTNVVYYTDDDGDWSVENNDWCG

SEQ ID NO: 1534 - protein, 35 aa, Neocallimastix californiae
  CBM_10
CFSTKLGYPCCTSTSDVVYTDDDGDWGIENNNWCG

SEQ ID NO: 1535 - protein, 35 aa, Neocallimastix californiae
  CBM_10
ACFSEKLGYKCCKRNEVVYTDNDGDWGVEDNEWCG

SEQ ID NO: 1536 - protein, 35 aa, Neocallimastix californiae
  CBM_10
CWSTALGYPCCKNSSIVYFTDNDGKWSVENNDWCG

SEQ ID NO: 1537 - protein, 35 aa, Neocallimastix californiae
  CBM_10
CFSEALGYPCCSSGVAVVYTDNDGPWGVENNDWCG

SEQ ID NO: 1538 - protein, 36 aa, Neocallimastix californiae
  CBM_10
TCFSVALGYNCCQHTTEVIYVDNDGSWGIENNDWCG

SEQ ID NO: 1539 - protein, 33 aa, Neocallimastix californiae
  CBM_10
CFALDLGFKCCNNNEVVYTDQDGKWGYTDDWCG

SEQ ID NO: 1540 - protein, 29 aa, Neocallimastix californiae
  CBM_10
CGDYPCCSTCEASYVDNEGGWNVENNDWC

SEQ ID NO: 1541 - protein, 35 aa, Neocallimastix californiae
  CBM_10
SCFATKLGYGCCTGCEVNYTDDDGAWGIENGNWCG

SEQ ID NO: 1542 - protein, 35 aa, Neocallimastix californiae
  CBM_10
ECFATKLGYDCCSGCDVNYTDGDGAWGIENGNWCG

SEQ ID NO: 1543 - protein, 37 aa, Neocallimastix californiae
  CBM_10
SCWSEALGYSCCTNSSSPVVYTDDDGQWSVENNEWCG

SEQ ID NO: 1544 - protein, 38 aa, Neocallimastix californiae
  CBM_10
SCWANTLGYQCCNTSNCRNIIYEDNDGQWDVDNNQWCG

SEQ ID NO: 1545 - protein, 24 aa, Neocallimastix californiae
  CBM_10
ACWSQPLGYPCCSSPNAEVYYTDN

SEQ ID NO: 1546 - protein, 36 aa, Neocallimastix californiae
  CBM_10
CWSQSLGYPCCSSPNAEVYYTDNDGKWSVENNDWCG

SEQ ID NO: 1547 - protein, 31 aa, Neocallimastix californiae
  CBM_10
AQGYPCCQNSCIVYSTDADGRWSIENGDWCL

SEQ ID NO: 1548 - protein, 35 aa, Neocallimastix californiae
  CBM_10
SCWSSRLGYPCCKSCNVVFTDNDGKWGVENDDWCG

SEQ ID NO: 1549 - protein, 35 aa, Neocallimastix californiae
  CBM_10
CWASALGFNCCKTTKTVVFEDQDGSWGVEDDFWCG

SEQ ID NO: 1550 - protein, 31 aa, Neocallimastix californiae
  CBM_10
AQGYPCCKTATEVFYTDNDGKWSVENDDWCL

SEQ ID NO: 1551 - protein, 31 aa, Neocallimastix californiae
  CBM_10
AQGYKCCSSNCEVVYVDDDGNWGVENGQWCG

SEQ ID NO: 1552 - protein, 23 aa, Neocallimastix californiae
  CBM_10
ACWSQPLGYPCCSSPNAEVYYTD

SEQ ID NO: 1553 - protein, 30 aa, Neocallimastix californiae
  CBM_10
ENSGYQCCDNCDVVYEDESGKWGIKDNDWC

SEQ ID NO: 1554 - protein, 30 aa, Neocallimastix californiae
  CBM_10
ADGYECCSGCSVVDNSDGIKWGVENDNWCI

SEQ ID NO: 1555 - protein, 35 aa, Neocallimastix californiae
  CBM_10
TCWSSRLGYSCCTGCEVSYTDNDGDWGYENNDWCG

SEQ ID NO: 1556 - protein, 32 aa, Neocallimastix californiae
  CBM_10
SCHPQYNCCNSCDVVYTDNEGEWGVENNNWCF

SEQ ID NO: 1557 - protein, 35 aa, Neocallimastix californiae
  CBM_10
SCKFEALGYPCCSHCNSIYHDESGDWGVENGDWCG

SEQ ID NO: 1558 - protein, 35 aa, Neocallimastix californiae
  CBM_10
ACWSQALGYPCCSHKNVVYTDNDGDWGVENGDWCG

SEQ ID NO: 1559 - protein, 35 aa, Neocallimastix californiae
  CBM_10
ACFSERLGYPCCKGNTVVYTDNDGKWGVENNNWCG

SEQ ID NO: 1560 - protein, 34 aa, Neocallimastix californiae
  CBM_10
WASALGFNCCKTTKTVVFEDQDGSWGVEDDFWCG

SEQ ID NO: 1561 - protein, 35 aa, Neocallimastix californiae
  CBM_10
ECKFSSLGYTCCPDSEVIFEDDHKWGATSDGQWCG

SEQ ID NO: 1562 - protein, 35 aa, Neocallimastix californiae
  CBM_10
TCWSVKLGYPCCEVSNAIYSVDDNGSWGYENDHWC

SEQ ID NO: 1563 - protein, 35 aa, Neocallimastix californiae
  CBM_10
ACFSERLGYPCCSGDEVVYTDNDGKWGVENGNWCG

SEQ ID NO: 1564 - protein, 37 aa, Neocallimastix californiae
  CBM_10
ACWSTSLGYPCCSSSNAEVWYTDDSGKWGVENGDWCG

SEQ ID NO: 1565 - protein, 37 aa, Neocallimastix californiae
  CBM_10
ACWSTSLGYPCCSSSSAEVWYTDDSGKWGVENGDWCG

SEQ ID NO: 1566 - protein, 35 aa, Neocallimastix californiae
  CBM_10
ACFSERLGYPCCSGNEVVYTDNDGKWGVENGNWCG

SEQ ID NO: 1567 - protein, 35 aa, Neocallimastix californiae; identical to SEQ ID NO: 1566
  CBM_10

SEQ ID NO: 1568 - protein, 37 aa, Neocallimastix californiae; identical to SEQ ID NO: 1565
  CBM_10

SEQ ID NO: 1569 - protein, 35 aa, Neocallimastix californiae; identical to SEQ ID NO: 1563
  CBM_10

SEQ ID NO: 1570 - protein, 37 aa, Neocallimastix californiae; identical to SEQ ID NO: 1523
  CBM_10

SEQ ID NO: 1571 - protein, 25 aa, Neocallimastix californiae
  CBM_10
TCWSLSQGYPCCSSSNAEVWYTDAS

SEQ ID NO: 1572 - protein, 35 aa, Neocallimastix californiae; identical to SEQ ID NO: 1563
  CBM_10

SEQ ID NO: 1573 - protein, 37 aa, Neocallimastix californiae
  CBM_10
ECWAKALGFECCTSEDIEVQYTDKDGKWGIENYEWCG

SEQ ID NO: 1574 - protein, 36 aa, Neocallimastix californiae
  CBM_10
CWAEELGFKCCSSSDAKVEYTDNDGEWSIEDGSWCG

SEQ ID NO: 1575 - protein, 35 aa, Neocallimastix californiae
  CBM_10
TCWSSALGYPCCKGCDITSTDSDGDWGVENNEWCG

SEQ ID NO: 1576 - protein, 35 aa, Neocallimastix californiae
  CBM_10
SCWSLAYGYDCCKGCEVSFIDNDGKWGFENEEWCG

SEQ ID NO: 1577 - protein, 27 aa, Neocallimastix californiae
  CBM_10
QYSTCKNTCEIEYEDDNKWGIENNEWC

SEQ ID NO: 1578 - protein, 32 aa, Neocallimastix californiae
  CBM_10
CWSDPYPCCEGTTVEYVDDQGEWGVENGEWCG

SEQ ID NO: 1579 - protein, 31 aa, Neocallimastix californiae
  CBM_10
LPDYPCCSSGIEVAYVDDQGEWGVENGEWCG

SEQ ID NO: 1580 - protein, 35 aa, Neocallimastix californiae
  CBM_10
CWSMPDYPCCKNTRYSYYTDSAGNEWGVENGDWCG

SEQ ID NO: 1581 - protein, 30 aa, Neocallimastix californiae
  CBM_10
KGYNCCRNTCDISYVDEDGNWGVENGNWCG

SEQ ID NO: 1582 - protein, 34 aa, Neocallimastix californiae
  CBM_10
TCFSEPDYPCCTSCDVVESDGDQRWGIENNEWCG

SEQ ID NO: 1583 - protein, 34 aa, Neocallimastix californiae
  CBM_10
TCTGYPDYPCCNSCDVSYSDSIGDWGIENNDWCG

SEQ ID NO: 1584 - protein, 35 aa, Neocallimastix californiae
  CBM_10
TCWAKKLGYNCCTGCNSIYSDKDGMWGYENEEWCG

SEQ ID NO: 1585 - protein, 34 aa, Neocallimastix californiae
  CBM_10
CTGAQGYPCCKSSCAIYSSDSDGDWSIENGDWCL

SEQ ID NO: 1586 - protein, 35 aa, Neocallimastix californiae
  CBM_10
TCWAKALGYECCKSCLPVVTTDGDGSWSVVNDDWC

SEQ ID NO: 1587 - protein, 34 aa, Neocallimastix californiae; identical to SEQ ID NO: 1585
  CBM_10

SEQ ID NO: 1588 - protein, 35 aa, Neocallimastix californiae; identical to SEQ ID NO: 1586
  CBM_10

SEQ ID NO: 1589 - protein, 31 aa, Neocallimastix californiae
  CBM_10
AQGYPCCENSTIVYYTDDDGDWSVENNDWCI

SEQ ID NO: 1590 - protein, 37 aa, Neocallimastix californiae
  CBM_10
CSSKITSQGYSCCSASCEIVYTDDDGTWGVENGDWCG

SEQ ID NO: 1591 - protein, 37 aa, Neocallimastix californiae
  CBM_10
CSSAILAQGYSCCSSCGTVYYTDADGDWGVENNDWCG

SEQ ID NO: 1592 - protein, 37 aa, Neocallimastix californiae
  CBM_10
CPASITNQGYACCAVGCEVVYTDNDGEWGVENNEWCG

SEQ ID NO: 1593 - protein, 27 aa, Neocallimastix californiae
  CBM_10
ACWSQPLGYPCCSSPNAEVYYTDNDGK

SEQ ID NO: 1594 - protein, 36 aa, Neocallimastix californiae
  CBM_10
SCWSKALGYTCCSTCTSVIDSDASGDWGIENGEWCG

SEQ ID NO: 1595 - protein, 34 aa, Neocallimastix californiae
  CBM_10
CKGAQGYPCCQKTCEVYSTDSDGSWNIENNDWCL

SEQ ID NO: 1596 - protein, 36 aa, Neocallimastix californiae
  CBM_10
TCWSETYGYPCCQSTCARLIEDESGAWGAENGEWCG

SEQ ID NO: 1597 - protein, 36 aa, Neocallimastix californiae
  CBM_10
ECWASIIGYPCCQKSTIVYDEDEYGTWSYEDDHWCG

SEQ ID NO: 1598 - protein, 36 aa, Neocallimastix californiae; identical to SEQ ID NO: 1596
  CBM_10

SEQ ID NO: 1599 - protein, 36 aa, Neocallimastix californiae; identical to SEQ ID NO: 1597
  CBM_10

SEQ ID NO: 1600 - protein, 36 aa, Neocallimastix californiae
  CBM_10
SCWSTSLGYPCCKTNCEVLDTDDNGNWGVENDEWCG

SEQ ID NO: 1601 - protein, 36 aa, Neocallimastix californiae
  CBM_10
SCWSIDLGYPCCEPGTEVIYADESGEWGVLNDDWCG

SEQ ID NO: 1602 - protein, 35 aa, Neocallimastix californiae
  CBM_10
TCKFEAIGYPCCSHCDVILTDDDGNWGAENGQWCG

SEQ ID NO: 1603 - protein, 30 aa, Neocallimastix californiae
  CBM_10
CHPYYDCCKGCQTILTDEEGNWGSENGQWC

SEQ ID NO: 1604 - protein, 35 aa, Neocallimastix californiae
  CBM_10
TCWSEPDYPCCKDNSNIVYSDGQGDWGYENENWCG

SEQ ID NO: 1605 - protein, 35 aa, Neocallimastix californiae
  CBM_10
TCWSLPSYPCCTEEQEPVYVDDLGKWGIENNDWCG

SEQ ID NO: 1606 - protein, 35 aa, Neocallimastix californiae
  CBM_10
SCFSEDLGYKCCQGCTVVSTDESGEWGIEDNEWCG

SEQ ID NO: 1607 - protein, 35 aa, Neocallimastix californiae
  CBM_10
SCWSEASGYHCCKLCNISYSDDSGDWGVENNEWCG

SEQ ID NO: 1608 - protein, 27 aa, Neocallimastix californiae
  CBM_10
YLCCKEGTEVIYTDEEGDWGLDGKNWC

SEQ ID NO: 1609 - protein, 35 aa, Neocallimastix californiae
  CBM_10
TCTGSNDGYSCCKTCNVAYTDDQGDWGFENDEWCG

SEQ ID NO: 1610 - protein, 35 aa, Neocallimastix californiae
  CBM_10
SCWAKKLGYDCCTGCNSVYSDESGEWGFENDKWCG

SEQ ID NO: 1611 - protein, 34 aa, Neocallimastix californiae
  CBM_10
TCTGYPDFPCCKGCDVAFSDTTGDWGVENNEWCG

SEQ ID NO: 1612 - protein, 34 aa, Neocallimastix californiae
  CBM_10
TCFSEPDYPCCTSCNVVETDGNQRWGIENNEWCG

SEQ ID NO: 1613 - protein, 33 aa, Neocallimastix californiae
  CBM_10
CHSLPFYPCCASCDVVRETDEGEWGIENDEWCG

SEQ ID NO: 1614 - protein, 35 aa, Neocallimastix californiae
  CBM_10
CWAKALGYECCKTCQASQLKDESGDWGIENGEWCG

SEQ ID NO: 1615 - protein, 29 aa, Neocallimastix californiae
  CBM_10
ALGYPCCKETFEATYTDENGKWAIENDEW

SEQ ID NO: 1616 - protein, 35 aa, Neocallimastix californiae
  CBM_10
CWSESLGYPCCTKTTEVVSEDSDGQWGLENDNWCG

SEQ ID NO: 1617 - protein, 35 aa, Neocallimastix californiae
  CBM_10
SCWAEKLGYKCCKECTVTYNDENGDWGFENGDWCG

SEQ ID NO: 1618 - protein, 34 aa, Neocallimastix californiae
  CBM_10
ECFSTPDYPCCSSCQTIYSDNDGDWGYEDDKWCG

SEQ ID NO: 1619 - protein, 35 aa, Neocallimastix californiae
  CBM_10
ECWSLPDYPCCEESTDVVYSDESGDWSVENDDWCG

SEQ ID NO: 1620 - protein, 35 aa, Neocallimastix californiae
  CBM_10
SCWSESQGYNCCSGCEVVYEDDSGKWGVENDDWCG

SEQ ID NO: 1621 - protein, 36 aa, Neocallimastix californiae
  CBM_10
SSSIQRQGYKCCKPGCEIIYVDNDGNWGVENGQWCG

SEQ ID NO: 1622 - protein, 31 aa, Neocallimastix californiae
  CBM_10
DQGYNCCSSCSFVYYTDSDGNWGVENNDWCG

SEQ ID NO: 1623 - protein, 35 aa, Neocallimastix californiae
  CBM_10
SCWSLSQGYPCCQSCNVTYEDESGKWGVENGNWCG

SEQ ID NO: 1624 - protein, 30 aa, Neocallimastix californiae
  CBM_10
AGYPCCARSCIVVTKDDDGYWGIENNNWCL

SEQ ID NO: 1625 - protein, 37 aa, Neocallimastix californiae
  CBM_10
ACWSQSLGYPCCSSPNAEVYYTDNDGKWSVENNDWCG

SEQ ID NO: 1626 - protein, 34 aa, Neocallimastix californiae
  CBM_10
SCFSYPTYPCCKGNTVIYTDEQGAWGIENDNWCG

SEQ ID NO: 1627 - protein, 35 aa, Neocallimastix californiae
  CBM_10
SCWAKSLGYNCCSHCSVSYTDENGKWGVENNEWCG

SEQ ID NO: 1628 - protein, 36 aa, Neocallimastix californiae
  CBM_10
ACWSEKLGYPCCKSTNDVYYEDDDGQWGVENNDWCG

SEQ ID NO: 1629 - protein, 36 aa, Neocallimastix californiae
  CBM_10
TCWSEKLGYPCCNSTNEVVYEDNDGPWGVENNNWCG

SEQ ID NO: 1630 - protein, 33 aa, Neocallimastix californiae
  CBM_10
CWSLPEYPCCEGNSIVTSDSQGDWGYENNHWCG

SEQ ID NO: 1631 - protein, 33 aa, Neocallimastix californiae
  CBM_10
CWSLPDYPCCEGNTIVTTDSHGDWGYENNHWCG

SEQ ID NO: 1632 - protein, 34 aa, Neocallimastix californiae
  CBM_10
CWSAAMGYNCCKGCTVYIEDQSGQWGYENHQWCG

SEQ ID NO: 1633 - protein, 34 aa, Neocallimastix californiae
  CBM_10
SCGAAAIGYPCCENTCTEVYTDEYRWGVENNDWC

SEQ ID NO: 1634 - protein, 33 aa, Neocallimastix californiae
  CBM_10
TCWSEPDYKCCSTCDIVYTDDHNWGVEDDEWCG

SEQ ID NO: 1635 - protein, 33 aa, Neocallimastix californiae
  CBM_10
CPGSNQGYSCCKTCEVYMTDETGPWNIENDEWC

SEQ ID NO: 1636 - protein, 38 aa, Neocallimastix californiae
  CBM_10
TCWSESLGYPCCSMGCNAINYYTDDDGFWGVENDDWCG

SEQ ID NO: 1637 - protein, 31 aa, Neocallimastix californiae
  CBM_10
QQGYKCCGNNCIVVYQDNDGYWGVENNQWCG

SEQ ID NO: 1638 - protein, 31 aa, Neocallimastix californiae
  CBM_10
KQGYPCCKNTKAVVFRDNDGNWGIENNDWCY

SEQ ID NO: 1639 - protein, 36 aa, Neocallimastix californiae
  CBM_10
CKASLIGYACCSPENTTIQYHDEDGDWGVENGEWCG

SEQ ID NO: 1640 - protein, 35 aa, Neocallimastix californiae
  CBM_10
CFSKFLGYPCCSSVVEVAYIDEDGKWGIENDAWCG

SEQ ID NO: 1641 - protein, 36 aa, Neocallimastix californiae
  CBM_10
CVVASLGYACCSPGNTVVYYQDENGDWGVENDDWCG

SEQ ID NO: 1642 - protein, 36 aa, Neocallimastix californiae
  CBM_10
ACWSDKLGYPCCSGCTENVYEDNDGKWGVENGDWCG

SEQ ID NO: 1643 - protein, 35 aa, Neocallimastix californiae
  CBM_10
CWSERLGYPCCTSTNGIYFSDNDGDWGIENDDWCG

SEQ ID NO: 1644 - protein, 36 aa, Neocallimastix californiae
  CBM_10
SCWSKALGYNCCTSTSDVIFEDSDGQWGIENDDWCG

SEQ ID NO: 1645 - protein, 39 aa, Neocallimastix californiae
  CBM_10
CWSESLGYRCCKDDESIVEYIDEDGWWGVTNDEKPDWCG

SEQ ID NO: 1646 - protein, 38 aa, Neocallimastix californiae
  CBM_10
SCSSKILAQGYKCCSSNCSVVYTDADGTWGVENNQWCG

SEQ ID NO: 1647 - protein, 31 aa, Neocallimastix californiae
  CBM_10
AQGYPCCKKETTVYYTDSDGKWSVENNDWCL

SEQ ID NO: 1648 - protein, 33 aa, Neocallimastix californiae
  CBM_10
CEATNGYPKCSSCVVYYTDENGDWGVENNDWCL

SEQ ID NO: 1649 - protein, 32 aa, Neocallimastix californiae
  CBM_10
KCHSQYECCSNCEVIYSDDEGDWGVENYDWCF

SEQ ID NO: 1650 - protein, 35 aa, Neocallimastix californiae
  CBM_10
SCWSSSLGYDCCDDCNTLYTDESGDWGVKNNDWCG

SEQ ID NO: 1651 - protein, 35 aa, Neocallimastix californiae
  CBM_10
SCWSKALGYDCCDDCNTLYTDDSGDWGVKNNDWCG

SEQ ID NO: 1652 - protein, 31 aa, Neocallimastix californiae
  CBM_10
DQGYKCCSTCGTVYYTDDDGDWGVENNEWCG

SEQ ID NO: 1653 - protein, 31 aa, Neocallimastix californiae
  CBM_10
AQGYKCCSDRCEVVYQDGDGDWGVENGEWCG

SEQ ID NO: 1654 - protein, 31 aa, Neocallimastix californiae
  CBM_10
DQGYSCCSVCGTVYYTDGDGDWGVENNQWCG

SEQ ID NO: 1655 - protein, 37 aa, Neocallimastix californiae
  CBM_10
CSASILAQGYECCSDRCEVVYQDGDGDWGVENGEWCG

SEQ ID NO: 1656 - protein, 34 aa, Neocallimastix californiae
  CBM_10
CWSEQLGYPCCQGCTVFETDADGSWGYESNHWCG

SEQ ID NO: 1657 - protein, 39 aa, Neocallimastix californiae
  CBM_10
SCWAERLGYPCCSANNQKIYAHDNDGDWGYNWKTNEWCG

SEQ ID NO: 1658 - protein, 37 aa, Neocallimastix californiae; identical to SEQ ID NO: 1523
  CBM_10

SEQ ID NO: 1659 - protein, 35 aa, Neocallimastix californiae; identical to SEQ ID NO: 1566
  CBM_10

SEQ ID NO: 1660 - protein, 35 aa, Neocallimastix californiae
  CBM_10
TCWSTKLGYPCCEVSNVIYSVDDNGSWGYEDDHWC

SEQ ID NO: 1661 - protein, 35 aa, Neocallimastix californiae
  CBM_10
ECKFSGLGYTCCPDSEVIFEDDHKWGATSDGQWCG

SEQ ID NO: 1662 - protein, 35 aa, Neocallimastix californiae; identical to SEQ ID NO: 1549
  CBM_10

SEQ ID NO: 1663 - protein, 37 aa, Neocallimastix californiae
  CBM_10
ACWSTSLGYPCCSSSNAEVWFTDDSGKWGVENGDWCG

SEQ ID NO: 1664 - protein, 35 aa, Neocallimastix californiae; identical to SEQ ID NO: 1566
  CBM_10

SEQ ID NO: 1665 - protein, 35 aa, Neocallimastix californiae
  CBM_10
SCFAEKLGYPCCSSCDVLYTDNDGEWGVENDNWCG

SEQ ID NO: 1666 - protein, 34 aa, Neocallimastix californiae
  CBM_10
CFSISLGFPCCKGNTVVYSDNDGDWGVENNEWCG

SEQ ID NO: 1667 - protein, 31 aa, Neocallimastix californiae
  CBM_10
SQGYKCCSSNCEVVYTDDDGTWGVENEEWCG

SEQ ID NO: 1668 - protein, 37 aa, Neocallimastix californiae
  CBM_10
CSAKILKQGYECCPSGCDVIYTDDDGDWGVNNGDWCG

SEQ ID NO: 1669 - protein, 37 aa, Neocallimastix californiae
  CBM_10
CSSKITDLGYKCCSSGCQVVYTDDDGTWGVENEEWCG

SEQ ID NO: 1670 - protein, 35 aa, Neocallimastix californiae
  CBM_10
TCWSLPSYPCCSSGIESAYEDDLGKWGIENGDWCG

SEQ ID NO: 1671 - protein, 35 aa, Neocallimastix californiae
  CBM_10
SCAAEAFGYNCCNGCTVVTTDETGDWGVENDEWCG

SEQ ID NO: 1672 - protein, 35 aa, Neocallimastix californiae
  CBM_10
KCWSEPDYPCCSGNTEIIYSDASGDWGYENNNWCG

SEQ ID NO: 1673 - protein, 35 aa, Neocallimastix californiae; identical to SEQ ID NO: 1671
  CBM_10

SEQ ID NO: 1674 - protein, 35 aa, Neocallimastix californiae; identical to SEQ ID NO: 1672
  CBM_10

SEQ ID NO: 1675 - protein, 35 aa, Neocallimastix californiae; identical to SEQ ID NO: 1670
  CBM_10

SEQ ID NO: 1676 - protein, 36 aa, Neocallimastix californiae
  CBM_10
SCWASTIGFPCCKSSCEVAYTDNDGDWAIENDEWCG

SEQ ID NO: 1677 - protein, 35 aa, Neocallimastix californiae
  CBM_10
SCFSKDMGYPCCSTCEVAYTDSDGGWGVENGEWCG

SEQ ID NO: 1678 - protein, 33 aa, Neocallimastix californiae
  CBM_10
CWTLDQSYPCCSSLSAKVDGYSDKWGYENGDWC

SEQ ID NO: 1679 - protein, 35 aa, Neocallimastix californiae
  CBM_10
KCWAYKLGYPCCEGNTIIEINEDGKWGIENDEWCG

SEQ ID NO: 1680 - protein, 36 aa, Neocallimastix californiae
  CBM_10
ECWSTSLGYPCCETTKDIIYNSNKGSWGYENDSWCG

SEQ ID NO: 1681 - protein, 35 aa, Neocallimastix californiae
  CBM_10
CWSLKQNYPCCKITKKVQFTDENGKWGVEKGNWCG

SEQ ID NO: 1682 - protein, 35 aa, Neocallimastix californiae
  CBM_10
CWSEPLGYPCCKETKKIEYYDDNGPWGMENDDWCG

SEQ ID NO: 1683 - protein, 36 aa, Neocallimastix californiae
  CBM_10
SCWSTSLGYPCCKTNCDVVVTDGDGDWGVENDEWCG

SEQ ID NO: 1684 - protein, 36 aa, Neocallimastix californiae
  CBM_10
ACWSLALGYPCCEPGTTAIYTDDSGDWGVLNDDWCG

SEQ ID NO: 1685 - protein, 36 aa, Neocallimastix californiae
  CBM_10
CWSEKLGWPCCSKGNTEVYYVDDDGDWGVENDDWCG

SEQ ID NO: 1686 - protein, 37 aa, Neocallimastix californiae
  CBM_10
KCFTEEKGMDFPCCQGCEVYYTDDDGEWGFENNQWCG

SEQ ID NO: 1687 - protein, 36 aa, Neocallimastix californiae
  CBM_10
CFTEEKGLGFPCCQECTVVTSDDDGDWGVENNEWCG

SEQ ID NO: 1688 - protein, 35 aa, Neocallimastix californiae
  CBM_10
KCWAKDLGFSCCQACEVTYTDNDGDWGFENGDWCG

SEQ ID NO: 1689 - protein, 35 aa, Neocallimastix californiae
  CBM_10
SCWSTALGYPCCDTCVSVSFEDGDGKWGIQNDDWC

SEQ ID NO: 1690 - protein, 34 aa, Neocallimastix californiae
  CBM_10
CSGAQGYPCCKSSCDVYSSDNDGNWSIENDDWCL

SEQ ID NO: 1691 - protein, 34 aa, Neocallimastix californiae; identical to SEQ ID NO: 1690
  CBM_10

SEQ ID NO: 1692 - protein, 35 aa, Neocallimastix californiae; identical to SEQ ID NO: 1689
  CBM_10

SEQ ID NO: 1693 - protein, 37 aa, Neocallimastix californiae
  CBM_10
CSSKITAQGYKCCSANCEVVYTDDDGNWGVENNNWCG

SEQ ID NO: 1694 - protein, 31 aa, Neocallimastix californiae
  CBM_10
AQGYPCCKTETTVYFTDDDGNWSVENGDWCL

SEQ ID NO: 1695 - protein, 35 aa, Neocallimastix californiae
  CBM_10
ACWSEPLGYPCCSSCSYVYYVDDDGNWGVENDDWC

SEQ ID NO: 1696 - protein, 34 aa, Neocallimastix californiae
  CBM_10
KITSQGYSCCPANCQIVYTDSDGTWGVHNDQWCG

SEQ ID NO: 1697 - protein, 33 aa, Neocallimastix californiae
  CBM_10
SFTSQGYGCCSRCGEVYFTDESGNWGIENGDWC

SEQ ID NO: 1698 - protein, 36 aa, Neocallimastix californiae
  CBM_10
ECWSKALGYDCCKEGTDVIYTDESGKWGMDGDDWCG

SEQ ID NO: 1699 - protein, 29 aa, Neocallimastix californiae
  CBM_10
GLYPCCSTCTSVFEDKDGKWGVENEEWCL

SEQ ID NO: 1700 - protein, 30 aa, Neocallimastix californiae
  CBM_10
QNGYECCKSCDVVFTDDDGEWGVEDGQWCG

SEQ ID NO: 1701 - protein, 35 aa, Neocallimastix californiae
  CBM_10
ACWSQKLGYPCCSSSSAEVWYTDNDGKWGVENNDW

SEQ ID NO: 1702 - protein, 35 aa, Neocallimastix californiae
  CBM_10
ECWSNKSGYPCCDSCDIYLDDETGKWGVMNGDWCG

SEQ ID NO: 1703 - protein, 35 aa, Neocallimastix californiae
  CBM_10
TCKFEALGYKCCSNCIAVFEDDDGYWGSENNEWCG

SEQ ID NO: 1704 - protein, 31 aa, Neocallimastix californiae
  CBM_10
AQGYPCCKSTCDVYSTDNDGKWGIENNDWCL

SEQ ID NO: 1705 - protein, 35 aa, Neocallimastix californiae
  CBM_10
ACWSVGLGYQCCKSCNVEYKDNDGEWGIENNKWCG

SEQ ID NO: 1706 - protein, 31 aa, Neocallimastix californiae; identical to SEQ ID NO: 1704
  CBM_10

SEQ ID NO: 1707 - protein, 35 aa, Neocallimastix californiae
  CBM_10
ACWSVGLGYQCCKSCDVVFKDNDGEWGVENEKWCG

SEQ ID NO: 1708 - protein, 31 aa, Neocallimastix californiae
  CBM_10
GRDGYPPCQETTEVLYTDDSEWGVENDGWCV

SEQ ID NO: 1709 - protein, 35 aa, Neocallimastix californiae
  CBM_10
TCFSERLGYPCCKGNEVLYTDNDGKWGVENDEWCG

SEQ ID NO: 1710 - protein, 35 aa, Neocallimastix californiae
  CBM_10
TCFSERLGYPCCKDNKVLYTNDIGNWGIENGNWCG

SEQ ID NO: 1711 - protein, 37 aa, Neocallimastix californiae
  CBM_10
ECWSERLGWPCCSKENTDVYYVDDDGEWGVENDDWCG

SEQ ID NO: 1712 - protein, 31 aa, Neocallimastix californiae
  CBM_10
AQGYPCCQSSCNVISTDSDGKWSVENDDWCL

SEQ ID NO: 1713 - protein, 35 aa, Neocallimastix californiae
  CBM_10
ACWSIGKGYNCCKSCNVVYKDNDGEWGVENDKWCG

SEQ ID NO: 1714 - protein, 38 aa, Neocallimastix californiae
  CBM_10
ECWANKVGYPCCDFDNNNVIYKDKDGSWGLTNENEWCG

SEQ ID NO: 1715 - protein, 36 aa, Neocallimastix californiae
  CBM_10
CWSEKLGYPCCTSEKAKVSYSDENGHWGIENNQWCG

SEQ ID NO: 1716 - protein, 38 aa, Neocallimastix californiae; identical to SEQ ID NO: 1714
  CBM_10

SEQ ID NO: 1717 - protein, 38 aa, Neocallimastix californiae
  CBM_10
TCSAKILAQGYSCCPKGCRVYVTDDDGDWGYVNNEWCG

SEQ ID NO: 1718 - protein, 30 aa, Neocallimastix californiae
  CBM_10
AQGYPCCKGKSEIYFVDKDGNWGYENGDWC

SEQ ID NO: 1719 - protein, 37 aa, Neocallimastix californiae
  CBM_10
CPASITSQGYECCSENCEIVYTDDDGNWGVENNQWCG

SEQ ID NO: 1720 - protein, 32 aa, Neocallimastix californiae
  CBM_10
TDQGYPCCSTGCTVYYTDNDGDWGVENNQWCG

SEQ ID NO: 1721 - protein, 35 aa, Neocallimastix californiae
  CBM_10
KCWAKSLGYSCCKSCKVYTVDKHGSWGVEDGKWCG

SEQ ID NO: 1722 - protein, 35 aa, Neocallimastix californiae
  CBM_10
TCWSSFYGYDCCKGCKVRYVDNLGSWGYEGNKWCG

SEQ ID NO: 1723 - protein, 34 aa, Neocallimastix californiae
  CBM_10
CWSESKGYPCCKSCDVVTVDRHGSWGIENGQWCG

SEQ ID NO: 1724 - protein, 35 aa, Neocallimastix californiae
  CBM_10
TCWASFYGYSCCKGCKVRYVDNLGSWGYEGNQWCG

SEQ ID NO: 1725 - protein, 35 aa, Neocallimastix californiae
  CBM_10
TCWSESKGYKCCKYCDVISVDRFGSWGVENGEWCG

SEQ ID NO: 1726 - protein, 35 aa, Neocallimastix californiae
  CBM_10
TCWSSGYGYPCCNNCKVYFIDETGEWGIQDGNWCG

SEQ ID NO: 1727 - protein, 37 aa, Neocallimastix californiae
  CBM_10
CSASITAQGYKCCSANCEVVYTDNDGDWGVENNEWCG

SEQ ID NO: 1728 - protein, 37 aa, Neocallimastix californiae
  CBM_10
CSSSITAQGYKCCSSCGTVYYTDGDGDWGVENGNWCG

SEQ ID NO: 1729 - protein, 36 aa, Neocallimastix californiae
  CBM_10
SCWATKIGYSCCKSTTQVEYTDDDGKWGIENDDWCG

SEQ ID NO: 1730 - protein, 37 aa, Neocallimastix californiae
  CBM_10
SCWATKLGYKCCTAECPVVYYTDDDGKWSVENDDWCG

SEQ ID NO: 1731 - protein, 37 aa, Neocallimastix californiae
  CBM_10
CSSNITRQGYKCCSKNCVVVYTDNDGTWGVENEEWCG

SEQ ID NO: 1732 - protein, 31 aa, Neocallimastix californiae
  CBM_10
AQGYPCCKSTKQVYYTDDDGSWGIEDGDWCI

SEQ ID NO: 1733 - protein, 35 aa, Neocallimastix californiae
  CBM_10
CWSIKFGYPCCITSSEALVTDDNGQWGSENGQWCG

SEQ ID NO: 1734 - protein, 35 aa, Neocallimastix californiae
  CBM_10
CFATKLGYPCCSIGYPSILTDKDGDWSVENGQWCG

SEQ ID NO: 1735 - protein, 28 aa, Neocallimastix californiae
  CBM_10
AYSECRGCAVYYVEDGVNWGVENDDWCL

SEQ ID NO: 1736 - protein, 34 aa, Neocallimastix californiae
  CBM_10
QCFSYPEYTCCEGCNVIEEDGSGKWGIENNQWCG

SEQ ID NO: 1737 - protein, 32 aa, Neocallimastix californiae
  CBM_10
KGTGYGCCVFKNTIVETVDESGKWGHEGNEWC

SEQ ID NO: 1738 - protein, 38 aa, Neocallimastix californiae
  CBM_10
CWSLADGYPCCRKETTKIEYVSKSSGKEWGLENGDWCG

SEQ ID NO: 1739 - protein, 29 aa, Neocallimastix californiae
  CBM_10
NESYSCCKKCDVIYTDEYKWGVEGGDWCI

SEQ ID NO: 1740 - protein, 31 aa, Neocallimastix californiae
  CBM_10
AQGYPCCKKSCAIYSTDGDGDWSIENNDWCL

SEQ ID NO: 1741 - protein, 36 aa, Neocallimastix californiae
  CBM_10
TCWSKALGYECCKSCSPVYFTDEDGEWGVVGNDWCG

SEQ ID NO: 1742 - protein, 37 aa, Neocallimastix californiae; identical to SEQ ID NO: 1478
  CBM_10

SEQ ID NO: 1743 - protein, 36 aa, Neocallimastix californiae
  CBM_10
CVVASMGYACCSPNNTEVYFQDENGDWGVENNDWCG

SEQ ID NO: 1744 - protein, 36 aa, Neocallimastix californiae
  CBM_10
QCWSDKLGFPCCSGCIDTVYTDNDGKWGVQNDDWCG

SEQ ID NO: 1745 - protein, 40 aa, Neocallimastix californiae
  CBM_10
TCWSETLGYRCCKDNENIVQYIDEDGWWGVTNDEQPDWCG

SEQ ID NO: 1746 - protein, 36 aa, Neocallimastix californiae
  CBM_10
KCWSTSLGYSCCKTCTDVVFVDSSGKWGVEGDDWCG

SEQ ID NO: 1747 - protein, 31 aa, Neocallimastix californiae
  CBM_10
IQGYSCCKSNCNVYEEDSDGKWSIENDEWCL

SEQ ID NO: 1748 - protein, 35 aa, Neocallimastix californiae; identical to SEQ ID NO: 1522
  CBM_10

SEQ ID NO: 1749 - protein, 31 aa, Neocallimastix californiae
  CBM_10
KQGYKCCASGCSVIYTDDDGTWGVENGEWCG

SEQ ID NO: 1750 - protein, 33 aa, Neocallimastix californiae
  CBM_10
TSQGYKCCSANNCNVYFTDDAGKWGIENDDWCG

SEQ ID NO: 1751 - protein, 36 aa, Neocallimastix californiae
  CBM_10
CWSESLGFPCCPSSYCEIVKTDSHGSWGFRNNEWCG

SEQ ID NO: 1752 - protein, 35 aa, Neocallimastix californiae
  CBM_10
ACFSERLGYPCCKGNNVVYTDNDGKWGVENNNWCG

SEQ ID NO: 1753 - protein, 35 aa, Neocallimastix californiae
  CBM_10
ACWSQALGYPCCTHKNAVYTDGDGDWGVENGDWCG

SEQ ID NO: 1754 - protein, 34 aa, Neocallimastix californiae
  CBM_10
CKGAQGYPCCKSNKTVYYTDDDGDWSVENDDWCL

SEQ ID NO: 1755 - protein, 31 aa, Neocallimastix californiae
  CBM_10
AQGYKCCSSGCEVVYTDDDGTWGVENDEWCG

SEQ ID NO: 1756 - protein, 24 aa, Neocallimastix californiae
  CBM_10
CSTCRAVTVEDGISWGVENNDWCI

SEQ ID NO: 1757 - protein, 34 aa, Neocallimastix californiae
  CBM_10
QCFSYPEYSCCKSCTVIAEDDNGQWGIEDDEWCG

SEQ ID NO: 1758 - protein, 30 aa, Neocallimastix californiae
  CBM_10
PGYTCCEGCKVSEIDGDGISWGIENGEWCI

SEQ ID NO: 1759 - protein, 35 aa, Neocallimastix californiae
  CBM_10
QCTGSNQGYQCCNGCKVEYTDGDGPWGVENGQWCG

SEQ ID NO: 1760 - protein, 36 aa, Neocallimastix californiae
  CBM_10
CFSTRLGFPCCSSWNKKVEFSDGDGNWGIENGSWCG

SEQ ID NO: 1761 - protein, 36 aa, Neocallimastix californiae
  CBM_10
SCWSTSLGYPCCSSCVNAAYQDNDGYWGVENDDWCG

SEQ ID NO: 1762 - protein, 31 aa, Neocallimastix californiae
  CBM_10
AQGYPCCKSTCLVYSEDGDGQWSIENNDWCL

SEQ ID NO: 1763 - protein, 38 aa, Neocallimastix californiae
  CBM_10
KCWSLAEGYPCCEKKGTKVRHVSKNGNEWGVEHGDWCG

SEQ ID NO: 1764 - protein, 37 aa, Neocallimastix californiae
  CBM_10
ECWAKELGFECCTSKDIEVQYTDKDGNWGIENDTWCG

SEQ ID NO: 1765 - protein, 36 aa, Neocallimastix californiae
  CBM_10
CWAEELGFKCCSSSDAKVEYTDNDGEWSIEDGNWCG

SEQ ID NO: 1766 - protein, 34 aa, Neocallimastix californiae
  CBM_10
SCWSLPEYPCCNGDTVVYTDGQGDWGYENGDWCG

SEQ ID NO: 1767 - protein, 34 aa, Neocallimastix californiae
  CBM_10
ECWSLPDFPCCNGNTVVYTDIQGDWGYENDNWCG

SEQ ID NO: 1768 - protein, 34 aa, Neocallimastix californiae
  CBM_10
CWSTAMGYNCCSGCNVEIEDDSGKWGIENNQWCG

SEQ ID NO: 1769 - protein, 36 aa, Neocallimastix californiae
  CBM_10
ECFGEISGEYKCCESCKVWYTDEQGDWGVENNDWCS

SEQ ID NO: 1770 - protein, 35 aa, Neocallimastix californiae
  CBM_10
CWSEKLGYSCCQKTCKIKYTGTDGKWGIENNQWCG

SEQ ID NO: 1771 - protein, 37 aa, Neocallimastix californiae; identical to SEQ ID NO: 1478
  CBM_10

SEQ ID NO: 1772 - protein, 36 aa, Neocallimastix californiae
  CBM_10
CWSEVLGYPCCKGCTIFEEDEDGQWGYDFKEATWCG

SEQ ID NO: 1773 - protein, 38 aa, Neocallimastix californiae
  CBM_10
CWVAQFGYPCCSSNNRVVYASDNEGDWGYNFVTKEWCG

SEQ ID NO: 1774 - protein, 36 aa, Neocallimastix californiae
  CBM_10
ACWSQPLGYPCCSSPNAEVYYTDNDGKWSVENNDWC

SEQ ID NO: 1775 - protein, 31 aa, Neocallimastix californiae
  CBM_10
NTGYNCCLFTTTVITSDSVGDWGVENDDWCL

SEQ ID NO: 1776 - protein, 28 aa, Neocallimastix californiae
  CBM_10
GEYPCCKECNVYYTDTEDWGIENGEWCS

SEQ ID NO: 1777 - protein, 35 aa, Neocallimastix californiae
  CBM_10
CPDGGDKYRCCLKTCKASYTDSTGDWAVESNNWCL

SEQ ID NO: 1778 - protein, 38 aa, Neocallimastix californiae
  CBM_10
CPSSITSQGYKCCSSDNCNVYATDDDGKWGIEDGDWCG

SEQ ID NO: 1779 - protein, 36 aa, Neocallimastix californiae
  CBM_10
SDAILKQGYKCCSKDCTIIYTDDDGSWGVENDEWCG

SEQ ID NO: 1780 - protein, 36 aa, Neocallimastix californiae; identical to SEQ ID NO: 1774
  CBM_10

SEQ ID NO: 1781 - protein, 37 aa, Neocallimastix californiae; identical to SEQ ID NO: 1450
  CBM_10

SEQ ID NO: 1782 - protein, 18 aa, Neocallimastix californiae
  CBM_10
VYTDNDGKWGVENGNWCG

SEQ ID NO: 1783 - protein, 32 aa, Neocallimastix californiae
  CBM_10
CWAAPYPCCKGNEVVYTDDQGDWGVEDGDWCG

SEQ ID NO: 1784 - protein, 31 aa, Neocallimastix californiae
  CBM_10
LPDYPCCSAGAEVVYEDDQGQWGVENGEWCG

SEQ ID NO: 1785 - protein, 35 aa, Neocallimastix californiae
  CBM_10
TCKFEALGYKCCSHCISYIEDEDGSWGVENGKWCG

SEQ ID NO: 1786 - protein, 35 aa, Neocallimastix californiae
  CBM_10
ECWSKKYGYPCCDTCNVFIIDKYGEWGIKDNDWCG

SEQ ID NO: 1787 - protein, 36 aa, Neocallimastix californiae
  CBM_10
TCWSETYGYPCCKTTNKVVYTDEDGKWGVEDKKWCG

SEQ ID NO: 1788 - protein, 37 aa, Neocallimastix californiae
  CBM_10
TCWSEKLGYPCCSSSDAEIIYTDKDGNWSIENYEWCG

SEQ ID NO: 1789 - protein, 38 aa, Neocallimastix californiae
  CBM_10
SCWAEALGYKCCSADAFTPVIFTDSDGDWSAENGEWCG

SEQ ID NO: 1790 - protein, 37 aa, Neocallimastix californiae
  CBM_10
TCWSKTYGYDCCAEGTAVYLEDESGKWGVTDDYQWCG

SEQ ID NO: 1791 - protein, 35 aa, Neocallimastix californiae
  CBM_10
CFAKSDGYDCCFDNEVVYEDDSGKWGINDEGEWCG

SEQ ID NO: 1792 - protein, 38 aa, Neocallimastix californiae
  CBM_10
KCRAQVKGFPCCKPNTEIFSVDADGYWGYNEETGEWCG

SEQ ID NO: 1793 - protein, 34 aa, Neocallimastix californiae
  CBM_10
SCWSEPDYPCCKYSCEVYFTDDHKWGIENGEWCG

SEQ ID NO: 1794 - protein, 33 aa, Neocallimastix californiae
  CBM_10
CKNVGLYNCCESCNIYTEEEGDKWGVENDEWCS

SEQ ID NO: 1795 - protein, 35 aa, Neocallimastix californiae
  CBM_10
ACWSQPLGYPCCSSPNAEVYYTDNDGKWSVENNDW

SEQ ID NO: 1796 - protein, 36 aa, Neocallimastix californiae
  CBM_10
SCWANELGYACCKSAKTVYATDKDGKWSVENNEWCG

SEQ ID NO: 1797 - protein, 35 aa, Neocallimastix californiae
  CBM_10
ECFSEKLGYKCCYGTRVVLTDSDGKWGVENNQWCG

SEQ ID NO: 1798 - protein, 35 aa, Neocallimastix californiae
  CBM_10
CWSHRYGYPCCTKTNEVLYSDSDGDWGIENGEWCG

SEQ ID NO: 1799 - protein, 36 aa, Neocallimastix californiae
  CBM_10
CFTSINNLGYPCCEGCEILYTDDDGDWGVENEDWCG

SEQ ID NO: 1800 - protein, 28 aa, Neocallimastix californiae
  CBM_10
NAEYPYCNNCVTVYEDDQKWGILNNQWC

SEQ ID NO: 1801 - protein, 35 aa, Neocallimastix californiae
  CBM_10
CWAEEYGYSCCSGCGIVVEEPGNVNWGIEYDKWCG

SEQ ID NO: 1802 - protein, 36 aa, Neocallimastix californiae
  CBM_10
CFSTRLGYPCCSSWNKQVAYTDNDGNWGVENGNWCG

SEQ ID NO: 1803 - protein, 35 aa, Neocallimastix californiae
  CBM_10
QCTGQNQGYQCCNGCKVEYTDNDGKWGIENNQWCG

SEQ ID NO: 1804 - protein, 35 aa, Neocallimastix californiae
  CBM_10
SCFSEKLGYKCCEGNVVEYIDEDGKWGIENDQWCG

SEQ ID NO: 1805 - protein, 36 aa, Neocallimastix californiae
  CBM_10
CSANIKNQGYSCCSNCIVYYTDNDGKWGIENESWCG

SEQ ID NO: 1806 - protein, 31 aa, Neocallimastix californiae
  CBM_10
KDQGYPCCKSCNVILTDESGDWGVENNDWCG

SEQ ID NO: 1807 - protein, 35 aa, Neocallimastix californiae
  CBM_10
ECWSTQFGYPCCDTCDVFLSDESGDWGVKDLDWCG

SEQ ID NO: 1808 - protein, 34 aa, Neocallimastix californiae
  CBM_10
CKAEALGYKCCSTCVSILEDENGLWGAENGEWCG

SEQ ID NO: 1809 - protein, 33 aa, Neocallimastix californiae
  CBM_10
CFSFPNYKCCKDCQVVYEDEDGKWGYENDEWCG

SEQ ID NO: 1810 - protein, 37 aa, Neocallimastix californiae
  CBM_10
ECWSESLGFPCCPSDYCEVAKTDSSGSWGIFDNNWCG

SEQ ID NO: 1811 - protein, 33 aa, Neocallimastix californiae
  CBM_10
CLSAGEYPCCESCNIYSEEEGDKWGIENNDWCS

SEQ ID NO: 1812 - protein, 34 aa, Neocallimastix californiae
  CBM_10
TCWSEPDYPCCKSSCEVYYTDEHKWGVENGDWCG

SEQ ID NO: 1813 - protein, 37 aa, Neocallimastix californiae
  CBM_10
QCWSIAVGYPCCSNANAEIIMTDESGNWGIENDDWCG

SEQ ID NO: 1814 - protein, 35 aa, Neocallimastix californiae
  CBM_10
CWSEEFGYPCCKNKDTKVSSTDQSGTWGIENGKWC

SEQ ID NO: 1815 - protein, 36 aa, Neocallimastix californiae
  CBM_10
CWSIAFGYPCCTNTYTQVVMNDESGEWGVENDDWCG

SEQ ID NO: 1816 - protein, 36 aa, Neocallimastix californiae
  CBM_10
ECWSKKYGYPCCENTEQKPITYDATGSWGYENNSFC

SEQ ID NO: 1817 - protein, 33 aa, Neocallimastix californiae
  CBM_10
ECFSYPLYPCCNGCDVIEETEEGKWGVENDEWC

SEQ ID NO: 1818 - protein, 27 aa, Neocallimastix californiae
  CBM_10
AYEECKGCGVVYEDDMKWGVENDDWCI

SEQ ID NO: 1819 - protein, 35 aa, Neocallimastix californiae
  CBM_10
SCFSIVQGYPCCETCHIDYTDESGDWGVEDDKWCG

SEQ ID NO: 1820 - protein, 37 aa, Neocallimastix californiae
  CBM_10
KCFSQKLNPSYPCCKGNEVVYTDESGDWGVENNSWCG

SEQ ID NO: 1821 - protein, 35 aa, Neocallimastix californiae
  CBM_10
TCFSIELGYPCCKDNKVIYTDERGDWGKENHQWCG

SEQ ID NO: 1822 - protein, 34 aa, Neocallimastix californiae
  CBM_10
SWSNELGYPSCQSTKEIKFYAEQGGFGYENGSWC

SEQ ID NO: 1823 - protein, 31 aa, Neocallimastix californiae
  CBM_10
CWSLDQGYPCCEGQYQKYDDDWGYQNNEWCG

SEQ ID NO: 1824 - protein, 37 aa, Neocallimastix californiae
  CBM_10
ECWAKALGYECCKSENPKVYTVDGDGEWAIENSEWCG

SEQ ID NO: 1825 - protein, 37 aa, Neocallimastix californiae
  CBM_10
KCWSLDLGYPCCNPKNTNVVYTDGTGKWGVENGDWCG

SEQ ID NO: 1826 - protein, 38 aa, Neocallimastix californiae
  CBM_10
CWSELLSNPFPCCKNDDVKEIGKDMDGAWGEENGTKCG

SEQ ID NO: 1827 - protein, 36 aa, Neocallimastix californiae
  CBM_10
ECFAKRLGYSCCTTTKEVVSIDPNGKWGIENGHICG

SEQ ID NO: 1828 - protein, 37 aa, Neocallimastix californiae
  CBM_10
CLSEFIGYPCCSPEFTTIYAQDEYGDWSYDFVKNEWC

SEQ ID NO: 1829 - protein, 35 aa, Neocallimastix californiae
  CBM_10
ECWSEELGYPCCKGCRVYETDSDGSWGYEFNQWCG

SEQ ID NO: 1830 - protein, 35 aa, Neocallimastix californiae; identical to SEQ ID NO: 1829
  CBM_10

SEQ ID NO: 1831 - protein, 33 aa, Neocallimastix californiae
  CBM_10
ACWSQPLGYPCCSSPNAEVYYTDNDGKWSVENN

SEQ ID NO: 1832 - protein, 37 aa, Neocallimastix californiae
  CBM_10
KCFSQKLNPSYPCCTGNEVVYTDENGDWGVENNSWCG

SEQ ID NO: 1833 - protein, 35 aa, Neocallimastix californiae
  CBM_10
TCFSIELGYPCCTDNKVIYTDERGDWGKENHQWCG

SEQ ID NO: 1834 - protein, 35 aa, Neocallimastix californiae; identical to SEQ ID NO: 1833
  CBM_10

SEQ ID NO: 1835 - protein, 35 aa, Neocallimastix californiae
  CBM_10
SCFSIVQGYPCCKTCHIDYTDESGDWGVEDDKWCG

SEQ ID NO: 1836 - protein, 37 aa, Neocallimastix californiae
  CBM_10
KCFSQKLNPSYPCCTGNEVVYTDESGDWGVENNSWCG

SEQ ID NO: 1837 - protein, 37 aa, Neocallimastix californiae; identical to SEQ ID NO: 1832
  CBM_10

SEQ ID NO: 1838 - protein, 35 aa, Neocallimastix californiae; identical to SEQ ID NO: 1835
  CBM_10

SEQ ID NO: 1839 - protein, 35 aa, Neocallimastix californiae; identical to SEQ ID NO: 1833
  CBM_10

SEQ ID NO: 1840 - protein, 35 aa, Neocallimastix californiae
  CBM_10
SCSAEAYGYKCCKGCTVVTSDETGDWGVENNEWCG

SEQ ID NO: 1841 - protein, 35 aa, Neocallimastix californiae
  CBM_10
TCWSLPSYPCCSTSTSVVYEDELGKWGIENDDWCG

SEQ ID NO: 1842 - protein, 35 aa, Neocallimastix californiae
  CBM_10
ACWSAPDYPCCSNNANIIYSDGQGDWGYENDNWCG

SEQ ID NO: 1843 - protein, 36 aa, Neocallimastix californiae
  CBM_10
TCWSEKLDYPCCTSTCYVYSTDVDGEWGYEDNHWCG

SEQ ID NO: 1844 - protein, 35 aa, Neocallimastix californiae
  CBM_10
QCWSTKLGYGCCEGCHTYEVDDNGKWGYENGKWCG

SEQ ID NO: 1845 - protein, 35 aa, Neocallimastix californiae
  CBM_10
SCKFEEIGYSCCSHCDVVYTDEDGDWGTEDGKWCG

SEQ ID NO: 1846 - protein, 37 aa, Neocallimastix californiae
  CBM_10
SCWAEEQGYPCCSDTNRKVEQIDDNGNAWAIENNDWC

SEQ ID NO: 1847 - protein, 36 aa, Neocallimastix californiae
  CBM_10
TCWSLPDYPCCSNENTAVITTDEQGDWGVENGDWCG

SEQ ID NO: 1848 - protein, 37 aa, Neocallimastix californiae
  CBM_10
CSQAILSQGYKCCSSDCVVIFTDDDGTWGIENDEWCG

SEQ ID NO: 1849 - protein, 33 aa, Neocallimastix californiae
  CBM_10
TSQGYKCCKDNNCSVIETDDAGKWGIEDDDWCG

SEQ ID NO: 1850 - protein, 35 aa, Neocallimastix californiae
  CBM_10
SCWSLPFGYPCCPHCKVLTEDENGKWGELNGEWCG

SEQ ID NO: 1851 - protein, 37 aa, Neocallimastix californiae; identical to SEQ ID NO: 1516
  CBM_10

SEQ ID NO: 1852 - protein, 35 aa, Neocallimastix californiae
  CBM_10
CWANILGYQCCENTKEVFLKDESGSWGIENDDWCG

SEQ ID NO: 1853 - protein, 36 aa, Neocallimastix californiae
  CBM_10
SCWADALGYNCCIYTKEVIYTDESGDWGVENNEWCG

SEQ ID NO: 1854 - protein, 34 aa, Neocallimastix californiae
  CBM_10
CFSEEMGYPCCSDCSVVYTDSDGGWGVEGDDWCG

SEQ ID NO: 1855 - protein, 36 aa, Neocallimastix californiae
  CBM_10
TCWSKALGYPCCKSSCEVIYSDDDGEWGVEDADWCG

SEQ ID NO: 1856 - protein, 36 aa, Neocallimastix californiae
  CBM_10
ACWSEKLGYPCCVSSCYVYESDNEGEWGYEDNHWCG

SEQ ID NO: 1857 - protein, 34 aa, Neocallimastix californiae
  CBM_10
CWSKKFGYDCCNGCTSYEEDSNGKWGYEENKWCG

SEQ ID NO: 1858 - protein, 38 aa, Neocallimastix californiae
  CBM_10
SCSASILAQGYECCSDNCEVVYTDADGDWGVENEQWCG

SEQ ID NO: 1859 - protein, 31 aa, Neocallimastix californiae
  CBM_10
SQGYECCSSCGTVYYTDDDGEWGVENNNWCG

SEQ ID NO: 1860 - protein, 38 aa, Neocallimastix californiae
  CBM_10
SCSAKILSQGYKCCKKGCAIIYTDDDGTWGVENGEWCG

SEQ ID NO: 1861 - protein, 33 aa, Neocallimastix californiae
  CBM_10
IAAQGYQCCSPGNCSIYLEDDTGRWGIENDEWC

SEQ ID NO: 1862 - protein, 35 aa, Neocallimastix californiae
  CBM_10
ECWSEVFGYPCCKGCYVYETDDDGKWGYENQHWCG

SEQ ID NO: 1863 - protein, 38 aa, Neocallimastix californiae
  CBM_10
QCMAEIIGYPCCDKNVKTVYEKDVYGDWGYDFKKGEWC

SEQ ID NO: 1864 - protein, 36 aa, Neocallimastix californiae
  CBM_10
ECAFEKIGYKCCESTTEVVFEDGSGTWGVENNEWCG

SEQ ID NO: 1865 - protein, 30 aa, Neocallimastix californiae
  CBM_10
ADGYECCNGCSVVEQSDGYKWGVENNKWCI

SEQ ID NO: 1866 - protein, 34 aa, Neocallimastix californiae
  CBM_10
SCWSTKLGYGCCTGCDVSYTDNDGDWGYENDWCG

SEQ ID NO: 1867 - protein, 32 aa, Neocallimastix californiae
  CBM_10
CTTSGYKCCDDCNVTYEDSTGKWGIKDNDWCA

SEQ ID NO: 1868 - protein, 31 aa, Neocallimastix californiae
  CBM_10
KNQGYSYCNLCDVIYNDNDGRWGIENGEWCG

SEQ ID NO: 1869 - protein, 34 aa, Neocallimastix californiae
  CBM_10
CFSINLGYPCCNGNTVYYTDNDGQWGYENNNWCG

SEQ ID NO: 1870 - protein, 36 aa, Neocallimastix californiae
  CBM_10
ECWSEKYGYPCCDSCIDVNFEDSNGYWGIQNGEICG

SEQ ID NO: 1871 - protein, 35 aa, Neocallimastix californiae
  CBM_10
CWSSNLGYSCCPSGTPVYFTDENGDWGIINDDWCG

SEQ ID NO: 1872 - protein, 35 aa, Neocallimastix californiae
  CBM_10
CFSEELGYPCCSSGVLVYEKDEHGSWGIENNDWCG

SEQ ID NO: 1873 - protein, 34 aa, Neocallimastix californiae
  CBM_10
CFSIPLGYPCCSEGTPEYYTDENGSWGVENDDWC

SEQ ID NO: 1874 - protein, 34 aa, Neocallimastix californiae; identical to SEQ ID NO: 1873
  CBM_10

SEQ ID NO: 1875 - protein, 35 aa, Neocallimastix californiae; identical to SEQ ID NO: 1872
  CBM_10

SEQ ID NO: 1876 - protein, 35 aa, Neocallimastix californiae; identical to SEQ ID NO: 1871
  CBM_10

SEQ ID NO: 1877 - protein, 35 aa, Neocallimastix californiae
  CBM_10
CSSRITSQGYKCCSNCIVYYTDNDGEWGVEDGNWC

SEQ ID NO: 1878 - protein, 31 aa, Neocallimastix californiae
  CBM_10
QCHWQYPCCDNCEVYYTDNEGKWGILNNDWC

SEQ ID NO: 1879 - protein, 36 aa, Neocallimastix californiae
  CBM_10
SCKFAKIGYMCCKNTDKVILLDKTGSWGVENGKWCG

SEQ ID NO: 1880 - protein, 36 aa, Neocallimastix californiae
  CBM_10
TCWSALLGYKCCKKSFSPLYKDKNGIWSVENDKWCG

SEQ ID NO: 1881 - protein, 36 aa, Neocallimastix californiae
  CBM_10
CWSEKLGYPCCKPTNTEILEVDKYGEWGMENGERCG

SEQ ID NO: 1882 - protein, 36 aa, Neocallimastix californiae; identical to SEQ ID NO: 1881
  CBM_10

SEQ ID NO: 1883 - protein, 37 aa, Neocallimastix californiae
  CBM_10
CNANIIAQGYKCCRVGCTVEYTDNDGEWGVEDGDWCG

SEQ ID NO: 1884 - protein, 32 aa, Neocallimastix californiae
  CBM_10
TRQGYKCCRVGCTVEYTDNDGEWGVEDGDWCG

SEQ ID NO: 1885 - protein, 33 aa, Neocallimastix californiae
  CBM_10
CWSLPDYPCCTGNEVVYTDSDGDWGYENNQWCG

SEQ ID NO: 1886 - protein, 34 aa, Neocallimastix californiae
  CBM_10
CFSESLGYNCCKGCDIILTDDYGSWGVENNDWCG

SEQ ID NO: 1887 - protein, 35 aa, Neocallimastix californiae
  CBM_10
SCWSLPEYKCCSEGIESIFEDSIGKWGIEDNEWCG

SEQ ID NO: 1888 - protein, 31 aa, Neocallimastix californiae
  CBM_10
CPKNDEYKCCGNCDVYYVDDFEWGVEDGKWC

SEQ ID NO: 1889 - protein, 38 aa, Neocallimastix californiae
  CBM_10
KCWALAEGYPCCKNKDAKVYSTDKHGKKWGIEDNNWCG

SEQ ID NO: 1890 - protein, 30 aa, Neocallimastix californiae
  CBM_10
NSGYSCCVLTKKVELTDNVGQWGVENGEWC

SEQ ID NO: 1891 - protein, 36 aa, Neocallimastix californiae
  CBM_10
SCWSKSLGYPCCSGKSAVLYTDASGQWGVENGDWCG

SEQ ID NO: 1892 - protein, 37 aa, Neocallimastix californiae
  CBM_10
CWAKALGSNCCSTSSCRNVVYFDYDGQWDVENGEWCG

SEQ ID NO: 1893 - protein, 36 aa, Neocallimastix californiae
  CBM_10
ECTFESIGYKCCSNSCTVVYTDESGDWGVENGEWCG

SEQ ID NO: 1894 - protein, 34 aa, Neocallimastix californiae
  CBM_10
ECFAEKLGYSCCNECNIIYTDNDGEWGIENDEWC

SEQ ID NO: 1895 - protein, 35 aa, Neocallimastix californiae
  CBM_10
CWSQSLGYGCCSGCIDVIMTDNDGEWGVENNDWCG

SEQ ID NO: 1896 - protein, 34 aa, Neocallimastix californiae
  CBM_10
CSGAQGYPCCKSTCSSYFQDNDGEWGVENDDWCL

SEQ ID NO: 1897 - protein, 35 aa, Neocallimastix californiae
  CBM_10
KCFSVDIGYPCCTNNSPVYYTDDDGKWGVQNGDWC

SEQ ID NO: 1898 - protein, 36 aa, Neocallimastix californiae
  CBM_10
SCWSKKLGYPCCSKNASTVYTDADGKWGVENNEWCG

SEQ ID NO: 1899 - protein, 35 aa, Neocallimastix californiae; identical to SEQ ID NO: 1819
  CBM_10

SEQ ID NO: 1900 - protein, 37 aa, Neocallimastix californiae
  CBM_10
ECWSEKLGYSCCSENNTRVVLTDDDGKWGAENGEWCG

SEQ ID NO: 1901 - protein, 38 aa, Neocallimastix californiae
  CBM_10
TCWSIELGYPCCSTSECKVVYEEDDDGKWGAENNDWCG

SEQ ID NO: 1902 - protein, 32 aa, Neocallimastix californiae
  CBM_10
AKKDGFNCCNGCTVTYTDASGKWGVENNQWCG

SEQ ID NO: 1903 - protein, 35 aa, Neocallimastix californiae
  CBM_10
SCWATSQGYPCCTGCDAIYTDGSGKWGFENNNWCG

SEQ ID NO: 1904 - protein, 36 aa, Neocallimastix californiae
  CBM_10
TCWSAAEGFPCCSTTTAVVLTDSKGKWGIENNNWCG

SEQ ID NO: 1905 - protein, 33 aa, Neocallimastix californiae
  CBM_10
NNTGYHCCSDPNTTVYTSDSSGDWGVEGDYWCL

SEQ ID NO: 1906 - protein, 37 aa, Neocallimastix californiae
  CBM_10
ECWSLERGYPCCVYATTVYYTSSNGKTWSVENGDWCG

SEQ ID NO: 1907 - protein, 34 aa, Neocallimastix californiae
  CBM_10
QSDYPNCKNKDTEILYSSDDTKKEWGEENDDWCI

SEQ ID NO: 1908 - protein, 35 aa, Neocallimastix californiae
  CBM_10
CPNSSDGYPCCPDCNVVYTDENNQVWGNLNDEWCS

SEQ ID NO: 1909 - protein, 35 aa, Neocallimastix californiae
  CBM_10
KCFSEPDFPCCTSTTEVVEVDENGEWGIENGNWCG

SEQ ID NO: 1910 - protein, 34 aa, Neocallimastix californiae
  CBM_10
CPGENLGYNCCSSCIEPYEEDENGKWAVVDESWC

SEQ ID NO: 1911 - protein, 35 aa, Neocallimastix californiae
  CBM_10
ECFSNGLGYPCCNSCDIIYIDESGNWGVENGDWCG

SEQ ID NO: 1912 - protein, 36 aa, Neocallimastix californiae
  CBM_10
ECFATILGFNCCASCINSIYDDDDGHWGLENNDWCG

SEQ ID NO: 1913 - protein, 35 aa, Neocallimastix californiae
  CBM_10
SCFAISLGYSCCEGSEIVYTDDDGDWGYENDNWCG

SEQ ID NO: 1914 - protein, 35 aa, Neocallimastix californiae
  CBM_10
SCPGKSEGYQCCSSCNVVFTDENGSWGVENNEWCG

SEQ ID NO: 1915 - protein, 29 aa, Neocallimastix californiae
  CBM_10
ALGYPCCENTFEATYTDENGKWAIENGDW

SEQ ID NO: 1916 - protein, 35 aa, Neocallimastix californiae
  CBM_10
CWAKALGYECCKTCQTTVSKDENGEWGIENDEWCG

SEQ ID NO: 1917 - protein, 34 aa, Neocallimastix californiae
  CBM_10
CFAKAQGFECCNDSEVVYSDDSGDWGVVNGQWCG

SEQ ID NO: 1918 - protein, 28 aa, Neocallimastix californiae
  CBM_10
GDYPCCSECNSVYSDESGEWGVENNDWC

SEQ ID NO: 1919 - protein, 31 aa, Neocallimastix californiae
  CBM_10
KNEGYSKCDNCEVVYSDDSGNWGVQNNDWCG

SEQ ID NO: 1920 - protein, 30 aa, Neocallimastix californiae
  CBM_10
EGQEYNCCKGCDVIYTDTSDWGVEDDDWCS

SEQ ID NO: 1921 - protein, 39 aa, Neocallimastix californiae
  CBM_10
ECWATELGYPCCELKTTKIEFTDSGSGKQFGVENNHICG

SEQ ID NO: 1922 - protein, 36 aa, Neocallimastix californiae
  CBM_10
EKILAQGYKCCSDKNCIVYYEDSDGYWGIENDDWCG

SEQ ID NO: 1923 - protein, 30 aa, Neocallimastix californiae
  CBM_10
QGYPCCKNTSTVFYTDDDGDWGVENNNWCV

SEQ ID NO: 1924 - protein, 35 aa, Neocallimastix californiae
  CBM_10
TCWSERLGYSCCQGCQVVEVDNDGNWGIENDQWCG

SEQ ID NO: 1925 - protein, 38 aa, Neocallimastix californiae
  CBM_10
KCTSEKLGYPCCSSNNNKVYYTDNDGDWGFDENTNNWC

SEQ ID NO: 1926 - protein, 35 aa, Neocallimastix californiae
  CBM_10
KCWSKKFGIECCKQTKEVVRETYDGLWGKENGEWC

SEQ ID NO: 1927 - protein, 33 aa, Neocallimastix californiae
  CBM_10
CFASPAYPCCSKCNVVYTDEEGEWGYEKGSWCG

SEQ ID NO: 1928 - protein, 36 aa, Neocallimastix californiae
  CBM_10
TCWSEKLGYDCCKHCTVSYTDESGEWGVEEDDVWCG

SEQ ID NO: 1929 - protein, 35 aa, Neocallimastix californiae
  CBM_10
ECWSEKLGYKCCKYCNVEYEDEEGKWGLENDEWCG

SEQ ID NO: 1930 - protein, 34 aa, Neocallimastix californiae
  CBM_10
CWSKKFNIPCCKSTDAVVRSTYDGEWGLENGEWC

SEQ ID NO: 1931 - protein, 35 aa, Neocallimastix californiae
  CBM_10
CWSEVLGYPCCTSSCHVYSTDSDGQWGYEDDHWCG

SEQ ID NO: 1932 - protein, 35 aa, Neocallimastix californiae
  CBM_10
TCWSKKFGYGCCEGCRAYEEDADGKWGYENNEWCG

SEQ ID NO: 1933 - protein, 35 aa, Neocallimastix californiae
  CBM_10
CWSKALGYNCCTTTSVVQYEDQDGPWGIENNDWCG

SEQ ID NO: 1934 - protein, 34 aa, Neocallimastix californiae
  CBM_10
CWSSRLGYPCCTSTNSIYFSDGDGDWGIENNQWC

SEQ ID NO: 1935 - protein, 35 aa, Neocallimastix californiae
  CBM_10
TCFSEKLGYKCCEGSDVELIDEDGMWGIENGQWCG

SEQ ID NO: 1936 - protein, 38 aa, Neocallimastix californiae
  CBM_10
ACWSIEEGYPCCQKKTTKVKHVSKNGNEWGVENNNWCG

SEQ ID NO: 1937 - protein, 32 aa, Neocallimastix californiae
  CBM_10
CPKYGKYNCCQGCKVKYVDSEKWGYENGEWCS

SEQ ID NO: 1938 - protein, 36 aa, Neocallimastix californiae
  CBM_10
ECWAEALGYKCCTNTKSVNFTDENGSWGFENNVRCG

SEQ ID NO: 1939 - protein, 35 aa, Neocallimastix californiae
  CBM_10
MCWSRSIGFVCCDKCNVLYVDEQGQWGVEDGYWCG

SEQ ID NO: 1940 - protein, 31 aa, Neocallimastix californiae
  CBM_10
KNKKNTLPCCTTCDIYLIDATGRYGYENGEW

SEQ ID NO: 1941 - protein, 36 aa, Neocallimastix californiae
  CBM_10
ECFATKLGYSCCTTTKNVISVNSYGKWGIENGKLCG

SEQ ID NO: 1942 - protein, 34 aa, Neocallimastix californiae
  CBM_10
CWAVKYGYSCCKETTVIEEVDENGRWGFENGGRC

SEQ ID NO: 1943 - protein, 37 aa, Neocallimastix californiae
  CBM_10
ECWSESYGYKCCTDPDAKIEYDGDGNLWGVENGEWCG

SEQ ID NO: 1944 - protein, 35 aa, Neocallimastix californiae
  CBM_10
CWSERLGYPCCVGYTDTIFADADGEWGLQNDDWCG

SEQ ID NO: 1945 - protein, 40 aa, Neocallimastix californiae
  CBM_10
CWSESLSEDKRFPCCSSNDVEVAGKEMDGSWGYENGKKCG

SEQ ID NO: 1946 - protein, 34 aa, Neocallimastix californiae
  CBM_10
FANNYGYPGCKNATKIRYSGVEGSWGYENGSWCG

SEQ ID NO: 1947 - protein, 35 aa, Neocallimastix californiae
  CBM_10
KCWSEPEYRCCNPETQVFYSDDQGKWGIENGEWCG

SEQ ID NO: 1948 - protein, 35 aa, Neocallimastix californiae
  CBM_10
KCFTLDLGYPCCKKNKDLVLEDEDGKWGNEDGEWC

SEQ ID NO: 1949 - protein, 37 aa, Neocallimastix californiae
  CBM_10
CSPKILAQGYSCCPKGCRVYETDEDGDWGYVDNEWCG

SEQ ID NO: 1950 - protein, 29 aa, Neocallimastix californiae
  CBM_10
KGYPCCKGDSEIYLVDEDGNWGYEDDEWC

SEQ ID NO: 1951 - protein, 35 aa, Neocallimastix californiae
  CBM_10
TCWASFYGYDCCNGCKVKSVDSLGSWGFEGGKWCG

SEQ ID NO: 1952 - protein, 35 aa, Neocallimastix californiae
  CBM_10
KCWSKSLGYSCCKTCNVYTVDKSGSWGYEDGKWCG

SEQ ID NO: 1953 - protein, 35 aa, Neocallimastix californiae
  CBM_10
TCWSSFYGYSCCKGCKVRYVDDLGSWGYEGGKWCG

SEQ ID NO: 1954 - protein, 35 aa, Neocallimastix californiae
  CBM_10
TCWSETKGYKCCKSCDVVTVDRFGSWGVENGEWCG

SEQ ID NO: 1955 - protein, 34 aa, Neocallimastix californiae
  CBM_10
CWSESKGYPCCKYCDVVSVDRYGSWGIENGKWCG

SEQ ID NO: 1956 - protein, 35 aa, Neocallimastix californiae
  CBM_10
KCWSSGYGYPCCNNCKVYFVDDNGEWGIENGNWCG

SEQ ID NO: 1957 - protein, 36 aa, Neocallimastix californiae
  CBM_10
ECFATKLGYPCCSVGYPTVLKDESGSWSVENGEWCG

SEQ ID NO: 1958 - protein, 36 aa, Neocallimastix californiae
  CBM_10
ECWSSSLGYPCCTSTKDAILVDDNGKWGSENGNWCG

SEQ ID NO: 1959 - protein, 37 aa, Neocallimastix californiae
  CBM_10
ECWSKKYGYECCSSENTRVVVTDETGKWGVENGQWCG

SEQ ID NO: 1960 - protein, 35 aa, Neocallimastix californiae
  CBM_10
ACWSLPFGYKCCTHCKVLTKDENGKWGEEKGEWCG

SEQ ID NO: 1961 - protein, 36 aa, Neocallimastix californiae
  CBM_10
ECWSLKLNYPCCDRNNTISFYRNDYGAWGNVDNKWC

SEQ ID NO: 1962 - protein, 35 aa, Neocallimastix californiae
  CBM_10
ECFSERLGYRCCYGNKVVLTDADGKWGVENNQWCG

SEQ ID NO: 1963 - protein, 36 aa, Neocallimastix californiae
  CBM_10
ACWANALGYPCCKTAYAIYYTDNDGNWSIENNEWCG

SEQ ID NO: 1964 - protein, 35 aa, Neocallimastix californiae
  CBM_10
CTFESIGYNCCSSTTDVIYQDENGDWGVENNDWCG

SEQ ID NO: 1965 - protein, 34 aa, Neocallimastix californiae
  CBM_10
CFSEKLGYPCCIGCNVIYTDDDGDWGIEQGSWCG

SEQ ID NO: 1966 - protein, 34 aa, Neocallimastix californiae
  CBM_10
CWSDALGYPCCHGCTVYETDADGSWGYESNQWCG

SEQ ID NO: 1967 - protein, 39 aa, Neocallimastix californiae
  CBM_10
TCWAESLGYPCCTGKNPIVYEHDSNGDWGYNWKTNEWCG

SEQ ID NO: 1968 - protein, 37 aa, Neocallimastix californiae
  CBM_10
TCWSTGLGYPCCSLTNTDVYYIDESGNWGIENDDWCG

SEQ ID NO: 1969 - protein, 36 aa, Neocallimastix californiae
  CBM_10
ECFSTKLGYPCCQQTKDVVYEDNDGQWGVENNDWCG

SEQ ID NO: 1970 - protein, 32 aa, Neocallimastix californiae
  CBM_10
QTEYNCCVFSTTENVQTTEEGKWGVEFNKWCL

SEQ ID NO: 1971 - protein, 30 aa, Neocallimastix californiae
  CBM_10
YNDKYKCCSHCNVSYTDSTKWGIENNHWCH

SEQ ID NO: 1972 - protein, 31 aa, Neocallimastix californiae
  CBM_10
KATDYPNCNSCDVYYTDATGKWGVENRNWCI

SEQ ID NO: 1973 - protein, 31 aa, Neocallimastix californiae
  CBM_10
CHPQYECCSGCDVFYSDNEALWGVENGNWCV

SEQ ID NO: 1974 - protein, 27 aa, Neocallimastix californiae
  CBM_10
AYEDCEGCYVVTEEDGIKWGVENNDWC

SEQ ID NO: 1975 - protein, 34 aa, Neocallimastix californiae
  CBM_10
SCFSFPTYMCCEGCDVYDQTEEGMWGIENDNWCG

SEQ ID NO: 1976 - protein, 34 aa, Neocallimastix californiae
  CBM_10
QCFSYPSYKCCQGCNVIEEDASGKWGIENNEWCG

SEQ ID NO: 1977 - protein, 36 aa, Neocallimastix californiae
  CBM_10
TCWATKLGYSCCKSTKEVVYTDADGRWGVENNNWCG

SEQ ID NO: 1978 - protein, 36 aa, Neocallimastix californiae
  CBM_10
CWATKLGYKCCTAKCPVEEYVDNDGSWGIENNNWCG

SEQ ID NO: 1979 - protein, 38 aa, Neocallimastix californiae
  CBM_10
ECWSENLGYKCCTKKCDAIFVLTDELGNWGMENKEWCG

SEQ ID NO: 1980 - protein, 35 aa, Neocallimastix californiae
  CBM_10
ECSASKFGYPCCKGCTVYEKDEVGEWGYENDEWCS

SEQ ID NO: 1981 - protein, 35 aa, Neocallimastix californiae
  CBM_10
CWAAKLGFNCCKTTKTVVYEDADGNWGVEDDYWCG

SEQ ID NO: 1982 - protein, 36 aa, Neocallimastix californiae
  CBM_10
QCWSTKLGYPCCEDANVIYTVDENGSWGYEDDHWCG

SEQ ID NO: 1983 - protein, 34 aa, Neocallimastix californiae
  CBM_10
CEFSTIGYSCCPDNEVIFEDDHKWGVNSNGQWCG

SEQ ID NO: 1984 - protein, 38 aa, Neocallimastix californiae
  CBM_10
ACWAEELGYECCSRKDTNIIFIDENGLWGATKDNKWCG

SEQ ID NO: 1985 - protein, 31 aa, Neocallimastix californiae
  CBM_10
EKGYNSCTLGTKVSFTDVNGIWGIENDKWCA

SEQ ID NO: 1986 - protein, 36 aa, Neocallimastix californiae
  CBM_10
ECWSLSEGYKCCSAGTTVALVDSKGKWGIENGDWCG

SEQ ID NO: 1987 - protein, 35 aa, Neocallimastix californiae
  CBM_10
SCWASSEGYSCCKGCESIFTDGVRRWGVENDQWCG

SEQ ID NO: 1988 - protein, 33 aa, Neocallimastix californiae
  CBM_10
HASKDGYSCCKSCTIVLDDESGKWGVENGDWCG

SEQ ID NO: 1989 - protein, 35 aa, Neocallimastix californiae
  CBM_10
CWSNALGYPCCKTTTTVISTDSDGQWGVENNEWCG

SEQ ID NO: 1990 - protein, 35 aa, Neocallimastix californiae
  CBM_10
CWATKLDYPCCSYSTQVFETDENGQWSIENGEWCG

SEQ ID NO: 1991 - protein, 35 aa, Neocallimastix californiae
  CBM_10
CFSEKLGYPCCKKTKDIVYSDEDGPWGVEDNSWCG

SEQ ID NO: 1992 - protein, 31 aa, Neocallimastix californiae
  CBM_10
ADGYPCCSQECTSYFRDESGDWSVENGDWCL

SEQ ID NO: 1993 - protein, 35 aa, Neocallimastix californiae
  CBM_10
SCWSEALGYPCCQGEVEYVESNENGDWGLENNEWC

SEQ ID NO: 1994 - protein, 36 aa, Neocallimastix californiae
  CBM_10
SCWSEALGYPCCQGEVELVESNEDGDWGLENNEWCG

SEQ ID NO: 1995 - protein, 36 aa, Neocallimastix californiae
  CBM_10
ACWSEAYGFPCCQGEIGYIESDEYGDWSVENNKWCG

SEQ ID NO: 1996 - protein, 35 aa, Neocallimastix californiae
  CBM_10
ECPNQKNGYPCCQTCDVYLTDADGKWGVENGNWCS

SEQ ID NO: 1997 - protein, 38 aa, Neocallimastix californiae
  CBM_10
ECWSSKLGYKCCSRGCNTAVVVTDNDGAWGVENGEWCG

SEQ ID NO: 1998 - protein, 34 aa, Neocallimastix californiae
  CBM_10
TCWSEPDYPCCKNTCRVVYTDSSEWGVENGNWCG

SEQ ID NO: 1999 - protein, 35 aa, Neocallimastix californiae
  CBM_10
SCPDYPDYPCCSTCDVYLTEDNGSRWGVENNDWCS

SEQ ID NO: 2000 - protein, 35 aa, Neocallimastix californiae
  CBM_10
CWSEKLGYPCCQNTSSVAYTDSDGKWGVENGNWCG

SEQ ID NO: 2001 - protein, 24 aa, Neocallimastix californiae
  CBM_10
CWSEKLGYPCCQNTSSVVYTDNDG

SEQ ID NO: 2002 - protein, 34 aa, Neocallimastix californiae
  CBM_10
ECGAAALGYPCCQSTCTEVYTDEYRWGVENGDWC

SEQ ID NO: 2003 - protein, 33 aa, Neocallimastix californiae
  CBM_10
SCWSEPDYKCCTTCDIVYTDDHNWGVENGEWCG

SEQ ID NO: 2004 - protein, 35 aa, Neocallimastix californiae
  CBM_10
ECWSEILGYPCCKGCKIYETDSDGSWGYEFNQWCG

SEQ ID NO: 2005 - protein, 37 aa, Neocallimastix californiae
  CBM_10
CLSEFLGYPCCSSELTTVYAEDEYGEWSYDFTKNEWC

SEQ ID NO: 2006 - protein, 34 aa, Neocallimastix californiae
  CBM_10
CFSIALGFPCCKGNTVIYTDDDGDWGVENEEWCG

SEQ ID NO: 2007 - protein, 35 aa, Neocallimastix californiae
  CBM_10
SCFAKALGYECCSTCDVVYTDDDGDWGVDNGEWCG

SEQ ID NO: 2008 - protein, 38 aa, Neocallimastix californiae
  CBM_10
KCWSLKLDEPYPCCVYATEIIYTNENGKWSMENGDWCG

SEQ ID NO: 2009 - protein, 35 aa, Neocallimastix californiae
  CBM_10
KCWSNFLGYPCCKKTDDIIYNAVKGSWGYENNSWC

SEQ ID NO: 2010 - protein, 37 aa, Neocallimastix californiae
  CBM_10
KCWAYARNYKCCSNPNTKVETEDKYGKWGIENNEWCG

SEQ ID NO: 2011 - protein, 32 aa, Neocallimastix californiae
  CBM_10
CKGLSEGYPCCSSLSMKTSGYDDQWGYEDNDW

SEQ ID NO: 2012 - protein, 38 aa, Neocallimastix californiae
  CBM_10
SCWAEELDDGYPCCKTTNVVIETDGNGEWGIENDQWCG

SEQ ID NO: 2013 - protein, 37 aa, Neocallimastix californiae
  CBM_10
KCWSLSQGYPCCSIQPYHIELSDESGDWGIENGDWCG

SEQ ID NO: 2014 - protein, 36 aa, Neocallimastix californiae
  CBM_10
CWATKKGFPCCSNKDTSIVSVDSEGQWGMENGQWCG

SEQ ID NO: 2015 - protein, 37 aa, Neocallimastix californiae
  CBM_10
KCWSVSKGYPCCVGDNPSIEFVDSDGQWGLENGNWCG

SEQ ID NO: 2016 - protein, 38 aa, Neocallimastix californiae
  CBM_10
KCWSKSQGYSCCKDATTTVRTTDSKGYLWGIENNEWCG

SEQ ID NO: 2017 - protein, 31 aa, Neocallimastix californiae
  CBM_10
STGYSCCMFNTTAIATKDSDGYWGVENGQWC

SEQ ID NO: 2018 - protein, 35 aa, Neocallimastix californiae
  CBM_10
QCPAAKNGYKCCNACKVKTTDKNGDWGVENGEWCS

SEQ ID NO: 2019 - protein, 34 aa, Neocallimastix californiae
  CBM_10
CSSSGYICCRTTDCEVVSSDEAGDWCMEGNLWCL

SEQ ID NO: 2020 - protein, 37 aa, Neocallimastix californiae
  CBM_10
ECWSLAEGYPCCQHATKVENIDEQGRKWSVENDDWCG

SEQ ID NO: 2021 - protein, 37 aa, Neocallimastix californiae
  CBM_10
CSGAILSQGYKCCSSGCSVVYTDGDGTWGFENDQWCG

SEQ ID NO: 2022 - protein, 33 aa, Neocallimastix californiae
  CBM_10
ASQGYKCCSSNNCDVYLTDESGKWGVENNDWCG

SEQ ID NO: 2023 - protein, 38 aa, Neocallimastix californiae
  CBM_10
SCSAAILSQGYKCCSGGCSVVYTDGDGTWGVENGQWCG

SEQ ID NO: 2024 - protein, 38 aa, Neocallimastix californiae
  CBM_10
CPATITSQGYKCCSSNNCDVYLTDESGRWGVENNDWCG

SEQ ID NO: 2025 - protein, 36 aa, Neocallimastix californiae
  CBM_10
CFSEDKNLGYPCCQNCYVIESDENGDYGIENGEWCS

SEQ ID NO: 2026 - protein, 30 aa, Neocallimastix californiae
  CBM_10
ENGYPYCKNTKIVVYTDDVEWGVENNEWCV

SEQ ID NO: 2027 - protein, 35 aa, Neocallimastix californiae
  CBM_10
KCWSEKLGYPCCVGNTVYTTDESGSWGLENDDWCG

SEQ ID NO: 2028 - protein, 35 aa, Neocallimastix californiae
  CBM_10
ECFSLVLGFPCCSSCDSIYEDDDGKWGVENNNWCG

SEQ ID NO: 2029 - protein, 35 aa, Neocallimastix californiae
  CBM_10
SCWSEEQGYQCCSGCDIVYEDNTGFWGVENNEWCG

SEQ ID NO: 2030 - protein, 31 aa, Neocallimastix californiae
  CBM_10
CHPNYDCCNGCDVYYTDDEGEWGIQNNNWCF

SEQ ID NO: 2031 - protein, 34 aa, Neocallimastix californiae
  CBM_10
CKFEAIGYPCCSHCNIVYTDDSGNWGIENDDWCG

SEQ ID NO: 2032 - protein, 36 aa, Neocallimastix californiae
  CBM_10
ECWAKALGYECCSSCQPSAFKDESGEWGIENNQWCG

SEQ ID NO: 2033 - protein, 29 aa, Neocallimastix californiae
  CBM_10
ALGYECCKTTTTVIYTDESGKWGIENNEW

SEQ ID NO: 2034 - protein, 27 aa, Neocallimastix californiae
  CBM_10
QYSNCKNTCEIAYEDENKWGIENEDWC

SEQ ID NO: 2035 - protein, 35 aa, Neocallimastix californiae
  CBM_10
SCWSLANGYDCCEGCEVAYTDADGKWGYENDEWCG

SEQ ID NO: 2036 - protein, 35 aa, Neocallimastix californiae
  CBM_10
SCWASSLGYSCCKGCDIIITDSNGDWGVEDNEWCG

SEQ ID NO: 2037 - protein, 35 aa, Neocallimastix californiae
  CBM_10
QCKGAQGYPCCAYSCTAYEKDRDGEWSVENNDWCL

SEQ ID NO: 2038 - protein, 36 aa, Neocallimastix californiae
  CBM_10
SCFSKALGYNCCKSCSGVYYVDKDGEWGIENGQWCG

SEQ ID NO: 2039 - protein, 34 aa, Neocallimastix californiae
  CBM_10
CPGEGTEYKCCSSCLDVYEEDENGPWAIEDEQWC

SEQ ID NO: 2040 - protein, 37 aa, Neocallimastix californiae
  CBM_10
CFSEKIEPYYPCCKTTTEIVSTDNSGDWGIENDEWCG

SEQ ID NO: 2041 - protein, 28 aa, Neocallimastix californiae
  CBM_10
YGYPCCSNCELTYQDETGKWGVEGEEWC

SEQ ID NO: 2042 - protein, 37 aa, Neocallimastix californiae
  CBM_10
SCWSLKYGYLCCNSDSTSVVKTNKYGNWGKENGKWCG

SEQ ID NO: 2043 - protein, 37 aa, Neocallimastix californiae
  CBM_10
KCPFKAIGYGCCKNSKTEIVFTDSFGNYGVEKGKRCG

SEQ ID NO: 2044 - protein, 38 aa, Neocallimastix californiae
  CBM_10
CWSLSLGYKCCTLRTTEPNYYSKSAGKWYGIENDEWCG

SEQ ID NO: 2045 - protein, 30 aa, Neocallimastix californiae
  CBM_10
NTGYHCCLYTTEVETTDAVGQWGIEAGEWC

SEQ ID NO: 2046 - protein, 28 aa, Neocallimastix californiae
  CBM_10
GEYRCCKECNVIFTDSEDWGIEDGDWCS

SEQ ID NO: 2047 - protein, 36 aa, Neocallimastix californiae
  CBM_10
ECFSEKLGFPCCVETKEVVNVDENGQWGIENNNWCG

SEQ ID NO: 2048 - protein, 37 aa, Neocallimastix californiae
  CBM_10
SCWSLPLGYNCCSSDNTEVYYTDDDGQWGVENGDWCG

SEQ ID NO: 2049 - protein, 37 aa, Neocallimastix californiae
  CBM_10
KCWSEPLGYECCDPKDNTYYYEDDDGYWGLVDGEWCG

SEQ ID NO: 2050 - protein, 36 aa, Neocallimastix californiae
  CBM_10
ECWSLKLGYPCCKESIEVYTTDENGSWGVENEQWCG

SEQ ID NO: 2051 - protein, 36 aa, Neocallimastix californiae
  CBM_10
TCFSKPDYPCCSRCDIKVILDDGDNKQWGIENSNWC

SEQ ID NO: 2052 - protein, 36 aa, Neocallimastix californiae
  CBM_10
ECFANKLGYPCCTQTNEIVSIDENGKWGLENGQICG

SEQ ID NO: 2053 - protein, 36 aa, Neocallimastix californiae
  CBM_10
CWSTALGYPCCSSANAEVYFTDESGDWGIENNTWCG

SEQ ID NO: 2054 - protein, 37 aa, Neocallimastix californiae
  CBM_10
CWAKELGYECCSTNSCRNAIYTDDDGEWDVENGNWCG

SEQ ID NO: 2055 - protein, 32 aa, Neocallimastix californiae
  CBM_10
QGYKCCEINNCNIYHKDGDGDWGLDRNLKWCG

SEQ ID NO: 2056 - protein, 31 aa, Neocallimastix californiae
  CBM_10
NQMGYKCCNSCNAVYTDSTGRWGVENRQWCG

SEQ ID NO: 2057 - protein, 28 aa, Neocallimastix californiae
  CBM_10
GEYPCCKECNIYYTDSEDWGIEDGKWCS

SEQ ID NO: 2058 - protein, 38 aa, Neocallimastix californiae
  CBM_10
CWSSPFGYDCCKLKKTQPYSYSNSAGHWYGIENGEWCG

SEQ ID NO: 2059 - protein, 30 aa, Neocallimastix californiae
  CBM_10
GTGFNCCLFTTIVATTDSVGQWGVENGEWC

SEQ ID NO: 2060 - protein, 37 aa, Neocallimastix californiae
  CBM_10
CWATYLDKNYTCCSNDNIEIKSINMDGEWGLENNNWC

SEQ ID NO: 2061 - protein, 35 aa, Neocallimastix californiae
  CBM_10
CWSLPDYPCCNNNNIAVVITDDKGNWGIENGEWCG

SEQ ID NO: 2062 - protein, 34 aa, Neocallimastix californiae
  CBM_10
CWAEKFGFKCCKENHIDNVSDSDGDWAQENGDWC

SEQ ID NO: 2063 - protein, 36 aa, Neocallimastix californiae
  CBM_10
SCWSLPDYPCCRNKKTDVVYTDDNGNWGIENENWCG

SEQ ID NO: 2064 - protein, 36 aa, Neocallimastix californiae
  CBM_10
TCWSLPDYSCCKDKNIDVIYTDNMGNWGIENGEWCG

SEQ ID NO: 2065 - protein, 28 aa, Neocallimastix californiae
  CBM_10
KCWSTSLGYSCCKTCTDIILVDSNGKWG

SEQ ID NO: 2066 - protein, 36 aa, Neocallimastix californiae
  CBM_10
KCWSASLGYPCCENTTSVAVSDASGDWGVEQDQWCG

SEQ ID NO: 2067 - protein, 36 aa, Neocallimastix californiae
  CBM_10
TCFSEKLGYPCCSIGYATVITDNDGLWSVENDDWCG

SEQ ID NO: 2068 - protein, 36 aa, Neocallimastix californiae
  CBM_10
QCWSEAQGYPCCKFTSDVVFTDNDGNWGVENGNWCG

SEQ ID NO: 2069 - protein, 36 aa, Neocallimastix californiae
  CBM_10
CFSSRLGFPCCSSSSAEVWYTDSDGKWGVENDGWCG

SEQ ID NO: 2070 - protein, 34 aa, Neocallimastix californiae
  CBM_10
CWSESLGYKCCSSCGQVYFTDENGRWSVENDDWC

SEQ ID NO: 2071 - protein, 37 aa, Neocallimastix californiae
  CBM_10
SCWSNSLGYNCCSDSNTQVYYEDQDGQWGIENNNWCG

SEQ ID NO: 2072 - protein, 33 aa, Neocallimastix californiae
  CBM_10
SFTSQGYKCCSYCSTVYYTDDSGKWGIENGNWC

SEQ ID NO: 2073 - protein, 31 aa, Neocallimastix californiae
  CBM_10
KQGYKCCPANCQIVYADNDGTWGVDNNQWCG

SEQ ID NO: 2074 - protein, 35 aa, Neocallimastix californiae
  CBM_10
ECTGRNQGYQCCNSCDVYYTDNDGRWGVENNAWCG

SEQ ID NO: 2075 - protein, 34 aa, Neocallimastix californiae
  CBM_10
CFSVNLGYPCCNGNTVYYTDDDGKWGYENDNWCG

SEQ ID NO: 2076 - protein, 32 aa, Neocallimastix californiae
  CBM_10
FTQQGYKCCSSCLPVMYTDESGKWGVENNNWC

SEQ ID NO: 2077 - protein, 38 aa, Neocallimastix californiae
  CBM_10
CPAAITNQGYKCCSAKCNPVVYKDESGDWGVENNQWCG

SEQ ID NO: 2078 - protein, 38 aa, Neocallimastix californiae
  CBM_10
CPTAITSQGYKCCRNKCNPVVYQDEAGDWGVENNQWCG

SEQ ID NO: 2079 - protein, 38 aa, Neocallimastix californiae; identical to SEQ ID NO: 2078
  CBM_10

SEQ ID NO: 2080 - protein, 33 aa, Neocallimastix californiae
  CBM_10
VTQQGYKCCSTCTATVYVDDAGKWGVENNDWCG

SEQ ID NO: 2081 - protein, 38 aa, Neocallimastix californiae
  CBM_10
CPTAITSQGYKCCSAKCNPVVYQDEAGDWGVENNQWCG

SEQ ID NO: 2082 - protein, 33 aa, Neocallimastix californiae
  CBM_10
VTQQGYKCCSTCTETFYVDDAGKWGIENNDWCG

SEQ ID NO: 2083 - protein, 31 aa, Neocallimastix californiae
  CBM_10
SISKYPCCESCDVVTTDQNGKWGIENGHWCS

SEQ ID NO: 2084 - protein, 34 aa, Neocallimastix californiae
  CBM_10
CWSEALGYNCCYGCISYYEDDDGKWGVENNQWCG

SEQ ID NO: 2085 - protein, 36 aa, Neocallimastix californiae
  CBM_10
NSSTNSNSYSYCNGCSVTSTGSDGSKWGWENNKSCR

SEQ ID NO: 2086 - protein, 28 aa, Neocallimastix californiae
  CBM_10
YPYCYGCQVTYTSNDGICWGWENNNSCV

SEQ ID NO: 2087 - protein, 33 aa, Neocallimastix californiae
  CBM_10
STNSNSYSYCNGCSVTSTGSDGSKWGWENNKSC

SEQ ID NO: 2088 - protein, 40 aa, Neocallimastix californiae
  CBM_10
CNNNGNGRATYGYPYCYGCQVTYTSNDGICWGWENNNSCV

SEQ ID NO: 2089 - protein, 36 aa, Neocallimastix californiae
  CBM_10
KCWSKKFGIECCKHTKTVVRKTYDGPWGKENGKWCG

SEQ ID NO: 2090 - protein, 39 aa, Neocallimastix californiae
  CBM_10
ECEAKEYGYPCCPAEFNTVKYHNELGDWGFDLEHSEWCS

SEQ ID NO: 2091 - protein, 36 aa, Neocallimastix californiae
  CBM_10
ECWSLKLGYSCCKESTKVYTTDESGSWGVENGQWCG

SEQ ID NO: 2092 - protein, 37 aa, Neocallimastix californiae
  CBM_10
TCFSEPDYPCCSKCDIEVAFNEGEHKLWGIENSNWCG

SEQ ID NO: 2093 - protein, 33 aa, Neocallimastix californiae
  CBM_10
CWPGEYECCSPGTKVEYTDEEALWGVENGNWCY

SEQ ID NO: 2094 - protein, 37 aa, Neocallimastix californiae
  CBM_10
ECWAEEFGYECCLFSSMVSYVDDKGRYWDFQNGNWCG

SEQ ID NO: 2095 - protein, 33 aa, Neocallimastix californiae; identical to SEQ ID NO: 2093
  CBM_10

SEQ ID NO: 2096 - protein, 33 aa, Neocallimastix californiae; identical to SEQ ID NO: 2093
  CBM_10

SEQ ID NO: 2097 - protein, 35 aa, Neocallimastix californiae
  CBM_10
QCWPDNKFKCCSPGTKVEYTDEEALWGVENGNWCY

SEQ ID NO: 2098 - protein, 38 aa, Neocallimastix californiae
  CBM_10
KCRSEVKGYPCCPPEITEIYMVDTDGDWGFDEKTNNWC

SEQ ID NO: 2099 - protein, 42 aa, Neocallimastix californiae
  CBM_10
TCWSEKYGYPCCKDPNTLLVSPQSKSNPDHEWYGVENNEWCG

SEQ ID NO: 2100 - protein, 32 aa, Neocallimastix californiae
  CBM_10
CQFNDQYKCCQHCKVVYTDSQKWGIEDNEWCH

SEQ ID NO: 2101 - protein, 37 aa, Neocallimastix californiae
  CBM_10
ECWSLERGYPCCVSATEVLYTSSNGKTWSVENGDWCG

SEQ ID NO: 2102 - protein, 31 aa, Neocallimastix californiae
  CBM_10
NTGYPCCSNPDAQVYTTDSSGDWSIEGDFWC

SEQ ID NO: 2103 - protein, 27 aa, Neocallimastix californiae
  CBM_10
EKYHVCKNCSVAAYQNDIYWGFENNQW

SEQ ID NO: 2104 - protein, 34 aa, Neocallimastix californiae
  CBM_10
ECHSYPLYPCCADCNVVAETEDGEWGVENGQWCG

SEQ ID NO: 2105 - protein, 34 aa, Neocallimastix californiae
  CBM_10
CWSKSLGYSCCTSCEISYEDTDGKWGYENDDWCG

SEQ ID NO: 2106 - protein, 36 aa, Neocallimastix californiae
  CBM_10
ECWATSLGYSCCSEGADIILEDENGKWGLENDDWCG

SEQ ID NO: 2107 - protein, 30 aa, Neocallimastix californiae
  CBM_10
KYGYRCCSTCTISYTDDTGNWGVENDEWCI

SEQ ID NO: 2108 - protein, 37 aa, Neocallimastix californiae
  CBM_10
ACWSEAYGYPCCSSASTKVIYTDSDGEWGVENGNWCG

SEQ ID NO: 2109 - protein, 34 aa, Neocallimastix californiae
  CBM_10
CFSDTLGYPCCTSTTNVIYTDSYGRWGIENSNWC

SEQ ID NO: 2110 - protein, 36 aa, Neocallimastix californiae
  CBM_10
SCFSLALGYNCCKHTTEVISVDNDGSWGIENNEWCG

SEQ ID NO: 2111 - protein, 35 aa, Neocallimastix californiae
  CBM_10
CFSEALGYPCCSDGVAVVYTDNDGPWGVENNDWCG

SEQ ID NO: 2112 - protein, 33 aa, Neocallimastix californiae
  CBM_10
AQNTNYPYCKYSTAVYYVDEDGQWSVENNEWCL

SEQ ID NO: 2113 - protein, 37 aa, Neocallimastix californiae
  CBM_10
SCWSSALGYPCCSSSNVPIIETDGDGQWGIENDEWCG

SEQ ID NO: 2114 - protein, 35 aa, Neocallimastix californiae
  CBM_10
KCWAEAYGYPCCSKCLPVIDTTNDKEWALENGNWC

SEQ ID NO: 2115 - protein, 29 aa, Neocallimastix californiae
  CBM_10
ASMYKCCKSCNIVLDDGDKWGVENGEWCS

SEQ ID NO: 2116 - protein, 37 aa, Neocallimastix californiae
  CBM_10
CLSEFYGYPCCSPELTEVYAQDDYGDWGYDFSKSEWC

SEQ ID NO: 2117 - protein, 38 aa, Neocallimastix californiae
  CBM_10
CWSEALGYPCCPSGITTVYEHDEDGDWSYNFSKEEWCG

SEQ ID NO: 2118 - protein, 29 aa, Neocallimastix californiae
  CBM_10
SGYPCCKSCDVVDTDDDGQWGVENNDWCS

SEQ ID NO: 2119 - protein, 29 aa, Neocallimastix californiae
  CBM_10
GIYPCCKTCTSVYEDDDGKWGVENDDWCL

SEQ ID NO: 2120 - protein, 35 aa, Neocallimastix californiae
  CBM_10
CWSKSLGYDCCKEGTSVAYTDDSGKWGVVGDQWCG

SEQ ID NO: 2121 - protein, 40 aa, Neocallimastix californiae
  CBM_10
TCWVSVYGYPCCEGKIKEHVYATDNDGKWGYDFSKKIWCG

SEQ ID NO: 2122 - protein, 34 aa, Neocallimastix californiae
  CBM_10
CWSLEQGYNCCVGCTTFLTTDEGNWGIENAEWCG

SEQ ID NO: 2123 - protein, 30 aa, Neocallimastix californiae
  CBM_10
KYNYPYCKTTSSVVYTDDFEWGIENDDWCI

SEQ ID NO: 2124 - protein, 34 aa, Neocallimastix californiae
  CBM_10
CWAEKLGYNCCTSKEVYFEDEDGKWGVENDDWCG

SEQ ID NO: 2125 - protein, 37 aa, Neocallimastix californiae
  CBM_10
ECWSKKLGWPCCSEGNVDIYYTDEDGDWGVENNDWCG

SEQ ID NO: 2126 - protein, 35 aa, Neocallimastix californiae
  CBM_10
SCWSEKFNIPCCKSTTSVERSTYNGDFGKENGQWC

SEQ ID NO: 2127 - protein, 36 aa, Neocallimastix californiae
  CBM_10
TCWSEILGYSCCHTTCTSVEDDADGSWGIEGNEWCG

SEQ ID NO: 2128 - protein, 34 aa, Neocallimastix californiae
  CBM_10
CTGALGYPCCTYQCSILYTDEDGDWSVENDDWCL

SEQ ID NO: 2129 - protein, 36 aa, Neocallimastix californiae
  CBM_10
NSEIAPNGYPYCQGCDVTATGGDGSKWGWENNKSCV

SEQ ID NO: 2130 - protein, 36 aa, Neocallimastix californiae
  CBM_10
FSDMAPNGSPYCEGCEATATSGDGTLWGWENEQSCV

SEQ ID NO: 2131 - protein, 32 aa, Neocallimastix californiae
  CBM_10
APNGSPYCEGCEATATSGDGTLWGWENEQSCV

SEQ ID NO: 2132 - protein, 32 aa, Neocallimastix californiae
  CBM_10
APNGYPYCQGCDVTATGGDGSKWGWENNKSCV

SEQ ID NO: 2133 - protein, 35 aa, Neocallimastix californiae
  CBM_10
ACWSESLGYSCCHGCTIYETDDDGSWGYENDSWCG

SEQ ID NO: 2134 - protein, 39 aa, Neocallimastix californiae
  CBM_10
KCWAESLGYPCCSGKNPKVYAHDNDGDWGYNFATGEWCG

SEQ ID NO: 2135 - protein, 36 aa, Neocallimastix californiae
  CBM_10
CWASKIGYPCCKKKNGKIYKVNSYGSWGIEKSNWCG

SEQ ID NO: 2136 - protein, 37 aa, Neocallimastix californiae
  CBM_10
KCWSEELGFLCCKESKTKVKLEDINGKWGKEKGRWCG

SEQ ID NO: 2137 - protein, 31 aa, Neocallimastix californiae
  CBM_10
HDPNYKVCKGCEVVVTDIEGAWGAENGEWCY

SEQ ID NO: 2138 - protein, 28 aa, Neocallimastix californiae
  CBM_10
VYDCCTGCKPIVADDEGLWGAENGDWCL

SEQ ID NO: 2139 - protein, 35 aa, Neocallimastix californiae; identical to SEQ ID NO: 2004
  CBM_10

SEQ ID NO: 2140 - protein, 37 aa, Neocallimastix californiae; identical to SEQ ID NO: 2005
  CBM_10

SEQ ID NO: 2141 - protein, 30 aa, Neocallimastix californiae
  CBM_10
KTAYPCCSHCNVSISEEYIRWGIENGDWCM

SEQ ID NO: 2142 - protein, 36 aa, Neocallimastix californiae
  CBM_10
KCWSKALGYECCDSCNVVFIDDKKQKWGSMNKQWCG

SEQ ID NO: 2143 - protein, 40 aa, Neocallimastix californiae
  CBM_10
CWSESLKESKKFPCCSSNNVKVAGKDMDGSWGYENGVKCG

SEQ ID NO: 2144 - protein, 34 aa, Neocallimastix californiae
  CBM_10
KCWTLSDGYPCCESLASKVEGENDEWGYENGGWC

SEQ ID NO: 2145 - protein, 36 aa, Neocallimastix californiae
  CBM_10
SCWSSSLGYSCCKSTNEVKYTAINGSFGYENDSWCG

SEQ ID NO: 2146 - protein, 37 aa, Neocallimastix californiae
  CBM_10
SCWSVSLGYPCCSEDNQGIYLIDENGSWGLENNDWCG

SEQ ID NO: 2147 - protein, 35 aa, Neocallimastix californiae
  CBM_10
KCFSEALGYPCCTNNSPIYYVDNDGNWGVQNNNWC

SEQ ID NO: 2148 - protein, 36 aa, Neocallimastix californiae
  CBM_10
SCWSTALGYPCCSSGTVVTYTDNDGDWGINNNNWCG

SEQ ID NO: 2149 - protein, 35 aa, Neocallimastix californiae
  CBM_10
TCWSKKLGYPCCNGCKIYESDLDGLWGYEKHQWCG

SEQ ID NO: 2150 - protein, 35 aa, Neocallimastix californiae; identical to SEQ ID NO: 2149
  CBM_10

SEQ ID NO: 2151 - protein, 34 aa, Neocallimastix californiae
  CBM_10
CWSESVGYPCCTGCEVVEVEDDKKWGVESNEWCG

SEQ ID NO: 2152 - protein, 39 aa, Neocallimastix californiae
  CBM_10
QCMAELAGYTCCPPEIDTVYFQDEYGDWGVNPENNNWCG

SEQ ID NO: 2153 - protein, 36 aa, Neocallimastix californiae
  CBM_10
CWANKLSYRCCSTSDADVVFKDGSGEWAIENGDWCG

SEQ ID NO: 2154 - protein, 36 aa, Neocallimastix californiae
  CBM_10
CWANDIKYECCESNDGEVYFIDDDGKWGIENGSWCG

SEQ ID NO: 2155 - protein, 31 aa, Neocallimastix californiae
  CBM_10
IQGYSCCKSSCNVYEEDSDGKWSIENDEWCL

SEQ ID NO: 2156 - protein, 31 aa, Neocallimastix californiae; identical to SEQ ID NO: 2155
  CBM_10

SEQ ID NO: 2157 - protein, 37 aa, Neocallimastix californiae
  CBM_10
CWANELGYDCCSKRDTKIIFIDESGAWGATKDNKWCG

SEQ ID NO: 2158 - protein, 31 aa, Neocallimastix californiae
  CBM_10
ENGYGSCSLQTKIIAVDNDGIWGIENNKWCA

SEQ ID NO: 2159 - protein, 36 aa, Neocallimastix californiae
  CBM_10
ECWSDVLGYSCCKKNCYVYYTDKDGKWGVEDNQWCG

SEQ ID NO: 2160 - protein, 35 aa, Neocallimastix californiae
  CBM_10
CYGETTKEYPCCEGCKTAYRDNNGKWGYENNNWCS

SEQ ID NO: 2161 - protein, 35 aa, Neocallimastix californiae
  CBM_10
CWSEKLGYSCCQTSCHVYETDEDGEWGYEEGHWCG

SEQ ID NO: 2162 - protein, 36 aa, Neocallimastix californiae
  CBM_10
TCWSVKYGYSCCETSCNVYETDAAGDWGYEDHHWCG

SEQ ID NO: 2163 - protein, 36 aa, Neocallimastix californiae
  CBM_10
ACWSTAQGYPCCSECQDPIYEDDDGKWGVEDNDWCG

SEQ ID NO: 2164 - protein, 39 aa, Neocallimastix californiae
  CBM_10
KCIAETLGYHCCSSDNTTVYAHDSNGDWGFDFEKKEWCG

SEQ ID NO: 2165 - protein, 36 aa, Neocallimastix californiae
  CBM_10
SCWSEILGYLCCSECIKVVEVDSNGKWGIENNHWCG

SEQ ID NO: 2166 - protein, 35 aa, Neocallimastix californiae
  CBM_10
TCWAASQGYKCCNSCQPVYTDGSRRWGVENNQWCG

SEQ ID NO: 2167 - protein, 33 aa, Neocallimastix californiae
  CBM_10
HATKLGYKCCKSCTIYLNDSTGKWGVENNQWCG

SEQ ID NO: 2168 - protein, 35 aa, Neocallimastix californiae
  CBM_10
CWAASEGYKCCKAGTAVVLTDSKGKWGIENNQWCG

SEQ ID NO: 2169 - protein, 35 aa, Neocallimastix californiae
  CBM_10
CWSEKLGYPCCTSTSVSVFEDNDGKWGIENGNWCG

SEQ ID NO: 2170 - protein, 37 aa, Neocallimastix californiae
  CBM_10
SCFSLKLGYPCCSNASTPSVYEDSDGKWGVENGNWCG

SEQ ID NO: 2171 - protein, 34 aa, Neocallimastix californiae
  CBM_10
CWSEKFGYSCCKKCVVYETDNNGKWGYENNHWCG

SEQ ID NO: 2172 - protein, 38 aa, Neocallimastix californiae
  CBM_10
QCYAELLNYPCCSSSITEVFAHDNLGDWGYDFEKKTWC

SEQ ID NO: 2173 - protein, 35 aa, Neocallimastix californiae
  CBM_10
CFSEALGYPCCTNNSRVYFIGESGSWGIQDDQWCG

SEQ ID NO: 2174 - protein, 34 aa, Neocallimastix californiae
  CBM_10
CFSESLGYPCCTNNSKVYYTDKHGSWGLQDNEWC

SEQ ID NO: 2175 - protein, 36 aa, Neocallimastix californiae
  CBM_10
QCWSLKLGYSCCPTGTKVYSTDSDGDWGVHNHKWCG

SEQ ID NO: 2176 - protein, 35 aa, Neocallimastix californiae
  CBM_10
KCKAAIKGYSCCSQCKVKYTDNDGDWGVENNQWCS

SEQ ID NO: 2177 - protein, 36 aa, Neocallimastix californiae
  CBM_10
CFSQALGYPCCSNPNTSVKATDKDGEWGIENNAWCG

SEQ ID NO: 2178 - protein, 36 aa, Neocallimastix californiae
  CBM_10
TCWAEKLGYSCCTSTSQVVYTDGDGNWGVENGNWCG

SEQ ID NO: 2179 - protein, 37 aa, Neocallimastix californiae
  CBM_10
ACWSENLGYKCCSSANAPIVYTDSDGNWGVENGNWCG

SEQ ID NO: 2180 - protein, 36 aa, Neocallimastix californiae; identical to SEQ ID NO: 2178
  CBM_10

SEQ ID NO: 2181 - protein, 37 aa, Neocallimastix californiae
  CBM_10
ACWSQSLGYSCCTNASTPVVYSDNDGDWGVENGNWCG

SEQ ID NO: 2182 - protein, 39 aa, Neocallimastix californiae
  CBM_10
SCWSELIGYPCCSSENTTVYQQDEYGDWGYDFTKQEWCG

SEQ ID NO: 2183 - protein, 38 aa, Neocallimastix californiae
  CBM_10
CWAENLGYSCCSPENTYIYSSDENGDWGFDFENQQWCG

SEQ ID NO: 2184 - protein, 35 aa, Neocallimastix californiae
  CBM_10
TCWSKKLGYPCCKGCKLYSTDDDGSWGYESNQWCG

SEQ ID NO: 2185 - protein, 37 aa, Neocallimastix californiae
  CBM_10
SCWAKKLGYKCCTAKCPGEYYIDEYGSWGVENNDWCG

SEQ ID NO: 2186 - protein, 36 aa, Neocallimastix californiae
  CBM_10
SCWSEKLGYKCCKTSYPVYFTDSDGQWGVENGNWCG

SEQ ID NO: 2187 - protein, 27 aa, Neocallimastix californiae
  CBM_10
YPCCKGCNVVEEDASGKWGIENNYWCA

SEQ ID NO: 2188 - protein, 29 aa, Neocallimastix californiae
  CBM_10
NAYSNCYGCQVVTEEDGYKWGVENNDWCI

SEQ ID NO: 2189 - protein, 36 aa, Neocallimastix californiae
  CBM_10
ECFSVHLGFPCCQNTQEIIYSDNDGDWGVENNSWCG

SEQ ID NO: 2190 - protein, 34 aa, Neocallimastix californiae
  CBM_10
CPGYLDYPCCSSCNVILVEDDGSRWGVQDNNWCS

SEQ ID NO: 2191 - protein, 34 aa, Neocallimastix californiae
  CBM_10
ACWSEPDYPCCKNTCNVILNDGSEWGSENGEWCG

SEQ ID NO: 2192 - protein, 35 aa, Neocallimastix californiae
  CBM_10
KCWSEPLGYPCCSECGYSYYSDSDGEWGVENDDWC

SEQ ID NO: 2193 - protein, 35 aa, Neocallimastix californiae
  CBM_10
CWTEELGYPCCQTCQISQFKDESGDWGYENDDWCG

SEQ ID NO: 2194 - protein, 29 aa, Neocallimastix californiae
  CBM_10
AQGYPCCQSTTSVIYTENNVKWGIENDNW

SEQ ID NO: 2195 - protein, 37 aa, Neocallimastix californiae
  CBM_10
CWSTPLGYQCCPSGCKAEVYETDDNGKWGYENGKWCG

SEQ ID NO: 2196 - protein, 37 aa, Neocallimastix californiae
  CBM_10
ACWSEKLGYPCCPSDRCHVLVTDESGSWGVYQNEWCG

SEQ ID NO: 2197 - protein, 30 aa, Neocallimastix californiae
  CBM_10
NSGYNCCLFSTSVITTDNVGKWGIENDEWC

SEQ ID NO: 2198 - protein, 30 aa, Neocallimastix californiae
  CBM_10
SGGQYNCCEECNVVYTDSEDWGIENGKWCS

SEQ ID NO: 2199 - protein, 39 aa, Neocallimastix californiae
  CBM_10
SCWSTKLGYKCCTLRTTKPIYYSKSADKWYGVENDEWCG

SEQ ID NO: 2200 - protein, 30 aa, Neocallimastix californiae
  CBM_10
SGGQYNCCKECNVVYTDSEDWGIEDGKWCS

SEQ ID NO: 2201 - protein, 39 aa, Neocallimastix californiae
  CBM_10
SCWSTKLGYKCCTLRTTKPTYYSKSADKWYGVENDEWCG

SEQ ID NO: 2202 - protein, 30 aa, Neocallimastix californiae
  CBM_10
NSGYNCCLFSTSVITTDKVGQWGIENDEWC

SEQ ID NO: 2203 - protein, 31 aa, Neocallimastix californiae
  CBM_10
PSGGLYPCCESCEIFYTDTEDWGIENGNWCS

SEQ ID NO: 2204 - protein, 39 aa, Neocallimastix californiae
  CBM_10
SCWSTKFGYKCCTLRTTEPSTFSESDGKWYGIENGKKCG

SEQ ID NO: 2205 - protein, 30 aa, Neocallimastix californiae
  CBM_10
NSGYNCCLFTTTVETTDSVGDWGIENGDWC

SEQ ID NO: 2206 - protein, 36 aa, Neocallimastix californiae
  CBM_10
ECWSEKLGYPCCTSGAQVYYTDADGQWGVENNNWCG

SEQ ID NO: 2207 - protein, 35 aa, Neocallimastix californiae
  CBM_10
CFATKLGYPCCTTTTEVVFTDNDGKWGVENNNWCG

SEQ ID NO: 2208 - protein, 35 aa, Neocallimastix californiae
  CBM_10
CWSKALGYPCCTSTNDVIYKDNDGEWGIENDDWCG

SEQ ID NO: 2209 - protein, 36 aa, Neocallimastix californiae
  CBM_10
ECWSERLGYPCCKSSTEVFFEDSDGQWSVENDDWCG

SEQ ID NO: 2210 - protein, 34 aa, Neocallimastix californiae
  CBM_10
CFSTRLGYPCCSGNTVAYTDNDGDWGVENGNWCG

SEQ ID NO: 2211 - protein, 37 aa, Neocallimastix californiae
  CBM_10
SCWSTALGYPCCSSSSAEVWYTDNDGAWGVENGDWCG

SEQ ID NO: 2212 - protein, 19 aa, Neocallimastix californiae
  CBM_10
VWYTDNDGAWGVENGDWCG

SEQ ID NO: 2213 - protein, 38 aa, Neocallimastix californiae
  CBM_10
KCISEVLGYPCCPPEITEVYVTDINGDWAYDYEKQVWC

SEQ ID NO: 2214 - protein, 36 aa, Neocallimastix californiae
  CBM_10
ECWSESLNYPCCDNCVVYEVDDNGKWGYDFQTQTWC

SEQ ID NO: 2215 - protein, 35 aa, Neocallimastix californiae; identical to SEQ ID NO: 1522
  CBM_10

SEQ ID NO: 2216 - protein, 37 aa, Neocallimastix californiae; identical to SEQ ID NO: 1523
  CBM_10

SEQ ID NO: 2217 - protein, 35 aa, Neocallimastix californiae
  CBM_10
ECWSEALGYPCCSECINAYAEDADGKWGIENDNWC

SEQ ID NO: 2218 - protein, 29 aa, Neocallimastix californiae
  CBM_10
KGYECCEGCTVEYEENNIKWGYENRNWCV

SEQ ID NO: 2219 - protein, 32 aa, Neocallimastix californiae
  CBM_10
ATRFGFPCCEKCILQYVDDFGNWGFENDNWCG

SEQ ID NO: 2220 - protein, 30 aa, Neocallimastix californiae
  CBM_10
KLGYRCCSSCEIKYIDNNIKYGYEDGEWCG

SEQ ID NO: 2221 - protein, 37 aa, Neocallimastix californiae
  CBM_10
KCWSKGLFKIPCCKKTDVVVRTTYDGEWGQEDNGKWC

SEQ ID NO: 2222 - protein, 35 aa, Neocallimastix californiae
  CBM_10
CYGETTGEYSCCEKCKVRYSDKHGDWGIENKEWCS

SEQ ID NO: 2223 - protein, 35 aa, Neocallimastix californiae
  CBM_10
CWSEILGYSCCKETCKTKYTDKHGNWGVENKQWCG

SEQ ID NO: 2224 - protein, 35 aa, Neocallimastix californiae
  CBM_10
CWSEILGYSCCKKTCKTKYSDKHGNWGVENKQWCG

SEQ ID NO: 2225 - protein, 29 aa, Neocallimastix californiae
  CBM_10
ECWSEVLGYPCCKSCTVYDTDSDGQWGYE

SEQ ID NO: 2226 - protein, 38 aa, Neocallimastix californiae
  CBM_10
CWVEQFGYPCCSSRNKIVYAHDGEGDWGYDFSKMEWCG

SEQ ID NO: 2227 - protein, 37 aa, Neocallimastix californiae; identical to SEQ ID NO: 1450
  CBM_10

SEQ ID NO: 2228 - protein, 34 aa, Neocallimastix californiae
  CBM_10
CFSTRLGYPCCSGNDVVYIDNDGKWGVENGNWCG

SEQ ID NO: 2229 - protein, 37 aa, Neocallimastix californiae
  CBM_10
QCWSKKLGYECCTGDDEGHIFVVEEDKDGQWGYENGH

SEQ ID NO: 2230 - protein, 36 aa, Neocallimastix californiae
  CBM_10
ECWSQRLGYNCCTTSCYIYEKDQDGNWGYENNEWCG

SEQ ID NO: 2231 - protein, 31 aa, Neocallimastix californiae
  CBM_10
GIYKCCSSSDAEVWYVDDDGNWGVENGEWCF

SEQ ID NO: 2232 - protein, 36 aa, Neocallimastix californiae
  CBM_10
CWSRKLGYRCCSADNTEVIVIDKDGKWGVEDQEWCG

SEQ ID NO: 2233 - protein, 35 aa, Neocallimastix californiae
  CBM_10
QCWSEPLGYPCCQKCSIIETNESGSWGFELNQWCG

SEQ ID NO: 2234 - protein, 37 aa, Neocallimastix californiae
  CBM_10
KCLSEIIGYSCCPLGYENIYHDNYGDWGYDFENDTWC

SEQ ID NO: 2235 - protein, 39 aa, Neocallimastix californiae
  CBM_10
ACWSTKLGYKCCTLRTTEPIHYSKSADKWYGVENDEWCG

SEQ ID NO: 2236 - protein, 31 aa, Neocallimastix californiae
  CBM_10
PSGGLYPCCKTCEVVYTDTEDWGIEDANWCS

SEQ ID NO: 2237 - protein, 30 aa, Neocallimastix californiae
  CBM_10
NSGYNCCLFTTKVETSDTVGDWGIENNEWC

SEQ ID NO: 2238 - protein, 35 aa, Neocallimastix californiae
  CBM_10
SCWSTSLGFPCCSGNSIVYFTDSNGQWGIENDQWC

SEQ ID NO: 2239 - protein, 37 aa, Neocallimastix californiae
  CBM_10
CWSSKYGYKCCSTSTCRNSVFADTDGQWDVENGQWCG

SEQ ID NO: 2240 - protein, 37 aa, Neocallimastix californiae
  CBM_10
TCWSTSLGYPCCKSCNTSAVFEDNDGKWGIENDDWCG

SEQ ID NO: 2241 - protein, 31 aa, Neocallimastix californiae
  CBM_10
AQGYPCCKTTCSVFSTDSDGKWGIENDNWCL

SEQ ID NO: 2242 - protein, 34 aa, Neocallimastix californiae
  CBM_10
CWSERFNIPCCKSTNTVVRSTYDGEWGMENGEWC

SEQ ID NO: 2243 - protein, 32 aa, Neocallimastix californiae
  CBM_10
AQGYKCCADSNCTVYYTDADGTWGVENGEWCG

SEQ ID NO: 2244 - protein, 39 aa, Neocallimastix californiae
  CBM_10
SCSSKITAQGYKCCSDPNCVVYYTDADGTWGVENGQWCG

SEQ ID NO: 2245 - protein, 36 aa, Neocallimastix californiae
  CBM_10
ECAFEKIGYKCCESTTDVVFEDGSGTWGVENNEWCG

SEQ ID NO: 2246 - protein, 29 aa, Neocallimastix californiae
  CBM_10
YGYKCCERCEVEYSDDTGSWGVENGDWCG

SEQ ID NO: 2247 - protein, 36 aa, Neocallimastix californiae
  CBM_10
TCWAQAQGYQCCTSTSEVVFTDESGDWGVENGEWCG

SEQ ID NO: 2248 - protein, 30 aa, Neocallimastix californiae
  CBM_10
SSGYPYCKSTTEVIYTDDVNWGVENGDWCV

SEQ ID NO: 2249 - protein, 29 aa, Neocallimastix californiae
  CBM_10
YGYKCCERCEVEYSDDTGSWGVENGDWCG

SEQ ID NO: 2250 - protein, 36 aa, Neocallimastix californiae; identical to SEQ ID NO: 2247
  CBM_10

SEQ ID NO: 2251 - protein, 30 aa, Neocallimastix californiae; identical to SEQ ID NO: 2248
  CBM_10

SEQ ID NO: 2252 - protein, 36 aa, Neocallimastix californiae
  CBM_10
TCWSVKLGYPCCEVSNAIYSVDDNGSWGVEDDFWCG

SEQ ID NO: 2253 - protein, 37 aa, Neocallimastix californiae
  CBM_10
ACWSDSLGYPCCSSADIQVVSEDSSGKWGIENNNWCG

SEQ ID NO: 2254 - protein, 36 aa, Neocallimastix californiae
  CBM_10
KCWSEPDYPCCKLSSTRVEYTDASGSWGIENGNWCG

SEQ ID NO: 2255 - protein, 35 aa, Neocallimastix californiae
  CBM_10
TCWAEALGYSCCPSGTPVSYTDASGDWGYVNDWCG

SEQ ID NO: 2256 - protein, 34 aa, Neocallimastix californiae
  CBM_10
ECFAYPLYNCCKGCDVIEESDEGKWGIENGYWCG

SEQ ID NO: 2257 - protein, 28 aa, Neocallimastix californiae
  CBM_10
AYDECKACNVVYVEGDEKWGVENNDWCI

SEQ ID NO: 2258 - protein, 31 aa, Neocallimastix californiae
  CBM_10
PNASKYKCCDSCKVSVDDGNKWGILNGEWCS

SEQ ID NO: 2259 - protein, 36 aa, Neocallimastix californiae
  CBM_10
QCWAEAYGYSCCTKCVSVVDISNNRKWGIENNRWCG

SEQ ID NO: 2260 - protein, 37 aa, Neocallimastix californiae
  CBM_10
CPSAITAQGYKCCSSCGTVYYTDGDGEWGVENGDWCG

SEQ ID NO: 2261 - protein, 31 aa, Neocallimastix californiae
  CBM_10
AQGYKCCSANCEVVYTDNDGDWGVENNEWCG

SEQ ID NO: 2262 - protein, 35 aa, Neocallimastix californiae
  CBM_10
SCWSSSLSYGCCSGCKVLYTDKDGKWGIENGDWCG

SEQ ID NO: 2263 - protein, 36 aa, Neocallimastix californiae
  CBM_10
SCWSTQLGYKCCTKTNFIVYTDKDGYWGVENKQWCG

SEQ ID NO: 2264 - protein, 35 aa, Neocallimastix californiae
  CBM_10
ECPGKKYGYPCCESCDVFLEDESGIWGAENGQWCS

SEQ ID NO: 2265 - protein, 38 aa, Neocallimastix californiae
  CBM_10
ECWSEAFGYKCCSAGCNSVVVVIDESGYWSAENGEWCG

SEQ ID NO: 2266 - protein, 32 aa, Neocallimastix californiae
  CBM_10
QSQGYQCCSNNNCNIVYQDGTGNWGVENNQWC

SEQ ID NO: 2267 - protein, 32 aa, Neocallimastix californiae
  CBM_10
QCHPQYPCCSGCDVIYTDTDGEWGVENYDWCF

SEQ ID NO: 2268 - protein, 31 aa, Neocallimastix californiae
  CBM_10
KKQGYSCCSSCIIYFTDNDGKWGVENGKWCG

SEQ ID NO: 2269 - protein, 31 aa, Neocallimastix californiae
  CBM_10
KSQGYACCRSCDIIYSDESGDWGIENSYWCG

SEQ ID NO: 2270 - protein, 32 aa, Neocallimastix californiae
  CBM_10
IKKQGYSCCSSCIIYFTDNDGKWGVENGKWCG

SEQ ID NO: 2271 - protein, 31 aa, Neocallimastix californiae; identical to SEQ ID NO: 2269
  CBM_10

SEQ ID NO: 2272 - protein, 37 aa, Neocallimastix californiae
  CBM_10
SCKFTQLGYPCCDNPKTVSVYTDESGDWGIENGDWCG

SEQ ID NO: 2273 - protein, 35 aa, Neocallimastix californiae
  CBM_10
SCTGMNLGYPCCDDCNVVYTDHDGKWGVQNDDWCG

SEQ ID NO: 2274 - protein, 31 aa, Neocallimastix californiae
  CBM_10
GLYPCCKNCEVIYTDEDDGTQYGLDKIEWCI

SEQ ID NO: 2275 - protein, 34 aa, Neocallimastix californiae
  CBM_10
FANAYGYPGCKSTTEIKYYDEEGSWGYENGTWCG

SEQ ID NO: 2276 - protein, 36 aa, Neocallimastix californiae
  CBM_10
KCWSEPLGYPCCTGIIKTEYTDKDGEWGLQNGDWCG

SEQ ID NO: 2277 - protein, 34 aa, Neocallimastix californiae
  CBM_10
SYIKGYKWCSDPNTKRYPYNDEDFWGVENGNWCV

SEQ ID NO: 2278 - protein, 36 aa, Neocallimastix californiae
  CBM_10
TCWSEPLGYPCCTGIIETEYTDKDGEWGLQNGDWCG

SEQ ID NO: 2279 - protein, 36 aa, Neocallimastix californiae
  CBM_10
CHFLDINYKCCTTTMTSSYEDIDGLWGNETNGEWCG

SEQ ID NO: 2280 - protein, 34 aa, Neocallimastix californiae
  CBM_10
CWSAKFGYPCCKETTVVEAVDENGRWGLENGGRC

SEQ ID NO: 2281 - protein, 36 aa, Neocallimastix californiae
  CBM_10
KCWSEPLGYPCCTGNTKTEYTDKDGEWGLQNGDWCG

SEQ ID NO: 2282 - protein, 28 aa, Neocallimastix californiae
  CBM_10
SSKYKCCESCNVSYDDGNKWGVLNGEWC

SEQ ID NO: 2283 - protein, 30 aa, Neocallimastix californiae
  CBM_10
ASYPCCENTCAVQYTDADGQWGIENGEWCS

SEQ ID NO: 2284 - protein, 36 aa, Neocallimastix californiae
  CBM_10
CFSTRLGYPCCSPNNTNVVYADNDGDWGIENGNWCG

SEQ ID NO: 2285 - protein, 36 aa, Neocallimastix californiae
  CBM_10
TCWSSAMGYSCCKSCDSFNYKDNDGEWGIENDAWCG

SEQ ID NO: 2286 - protein, 34 aa, Neocallimastix californiae
  CBM_10
CKGALGYPCCKSTCNVYSSDESGQWGIEDNNWCL

SEQ ID NO: 2287 - protein, 34 aa, Neocallimastix californiae
  CBM_10
QCFSYPEYICCEGCNVIEETAEGKWGIEKNQWCG

SEQ ID NO: 2288 - protein, 27 aa, Neocallimastix californiae
  CBM_10
AYEYCQGCRVFYEDDQQWGVENNDWCI

SEQ ID NO: 2289 - protein, 29 aa, Neocallimastix californiae
  CBM_10
YSKTGYPYCSLENIDIAYTHETGSWGFEN

SEQ ID NO: 2290 - protein, 30 aa, Neocallimastix californiae
  CBM_10
KGYNCCKNSCNVTYKDNDGNWDVENGNWCG

SEQ ID NO: 2291 - protein, 35 aa, Neocallimastix californiae
  CBM_10
CWSMPDYPCCTNTKTAVYTDNAGNEWGMENNNWCG

SEQ ID NO: 2292 - protein, 36 aa, Neocallimastix californiae
  CBM_10
CFSEALGYPCCSDSNAAVVTTDEFGHWGIENNEWCG

SEQ ID NO: 2293 - protein, 32 aa, Neocallimastix californiae
  CBM_10
VSNGFPTCKSCDVTATGTDGVSLWGWENEKSC

SEQ ID NO: 2294 - protein, 31 aa, Neocallimastix californiae
  CBM_10
NSGYNCCVFDTTAVQTVDVVGKWGIENGDWC

SEQ ID NO: 2295 - protein, 32 aa, Neocallimastix californiae
  CBM_10
CPSGGTYKCCSSCEILYTDTEEWGIEDGEWCS

SEQ ID NO: 2296 - protein, 39 aa, Neocallimastix californiae
  CBM_10
SCWSKSLGYPCCTSKTTELIYFSKSANKWYGVENDEWCG

SEQ ID NO: 2297 - protein, 35 aa, Neocallimastix californiae
  CBM_10
AITSQGYKCCKEDNCSVIETDDAGKWGIEDGQWCG

SEQ ID NO: 2298 - protein, 37 aa, Neocallimastix californiae
  CBM_10
CSDAILKKGYKCCSKDCFIVFTDDDGTWGIENDQWCG

SEQ ID NO: 2299 - protein, 34 aa, Neocallimastix californiae
  CBM_10
CTGAQGYPCCQSTTKVEYTDGDGNWGVENGDWCI

SEQ ID NO: 2300 - protein, 31 aa, Neocallimastix californiae
  CBM_10
SQGYKCCSRNCVVVYSDADGNWGVENGEWCG

SEQ ID NO: 2301 - protein, 35 aa, Neocallimastix californiae
  CBM_10
CWSKKLGYPCCTSSSQVYETDANGEWGYEDNHWCG

SEQ ID NO: 2302 - protein, 36 aa, Neocallimastix californiae
  CBM_10
ECWSEVLGYPCCTSSCHVYETDSDGEWGYENKQWCG

SEQ ID NO: 2303 - protein, 36 aa, Neocallimastix californiae
  CBM_10
SCFSKSLGYPCCTSKNPRIYFSDSKGNWSYENGKWC

SEQ ID NO: 2304 - protein, 35 aa, Neocallimastix californiae
  CBM_10
KCFATALGYPCCSPYAKERFRDKNGRWGIEYGAWC

SEQ ID NO: 2305 - protein, 35 aa, Neocallimastix californiae
  CBM_10
KCFTIPLGYPCCTKTKEVTYTNGYGTWGTENGDWC

SEQ ID NO: 2306 - protein, 35 aa, Neocallimastix californiae
  CBM_10
CWSKTLGYDCCKNTCNVVYSDNDGEWGVENNEWCG

SEQ ID NO: 2307 - protein, 33 aa, Neocallimastix californiae
  CBM_10
QCYGTTTGEYPCCTHCDIYYVDENGNWGIENNN

SEQ ID NO: 2308 - protein, 34 aa, Neocallimastix californiae
  CBM_10
KCFSYPDYPCCEECNVYEEDDSGKWGIENNQWCG

SEQ ID NO: 2309 - protein, 29 aa, Neocallimastix californiae
  CBM_10
AYSNCNSTCRVVTVEDGVSWGVENNDWCI

SEQ ID NO: 2310 - protein, 33 aa, Neocallimastix californiae
  CBM_10
QSQGYKCCSDKNCAVVYSDNDGTWGVENGQWCG

SEQ ID NO: 2311 - protein, 34 aa, Neocallimastix californiae
  CBM_10
CKGVTGYPCCQSNKTVYFSDESGDWSVENNNWCL

SEQ ID NO: 2312 - protein, 35 aa, Neocallimastix californiae
  CBM_10
KCRFESLGYPCCSHCNVIYTDDDGNWGAENGQWCG

SEQ ID NO: 2313 - protein, 36 aa, Neocallimastix californiae
  CBM_10
CVVKSLGYPCCSPNNTEVFYTDENGDWGVENGDWCG

SEQ ID NO: 2314 - protein, 34 aa, Neocallimastix californiae
  CBM_10
CWSEALGYPCCSTCSSPVYSDNDGNWGIENGDWC

SEQ ID NO: 2315 - protein, 34 aa, Neocallimastix californiae
  CBM_10
CWSLALGYPCCVGNDVIFVDESGEWGVENNNWCG

SEQ ID NO: 2316 - protein, 38 aa, Neocallimastix californiae
  CBM_10
ACWATALGYDCCSTNVCRTVYYEDNDGKWDVENGQWCG

SEQ ID NO: 2317 - protein, 37 aa, Neocallimastix californiae
  CBM_10
ECWSLKDGYPCCKTTFTVIEVDENGKKWGFENNNWCG

SEQ ID NO: 2318 - protein, 36 aa, Neocallimastix californiae
  CBM_10
QCWATKYDYPCCKKTTEVIEKDEHGKWGFENNDWCG

SEQ ID NO: 2319 - protein, 36 aa, Neocallimastix californiae
  CBM_10
SCWASKLGFSCCKNTKDVVYRDSNGKWGVENNTWCG

SEQ ID NO: 2320 - protein, 36 aa, Neocallimastix californiae
  CBM_10
KCWASEFGYPCCKTTTEVIEKDEHGKWGFENKEWCG

SEQ ID NO: 2321 - protein, 36 aa, Neocallimastix californiae
  CBM_10
KCWASEFNYPCCKTTSKVIEVNEYGKWGIENNDWCG

SEQ ID NO: 2322 - protein, 34 aa, Neocallimastix californiae
  CBM_10
CWSIDLGYPCCIENNVVEVNENGKWGIENNNWCG

SEQ ID NO: 2323 - protein, 30 aa, Neocallimastix californiae
  CBM_10
NSGYNCCILTKSVKLIDNVGQWGVENGEWC

SEQ ID NO: 2324 - protein, 37 aa, Neocallimastix californiae
  CBM_10
CWAISEGYPCCKNKNTQVQDISSDGRKWGFENDDWCG

SEQ ID NO: 2325 - protein, 31 aa, Neocallimastix californiae
  CBM_10
CPVNSEYSCCSSCDVYYVDEFEWGVEDGSWC

SEQ ID NO: 2326 - protein, 33 aa, Neocallimastix californiae
  CBM_10
SKFGYSCCKKETTAILTTDRDADWGVEDGKWCA

SEQ ID NO: 2327 - protein, 35 aa, Neocallimastix californiae
  CBM_10
CWSLPQGYPCCKKTTNVTYRDETGNWGFEFGNWCG

SEQ ID NO: 2328 - protein, 36 aa, Neocallimastix californiae
  CBM_10
YKKTYASDYPTCTGCVLYASGTDGNLWGWENFDFCK

SEQ ID NO: 2329 - protein, 36 aa, Neocallimastix californiae
  CBM_10
RCHINISEHPFCKGCVVTATGTDSSLWGWENNSSCM

SEQ ID NO: 2330 - protein, 35 aa, Neocallimastix californiae
  CBM_10
CHINISEHPFCKGCVVTATGTDSSLWGWENNSSCM

SEQ ID NO: 2331 - protein, 31 aa, Neocallimastix californiae
  CBM_10
AQGYPCCESSTIVYYTDGDGDWSVENGDWCI

SEQ ID NO: 2332 - protein, 31 aa, Neocallimastix californiae
  CBM_10
QQGYSCCQPGCTVVYTDNDGDWGVENNAWCG

SEQ ID NO: 2333 - protein, 37 aa, Neocallimastix californiae
  CBM_10
ACFSEKLGYPCCSANNKNVVYTDSDGDWGVENNNWCG

SEQ ID NO: 2334 - protein, 35 aa, Neocallimastix californiae
  CBM_10
CWATALGYKCCQSTSVVVETDANGKWGIENNEWCG

SEQ ID NO: 2335 - protein, 37 aa, Neocallimastix californiae
  CBM_10
CSSKITAQGYSCCSKYCTIVYTDNDGTWGYENGDWCG

SEQ ID NO: 2336 - protein, 28 aa, Neocallimastix californiae
  CBM_10
GEYPCCKECNVYYTDTEDWGIEDGEWCS

SEQ ID NO: 2337 - protein, 39 aa, Neocallimastix californiae
  CBM_10
KCWSLKYDYKCCTLRTTEPSYFSKTANNWYGIENGEWCG

SEQ ID NO: 2338 - protein, 30 aa, Neocallimastix californiae
  CBM_10
NTGYNCCLFTTTVVTTDSVGDWGVENEDWC

SEQ ID NO: 2339 - protein, 31 aa, Neocallimastix californiae
  CBM_10
NQGYKCCSDGCTVIYIDSDGDWGAENGEWCG

SEQ ID NO: 2340 - protein, 31 aa, Neocallimastix californiae
  CBM_10
RYGYKCCSSCSKVYYTDKDGKWGIENRDWCG

SEQ ID NO: 2341 - protein, 35 aa, Neocallimastix californiae
  CBM_10
CFALSDGYECCFDNEVVYEDETGKWGINDKGEWCG

SEQ ID NO: 2342 - protein, 38 aa, Neocallimastix californiae
  CBM_10
ECWAEALGYKCCSDDGFHPVIYQDESGDWSADNGEWCG

SEQ ID NO: 2343 - protein, 37 aa, Neocallimastix californiae
  CBM_10
ECWSKAQGYDCCAEGTSVFLEDESGKWGVTPNGLWCG

SEQ ID NO: 2344 - protein, 27 aa, Neocallimastix californiae
  CBM_10
DCCKNSNLKVSYVDNNGYWGIESESWC

SEQ ID NO: 2345 - protein, 36 aa, Neocallimastix californiae
  CBM_10
KCWSESLGYKCCSLDIEPIFTDNDGIWGMENEQWCG

SEQ ID NO: 2346 - protein, 36 aa, Neocallimastix californiae
  CBM_10
CWSLDIGYGCCSSNNTDILYNNEDGSWGIENGQWCG

SEQ ID NO: 2347 - protein, 38 aa, Neocallimastix californiae
  CBM_10
TCSSKILAQGYPCCSDNCTVVYTDDDGTWGVENGQWCG

SEQ ID NO: 2348 - protein, 35 aa, Neocallimastix californiae
  CBM_10
SCWSASLGYPCCKSCSVYYSDNDGKWGIENDNWCG

SEQ ID NO: 2349 - protein, 31 aa, Neocallimastix californiae
  CBM_10
AQGYPCCQNTCTVYSTDADGKWGIENNDWCL

SEQ ID NO: 2350 - protein, 35 aa, Neocallimastix californiae
  CBM_10
CWASALGFKCCKTTSTVIFEDQDGSWGIEDDFWCG

SEQ ID NO: 2351 - protein, 36 aa, Neocallimastix californiae
  CBM_10
TCWSTRLGYPCCEDSNVVYAVDENGIWGYENKHWCG

SEQ ID NO: 2352 - protein, 28 aa, Neocallimastix californiae
  CBM_10
ECEFNALGYSCCPDAAVVFEDDHKWGYV

SEQ ID NO: 2353 - protein, 36 aa, Neocallimastix californiae
  CBM_10
SCFSVALGFPCCSSSATEVFRDSYGSWGVEYGEWCG

SEQ ID NO: 2354 - protein, 37 aa, Neocallimastix californiae
  CBM_10
SCFSSALGIPCCSSKNAEIYYSDIKGNWGIENGDWCG

SEQ ID NO: 2355 - protein, 37 aa, Neocallimastix californiae
  CBM_10
SCFSKSLGFPCCSSKNKDIYFTDEKGNWGIENGEWCG

SEQ ID NO: 2356 - protein, 35 aa, Neocallimastix californiae
  CBM_10
TCFSIPLGYPCCTSTKEVIDTNEYGTWGIENGDWC

SEQ ID NO: 2357 - protein, 23 aa, Neocallimastix californiae
  CBM_10
EGYTCCKGCDVIYTDDFKWGFEA

SEQ ID NO: 2358 - protein, 39 aa, Neocallimastix californiae
  CBM_10
KCWSLSQGYPCCKKETTAINYTSSSTGAEWGIENGNWCG

SEQ ID NO: 2359 - protein, 32 aa, Neocallimastix californiae
  CBM_10
KGTGYACCIFKNTIVETVDESGQWGHEGNDWC

SEQ ID NO: 2360 - protein, 34 aa, Neocallimastix californiae
  CBM_10
CWALAEGYNCCSGCSVSYEDETGKWGIENGQWCG

SEQ ID NO: 2361 - protein, 21 aa, Neocallimastix californiae
  CBM_10
CSVSYEDETGKWGIENGQWCG

SEQ ID NO: 2362 - protein, 35 aa, Neocallimastix californiae
  CBM_10
SCFSYTLGYPCCTSTTNVIYTDSYGRWGIEKGNWC

SEQ ID NO: 2363 - protein, 36 aa, Neocallimastix californiae
  CBM_10
CWSKTYGYPCCSSASTKVMYTDNDGEWGVENGNWCG

SEQ ID NO: 2364 - protein, 36 aa, Neocallimastix californiae
  CBM_10
ECWSLELGYPCCKTTKDVVYTDNSGDWGLENGDWCG

SEQ ID NO: 2365 - protein, 35 aa, Neocallimastix californiae
  CBM_10
CWIKDYFSCCDEGAEVIYEDHNGKWGIQGANDWCL

SEQ ID NO: 2366 - protein, 30 aa, Neocallimastix californiae
  CBM_10
ALAYEDCKSCYIHYEDSDGYWGYNGDEWCI

SEQ ID NO: 2367 - protein, 34 aa, Neocallimastix californiae
  CBM_10
CWSEKYGYPCCPKSKVITVDKHGKWGIENGDYCG

SEQ ID NO: 2368 - protein, 34 aa, Neocallimastix californiae
  CBM_10
ECFATKLNYKCCSGCDVAFVDNDGKWGYENNNWC

SEQ ID NO: 2369 - protein, 34 aa, Neocallimastix californiae
  CBM_10
CFSLPEYPCCTSTKTVMYTDEKGPWGIENGNWCG

SEQ ID NO: 2370 - protein, 35 aa, Neocallimastix californiae
  CBM_10
ECFSIKLGYPCCNTCNVSTTDQDGSWGIENNQWCG

SEQ ID NO: 2371 - protein, 36 aa, Neocallimastix californiae
  CBM_10
KCWSTALGYSCCKSCLAAVFSDNDGKWAVEEDNWCG

SEQ ID NO: 2372 - protein, 37 aa, Neocallimastix californiae
  CBM_10
SCWATKLGYKCCTAKCPEVSYVDQDGAWGVENGNWCG

SEQ ID NO: 2373 - protein, 36 aa, Neocallimastix californiae
  CBM_10
SCWATKLGFNCCKNTSAVYETDANGRWGIENGNWCG

SEQ ID NO: 2374 - protein, 31 aa, Neocallimastix californiae
  CBM_10
AQGYPCCSANCQVVYTDADGEWGVENGDWCG

SEQ ID NO: 2375 - protein, 31 aa, Neocallimastix californiae
  CBM_10
AQGFPCCESSTIVYYTDGDGDWSVENNDWCI

SEQ ID NO: 2376 - protein, 35 aa, Neocallimastix californiae
  CBM_10
ACWSTSLGYPCCSGNEVVYTDNDGKWGVENGNWCG

SEQ ID NO: 2377 - protein, 25 aa, Neocallimastix californiae
  CBM_10
CCSGNEVVYTDNDGKWGVENGNWCG

SEQ ID NO: 2378 - protein, 38 aa, Neocallimastix californiae
  CBM_10
CSSSITNQGYSCCSSSNCNIIYTDKDGKWGVENNTWCG

SEQ ID NO: 2379 - protein, 38 aa, Neocallimastix californiae
  CBM_10
QCSSSILSQGYKCCSSKCTIVYVDEDGTWGIENDEWCG

SEQ ID NO: 2380 - protein, 37 aa, Neocallimastix californiae
  CBM_10
CSASILKQGYSCCSSRCTVTFTDEDGDWGVENGQWCG

SEQ ID NO: 2381 - protein, 34 aa, Neocallimastix californiae
  CBM_10
SNNTGYDCCADSNARVQYTDESGNWSIENGNWCL

SEQ ID NO: 2382 - protein, 24 aa, Neocallimastix californiae
  CBM_10
QCFSISLGYPCCQGNTVVYTDKDG

SEQ ID NO: 2383 - protein, 29 aa, Neocallimastix californiae
  CBM_10
DGYECCKSCNIVLTDESGNWGVEDGQWCG

SEQ ID NO: 2384 - protein, 36 aa, Neocallimastix californiae
  CBM_10
ECWAAEQGYPCCTTTTEVAFADASGKWGIEDGNWCG

SEQ ID NO: 2385 - protein, 29 aa, Neocallimastix californiae
  CBM_10
GIYPCCQGCVVVTSDSDGDWGVEDGQWCL

SEQ ID NO: 2386 - protein, 38 aa, Neocallimastix californiae
  CBM_10
SCWSETYGYKCCSKGCSSNVLTNDEYGYWGAENGEWCG

SEQ ID NO: 2387 - protein, 33 aa, Neocallimastix californiae
  CBM_10
HASNQGYSCCKDCTVVYEDEAGKWGVENDQWCG

SEQ ID NO: 2388 - protein, 35 aa, Neocallimastix californiae
  CBM_10
SCWATAQGYGCCTGCEAIMTDDNRKWGFENGNWCG

SEQ ID NO: 2389 - protein, 35 aa, Neocallimastix californiae
  CBM_10
CWAAAEGFKCCSPGVKSILTDSKGSWGIENDEWCG

SEQ ID NO: 2390 - protein, 30 aa, Neocallimastix californiae
  CBM_10
KQGYPCCKNTKDVYYRDADGNWGIENNNWC

SEQ ID NO: 2391 - protein, 32 aa, Neocallimastix californiae
  CBM_10
QQGYKCCSSSNCVVQYVDSDGYWAVENNQWCG

SEQ ID NO: 2392 - protein, 38 aa, Neocallimastix californiae
  CBM_10
SCSANILKQGYKCCPSGCVVVFTDNDGTWGVNNGEWCG

SEQ ID NO: 2393 - protein, 34 aa, Neocallimastix californiae
  CBM_10
CFALDLGFKCCNDATVVYTDDSGDWGYVNNDWCG

SEQ ID NO: 2394 - protein, 27 aa, Neocallimastix californiae
  CBM_10
YPCCSECTVVYTDESGDWGVENNEWCL

SEQ ID NO: 2395 - protein, 37 aa, Neocallimastix californiae
  CBM_10
TCWASALGYPCCSSSSVTVYEEDSNGKWGIENDNWCG

SEQ ID NO: 2396 - protein, 34 aa, Neocallimastix californiae
  CBM_10
CFAIKLGYKCCKTTTVTIYEDNDGPWGIENDEWC

SEQ ID NO: 2397 - protein, 30 aa, Neocallimastix californiae
  CBM_10
SCWSESFGYPCCHSCYVFETDDNGKWGFEN

SEQ ID NO: 2398 - protein, 34 aa, Neocallimastix californiae
  CBM_10
ECWTLPDYPCCKGNTVVLTDVKGDWGVENNAWCG

SEQ ID NO: 2399 - protein, 33 aa, Neocallimastix californiae
  CBM_10
CWSLPQFPCCKNNVVVYTDGSGDWGFENNNWCG

SEQ ID NO: 2400 - protein, 18 aa, Neocallimastix californiae
  CBM_10
VYTDEDGNWGVENDQWCG

SEQ ID NO: 2401 - protein, 30 aa, Neocallimastix californiae
  CBM_10
KGYSCCPKDCKVLYTDEEGTWGINNYKWCI

SEQ ID NO: 2402 - protein, 30 aa, Neocallimastix californiae
  CBM_10
FNYPCCSLGYDKIVYSDKYAYWGFENGDWC

SEQ ID NO: 2403 - protein, 36 aa, Neocallimastix californiae
  CBM_10
TCWATKLGYPCCTTTSQSLFTDENGEWGVENNDWCG

SEQ ID NO: 2404 - protein, 32 aa, Neocallimastix californiae
  CBM_10
KHPNGYPYCKQTNEVVFTDTVEWGVENGAWCV

SEQ ID NO: 2405 - protein, 30 aa, Neocallimastix californiae
  CBM_10
KCWSLEYGYKCCSHCKVLLKDDYGKWGEMN

SEQ ID NO: 2406 - protein, 37 aa, Neocallimastix californiae
  CBM_10
ECWSKALGYECCSKDNTRVVVSDDSGKWGVENGQWCG

SEQ ID NO: 2407 - protein, 37 aa, Neocallimastix californiae
  CBM_10
TCWSERKGFPCCSSKDTKVDYEDSDGKWGHENNQWCG

SEQ ID NO: 2408 - protein, 34 aa, Neocallimastix californiae
  CBM_10
CFSIDLGYPCCKKTQKVESKDSDGTWGYENGGWC

SEQ ID NO: 2409 - protein, 36 aa, Neocallimastix californiae
  CBM_10
SCWSKASGFNCCKNCGKVYFIDKDGEWGIENNDWCG

SEQ ID NO: 2410 - protein, 32 aa, Neocallimastix californiae
  CBM_10
CKGAQGYPCCAYSCDSLFTDSDGEWSVENENW

SEQ ID NO: 2411 - protein, 31 aa, Neocallimastix californiae
  CBM_10
GTGYDCCQYTTIPTYTDKQGYWAMEDEEWCI

SEQ ID NO: 2412 - protein, 30 aa, Neocallimastix californiae
  CBM_10
GANYKCCTTTCEVYYSDESGDWGVEDNDWC

SEQ ID NO: 2413 - protein, 34 aa, Neocallimastix californiae
  CBM_10
TCWSLPDFPCCTGKDIVYSDGSGDWGFENGSWCG

SEQ ID NO: 2414 - protein, 36 aa, Neocallimastix californiae
  CBM_10
TCWSLPEYPCCTDSNTPVMEEDTLGKWGIENGSWCG

SEQ ID NO: 2415 - protein, 32 aa, Neocallimastix californiae
  CBM_10
KGSGYSCCIFDTTPVVSKDNTGYWGVENGQWC

SEQ ID NO: 2416 - protein, 38 aa, Neocallimastix californiae
  CBM_10
KCWSEAQDYPCCKEPTTSVVSKDSKGYLWGVENNEWCG

SEQ ID NO: 2417 - protein, 34 aa, Neocallimastix californiae
  CBM_10
QCFSYPDYPCCKSCVEVYEDDLGKWGIENDVWCG

SEQ ID NO: 2418 - protein, 25 aa, Neocallimastix californiae
  CBM_10
CCEGCKVIQEDKDGKWGYENNEWCG

SEQ ID NO: 2419 - protein, 29 aa, Neocallimastix californiae
  CBM_10
GREYKCCKSCDIIYTDTSDWGVEDDDWCS

SEQ ID NO: 2420 - protein, 36 aa, Neocallimastix californiae
  CBM_10
SCWSQDLGYPCCQSTVDVRYTDKDGLWGVENGNWCG

SEQ ID NO: 2421 - protein, 35 aa, Neocallimastix californiae
  CBM_10
TCFSIDMGYPCCSTCTVVYTDSDGGWGVENGEWCG

SEQ ID NO: 2422 - protein, 35 aa, Neocallimastix californiae
  CBM_10
SCWAQGLGYPCCEGCEASFTDGDGDWAIENGNWCG

SEQ ID NO: 2423 - protein, 36 aa, Neocallimastix californiae
  CBM_10
QCWSQSQGFPCCSPDTPVFSTDESGKWGIENDDWCG

SEQ ID NO: 2424 - protein, 36 aa, Neocallimastix californiae
  CBM_10
TCWSELLGFPCCVGTVTVEYTDEDGEWGLQNGDWCG

SEQ ID NO: 2425 - protein, 35 aa, Neocallimastix californiae
  CBM_10
CWSTALGYPCCKNSSIVYFTDNDGKWSVEDNEWCG

SEQ ID NO: 2426 - protein, 25 aa, Neocallimastix californiae
  CBM_10
CWSTALGYPCCKNSSIVYFTDNDGK

SEQ ID NO: 2427 - protein, 39 aa, Neocallimastix californiae
  CBM_10
ECWSEQLGYPCCNSGNKEVVFEDENGNWGISPKTNDWCG

SEQ ID NO: 2428 - protein, 30 aa, Neocallimastix californiae
  CBM_10
GFKCCSSSDAKVEYTDNDGKWSIEDGNWCG

SEQ ID NO: 2429 - protein, 37 aa, Neocallimastix californiae
  CBM_10
ECWALELGFECCTSEDIEVQYTDKDGKWGIENYEWCG

SEQ ID NO: 2430 - protein, 31 aa, Neocallimastix californiae
  CBM_10
KDQGYSCCKTCTVSYTDESGEWGIENNHWCG

SEQ ID NO: 2431 - protein, 14 aa, Neocallimastix californiae
  CBM_10
DNDGDWGFENDNWC

SEQ ID NO: 2432 - protein, 35 aa, Neocallimastix californiae
  CBM_10
CPNGGEQYSCCKSTCTPSLSDNTGDWAVENGAWCS

SEQ ID NO: 2433 - protein, 28 aa, Neocallimastix californiae
  CBM_10
GYGCCKGCKVRATDSTGEWGYENGKWCG

SEQ ID NO: 2434 - protein, 35 aa, Neocallimastix californiae
  CBM_10
SCWSNALGYECCKGCTVIESDASGDWGIENNQWCG

SEQ ID NO: 2435 - protein, 35 aa, Neocallimastix californiae
  CBM_10
SCWSKSLGYDCCKECNTVYTDGDGDWGFENNQWCG

SEQ ID NO: 2436 - protein, 26 aa, Neocallimastix californiae
  CBM_10
PCCSKCNVVYTDDEGDWGFEKGAWCS

SEQ ID NO: 2437 - protein, 35 aa, Neocallimastix californiae
  CBM_10
TCWAEQYGYDCCKHCNVTYTDETGDWGKEDDAWCG

SEQ ID NO: 2438 - protein, 36 aa, Neocallimastix californiae
  CBM_10
ECWANAYGYDCCVDGTLTYLEDETGKWGVTSDYQWC

SEQ ID NO: 2439 - protein, 29 aa, Neocallimastix californiae
  CBM_10
ECWANAYGYDCCVDGTLTYLEDETGKWGV

SEQ ID NO: 2440 - protein, 36 aa, Neocallimastix californiae; identical to SEQ ID NO: 2438
  CBM_10

SEQ ID NO: 2441 - protein, 36 aa, Neocallimastix californiae
  CBM_10
ECWSAKFGYKCCDSSTEISFEDEKGKWGIDGSSWCG

SEQ ID NO: 2442 - protein, 36 aa, Neocallimastix californiae
  CBM_10
ECFSAKLGYSCCTTGIASVKNDENGYWGIENDEWCG

SEQ ID NO: 2443 - protein, 37 aa, Neocallimastix californiae
  CBM_10
CSAKITSQGYPCCSSSCTVVYTDESGDWGVENNQWCG

SEQ ID NO: 2444 - protein, 33 aa, Neocallimastix californiae
  CBM_10
TGAQGYPCCRTATFVYYTDSDGNWSVENNDWCL

SEQ ID NO: 2445 - protein, 34 aa, Neocallimastix californiae
  CBM_10
CWSSGYGYSCCKTCKIYYTDDIGEWGIENGQWCG

SEQ ID NO: 2446 - protein, 33 aa, Neocallimastix californiae
  CBM_10
CFSEPFYPCCEKNTVVFTDKQGKWGIENGSWCG

SEQ ID NO: 2447 - protein, 28 aa, Neocallimastix californiae
  CBM_10
GEYKCCKGCEVVYTDSEDWGIEDGKWCS

SEQ ID NO: 2448 - protein, 38 aa, Neocallimastix californiae
  CBM_10
CWSVSLGYKCCTLRTTKPYYYSKSVDKWYGVENNEWCG

SEQ ID NO: 2449 - protein, 17 aa, Neocallimastix californiae
  CBM_10
YTDNDGEWGINNGEWCG

SEQ ID NO: 2450 - protein, 25 aa, Neocallimastix californiae
  CBM_10
ECFSIKLGYPCCQGNTVYYIDNDGQ

SEQ ID NO: 2451 - protein, 31 aa, Neocallimastix californiae
  CBM_10
NGTSYSCCVLTTTVVTTDGTGKWGIEGNQWC

SEQ ID NO: 2452 - protein, 30 aa, Neocallimastix californiae
  CBM_10
NAYSNCTHTCNVIVTEDGVEWGAENQDWCI

SEQ ID NO: 2453 - protein, 33 aa, Neocallimastix californiae
  CBM_10
QCFSFPQYHCCNECNVVLEDEEGKWGFENNKWC

SEQ ID NO: 2454 - protein, 35 aa, Neocallimastix californiae
  CBM_10
CWAEKLGYPCCSSSKDVLFEDSDGQWSVENDNWCG

SEQ ID NO: 2455 - protein, 20 aa, Neocallimastix californiae
  CBM_10
AQGYECCPSDCETIYTDDDG

SEQ ID NO: 2456 - protein, 30 aa, Neocallimastix californiae
  CBM_10
YECCNNNEVVYTDETGDWGLTDTVPPQWCS

SEQ ID NO: 2457 - protein, 25 aa, Neocallimastix californiae
  CBM_10
YPYCNGCESNYTDGDGDWYFVDNNW

SEQ ID NO: 2458 - protein, 32 aa, Neocallimastix californiae
  CBM_10
VNGYQCCKNSSTVAVYSDKDGEWGVENNDWCI

SEQ ID NO: 2459 - protein, 33 aa, Neocallimastix californiae
  CBM_10
CGAAGYPCCKSSCTVYAEDSDGKWSIENDNWCL

SEQ ID NO: 2460 - protein, 36 aa, Neocallimastix californiae
  CBM_10
ACWSVGLGYSCCKSCIAAVYTDNDGKWGVENDKWCG

SEQ ID NO: 2461 - protein, 23 aa, Neocallimastix californiae
  CBM_10
FTKQGYKCCSSCSFVYYTDESGD

SEQ ID NO: 2462 - protein, 37 aa, Neocallimastix californiae
  CBM_10
CPAAIRNQGYKCCKAGCQVIYKDSDGDWGVENNQWCG

SEQ ID NO: 2463 - protein, 29 aa, Neocallimastix californiae
  CBM_10
YKCCSETCEVKKFTKSGKVLGYENGKWCS

SEQ ID NO: 2464 - protein, 36 aa, Neocallimastix californiae
  CBM_10
CWAYKLGYQCCLGDNVKSIYNDVDGDWNYLNGRWCG

SEQ ID NO: 2465 - protein, 35 aa, Neocallimastix californiae
  CBM_10
SCFSVALGYPCCESSCNVYYTDNDGEWGVENGNWC

SEQ ID NO: 2466 - protein, 19 aa, Neocallimastix californiae
  CBM_10
VVYVDKDGEWGVENGNWCG

SEQ ID NO: 2467 - protein, 31 aa, Neocallimastix californiae
  CBM_10
LGYNCCKYRSTPVYEKDNDGLWGIEDNDWCG

SEQ ID NO: 2468 - protein, 30 aa, Neocallimastix californiae
  CBM_10
QGYECCPSDCEVIYTDNDGDWGVNNNQWCG

SEQ ID NO: 2469 - protein, 35 aa, Neocallimastix californiae
  CBM_10
SNIKAQGYKCCSANCIVYYTDADGDWGIENDEWCG

SEQ ID NO: 2470 - protein, 31 aa, Neocallimastix californiae
  CBM_10
YGYKCCKGENVIPIVTESVGQWGIENDDWCG

SEQ ID NO: 2471 - protein, 38 aa, Neocallimastix californiae
  CBM_10
QCWSEVVGYSCCSSNETTVYAHDDNGDWGYDFNKQEWC

SEQ ID NO: 2472 - protein, 26 aa, Neocallimastix californiae
  CBM_10
YNCCTKCDYRLEDEYGQWGFENGKWC

SEQ ID NO: 2473 - protein, 36 aa, Neocallimastix californiae
  CBM_10
ECWSLPRYPCCSNVTITLIKDMYGNKWGMENKNYCG

SEQ ID NO: 2474 - protein, 27 aa, Neocallimastix californiae
  CBM_10
YECCQGCEVFEETEEGKWGAENGEWCG

SEQ ID NO: 2475 - protein, 35 aa, Neocallimastix californiae
  CBM_10
SCGAAAIGYPCCENTCTEVYTDEYRWGVEDDEWCG

SEQ ID NO: 2476 - protein, 36 aa, Neocallimastix californiae; identical to SEQ ID NO: 1774
  CBM_10

SEQ ID NO: 2477 - protein, 29 aa, Neocallimastix californiae
  CBM_10
ACWSQPLGYPCCSSPNAEVYYTDNDGKWS

SEQ ID NO: 2478 - protein, 34 aa, Neocallimastix californiae
  CBM_10
ACWSQPLGYPCCSSPNAEVYYTDNDGKWSVENND

SEQ ID NO: 2479 - protein, 30 aa, Neocallimastix californiae
  CBM_10
SGGEYPCCQECNVLYTDTEDWGIENGSWCS

SEQ ID NO: 2480 - protein, 36 aa, Neocallimastix californiae
  CBM_10
TCWSTAEGYPCCTPGTAVTLTDSKGKWGIENGSWCG

SEQ ID NO: 2481 - protein, 26 aa, Neocallimastix californiae
  CBM_10
ACWSQPLGYPCCSSPNAEVYYTDNDG

SEQ ID NO: 2482 - protein, 37 aa, Neocallimastix californiae; identical to SEQ ID NO: 1478
  CBM_10

SEQ ID NO: 2483 - protein, 37 aa, Neocallimastix californiae; identical to SEQ ID NO: 1478
  CBM_10

SEQ ID NO: 2484 - protein, 34 aa, Neocallimastix californiae; identical to SEQ ID NO: 1491
  CBM_10

SEQ ID NO: 2485 - protein, 37 aa, Neocallimastix californiae; identical to SEQ ID NO: 1478
  CBM_10

SEQ ID NO: 2486 - protein, 37 aa, Neocallimastix californiae; identical to SEQ ID NO: 1478
  CBM_10

SEQ ID NO: 2487 - protein, 37 aa, Neocallimastix californiae; identical to SEQ ID NO: 1478
  CBM_10

SEQ ID NO: 2488 - protein, 32 aa, Neocallimastix californiae
  CBM_10
ACWSQPLGYPCCSSPNAEVYYTDNDGKWSVEN

SEQ ID NO: 2489 - protein, 29 aa, Neocallimastix californiae
  CBM_10
ACWSQPLGYPCCSSPNAEVYYTDNDGKWS

SEQ ID NO: 2490 - protein, 32 aa, Neocallimastix californiae
  CBM_10
CWSLDHGYKCCKGENVEVEYTDSKGQWGKENG

SEQ ID NO: 2491 - protein, 36 aa, Neocallimastix californiae; identical to SEQ ID NO: 1774
  CBM_10

SEQ ID NO: 2492 - protein, 31 aa, Neocallimastix californiae
  CBM_10
AQGYPCCKTATEVFYTDNDGNWGVENGQWCG

SEQ ID NO: 2493 - protein, 37 aa, Neocallimastix californiae; identical to SEQ ID NO: 1478
  CBM_10

SEQ ID NO: 2494 - protein, 37 aa, Neocallimastix californiae; identical to SEQ ID NO: 1478
  CBM_10

SEQ ID NO: 2495 - protein, 37 aa, Neocallimastix californiae; identical to SEQ ID NO: 1478
  CBM_10

SEQ ID NO: 2496 - protein, 37 aa, Neocallimastix californiae; identical to SEQ ID NO: 1478
  CBM_10

SEQ ID NO: 2497 - protein, 27 aa, Neocallimastix californiae
  CBM_10
ACWSQPLGYPCCSSPNAEVYYTDNDGK

SEQ ID NO: 2498 - protein, 37 aa, Neocallimastix californiae; identical to SEQ ID NO: 1478
  CBM_10

SEQ ID NO: 2499 - protein, 34 aa, Neocallimastix californiae; identical to SEQ ID NO: 2478
  CBM_10

SEQ ID NO: 2500 - protein, 37 aa, Neocallimastix californiae; identical to SEQ ID NO: 1478
  CBM_10

SEQ ID NO: 2501 - protein, 37 aa, Neocallimastix californiae; identical to SEQ ID NO: 1478
  CBM_10

SEQ ID NO: 2502 - protein, 29 aa, Neocallimastix californiae
  CBM_10
ACWSQPLGYPCCSSPNAEVYYTDNDGKWS

SEQ ID NO: 2503 - protein, 31 aa, Neocallimastix californiae
  CBM_10
ACWSQPLGYPCCSSPNAEVYYTDNDGKWSVE

SEQ ID NO: 2504 - protein, 37 aa, Neocallimastix californiae; identical to SEQ ID NO: 1478
  CBM_10

SEQ ID NO: 2505 - protein, 32 aa, Anaeromyces robustus; identical to SEQ ID NO: 2076
  CBM_10

SEQ ID NO: 2506 - protein, 38 aa, Anaeromyces robustus; identical to SEQ ID NO: 2077
  CBM_10

SEQ ID NO: 2507 - protein, 38 aa, Anaeromyces robustus; identical to SEQ ID NO: 2078
  CBM_10

SEQ ID NO: 2508 - protein, 36 aa, Anaeromyces robustus; identical to SEQ ID NO: 2178
  CBM_10

SEQ ID NO: 2509 - protein, 37 aa, Anaeromyces robustus
  CBM_10
SCFSVKLGYPCCSSANVPVAYTDNDGNWGIENGDWCG

SEQ ID NO: 2510 - protein, 37 aa, Anaeromyces robustus
  CBM_10
TCWSEKLGFPCCSSPSAPVQYTDADGKWSVENGDWCG

SEQ ID NO: 2511 - protein, 29 aa, Anaeromyces robustus
  CBM_10
AQGYPCCQSTTSVIYTENNVKWGIENDNW

SEQ ID NO: 2512 - protein, 35 aa, Anaeromyces robustus; identical to SEQ ID NO: 2193
  CBM_10

SEQ ID NO: 2513 - protein, 35 aa, Anaeromyces robustus; identical to SEQ ID NO: 2192
  CBM_10

SEQ ID NO: 2514 - protein, 36 aa, Anaeromyces robustus; identical to SEQ ID NO: 2206
  CBM_10

SEQ ID NO: 2515 - protein, 35 aa, Anaeromyces robustus; identical to SEQ ID NO: 2207
  CBM_10

SEQ ID NO: 2516 - protein, 27 aa, Anaeromyces robustus
  CBM_10
SCSSKITAQGYKCCSDPNCTVYYTDAD

SEQ ID NO: 2517 - protein, 35 aa, Anaeromyces robustus; identical to SEQ ID NO: 2238
  CBM_10

SEQ ID NO: 2518 - protein, 37 aa, Anaeromyces robustus; identical to SEQ ID NO: 2239
  CBM_10

SEQ ID NO: 2519 - protein, 37 aa, Anaeromyces robustus; identical to SEQ ID NO: 2253
  CBM_10

SEQ ID NO: 2520 - protein, 36 aa, Anaeromyces robustus; identical to SEQ ID NO: 2254
  CBM_10

SEQ ID NO: 2521 - protein, 35 aa, Anaeromyces robustus; identical to SEQ ID NO: 2255
  CBM_10

SEQ ID NO: 2522 - protein, 34 aa, Anaeromyces robustus; identical to SEQ ID NO: 2256
  CBM_10

SEQ ID NO: 2523 - protein, 28 aa, Anaeromyces robustus
  CBM_10
AYDECKACNVVYVEGDEKWGVENNDWCI

SEQ ID NO: 2524 - protein, 37 aa, Anaeromyces robustus; identical to SEQ ID NO: 2240
  CBM_10

SEQ ID NO: 2525 - protein, 31 aa, Anaeromyces robustus; identical to SEQ ID NO: 2241
  CBM_10

SEQ ID NO: 2526 - protein, 35 aa, Anaeromyces robustus; identical to SEQ ID NO: 2217
  CBM_10

SEQ ID NO: 2527 - protein, 32 aa, Anaeromyces robustus; identical to SEQ ID NO: 2267
  CBM_10

SEQ ID NO: 2528 - protein, 32 aa, Anaeromyces robustus; identical to SEQ ID NO: 2266
  CBM_10

SEQ ID NO: 2529 - protein, 37 aa, Anaeromyces robustus; identical to SEQ ID NO: 2170
  CBM_10

SEQ ID NO: 2530 - protein, 35 aa, Anaeromyces robustus; identical to SEQ ID NO: 2169
  CBM_10

SEQ ID NO: 2531 - protein, 35 aa, Anaeromyces robustus; identical to SEQ ID NO: 2169
  CBM_10

SEQ ID NO: 2532 - protein, 37 aa, Anaeromyces robustus; identical to SEQ ID NO: 2170
  CBM_10

SEQ ID NO: 2533 - protein, 30 aa, Anaeromyces robustus; identical to SEQ ID NO: 2283
  CBM_10

SEQ ID NO: 2534 - protein, 36 aa, Anaeromyces robustus; identical to SEQ ID NO: 2284
  CBM_10

SEQ ID NO: 2535 - protein, 34 aa, Anaeromyces robustus; identical to SEQ ID NO: 2287
  CBM_10

SEQ ID NO: 2536 - protein, 27 aa, Anaeromyces robustus
  CBM_10
AYEYCQGCRVFYEDDQQWGVENNDWCI

SEQ ID NO: 2537 - protein, 36 aa, Anaeromyces robustus; identical to SEQ ID NO: 2285
  CBM_10

SEQ ID NO: 2538 - protein, 34 aa, Anaeromyces robustus; identical to SEQ ID NO: 2286
  CBM_10

SEQ ID NO: 2539 - protein, 29 aa, Anaeromyces robustus
  CBM_10
GYSCCKSCDSFNYKDNDGEWGIENDAWCG

SEQ ID NO: 2540 - protein, 34 aa, Anaeromyces robustus
  CBM_10
CKGALGYPCCKSTCNVYSSDESGQWGIENDAWCG

SEQ ID NO: 2541 - protein, 34 aa, Anaeromyces robustus
  CBM_10
CKGALGYSCCKSCDSFNYKDNDGEWGIENDAWCG

SEQ ID NO: 2542 - protein, 37 aa, Anaeromyces robustus; identical to SEQ ID NO: 2272
  CBM_10

SEQ ID NO: 2543 - protein, 35 aa, Anaeromyces robustus; identical to SEQ ID NO: 2273
  CBM_10

SEQ ID NO: 2544 - protein, 31 aa, Anaeromyces robustus; identical to SEQ ID NO: 2274
  CBM_10

SEQ ID NO: 2545 - protein, 37 aa, Anaeromyces robustus; identical to SEQ ID NO: 2298
  CBM_10

SEQ ID NO: 2546 - protein, 35 aa, Anaeromyces robustus; identical to SEQ ID NO: 2297
  CBM_10

SEQ ID NO: 2547 - protein, 37 aa, Anaeromyces robustus; identical to SEQ ID NO: 2333
  CBM_10

SEQ ID NO: 2548 - protein, 35 aa, Anaeromyces robustus; identical to SEQ ID NO: 2334
  CBM_10

SEQ ID NO: 2549 - protein, 34 aa, Anaeromyces robustus; identical to SEQ ID NO: 2308
  CBM_10

SEQ ID NO: 2550 - protein, 29 aa, Anaeromyces robustus
  CBM_10
AYSNCNSTCRVVTVEDGVSWGVENNDWCI

SEQ ID NO: 2551 - protein, 35 aa, Anaeromyces robustus; identical to SEQ ID NO: 2350
  CBM_10

SEQ ID NO: 2552 - protein, 34 aa, Anaeromyces robustus
  CBM_10
ECEFNALGYSCCPDAAVVFEDDHKWGYVNNKWCG

SEQ ID NO: 2553 - protein, 36 aa, Anaeromyces robustus; identical to SEQ ID NO: 2351
  CBM_10

SEQ ID NO: 2554 - protein, 33 aa, Anaeromyces robustus; identical to SEQ ID NO: 2310
  CBM_10

SEQ ID NO: 2555 - protein, 34 aa, Anaeromyces robustus; identical to SEQ ID NO: 2311
  CBM_10

SEQ ID NO: 2556 - protein, 31 aa, Anaeromyces robustus; identical to SEQ ID NO: 2300
  CBM_10

SEQ ID NO: 2557 - protein, 34 aa, Anaeromyces robustus; identical to SEQ ID NO: 2299
  CBM_10

SEQ ID NO: 2558 - protein, 34 aa, Anaeromyces robustus; identical to SEQ ID NO: 2314
  CBM_10

SEQ ID NO: 2559 - protein, 36 aa, Anaeromyces robustus; identical to SEQ ID NO: 2313
  CBM_10

SEQ ID NO: 2560 - protein, 35 aa, Anaeromyces robustus; identical to SEQ ID NO: 2341
  CBM_10

SEQ ID NO: 2561 - protein, 36 aa, Anaeromyces robustus
  CBM_10
ECWSKAQGYDCCAEGTSVFLEDESGKWGVTPNGLWC

SEQ ID NO: 2562 - protein, 38 aa, Anaeromyces robustus; identical to SEQ ID NO: 2342
  CBM_10

SEQ ID NO: 2563 - protein, 36 aa, Anaeromyces robustus; identical to SEQ ID NO: 2364
  CBM_10

SEQ ID NO: 2564 - protein, 35 aa, Anaeromyces robustus; identical to SEQ ID NO: 2365
  CBM_10

SEQ ID NO: 2565 - protein, 30 aa, Anaeromyces robustus; identical to SEQ ID NO: 2366
  CBM_10

SEQ ID NO: 2566 - protein, 35 aa, Anaeromyces robustus; identical to SEQ ID NO: 2365
  CBM_10

SEQ ID NO: 2567 - protein, 31 aa, Anaeromyces robustus; identical to SEQ ID NO: 2375
  CBM_10

SEQ ID NO: 2568 - protein, 31 aa, Anaeromyces robustus; identical to SEQ ID NO: 2374
  CBM_10

SEQ ID NO: 2569 - protein, 34 aa, Anaeromyces robustus; identical to SEQ ID NO: 2368
  CBM_10

SEQ ID NO: 2570 - protein, 34 aa, Anaeromyces robustus; identical to SEQ ID NO: 2369
  CBM_10

SEQ ID NO: 2571 - protein, 35 aa, Anaeromyces robustus; identical to SEQ ID NO: 2370
  CBM_10

SEQ ID NO: 2572 - protein, 35 aa, Anaeromyces robustus; identical to SEQ ID NO: 2435
  CBM_10

SEQ ID NO: 2573 - protein, 35 aa, Anaeromyces robustus; identical to SEQ ID NO: 2434
  CBM_10

SEQ ID NO: 2574 - protein, 34 aa, Anaeromyces robustus
  CBM_10
CWSSAMGYACCNGCDVAYEDGSGKWGIENNNWCG

SEQ ID NO: 2575 - protein, 33 aa, Anaeromyces robustus; identical to SEQ ID NO: 2399
  CBM_10

SEQ ID NO: 2576 - protein, 34 aa, Anaeromyces robustus; identical to SEQ ID NO: 2398
  CBM_10

SEQ ID NO: 2577 - protein, 29 aa, Anaeromyces robustus
  CBM_10
GIYPCCQGCVVVTSDSDGDWGVEDGQWCL

SEQ ID NO: 2578 - protein, 29 aa, Anaeromyces robustus
  CBM_10
DGYECCKSCNIVLTDESGNWGVEDGQWCG

SEQ ID NO: 2579 - protein, 36 aa, Anaeromyces robustus; identical to SEQ ID NO: 2384
  CBM_10

SEQ ID NO: 2580 - protein, 34 aa, Anaeromyces robustus; identical to SEQ ID NO: 2381
  CBM_10

SEQ ID NO: 2581 - protein, 31 aa, Anaeromyces robustus
  CBM_10
TKNGYPVCKTTTTVVYTDSDKWGVENGEWCI

SEQ ID NO: 2582 - protein, 35 aa, Anaeromyces robustus
  CBM_10
QCFSISLGYPCCQGNTVVYTDKDGKWGLENGQWCG

SEQ ID NO: 2583 - protein, 35 aa, Anaeromyces robustus
  CBM_10
SCWSESFGYPCCHSCYVFETDDNGKWGFENNTWCG

SEQ ID NO: 2584 - protein, 34 aa, Anaeromyces robustus; identical to SEQ ID NO: 2315
  CBM_10

SEQ ID NO: 2585 - protein, 38 aa, Anaeromyces robustus; identical to SEQ ID NO: 2316
  CBM_10

SEQ ID NO: 2586 - protein, 30 aa, Anaeromyces robustus; identical to SEQ ID NO: 2390
  CBM_10

SEQ ID NO: 2587 - protein, 32 aa, Anaeromyces robustus; identical to SEQ ID NO: 2391
  CBM_10

SEQ ID NO: 2588 - protein, 35 aa, Anaeromyces robustus
  CBM_10
TCWSKSLGYPCCTSKSTVIFTDSNGQWGIENGNWC

SEQ ID NO: 2589 - protein, 37 aa, Anaeromyces robustus
  CBM_10
CWAKSLGYNCCSTSSCRTAQFSDADGQWDVENGNWCG

SEQ ID NO: 2590 - protein, 36 aa, Anaeromyces robustus; identical to SEQ ID NO: 2414
  CBM_10

SEQ ID NO: 2591 - protein, 34 aa, Anaeromyces robustus; identical to SEQ ID NO: 2413
  CBM_10

SEQ ID NO: 2592 - protein, 35 aa, Anaeromyces robustus
  CBM_10
ACFSEASGYGCCKGCDVAYTDDSGDWGVENGEWCG

SEQ ID NO: 2593 - protein, 34 aa, Anaeromyces robustus
  CBM_10
CTGAQGYPCCKTATQVYFSDNDGDWSVENNNWCL

SEQ ID NO: 2594 - protein, 38 aa, Anaeromyces robustus; identical to SEQ ID NO: 2347
  CBM_10

SEQ ID NO: 2595 - protein, 37 aa, Anaeromyces robustus; identical to SEQ ID NO: 2406
  CBM_10

SEQ ID NO: 2596 - protein, 35 aa, Anaeromyces robustus
  CBM_10
KCWSLEYGYKCCSHCKVLLKDDYGKWGEMNGQWCG

SEQ ID NO: 2597 - protein, 35 aa, Anaeromyces robustus; identical to SEQ ID NO: 2312
  CBM_10

SEQ ID NO: 2598 - protein, 31 aa, Anaeromyces robustus
  CBM_10
CHPDYECCKGCQTILTDDEGNWGAENNQWCF

SEQ ID NO: 2599 - protein, 35 aa, Anaeromyces robustus; identical to SEQ ID NO: 2388
  CBM_10

SEQ ID NO: 2600 - protein, 35 aa, Anaeromyces robustus; identical to SEQ ID NO: 2389
  CBM_10

SEQ ID NO: 2601 - protein, 33 aa, Anaeromyces robustus; identical to SEQ ID NO: 2387
  CBM_10

SEQ ID NO: 2602 - protein, 34 aa, Anaeromyces robustus
  CBM_10
QCFSDPDYPCCEGCKVIQEDKDGKWGYENNEWCG

SEQ ID NO: 2603 - protein, 24 aa, Anaeromyces robustus
  CBM_10
CSTCRVVTVDDNIYWGVENNDWCI

SEQ ID NO: 2604 - protein, 34 aa, Anaeromyces robustus; identical to SEQ ID NO: 2417
  CBM_10

SEQ ID NO: 2605 - protein, 31 aa, Anaeromyces robustus
  CBM_10
CNPDYPCCNNCEVIYVDSDGEWGVENNNWCA

SEQ ID NO: 2606 - protein, 29 aa, Anaeromyces robustus
  CBM_10
GDYPFCKGCTVVYTDNDGDWGVENNDWCL

SEQ ID NO: 2607 - protein, 33 aa, Anaeromyces robustus
  CBM_10
RSLGYSCCSDNNCTVYATDESGKWGIENDQWCG

SEQ ID NO: 2608 - protein, 38 aa, Anaeromyces robustus; identical to SEQ ID NO: 2392
  CBM_10

SEQ ID NO: 2609 - protein, 31 aa, Anaeromyces robustus
  CBM_10
KNLGYKCCQYCDIVYTDSDGDYGFENNDWCG

SEQ ID NO: 2610 - protein, 32 aa, Anaeromyces robustus; identical to SEQ ID NO: 2404
  CBM_10

SEQ ID NO: 2611 - protein, 36 aa, Anaeromyces robustus; identical to SEQ ID NO: 2403
  CBM_10

SEQ ID NO: 2612 - protein, 37 aa, Anaeromyces robustus; identical to SEQ ID NO: 2395
  CBM_10

SEQ ID NO: 2613 - protein, 34 aa, Anaeromyces robustus; identical to SEQ ID NO: 2396
  CBM_10

SEQ ID NO: 2614 - protein, 29 aa, Anaeromyces robustus
  CBM_10
GYPCCKTNKQVYFTDNDGNWSFENNNWCL

SEQ ID NO: 2615 - protein, 38 aa, Anaeromyces robustus
  CBM_10
CSAKIQAQGYKCCSDKNCTIFYSDNDGNWGVENGQWCG

SEQ ID NO: 2616 - protein, 35 aa, Anaeromyces robustus
  CBM_10
CWSMPDYQCCRNTRVSQYTDSAGNEWGIENNQWCG

SEQ ID NO: 2617 - protein, 30 aa, Anaeromyces robustus
  CBM_10
LGYNCCRNTCSISYKDDDGNWGIENGNWCG

SEQ ID NO: 2618 - protein, 35 aa, Anaeromyces robustus; identical to SEQ ID NO: 2422
  CBM_10

SEQ ID NO: 2619 - protein, 35 aa, Anaeromyces robustus; identical to SEQ ID NO: 2421
  CBM_10

SEQ ID NO: 2620 - protein, 36 aa, Anaeromyces robustus; identical to SEQ ID NO: 2460
  CBM_10

SEQ ID NO: 2621 - protein, 33 aa, Anaeromyces robustus; identical to SEQ ID NO: 2459
  CBM_10

SEQ ID NO: 2622 - protein, 37 aa, Anaeromyces robustus
  CBM_10
KCWSEKLGYPCCKNSNTDVAYIDADGKWGVENHEWCG

SEQ ID NO: 2623 - protein, 30 aa, Anaeromyces robustus; identical to SEQ ID NO: 2402
  CBM_10

SEQ ID NO: 2624 - protein, 35 aa, Anaeromyces robustus
  CBM_10
CWSQPLGYPCCSSSNKNVIYTDKDGDWGIENNGWC

SEQ ID NO: 2625 - protein, 37 aa, Anaeromyces robustus
  CBM_10
CSDAILKKGYKCCSNDCFVIYTDDDGTWGIENDQWCG

SEQ ID NO: 2626 - protein, 38 aa, Anaeromyces robustus
  CBM_10
CPTSITSQGYRCCKENNCSVIETDDSGKWGIEDGQWCG

SEQ ID NO: 2627 - protein, 35 aa, Anaeromyces robustus; identical to SEQ ID NO: 2454
  CBM_10

SEQ ID NO: 2628 - protein, 36 aa, Anaeromyces robustus
  CBM_10
ECWSEKLGYPCCSYSKNVLFEDNDGQWSVENDNWCG

SEQ ID NO: 2629 - protein, 32 aa, Anaeromyces robustus
  CBM_10
GAQGYPCCRTATFVYYTDSDGNWSVENNDWCL

SEQ ID NO: 2630 - protein, 37 aa, Anaeromyces robustus; identical to SEQ ID NO: 2443
  CBM_10

SEQ ID NO: 2631 - protein, 30 aa, Anaeromyces robustus
  CBM_10
VGYPCCKNNKTVYFTDNSGKWSVENNNWCL

SEQ ID NO: 2632 - protein, 38 aa, Anaeromyces robustus
  CBM_10
CSSKITKQGYKCCSSKSCIVYYTDNAGNWGVENGEWCG

SEQ ID NO: 2633 - protein, 35 aa, Anaeromyces robustus
  CBM_10
KCWSSGYGYPCCDNCKVYYIDKIGEWGIKNGNWCG

SEQ ID NO: 2634 - protein, 35 aa, Anaeromyces robustus
  CBM_10
ECWASWYGYGCCKGCKVRATDSTGEWGYENGKWCG

SEQ ID NO: 2635 - protein, 35 aa, Anaeromyces robustus
  CBM_10
TCWSEELGYKCCKGCKVYSVDRNGSWGVEDKQWCG

SEQ ID NO: 2636 - protein, 34 aa, Anaeromyces robustus
  CBM_10
CWASWYGYECCKGCKVKGEDSKGKWGWENGKWCG

SEQ ID NO: 2637 - protein, 35 aa, Anaeromyces robustus
  CBM_10
ECWSESKGYSCCKGCDIYTNDRFGAWGIEKGKWCG

SEQ ID NO: 2638 - protein, 29 aa, Anaeromyces robustus
  CBM_10
NGYPCCKKCDVYSYDRHGYWGIEKGNWCG

SEQ ID NO: 2639 - protein, 27 aa, Anaeromyces robustus
  CBM_10
APCCSHCNGIYHDNDGDWGVENNQWCL

SEQ ID NO: 2640 - protein, 33 aa, Anaeromyces robustus
  CBM_10
CFAIKLGYKCCNNEAVVLVDNDGKWGYNGDWCG

SEQ ID NO: 2641 - protein, 32 aa, Anaeromyces robustus
  CBM_10
CKSTSYPCCSSCNLPVYSTDSDGKWSIENNNW

SEQ ID NO: 2642 - protein, 35 aa, Anaeromyces robustus
  CBM_10
KCWSEELGYKCCKYCNVLMEDENGQWGFENDEWCG

SEQ ID NO: 2643 - protein, 34 aa, Anaeromyces robustus
  CBM_10
ECFASPTYPCCSKCNVVYTDDEGDWGFEKGAWCS

SEQ ID NO: 2644 - protein, 35 aa, Anaeromyces robustus; identical to SEQ ID NO: 2437
  CBM_10

SEQ ID NO: 2645 - protein, 34 aa, Anaeromyces robustus
  CBM_10
CKGAQGYPCCAYSCDSLFTDSDGEWSVENENWCL

SEQ ID NO: 2646 - protein, 36 aa, Anaeromyces robustus; identical to SEQ ID NO: 2409
  CBM_10

SEQ ID NO: 2647 - protein, 35 aa, Anaeromyces robustus
  CBM_10
TCWSEALGYPCCKGCESATTDSSGAWGIEDGEWCG

SEQ ID NO: 2648 - protein, 27 aa, Anaeromyces robustus
  CBM_10
QYSNCKSTCEVSYEDDQKWGIENGQWC

SEQ ID NO: 2649 - protein, 35 aa, Anaeromyces robustus
  CBM_10
SCWSIAFGYGCCEGCTTVYTDKDGAWGYENENWCG

SEQ ID NO: 2650 - protein, 28 aa, Anaeromyces robustus
  CBM_10
YPCCSKGAEVIYTDESGDWGLENGDWCF

SEQ ID NO: 2651 - protein, 35 aa, Anaeromyces robustus
  CBM_10
SCWSAPYGYPCCKSCEIHTTNDSGKWGMENNKWCG

SEQ ID NO: 2652 - protein, 35 aa, Anaeromyces robustus
  CBM_10
SCTGIEDGYPCCKTCNAIYNDEQGPWGYENNEWCG

SEQ ID NO: 2653 - protein, 32 aa, Anaeromyces robustus
  CBM_10
ASKDGYPCCKGCSVTYEDASGKWGVENNAWCG

SEQ ID NO: 2654 - protein, 36 aa, Anaeromyces robustus; identical to SEQ ID NO: 2480
  CBM_10

SEQ ID NO: 2655 - protein, 35 aa, Anaeromyces robustus
  CBM_10
SCWASSLGYGCCNGCEAITVDGSGKWGFENGAWCG

SEQ ID NO: 2656 - protein, 32 aa, Anaeromyces robustus; identical to SEQ ID NO: 2653
  CBM_10

SEQ ID NO: 2657 - protein, 26 aa, Anaeromyces robustus
  CBM_10
TCWSTAEGYPCCTPGTAVTLTDSKGK

SEQ ID NO: 2658 - protein, 37 aa, Anaeromyces robustus
  CBM_10
SCWSTKLGYPCCSAGNKDVYYNDDDGLWGVENGDWCG

SEQ ID NO: 2659 - protein, 35 aa, Anaeromyces robustus
  CBM_10
SCFSIALGYPCCKGNTIVYTDDSGDWGVENNNWCG

SEQ ID NO: 2660 - protein, 31 aa, Anaeromyces robustus
  CBM_10
NGYQCCKNSSTVAVYSDKDGEWGVENNDWCI

SEQ ID NO: 2661 - protein, 25 aa, Anaeromyces robustus
  CBM_10
YPYCNGCESNYTDGDGDWYFVDNNW

SEQ ID NO: 2662 - protein, 37 aa, Anaeromyces robustus
  CBM_10
CPGYELGYECCNNNEVVYTDETGDWGLTDTVPPQWCS

SEQ ID NO: 2663 - protein, 34 aa, Anaeromyces robustus
  CBM_10
ECFSYPLYPCCEGCNVYEETEEGKWGIENDAWCG

SEQ ID NO: 2664 - protein, 27 aa, Anaeromyces robustus
  CBM_10
AYDECKGCTVYYEDDTKWGVENDDWCI

SEQ ID NO: 2665 - protein, 36 aa, Anaeromyces robustus
  CBM_10
ECWSERLGYPCCTSGAQVYYSDADGQWGVENNNWCG

SEQ ID NO: 2666 - protein, 35 aa, Anaeromyces robustus
  CBM_10
CFATKLGYPCCTTTTEVVYTDSDGQWGVENNNWCG

SEQ ID NO: 2667 - protein, 34 aa, Anaeromyces robustus
  CBM_10
CFSIQMGYPCCNGCDVVSFDDGKPWGIENGNWCG

SEQ ID NO: 2668 - protein, 35 aa, Anaeromyces robustus
  CBM_10
TCFSLPDYPCCSSSVGVSFVDESGSWGIENGNWCG

SEQ ID NO: 2669 - protein, 35 aa, Anaeromyces robustus
  CBM_10
SCFAAKLNYKCCSTCDVAYTDGDGDWGFENNEWCG

SEQ ID NO: 2670 - protein, 37 aa, Anaeromyces robustus
  CBM_10
KCFSQKLNPSYPCCEGDVVVYVDKDGEWGVENGNWCG

SEQ ID NO: 2671 - protein, 35 aa, Anaeromyces robustus; identical to SEQ ID NO: 2465
  CBM_10

SEQ ID NO: 2672 - protein, 33 aa, Anaeromyces robustus
  CBM_10
CWSLPDYPCCEGTDVVYSDASGDWGVENGQWCG

SEQ ID NO: 2673 - protein, 31 aa, Anaeromyces robustus
  CBM_10
LPDYPCCKEGAEAIYEDAQGKWGVENGQWCG

SEQ ID NO: 2674 - protein, 35 aa, Anaeromyces robustus
  CBM_10
TCWALQYGYTCCEDDTIVYTDELGDWGVEDGQWCG

SEQ ID NO: 2675 - protein, 36 aa, Anaeromyces robustus
  CBM_10
SCWSTALNYPCCKNSCDVVISDDDGDWGVEDGQWCG

SEQ ID NO: 2676 - protein, 33 aa, Anaeromyces robustus
  CBM_10
SCWSLPDYKCCSGCDIVYTDNHNWGVENGEWCG

SEQ ID NO: 2677 - protein, 34 aa, Anaeromyces robustus
  CBM_10
CAVLSQGYPCCQQTCDVVYVDDYKWGVENGEWCG

SEQ ID NO: 2678 - protein, 40 aa, Anaeromyces robustus
  CBM_10
CWAKALGFKCCDEENPQVYYTDESGDWSVEFKGDSGEWCG

SEQ ID NO: 2679 - protein, 36 aa, Anaeromyces robustus
  CBM_10
TCWSQPLGYPCCQSTSDVIYTDSDGDWGVENGNWCG

SEQ ID NO: 2680 - protein, 35 aa, Anaeromyces robustus
  CBM_10
SCWANRLGYQCCKGNTVVYTDSDGKWGVENGNWCG

SEQ ID NO: 2681 - protein, 33 aa, Anaeromyces robustus
  CBM_10
CAGYPEYPCCKGCDISYSDESGDWGVENGKWCG

SEQ ID NO: 2682 - protein, 34 aa, Anaeromyces robustus
  CBM_10
TCFSEPDYPCCNSCNIVETDALGRWGVENGEWCG

SEQ ID NO: 2683 - protein, 36 aa, Anaeromyces robustus
  CBM_10
TCWSKSIGYECCKETTTAIYNDENGKWGYENGDWCG

SEQ ID NO: 2684 - protein, 33 aa, Anaeromyces robustus
  CBM_10
  MOD_RES (24)..(24): Any amino acid
TCWAEKLGYSCCTSTSPVVYTDNXGNWGVENGN

SEQ ID NO: 2685 - protein, 13 aa, Anaeromyces robustus
  CBM_10
DGDWGVENGNWCG

SEQ ID NO: 2686 - protein, 35 aa, Anaeromyces robustus
  CBM_10
CFSERLGYPCCVYTTKVEYVDADGDWGVENGNWCG

SEQ ID NO: 2687 - protein, 36 aa, Anaeromyces robustus
  CBM_10
ECFSIKLGYPCCQNTSDVILTDEDGKWGAENGDWCG

SEQ ID NO: 2688 - protein, 35 aa, Anaeromyces robustus
  CBM_10
ECFSVSLGYPCCQKTTKVVVVDEDGEWGAEDGNWC

SEQ ID NO: 2689 - protein, 34 aa, Anaeromyces robustus
  CBM_10
ECFSSPNYPCCSECKTIYTDQTGDWGYENEQWCG

SEQ ID NO: 2690 - protein, 35 aa, Anaeromyces robustus
  CBM_10
SCWAEKLGYKCCEKCTVTFNDENGDWGFENGDWCG

SEQ ID NO: 2691 - protein, 36 aa, Anaeromyces robustus
  CBM_10
ECWAEKLGYGCCKTTTTPILEDDDGKWGVENDEWCG

SEQ ID NO: 2692 - protein, 35 aa, Anaeromyces robustus
  CBM_10
ECWAEALGYSCCKGCDIIYSDNDGDWSVENDEWCG

SEQ ID NO: 2693 - protein, 28 aa, Anaeromyces robustus
  CBM_10
CFSEEKDMGYPCCDNCEVVTTDSDGGWG

SEQ ID NO: 2694 - protein, 30 aa, Anaeromyces robustus
  CBM_10
NGDEYKCCKKCNVVYRDDYDWGVENNDWCS

SEQ ID NO: 2695 - protein, 38 aa, Anaeromyces robustus
  CBM_10
ECWSEASGYSCCKLKTTTVEFTDSKGNKYGIENGHFCG

SEQ ID NO: 2696 - protein, 23 aa, Anaeromyces robustus
  CBM_10
FTKQGYKCCSSCSFVYYTDESGD

SEQ ID NO: 2697 - protein, 37 aa, Anaeromyces robustus; identical to SEQ ID NO: 2462
  CBM_10

SEQ ID NO: 2698 - protein, 30 aa, Anaeromyces robustus
  CBM_10
KNQGFSCCEGCTKYYSDNDGDWGFENDNWC

SEQ ID NO: 2699 - protein, 31 aa, Anaeromyces robustus; identical to SEQ ID NO: 2430
  CBM_10

SEQ ID NO: 2700 - protein, 34 aa, Anaeromyces robustus
  CBM_10
TCWSEPEFKCCTKSCTVYFTDDHEWGVEDDEWCG

SEQ ID NO: 2701 - protein, 34 aa, Anaeromyces robustus
  CBM_10
SCKSASFYPCCETCNVFSEEDGDRWGVENDQWCS

SEQ ID NO: 2702 - protein, 27 aa, Anaeromyces robustus
  CBM_10
AYEECKGCVVYYEDDTKWGIENDDWCI

SEQ ID NO: 2703 - protein, 34 aa, Anaeromyces robustus
  CBM_10
ECFAYPLYPCCEGCDVYEESEEGKWGIEKDAWCG

SEQ ID NO: 2704 - protein, 30 aa, Anaeromyces robustus
  CBM_10
CHPNYPCCNGCEVVYTDVDGEWGVENGAWC

SEQ ID NO: 2705 - protein, 35 aa, Anaeromyces robustus
  CBM_10
TCNTESLGYPCCTHCNTIYTDADGDWGIENGDWCG

SEQ ID NO: 2706 - protein, 36 aa, Anaeromyces robustus
  CBM_10
TSDIAPNGYPYCVNCVVTATGGDGSLWGWENEKSCV

SEQ ID NO: 2707 - protein, 36 aa, Anaeromyces robustus
  CBM_10
FSEMAPNGFPYCEYCEVGATGGDGSLWGWENEQSCV

SEQ ID NO: 2708 - protein, 35 aa, Anaeromyces robustus
  CBM_10
TCFSVNLGFKCCSGCNVIYTDNDGDWGVENDQWCG

SEQ ID NO: 2709 - protein, 32 aa, Anaeromyces robustus
  CBM_10
IAPNGYPYCVNCVVTATGGDGSLWGWENEKSC

SEQ ID NO: 2710 - protein, 31 aa, Anaeromyces robustus
  CBM_10
APNGFPYCEYCEVGATGGDGSLWGWENEQSC

SEQ ID NO: 2711 - protein, 35 aa, Anaeromyces robustus
  CBM_10
QCWSEKLGYQCCKSTKDIVFTDNDGNWGIENGNWC

SEQ ID NO: 2712 - protein, 37 aa, Anaeromyces robustus
  CBM_10
ECWSLRLGYNCCKYRSTPVYEKDNDGLWGIEDNDWCG

SEQ ID NO: 2713 - protein, 40 aa, Anaeromyces robustus
  CBM_10
TCWSLKRNHPYPCCEKSETEVVYISSNGDEWGTENGDWCG

SEQ ID NO: 2714 - protein, 34 aa, Anaeromyces robustus
  CBM_10
CPRDPTQDYPCCKGCIVKYVDDYEWGVEENNWCY

SEQ ID NO: 2715 - protein, 31 aa, Anaeromyces robustus
  CBM_10
THENGYPYCKTTTLVLYTDDLEWGYENDEWC

SEQ ID NO: 2716 - protein, 35 aa, Anaeromyces robustus
  CBM_10
KCWSEKLGYPCCTNKNVVHVDENGQWGIENDMWCG

SEQ ID NO: 2717 - protein, 36 aa, Anaeromyces robustus
  CBM_10
CFSEEKNLGYPCCKYCVIVESDSYGDYGIENDQWCS

SEQ ID NO: 2718 - protein, 36 aa, Anaeromyces robustus; identical to SEQ ID NO: 2373
  CBM_10

SEQ ID NO: 2719 - protein, 37 aa, Anaeromyces robustus; identical to SEQ ID NO: 2372
  CBM_10

SEQ ID NO: 2720 - protein, 36 aa, Anaeromyces robustus; identical to SEQ ID NO: 2373
  CBM_10

SEQ ID NO: 2721 - protein, 37 aa, Anaeromyces robustus; identical to SEQ ID NO: 2372
  CBM_10

SEQ ID NO: 2722 - protein, 37 aa, Anaeromyces robustus
  CBM_10
QCWAEAKGYKCCQDPNTPVYETDSDGKWGIEDGQWCG

SEQ ID NO: 2723 - protein, 36 aa, Anaeromyces robustus; identical to SEQ ID NO: 2464
  CBM_10

SEQ ID NO: 2724 - protein, 33 aa, Anaeromyces robustus
  CBM_10
WSKKLGYPLCKESKEVLYEDKDGKWGYENDWCG

SEQ ID NO: 2725 - protein, 34 aa, Anaeromyces robustus
  CBM_10
CKGAQGYPCCTKSCDSIYQDGDGDWSLENNNWCL

SEQ ID NO: 2726 - protein, 35 aa, Anaeromyces robustus
  CBM_10
CWSESLGYSCCTFCSPIIYSDESGDWGVINNEWCG

SEQ ID NO: 2727 - protein, 35 aa, Anaeromyces robustus
  CBM_10
CFAEDLGFKCCSYSTMEVYSDSNGKWSVESGEWCG

SEQ ID NO: 2728 - protein, 36 aa, Anaeromyces robustus
  CBM_10
SCWANALGYRCCKSSQEVIATDKDGEWSVEDGHWCG

SEQ ID NO: 2729 - protein, 35 aa, Anaeromyces robustus
  CBM_10
KCWAEKLGYSCCQGCHVIYVDNDGEWGVENNAWCG

SEQ ID NO: 2730 - protein, 34 aa, Anaeromyces robustus
  CBM_10
CTGKLQGYQCCLTCNVVTTDADGRWGIENGNWCG

SEQ ID NO: 2731 - protein, 35 aa, Anaeromyces robustus
  CBM_10
ECFSIKLGYPCCQGNTVYYIDNDGQWGFENNNWCG

SEQ ID NO: 2732 - protein, 36 aa, Anaeromyces robustus
  CBM_10
TCWSEKLGYPCCNNSCYAFTTDNDGEWGYEDGHWCG

SEQ ID NO: 2733 - protein, 35 aa, Anaeromyces robustus
  CBM_10
KCWSKKYGYECCQGCTAYEVDEFGKWGYEKNHWCG

SEQ ID NO: 2734 - protein, 35 aa, Anaeromyces robustus
  CBM_10
CWSLPDFPCCSPDNTYIFFSDNNGDWGIENGDWCG

SEQ ID NO: 2735 - protein, 36 aa, Anaeromyces robustus
  CBM_10
KCWSKKLGFPCCKTNKVVLFEDADGKWGVENDNWCG

SEQ ID NO: 2736 - protein, 37 aa, Anaeromyces robustus
  CBM_10
CWAYELGYQCCFETGPEKARQQDQYGKWGVEWGRWCG

SEQ ID NO: 2737 - protein, 35 aa, Anaeromyces robustus
  CBM_10
CWSAVFGYPCCKYTKVVRSTDENGDWGIEYDHWCG

SEQ ID NO: 2738 - protein, 17 aa, Anaeromyces robustus
  CBM_10
FTDDNGKWSVENDEWCG

SEQ ID NO: 2739 - protein, 34 aa, Anaeromyces robustus
  CBM_10
CPKYKLGKYKCCQQCKVRYTDDYEWGVEDGEWCS

SEQ ID NO: 2740 - protein, 38 aa, Anaeromyces robustus
  CBM_10
ECWSLKQGYSCCQNKNTKVSYISKNGDEWGVENNEWCG

SEQ ID NO: 2741 - protein, 35 aa, Anaeromyces robustus
  CBM_10
CWSEKFNIPCCQSTSEVVRKTYDGEWGIEDGKWCS

SEQ ID NO: 2742 - protein, 34 aa, Anaeromyces robustus
  CBM_10
QTDANGKLICNECNVESTGGDGSLWGFENEKSCI

SEQ ID NO: 2743 - protein, 36 aa, Anaeromyces robustus
  CBM_10
RCGFNKTPHPWCSGCVVTATGEDGALYGWESQASCL

SEQ ID NO: 2744 - protein, 35 aa, Anaeromyces robustus
  CBM_10
VNNIEASTPKCSDCTVYATGKDGTSWGWENDSFCK

SEQ ID NO: 2745 - protein, 30 aa, Anaeromyces robustus
  CBM_10
NGKLICNECNVESTGGDGSLWGFENEKSCI

SEQ ID NO: 2746 - protein, 32 aa, Anaeromyces robustus
  CBM_10
CPRQGEYKCCESCNVVYTDFQKWGYEDNEWCS

SEQ ID NO: 2747 - protein, 33 aa, Anaeromyces robustus
  CBM_10
CFSIKFGYPCCNGCDVIYVDEDGKWSVENDSWC

SEQ ID NO: 2748 - protein, 35 aa, Anaeromyces robustus
  CBM_10
CWALKYNYKCCIETTDVIETDEHGDWGVENGDWCG

SEQ ID NO: 2749 - protein, 32 aa, Anaeromyces robustus
  CBM_10
GTQYACCKDPNTYISTTDKTGDWGIEGNYWCL

SEQ ID NO: 2750 - protein, 30 aa, Anaeromyces robustus
  CBM_10
SEYDCCSGCTVVDQGDGKIKWGVENNQWCI

SEQ ID NO: 2751 - protein, 30 aa, Anaeromyces robustus
  CBM_10
CKSSGYPCCENCEVIYDDGNTKWGLLNNDW

SEQ ID NO: 2752 - protein, 35 aa, Anaeromyces robustus
  CBM_10
SCWSKKLGYECCAGCSVAYTDSDGEWGLENDQWCG

SEQ ID NO: 2753 - protein, 39 aa, Anaeromyces robustus
  CBM_10
ECWADSYGYPCCSEGILALPFYTDEKGNKWGRENDDYCG

SEQ ID NO: 2754 - protein, 36 aa, Anaeromyces robustus
  CBM_10
CWSEVFGYKCCSEDNKNAEYTDINGKWGVENDDWCG

SEQ ID NO: 2755 - protein, 32 aa, Anaeromyces robustus
  CBM_10
GNGYPCCKDQRPEKKTYLDMDGDWTIEDGKWC

SEQ ID NO: 2756 - protein, 34 aa, Anaeromyces robustus
  CBM_10
QCFSFPEYMCCKGCDVVEDDGETTKWGIENNEWC

SEQ ID NO: 2757 - protein, 29 aa, Anaeromyces robustus
  CBM_10
NAYSNCQGCRVILEENGVKWGVENNDWCI

SEQ ID NO: 2758 - protein, 35 aa, Anaeromyces robustus
  CBM_10
TCWSKGLGYDCCKGCNTIYTDGSGDWGVENNQWCG

SEQ ID NO: 2759 - protein, 35 aa, Anaeromyces robustus
  CBM_10
SCWSNALGYECCKGCTVIETDGSGDWGVENNQWCG

SEQ ID NO: 2760 - protein, 35 aa, Anaeromyces robustus
  CBM_10
KCWAEALGFECCKTSVPVTYTDKDGKWGVENGNWC

SEQ ID NO: 2761 - protein, 37 aa, Anaeromyces robustus
  CBM_10
TCWAEPLGFKCCTGTDPKIVYSDEDGDWAIENGQWCG

SEQ ID NO: 2762 - protein, 35 aa, Anaeromyces robustus
  CBM_10
CFALSDGYECCFDNEVVYEDETGKWGINENGEWCG

SEQ ID NO: 2763 - protein, 37 aa, Anaeromyces robustus
  CBM_10
ECWAEPLGFKCCSSPDAQIFTSDSDGDWAIENGQWCG

SEQ ID NO: 2764 - protein, 35 aa, Anaeromyces robustus
  CBM_10
CPDYTSKYRCCTECNVSYTGSDGHTWGIEYGQWCS

SEQ ID NO: 2765 - protein, 39 aa, Anaeromyces robustus
  CBM_10
ECWASFEGYPCCEDPKTPVSYVNKQTRVEYGFEHGEWCG

SEQ ID NO: 2766 - protein, 35 aa, Anaeromyces robustus
  CBM_10
SCWSQRLGFPCCNGCDVAYTDSDGDWGLENNNWCG

SEQ ID NO: 2767 - protein, 35 aa, Anaeromyces robustus
  CBM_10
QCFSQSLGFPCCNNCNVVYTDESGSWGVENNDWCG

SEQ ID NO: 2768 - protein, 36 aa, Anaeromyces robustus
  CBM_10
SCWAEAQGYQCCKNICDVVYTDDSGSWGLENNDWCG

SEQ ID NO: 2769 - protein, 36 aa, Anaeromyces robustus
  CBM_10
CWALDYGYKCCKGENVIPIVTESVGQWGIENDDWCG

SEQ ID NO: 2770 - protein, 36 aa, Anaeromyces robustus
  CBM_10
CWSLDHGYKCCKGENVEVEYTDSKGQWGKENGEWCG

SEQ ID NO: 2771 - protein, 37 aa, Anaeromyces robustus
  CBM_10
TCWAEALSYKCCSNPNTPVVLTDKSGEWGIENGNWCG

SEQ ID NO: 2772 - protein, 37 aa, Anaeromyces robustus
  CBM_10
TCWAEALHYKCCTDPDTPVKGTDEFGKWGKENGEWCG

SEQ ID NO: 2773 - protein, 37 aa, Anaeromyces robustus
  CBM_10
TCWAEKISYKCCTDPDTVVIETDELGKWGVENGDWCG

SEQ ID NO: 2774 - protein, 37 aa, Anaeromyces robustus
  CBM_10
TCWAEALNYKCCSDPDTPVRSTDEFGKWGRENHEWCG

SEQ ID NO: 2775 - protein, 36 aa, Anaeromyces robustus
  CBM_10
CWSLNYGYKCCKDENVEVITTDIYGQWGKEDGKWCG

SEQ ID NO: 2776 - protein, 29 aa, Anaeromyces robustus
  CBM_10
DKYQCCKDKKSIYTDDDGDWAYTNGEWCG

SEQ ID NO: 2777 - protein, 37 aa, Anaeromyces robustus
  CBM_10
QCFSKTLTPSYPCCKGDKVIYTDKNGDWGVENGEWCG

SEQ ID NO: 2778 - protein, 35 aa, Anaeromyces robustus
  CBM_10
SCFSIAQGYPCCQSCKIKYTDESGKWGVEDGKWCG

SEQ ID NO: 2779 - protein, 35 aa, Anaeromyces robustus
  CBM_10
TCFSVAMGYPCCKSNKVVYTDESGEWGIENNEWCG

SEQ ID NO: 2780 - protein, 37 aa, Anaeromyces robustus
  CBM_10
CWSESLGVRCCKGAENIVEYMDQEGWWGVTEEDQWCG

SEQ ID NO: 2781 - protein, 34 aa, Anaeromyces robustus
  CBM_10
CWSEKLGYKCCTGCTVITTDESGKWGIENNEWCG

SEQ ID NO: 2782 - protein, 34 aa, Anaeromyces robustus
  CBM_10
TCFSLPEYPCCKGNVVYYTDEQGAWGVENGNWCG

SEQ ID NO: 2783 - protein, 30 aa, Anaeromyces robustus
  CBM_10
EGYECCPIGCKIYYTDSSGDWGIYNNDWCG

SEQ ID NO: 2784 - protein, 30 aa, Anaeromyces robustus
  CBM_10
YGYPCCSECSTVYYQDKNGEWGIENGDWCG

SEQ ID NO: 2785 - protein, 34 aa, Anaeromyces robustus
  CBM_10
CWAQKLGYPCCTEKVIYYSDGDGDWGFENNQWCG

SEQ ID NO: 2786 - protein, 31 aa, Anaeromyces robustus
  CBM_10
PYSYPYCKTTKDVAFDDGTLQWGVENDNWCI

SEQ ID NO: 2787 - protein, 38 aa, Anaeromyces robustus
  CBM_10
SCPSSITNQGYPCCSSCSTVYYVDNDGKWGVENNDWCG

SEQ ID NO: 2788 - protein, 31 aa, Anaeromyces robustus
  CBM_10
ALGYKCCSVGCQVSYTDNDGDWSFENGQWCG

SEQ ID NO: 2789 - protein, 38 aa, Anaeromyces robustus
  CBM_10
QCWSLAKGFPCCEMTKEVTFNDEANGEIWGIENGTWCG

SEQ ID NO: 2790 - protein, 32 aa, Anaeromyces robustus
  CBM_10
KGYRCCKNPNTKIEYISKNGDEWGVENNDWCG

SEQ ID NO: 2791 - protein, 32 aa, Anaeromyces robustus
  CBM_10
KGTGYPCCIFDTTKAVLHDDDGDWGIEGDYCL

SEQ ID NO: 2792 - protein, 36 aa, Anaeromyces robustus
  CBM_10
TCKAEEIGYSCCKKQKEVIYTDDLGEWGIENGDWCG

SEQ ID NO: 2793 - protein, 29 aa, Anaeromyces robustus
  CBM_10
TGDYPVCKTTSEIVFTDTEKWGIENNEWC

SEQ ID NO: 2794 - protein, 34 aa, Anaeromyces robustus
  CBM_10
CSFNGYKCCSNINAEVQYHDKDGDWSIENNEWCI

SEQ ID NO: 2795 - protein, 37 aa, Anaeromyces robustus
  CBM_10
CWAEKLGFKCCDPKKCRDVVYFDYDGQWDVENGEWCG

SEQ ID NO: 2796 - protein, 36 aa, Anaeromyces robustus
  CBM_10
CWGDEMGYSCCKEKKTIVMYTDISGRWSVEGGKWCA

SEQ ID NO: 2797 - protein, 38 aa, Anaeromyces robustus
  CBM_10
CPATITAQNYPCCSDNNCDVYAVDESGKWGLENNQWCG

SEQ ID NO: 2798 - protein, 32 aa, Anaeromyces robustus
  CBM_10
TKQGYKCCPSGCIVIYTDDDGTWGINNGEWCG

SEQ ID NO: 2799 - protein, 36 aa, Anaeromyces robustus
  CBM_10
SKNILNKGYSCCPYKCEVIYTDEDGTWGIYDNEWCG

SEQ ID NO: 2800 - protein, 36 aa, Anaeromyces robustus
  CBM_10
KCFSTVLGYPCCKNTKEVSVKDCDGSWGVENDQWCG

SEQ ID NO: 2801 - protein, 36 aa, Anaeromyces robustus
  CBM_10
CWAKKLGYSCCASKCAEVYYTDANGKWGVENGKWCG

SEQ ID NO: 2802 - protein, 27 aa, Anaeromyces robustus
  CBM_10
TYKCCKSCDIVYTDTTNWGVENNEWCS

SEQ ID NO: 2803 - protein, 39 aa, Anaeromyces robustus
  CBM_10
SCWSTEYGYPCCVLKSTVIEYDDVENGRKYGIEDNKICG

SEQ ID NO: 2804 - protein, 33 aa, Anaeromyces robustus
  CBM_10
KSGDLYKCCKNTCKVYLEDSSDYWNIENGEWCS

SEQ ID NO: 2805 - protein, 39 aa, Anaeromyces robustus
  CBM_10
SCWSSAEGYPCCQDKKTKVSYVSKLTGKKYGIENNKKCG

SEQ ID NO: 2806 - protein, 33 aa, Anaeromyces robustus
  CBM_10
TAPDGYKCCKESCAYYDKDSKGYWGLENKEWCY

SEQ ID NO: 2807 - protein, 34 aa, Anaeromyces robustus
  CBM_10
CWSEKLGYKCCSTCGQVYYADKDGEWGYTNDWCG

SEQ ID NO: 2808 - protein, 33 aa, Anaeromyces robustus
  CBM_10
CWSASLPCCKECNVVDASDKSRQYGWENDQWCA

SEQ ID NO: 2809 - protein, 37 aa, Anaeromyces robustus
  CBM_10
ECWATKLGYPCCTGKYPGISYTDKDGSWSIENGQWCG

SEQ ID NO: 2810 - protein, 37 aa, Anaeromyces robustus
  CBM_10
ECWAESKGYPCCDPSNTNVIMEDIDGKWGLENNQWCG

SEQ ID NO: 2811 - protein, 39 aa, Anaeromyces robustus
  CBM_10
KCPGYAEGYNCCKNCEVTYISHSDPNKKWGFFSNGDWCS

SEQ ID NO: 2812 - protein, 38 aa, Anaeromyces robustus
  CBM_10
TCWSEALGYPCCRDPRTTIYKTEKDGKEWGIESNQWCG

SEQ ID NO: 2813 - protein, 36 aa, Anaeromyces robustus
  CBM_10
KCWSNELGYPCCKSTTEIVFTDDRGNWGVEDKKWCG

SEQ ID NO: 2814 - protein, 32 aa, Anaeromyces robustus
  CBM_10
KKLGYPCCSNKNGKVVYKDENGNWGVEHHQWC

SEQ ID NO: 2815 - protein, 35 aa, Anaeromyces robustus
  CBM_10
CSSKSLGYPCCKSSNNVVSTDELGKWGVENGDWCY

SEQ ID NO: 2816 - protein, 35 aa, Anaeromyces robustus
  CBM_10
CWSEKLGYKCCNTCFPVYYTDNDGQWGIVNGEWCG

SEQ ID NO: 2817 - protein, 35 aa, Anaeromyces robustus
  CBM_10
CWALKLGSPCCTFNKDVYAIDENGKWSVENGIWCG

SEQ ID NO: 2818 - protein, 36 aa, Anaeromyces robustus
  CBM_10
ECWSLKLGSPCCTTTKEIIYTDDDGNWGIENNDWCG

SEQ ID NO: 2819 - protein, 36 aa, Anaeromyces robustus
  CBM_10
ECWAKILGSPCCLTTKVVVEIDDFGKWGIENGAWCG

SEQ ID NO: 2820 - protein, 35 aa, Anaeromyces robustus
  CBM_10
CWAHAYNYPCCKTTKNLVETDSKGNKWGIEDNHWC

SEQ ID NO: 2821 - protein, 37 aa, Anaeromyces robustus
  CBM_10
ACFSEKLGYPCCDSSNDIVLYTDSDGKWGVENNNWCG

SEQ ID NO: 2822 - protein, 38 aa, Anaeromyces robustus
  CBM_10
CWSMKEGYPCCKDENTPVSYISKSTGKEWGMENGEWCG

SEQ ID NO: 2823 - protein, 29 aa, Anaeromyces robustus
  CBM_10
EGYKCCKSTCTVSYTDSNKWGVENNEWCI

SEQ ID NO: 2824 - protein, 36 aa, Anaeromyces robustus
  CBM_10
ECWSLKQGYPCCVKTEIVVIEDENGKWGVENDDWCG

SEQ ID NO: 2825 - protein, 31 aa, Anaeromyces robustus
  CBM_10
ESTGYKCCPDAEVKATYGNSTWGKVNGEWCG

SEQ ID NO: 2826 - protein, 36 aa, Anaeromyces robustus
  CBM_10
KCPFNQYGYPCCKTTKVVVSIDSMGKWGIEDGQWCG

SEQ ID NO: 2827 - protein, 34 aa, Anaeromyces robustus
  CBM_10
SYERTYPCCSPDNKKIKYVDQHGQWGFENGDWCG

SEQ ID NO: 2828 - protein, 37 aa, Anaeromyces robustus
  CBM_10
CLSELVGYPCCAKGIKAVYAKDEYGEWGYDFKKNEWC

SEQ ID NO: 2829 - protein, 35 aa, Anaeromyces robustus
  CBM_10
TCWSEKYGYPCCNGCYVFETDDDGQWGYENNQWCG

SEQ ID NO: 2830 - protein, 34 aa, Anaeromyces robustus
  CBM_10
CRSALEGYMCCKTPGKVFYRDDFGSWGVENEQWC

SEQ ID NO: 2831 - protein, 30 aa, Anaeromyces robustus
  CBM_10
QLYEICKEQHDVVFKDNEGVWSVENGNWCS

SEQ ID NO: 2832 - protein, 36 aa, Anaeromyces robustus
  CBM_10
CWAEKLGYPCCKGNEPKVEFTDEHGDWSIENGQKCG

SEQ ID NO: 2833 - protein, 34 aa, Anaeromyces robustus
  CBM_10
CFSEKLGYPCCSGCTVIYSDNDGEWGIENDNWCG

SEQ ID NO: 2834 - protein, 35 aa, Anaeromyces robustus
  CBM_10
CPFESIGYKCCSKTCLVLYSDESGDWGVEDDEWCG

SEQ ID NO: 2835 - protein, 36 aa, Anaeromyces robustus
  CBM_10
ECWSTEYGYPCCSSPDTKSNSTDSKGTWGFENGDWC

SEQ ID NO: 2836 - protein, 35 aa, Anaeromyces robustus
  CBM_10
CWADELGFSCCENDNGKIVIGDNNGLWGKENGNWC

SEQ ID NO: 2837 - protein, 35 aa, Anaeromyces robustus
  CBM_10
CWSLALGYPCCQSSTKVHTTDENGSWGIENNQWCG

SEQ ID NO: 2838 - protein, 37 aa, Anaeromyces robustus
  CBM_10
CFSEPDYPCCSNCDVEIIWNDENKGQSWSIENNNWCG

SEQ ID NO: 2839 - protein, 31 aa, Anaeromyces robustus
  CBM_10
SGNIYKCCKKSCKVYREEDGDYWNVENNEWC

SEQ ID NO: 2840 - protein, 36 aa, Anaeromyces robustus
  CBM_10
CWARKLGYPCCEKCPLLTLYKDSNGSWGLEHLRWCG

SEQ ID NO: 2841 - protein, 37 aa, Anaeromyces robustus
  CBM_10
CMAEVIGYPCCTSKQTKVYRTDEYGDWSFNFLKLQWC

SEQ ID NO: 2842 - protein, 37 aa, Anaeromyces robustus
  CBM_10
CLSELVGYPCCAKGIKVVYAKDEYGEWGYDFKKNEWC

SEQ ID NO: 2843 - protein, 35 aa, Anaeromyces robustus
  CBM_10
ECWSEKYGYPCCNGCYVFETDDDGQWGYENNQWCG

SEQ ID NO: 2844 - protein, 30 aa, Anaeromyces robustus
  CBM_10
IYGYKCCPNATALLEDDYGSWSIVNGEWCG

SEQ ID NO: 2845 - protein, 36 aa, Anaeromyces robustus
  CBM_10
ECWSLNLGFPCCEETKNVIEIDDNGKWGIENNNWCG

SEQ ID NO: 2846 - protein, 36 aa, Anaeromyces robustus
  CBM_10
ECWSLKKGFPCCETTKAIIYTDEDGNWGTENNNWCG

SEQ ID NO: 2847 - protein, 36 aa, Anaeromyces robustus
  CBM_10
ECWSLNLGFPCCEETQNVIEIDDNGKWGIENNNWCG

SEQ ID NO: 2848 - protein, 28 aa, Anaeromyces robustus
  CBM_10
GSPCCENNDGEILYYDMDGDWGYENGLW

SEQ ID NO: 2849 - protein, 36 aa, Anaeromyces robustus
  CBM_10
QCWSLRLGSPCCTTTDKVIYTDGDGNWGYENNEWCG

SEQ ID NO: 2850 - protein, 35 aa, Anaeromyces robustus
  CBM_10
CWAKAKGYPCCDNDEGYLQSYDMDGKWGYENNAWC

SEQ ID NO: 2851 - protein, 35 aa, Anaeromyces robustus
  CBM_10
KCWSMPLGYPCCVGNDVYKKDVYGLWGIENDNYCG

SEQ ID NO: 2852 - protein, 36 aa, Anaeromyces robustus
  CBM_10
SSRIQNQGFKCCSNNCMVFYSDGDGNWGYEDGEWCG

SEQ ID NO: 2853 - protein, 29 aa, Anaeromyces robustus
  CBM_10
GYACCKSSDVKIYETDEYGKWGVEDNKWC

SEQ ID NO: 2854 - protein, 35 aa, Anaeromyces robustus
  CBM_10
ECFSIALGYPCCQGNEIVYTDNDGNWGVENGQWCG

SEQ ID NO: 2855 - protein, 35 aa, Anaeromyces robustus
  CBM_10
SCFSEALGYPCCTSCNVIFTDSDGKWGVENNSWCG

SEQ ID NO: 2856 - protein, 38 aa, Anaeromyces robustus
  CBM_10
CWSIAEGYPCCQNPETTVSYTSKSSGKLWGVENNEWCG

SEQ ID NO: 2857 - protein, 31 aa, Anaeromyces robustus
  CBM_10
GTSYSCCVFRDTAVYSTDETGTWGIEGNRWC

SEQ ID NO: 2858 - protein, 33 aa, Anaeromyces robustus
  CBM_10
QCVKNKNGLKCCSTCEIALTDATGRYGYENGEW

SEQ ID NO: 2859 - protein, 34 aa, Anaeromyces robustus
  CBM_10
CWSRSIGFVCCDKCNVLYVDEQGKWGIEDEYWCG

SEQ ID NO: 2860 - protein, 29 aa, Anaeromyces robustus
  CBM_10
TGDYPVCKETTKVMYTDTEKWGVEHGEWC

SEQ ID NO: 2861 - protein, 35 aa, Anaeromyces robustus
  CBM_10
CFASSGYPCCTDPHTKVVYHDDEGDWGVENKEWCF

SEQ ID NO: 2862 - protein, 35 aa, Anaeromyces robustus
  CBM_10
CNSEKYGYSCCKTEQKVVYTDSQGDWGIEDGNWCG

SEQ ID NO: 2863 - protein, 34 aa, Anaeromyces robustus
  CBM_10
QRQGYPCCEENNCNIYFKDGDGDWGISSKSNWCG

SEQ ID NO: 2864 - protein, 33 aa, Anaeromyces robustus
  CBM_10
KFNQMGYKCCNGCNVILTDETGKWGVENNEWCG

SEQ ID NO: 2865 - protein, 38 aa, Anaeromyces robustus
  CBM_10
SCSSRILNQGYKCCSDNCKVVYTDEDGTWGYENNQWCG

SEQ ID NO: 2866 - protein, 34 aa, Anaeromyces robustus
  CBM_10
FTSLGYSCCSDNNCVVYTVDSTGNWGVENNEWCG

SEQ ID NO: 2867 - protein, 37 aa, Anaeromyces robustus
  CBM_10
CLAELIGYPCCPSIIKTIYAQDEYGDWGFDFKKQEWC

SEQ ID NO: 2868 - protein, 35 aa, Anaeromyces robustus
  CBM_10
ECWSKIYGYSCCKRCMVYETDENGKWGFESNQWCG

SEQ ID NO: 2869 - protein, 37 aa, Anaeromyces robustus
  CBM_10
ECWAFDLGYPCCSDPNSIIWETDSNGSWSIENNEWCG

SEQ ID NO: 2870 - protein, 35 aa, Anaeromyces robustus
  CBM_10
CWAYQYGFQCCFYYTKPYLVDERGSWSFERGNWCG

SEQ ID NO: 2871 - protein, 36 aa, Anaeromyces robustus
  CBM_10
KCWSKKLGYSCCEESKEVFYEDQDGKWGYEKDNWCG

SEQ ID NO: 2872 - protein, 37 aa, Anaeromyces robustus
  CBM_10
TCWGEKLGYPCCPPTNCRIFYVNDDGDWGFHNYKWCA

SEQ ID NO: 2873 - protein, 36 aa, Anaeromyces robustus
  CBM_10
CWAKKFGYECCPPGVCEVSQKDENGSWGAYDGEWCG

SEQ ID NO: 2874 - protein, 30 aa, Anaeromyces robustus
  CBM_10
LGYPCCKRCDSFLLTDDDANWGVENSEWCI

SEQ ID NO: 2875 - protein, 37 aa, Anaeromyces robustus
  CBM_10
CWSESLGYKCCSAGCKAASIFVDSDGSWGVENGEWCG

SEQ ID NO: 2876 - protein, 37 aa, Anaeromyces robustus
  CBM_10
CLAELLGYSCCSPENTNIYLQDENGDWGFDFEKNEWC

SEQ ID NO: 2877 - protein, 36 aa, Anaeromyces robustus
  CBM_10
TCWSEEIGYPCCKTCDVFYEEDYEGRWGIENDNWCG

SEQ ID NO: 2878 - protein, 35 aa, Anaeromyces robustus
  CBM_10
KCWSERLGYPCCKGNVVVTSDADGDWGVENNNWCG

SEQ ID NO: 2879 - protein, 38 aa, Anaeromyces robustus
  CBM_10
SCWSEALGFPCCSTNGCQVVYYTDTDGKWGVENNNWCG

SEQ ID NO: 2880 - protein, 36 aa, Anaeromyces robustus
  CBM_10
ACWSETLGYTCCKSSCDIYYTDQDGHWGVENNQWCG

SEQ ID NO: 2881 - protein, 36 aa, Anaeromyces robustus
  CBM_10
KCNTYNNKYPCCSHCNVYHTDTDGSRWGIENDNWCS

SEQ ID NO: 2882 - protein, 36 aa, Anaeromyces robustus
  CBM_10
CWAEKLGYPCCKGNEPKVEFTDEYGDWSTEDGQKCG

SEQ ID NO: 2883 - protein, 30 aa, Anaeromyces robustus
  CBM_10
LGYDTCKEQHEYIYKDNEGLWSIEGGKWCG

SEQ ID NO: 2884 - protein, 35 aa, Anaeromyces robustus
  CBM_10
SCRSALNGYMCCKNTDKVVYRDDFGSWGIENGQWC

SEQ ID NO: 2885 - protein, 26 aa, Anaeromyces robustus
  CBM_10
NYPYCDGCETNYTDKDGGWYYTNKTW

SEQ ID NO: 2886 - protein, 31 aa, Anaeromyces robustus
  CBM_10
KGYQCCKDSSTKVISEDNDGTWGIENKKWCL

SEQ ID NO: 2887 - protein, 37 aa, Anaeromyces robustus
  CBM_10
ECWSEVFGYPCCQSCYVYEEDENGKWGYDFNESTWCG

SEQ ID NO: 2888 - protein, 37 aa, Anaeromyces robustus
  CBM_10
CWVEQFGYPCCQKNAKVYAVDDEGEWGYNFKTQEWCG

SEQ ID NO: 2889 - protein, 34 aa, Anaeromyces robustus
  CBM_10
QCPDYATGYSCCYECNIVYNDGHDWGIENGKWCS

SEQ ID NO: 2890 - protein, 34 aa, Anaeromyces robustus
  CBM_10
QCFSYPQYPCCEGCTVIEETAEGKWGIENSQWCG

SEQ ID NO: 2891 - protein, 28 aa, Anaeromyces robustus
  CBM_10
AYDECKSCLTYYIEDGVKWGVENNDWCL

SEQ ID NO: 2892 - protein, 34 aa, Anaeromyces robustus
  CBM_10
CWAGQLGYPYCTSTTREVYKDNDGKWGIENNNWC

SEQ ID NO: 2893 - protein, 35 aa, Anaeromyces robustus
  CBM_10
CFSSKLGYPCCSSTKVIVYQDNSGNWGVENNEWCG

SEQ ID NO: 2894 - protein, 27 aa, Anaeromyces robustus
  CBM_10
YKCCQKCEIVYEDKEGKWGVENDEWCV

SEQ ID NO: 2895 - protein, 35 aa, Anaeromyces robustus
  CBM_10
SCFATRLGYECCNYNEILYSDDDGDWGVNDNRWCG

SEQ ID NO: 2896 - protein, 37 aa, Anaeromyces robustus
  CBM_10
CWSLKYGYPCCKENATTIRKDKNGEWGFDFQKFRWCG

SEQ ID NO: 2897 - protein, 36 aa, Anaeromyces robustus
  CBM_10
TCFSLEIGFPCCREGEKIVYSDDDGYWGVENGEWCG

SEQ ID NO: 2898 - protein, 35 aa, Anaeromyces robustus
  CBM_10
ECFSLSEGYPCCEFCMVEQCIDNNLWGVENGQWCG

SEQ ID NO: 2899 - protein, 35 aa, Anaeromyces robustus
  CBM_10
ECFSIKLGYPCCKKTTEVAHIDKNGKWGIEDNHWC

SEQ ID NO: 2900 - protein, 34 aa, Anaeromyces robustus
  CBM_10
CWSEQYGYPCCDSNDVFLEDELGKWGVMNGSWCG

SEQ ID NO: 2901 - protein, 32 aa, Anaeromyces robustus
  CBM_10
FEDLGFKCCSHCVHIYDDKTGLWGVEANEWCG

SEQ ID NO: 2902 - protein, 37 aa, Anaeromyces robustus
  CBM_10
SCWSSSLGYPCCSNSNTLVEYTDNDGEWGIENGIWCG

SEQ ID NO: 2903 - protein, 35 aa, Anaeromyces robustus
  CBM_10
SFAANSNYPVCKYNSIVYFTDEDGQWSVENDNWCL

SEQ ID NO: 2904 - protein, 38 aa, Anaeromyces robustus
  CBM_10
ECWSLSQGYPCCVNKNTKIKSTSSNGDEWGVENNEWCG

SEQ ID NO: 2905 - protein, 30 aa, Anaeromyces robustus
  CBM_10
NSGYSCCVSTTKVLSGDGTGDWGVEFNDWC

SEQ ID NO: 2906 - protein, 37 aa, Anaeromyces robustus
  CBM_10
ECWSIAEGFPCCENKDTIISIIQSGRGWGVENGHWCG

SEQ ID NO: 2907 - protein, 33 aa, Anaeromyces robustus
  CBM_10
CPSSGNYKCCKSSCSVYYVDTEEWGYEHGEWCL

SEQ ID NO: 2908 - protein, 29 aa, Anaeromyces robustus
  CBM_10
SGDYPCCKGCDVYYTDDVEWGIENGDWCS

SEQ ID NO: 2909 - protein, 35 aa, Anaeromyces robustus
  CBM_10
ECWSEIYGYSCCKGCIIYESDENGKWGYKNGKWCG

SEQ ID NO: 2910 - protein, 38 aa, Anaeromyces robustus
  CBM_10
CWAELIGYPCCPSHNKIVYSHDENGDWGYDYKTNQWCG

SEQ ID NO: 2911 - protein, 34 aa, Anaeromyces robustus
  CBM_10
CFSIALGYPCCKKCDVLFVDKDGQWGVEDNEWCG

SEQ ID NO: 2912 - protein, 37 aa, Anaeromyces robustus
  CBM_10
QCFSQALNPSYPCCKSNKVVYTDKSGDWGVENDQWCG

SEQ ID NO: 2913 - protein, 32 aa, Anaeromyces robustus
  CBM_10
CNKNNEYECCETCTEYFSDNTGRYGYENEKWC

SEQ ID NO: 2914 - protein, 35 aa, Anaeromyces robustus
  CBM_10
KCWSEEQGFPCCKGCVVIYTENNEKWGIENDEWCG

SEQ ID NO: 2915 - protein, 30 aa, Anaeromyces robustus
  CBM_10
QGYNCCIHDCIYITSDENRNWSVENGEWCW

SEQ ID NO: 2916 - protein, 36 aa, Anaeromyces robustus
  CBM_10
KCWSERLGYPCCTTTKKAYTEDSDGKWGVEKGNYCG

SEQ ID NO: 2917 - protein, 35 aa, Anaeromyces robustus
  CBM_10
CWSIPLGYPCCSNSYLPTLFTDDNGEWSVENDNWC

SEQ ID NO: 2918 - protein, 37 aa, Anaeromyces robustus
  CBM_10
TCWSIQYGYECCKDPETPVYSKDSTGEWGIENNNWCG

SEQ ID NO: 2919 - protein, 35 aa, Anaeromyces robustus
  CBM_10
CFSVKLGYPCCQYTDEVVYVDDDGDWGVENNDWCG

SEQ ID NO: 2920 - protein, 31 aa, Anaeromyces robustus
  CBM_10
MKLGYRCCNTCKIEYIDNNIKYGYENGEWCG

SEQ ID NO: 2921 - protein, 31 aa, Anaeromyces robustus
  CBM_10
ATRFGYPCCDTCKLEYIDDFGDWGFENDNWC

SEQ ID NO: 2922 - protein, 29 aa, Anaeromyces robustus
  CBM_10
EGYECCEGCTVESEEDNIKWGYENRNWCV

SEQ ID NO: 2923 - protein, 35 aa, Anaeromyces robustus
  CBM_10
ECWSEIIGYSCCKGCTVYEEDEFGKWGYEKNHWCG

SEQ ID NO: 2924 - protein, 38 aa, Anaeromyces robustus
  CBM_10
KCWAEFIGYPCCSEKDTYVYDTDSYGDWSYDFDNNEWC

SEQ ID NO: 2925 - protein, 35 aa, Anaeromyces robustus
  CBM_10
CWSAKLGYPCCKSTTAVEMSDSDGQWGVENGQWCG

SEQ ID NO: 2926 - protein, 35 aa, Anaeromyces robustus
  CBM_10
CWATRLGFPCCEYSAQVFYTDNDGKWSIENGEWCG

SEQ ID NO: 2927 - protein, 35 aa, Anaeromyces robustus
  CBM_10
CWSVSEGYKCCSLGTKTVLTDSKGKWGIENNEWCG

SEQ ID NO: 2928 - protein, 34 aa, Anaeromyces robustus
  CBM_10
CWATSIGYGCCNHCNSIYTDGTYRWGVQNNQWCG

SEQ ID NO: 2929 - protein, 33 aa, Anaeromyces robustus
  CBM_10
HATKLGYSCCKTCMVALTDKDGKWGVENKNWCG

SEQ ID NO: 2930 - protein, 38 aa, Anaeromyces robustus
  CBM_10
QCWAQKLGFKCCKNPNATVINIDEDGTKWGIENDEWCG

SEQ ID NO: 2931 - protein, 35 aa, Anaeromyces robustus
  CBM_10
CKSDKEEDNCCKTNTEILYSDDEGAWGYENDAWCI

SEQ ID NO: 2932 - protein, 37 aa, Anaeromyces robustus
  CBM_10
ECWAEKYGRPCCKNSSTKNVYTDNEGMWGVENDEWCG

SEQ ID NO: 2933 - protein, 38 aa, Anaeromyces robustus
  CBM_10
ECKSEKLGIECCKDISTENVYTDDEGIKFGVEKDDWCG

SEQ ID NO: 2934 - protein, 37 aa, Anaeromyces robustus
  CBM_10
QCWAKKYGRPCCLNNLTEYVYADDEGMWGVENGDWCG

SEQ ID NO: 2935 - protein, 30 aa, Anaeromyces robustus
  CBM_10
CDPQYPCCNGCDVKYTDNSGKWGVENNNWC

SEQ ID NO: 2936 - protein, 35 aa, Anaeromyces robustus
  CBM_10
SCKFEALGYPCCSHCESIYEDNSGKWGVENNNWCG

SEQ ID NO: 2937 - protein, 35 aa, Anaeromyces robustus
  CBM_10
CWSLKLGYSCCTSNDIILYSDADGDWSVENNEWCG

SEQ ID NO: 2938 - protein, 38 aa, Anaeromyces robustus
  CBM_10
ECWADYFNYKCCSTRNCRSVYLTDANGDWDIEDGQWCG

SEQ ID NO: 2939 - protein, 34 aa, Anaeromyces robustus
  CBM_10
CWSKELGFPCCKGCLVIDKDEFGSWGFELDHWCG

SEQ ID NO: 2940 - protein, 39 aa, Anaeromyces robustus
  CBM_10
QCWAQLVGYGCCPEGTNDVYYEDSYGKWGIDLKKEDWCG

SEQ ID NO: 2941 - protein, 37 aa, Anaeromyces robustus
  CBM_10
TCWAELLGYNCCKSKNPIIIQTDEYGDWAIEKNNWCG

SEQ ID NO: 2942 - protein, 36 aa, Anaeromyces robustus
  CBM_10
KCWASSLGFPCCQSSKVVFRTDSNGSWSLENDEWCG

SEQ ID NO: 2943 - protein, 37 aa, Anaeromyces robustus
  CBM_10
QCWAKSLGFKCCTGSKPTVVYTDNNGDWSVENDEWCG

SEQ ID NO: 2944 - protein, 32 aa, Anaeromyces robustus
  CBM_10
GNKYPCCKNSKAKMQAFEMDGFLGVENNSYCG

SEQ ID NO: 2945 - protein, 34 aa, Anaeromyces robustus
  CBM_10
CWANKFGYDCCKSGAVFVTKDSDGDWGIENGKWC

SEQ ID NO: 2946 - protein, 37 aa, Anaeromyces robustus
  CBM_10
QCWAKKIGYECCKDSKTYAIYTDNNGDWGVENEVWCG

SEQ ID NO: 2947 - protein, 36 aa, Anaeromyces robustus
  CBM_10
KCWAKSLGYKCCTSKAIYYASDNDGDWGIENDDWCG

SEQ ID NO: 2948 - protein, 33 aa, Anaeromyces robustus
  CBM_10
TCWAYQLGYKCCKKSETVEVESGYGVLNGNWCG

SEQ ID NO: 2949 - protein, 34 aa, Anaeromyces robustus
  CBM_10
CWSEVFGYPCCESCYVFETDDYGKWGYENNHWCG

SEQ ID NO: 2950 - protein, 38 aa, Anaeromyces robustus
  CBM_10
KCWAELAGYPCCSERIKIVYEHDEFGDWGYDYSIKQWC

SEQ ID NO: 2951 - protein, 34 aa, Anaeromyces robustus
  CBM_10
CWSKKLGYSCCEGCKVIETDEDGSWGYEYDQWCG

SEQ ID NO: 2952 - protein, 36 aa, Anaeromyces robustus
  CBM_10
CLSELIGYACCSLELTSIYTDEYGDWGYDYNKKEWC

SEQ ID NO: 2953 - protein, 37 aa, Anaeromyces robustus
  CBM_10
SCWSKKLGYNCCTAKCPKEYYIDNDGSWGVENNNWCG

SEQ ID NO: 2954 - protein, 36 aa, Anaeromyces robustus
  CBM_10
SCWSLKLGYKCCKKNNMVVLTDTDGQWGVENNEWCG

SEQ ID NO: 2955 - protein, 38 aa, Anaeromyces robustus
  CBM_10
ECWSEALGYKCCSKGCDAVVLAIDNSGNWGAENGEWCG

SEQ ID NO: 2956 - protein, 35 aa, Anaeromyces robustus
  CBM_10
ECPGKKYGYSCCETCDVYLNDDEGKWGVDNGYWCS

SEQ ID NO: 2957 - protein, 36 aa, Anaeromyces robustus
  CBM_10
ECWSEIFGYPCCKSCVVYEEEEEYGKWGYENNQWCG

SEQ ID NO: 2958 - protein, 35 aa, Anaeromyces robustus
  CBM_10
CWANNLGYPCCSSNTQVIYTDNNGQWGVENNNWCG

SEQ ID NO: 2959 - protein, 34 aa, Anaeromyces robustus
  CBM_10
CFSTRLGYPCCTKTTAVVYHDNDGDWGVEDNHWC

SEQ ID NO: 2960 - protein, 35 aa, Anaeromyces robustus
  CBM_10
ECWSESQGYKCCKTCVVVYVDEFGSWGVENDQWCG

SEQ ID NO: 2961 - protein, 35 aa, Anaeromyces robustus
  CBM_10
TCWSSGYGYPCCTTCKVYYEDYSGEWGVENGDWCG

SEQ ID NO: 2962 - protein, 36 aa, Anaeromyces robustus; identical to SEQ ID NO: 2178
  CBM_10

SEQ ID NO: 2963 - protein, 36 aa, Anaeromyces robustus
  CBM_10
CFSESLGYPCCRKQNPKVYYTNEDGEWSVENGKWCG

SEQ ID NO: 2964 - protein, 35 aa, Anaeromyces robustus
  CBM_10
CWATAHGYNCCSGCKVIFEETETMKWGVENHEWCG

SEQ ID NO: 2965 - protein, 27 aa, Anaeromyces robustus
  CBM_10
LGYPCCNDCRVVYQDEYNWGVLNNQWC

SEQ ID NO: 2966 - protein, 36 aa, Anaeromyces robustus
  CBM_10
ECFSSKLGYPCCTSTTDIYYSDNDGKWGIENGNWCG

SEQ ID NO: 2967 - protein, 37 aa, Anaeromyces robustus
  CBM_10
CWAEVLGFPCCSTDKCRTVYFTDDDGEWDVENNNWCG

SEQ ID NO: 2968 - protein, 35 aa, Anaeromyces robustus
  CBM_10
CWATALGYPCCTTTTDVVFTDNSGDWGVEKGNWCG

SEQ ID NO: 2969 - protein, 29 aa, Anaeromyces robustus
  CBM_10
GEKYKCCKSCDIFYVDNYKWGVENNEWCS

SEQ ID NO: 2970 - protein, 39 aa, Anaeromyces robustus
  CBM_10
ECWSEVHGYPCCELKTTQVEFTDSSTGEQYGIENGRICG

SEQ ID NO: 2971 - protein, 30 aa, Anaeromyces robustus
  CBM_10
ASYPCCENTCAVQYTDADGQWGIENGNWCG

SEQ ID NO: 2972 - protein, 30 aa, Anaeromyces robustus; identical to SEQ ID NO: 2971
  CBM_10

SEQ ID NO: 2973 - protein, 35 aa, Anaeromyces robustus
  CBM_10
ACFSENLGYKCCKGNTIYYTDNNGAWGIENGEWCG

SEQ ID NO: 2974 - protein, 34 aa, Anaeromyces robustus
  CBM_10
CFSVKLGFKCCKGNNIIYTDKDGDWGVEDDEWCG

SEQ ID NO: 2975 - protein, 36 aa, Anaeromyces robustus
  CBM_10
CWAKTYGFECCTREEADIVLVDELGPWGIKDDKWCG

SEQ ID NO: 2976 - protein, 35 aa, Anaeromyces robustus
  CBM_10
TCWSEIFGYSCCKGCTIYEVDNDGSWGYENGEWCG

SEQ ID NO: 2977 - protein, 37 aa, Anaeromyces robustus
  CBM_10
CIAELIGYKCCSPNNTKVYAHDENGDWGYDFKKGEWC

SEQ ID NO: 2978 - protein, 33 aa, Anaeromyces robustus
  CBM_10
CWSVDLGYPCCKSTNEVYVTDENGKWGLENNNW

SEQ ID NO: 2979 - protein, 36 aa, Anaeromyces robustus
  CBM_10
ECFSLALGYSCCQKTTAVIYEDKDGKWGIENNQWCG

SEQ ID NO: 2980 - protein, 37 aa, Anaeromyces robustus
  CBM_10
SCWSTALGYPCCTNANLDVLFTDDDGDWSIENNNWCG

SEQ ID NO: 2981 - protein, 35 aa, Anaeromyces robustus
  CBM_10
ECWSLILGYKCCSSCLPIVETDSSGNWSIEDNQWC

SEQ ID NO: 2982 - protein, 35 aa, Anaeromyces robustus
  CBM_10
CFSERLGFPCCPPGTKVEYSDEEGDWGIINEEWCG

SEQ ID NO: 2983 - protein, 37 aa, Anaeromyces robustus
  CBM_10
CWAEEFGYPCCSNLNNKIVYYIDEYGNKWGVENDDWC

SEQ ID NO: 2984 - protein, 35 aa, Anaeromyces robustus
  CBM_10
CWAEKLGYPCCSSSKNVLFEDNDGQWSVENDNWCG

SEQ ID NO: 2985 - protein, 35 aa, Anaeromyces robustus
  CBM_10
CWSEALGYPCCSTCSSPVYSDNDGNWGVENGDWCG

SEQ ID NO: 2986 - protein, 36 aa, Anaeromyces robustus
  CBM_10
CKNQTNGCPKTDYPCCSHCDVLFTDRTARWGIENND

SEQ ID NO: 2987 - protein, 35 aa, Anaeromyces robustus
  CBM_10
CWAAALGYKCCNHCNVVETDDQDHEWGSLNGEWCG

SEQ ID NO: 2988 - protein, 35 aa, Anaeromyces robustus
  CBM_10
CFSERLGYPCCKYTSKVEYVDADGDWGVENGDWCG

SEQ ID NO: 2989 - protein, 35 aa, Anaeromyces robustus; identical to SEQ ID NO: 2988
  CBM_10

SEQ ID NO: 2990 - protein, 35 aa, Anaeromyces robustus
  CBM_10
QCWAEAYGYSCCSKCVKVIDTSYNKKWGLENGKWC

SEQ ID NO: 2991 - protein, 29 aa, Anaeromyces robustus
  CBM_10
NSPAYKCCSSCIVYFEDNYKWGTMNGEWC

SEQ ID NO: 2992 - protein, 26 aa, Anaeromyces robustus
  CBM_10
YKCCNSCDIVYTDFQYWGYENNEWCS

SEQ ID NO: 2993 - protein, 35 aa, Anaeromyces robustus
  CBM_10
TCFSLAQGYPCCQSCKVLYTDKSGKWGVENGKWCG

SEQ ID NO: 2994 - protein, 35 aa, Anaeromyces robustus
  CBM_10
TCFSVAMGYPCCTGNKIVYTDKSGNWGIENNKRCG

SEQ ID NO: 2995 - protein, 37 aa, Anaeromyces robustus
  CBM_10
QCFSKTLKPSYPCCKGNKVVYTDKNGNWGFENNKWCG

SEQ ID NO: 2996 - protein, 36 aa, Anaeromyces robustus
  CBM_10
ECWSKAQGYDCCAEGTSVFLEDESGDWSADNGEWCG

SEQ ID NO: 2997 - protein, 38 aa, Anaeromyces robustus
  CBM_10
TCWSETLGYPCCNTNGCQTIYFIDSNGMWSVENDNWCG

SEQ ID NO: 2998 - protein, 36 aa, Anaeromyces robustus
  CBM_10
CWAHRLGFQCCKNYKIEVAYSDSDGDWGIENGEWCG

SEQ ID NO: 2999 - protein, 30 aa, Anaeromyces robustus
  CBM_10
QGYKCCSDNCIIYYNDEDGDWGVENGEWCG

SEQ ID NO: 3000 - protein, 38 aa, Anaeromyces robustus
  CBM_10
SCSANILKQGYKCCPDNCVVTYVDADGDWSIDGQEWCG

SEQ ID NO: 3001 - protein, 30 aa, Anaeromyces robustus; identical to SEQ ID NO: 2999
  CBM_10

SEQ ID NO: 3002 - protein, 38 aa, Anaeromyces robustus; identical to SEQ ID NO: 3000
  CBM_10

SEQ ID NO: 3003 - protein, 38 aa, Anaeromyces robustus
  CBM_10
CFSKFLGSPYPCCSPDNQKIEFIDHDGLWGRENGKWCG

SEQ ID NO: 3004 - protein, 31 aa, Anaeromyces robustus
  CBM_10
ISSGYKCCPNAKEVQSDDNGSWGYVDGQWCG

SEQ ID NO: 3005 - protein, 37 aa, Anaeromyces robustus
  CBM_10
SCWSTKLGYPCCSAGNKDVYYNDDDGLWGVENNNWCG

SEQ ID NO: 3006 - protein, 20 aa, Anaeromyces robustus
  CBM_10
SCWSTKLGYPCCSAGNKDVY

SEQ ID NO: 3007 - protein, 32 aa, Anaeromyces robustus
  CBM_10
INGYQCCKDSSTQVILTDDDGTWGIENNHWCH

SEQ ID NO: 3008 - protein, 35 aa, Anaeromyces robustus; identical to SEQ ID NO: 2434
  CBM_10

SEQ ID NO: 3009 - protein, 36 aa, Anaeromyces robustus
  CBM_10
ECWSLKHGYPCCQKTKVVTLEDENGKWGVENDDWCG

SEQ ID NO: 3010 - protein, 36 aa, Anaeromyces robustus
  CBM_10
ECPFEKYGYPCCEITNIVVYTDDMGKWGIENDVWCG

SEQ ID NO: 3011 - protein, 35 aa, Anaeromyces robustus
  CBM_10
TCTAQDQGYKCCSTCNVVYTDESGDWGVENNEWCL

SEQ ID NO: 3012 - protein, 36 aa, Anaeromyces robustus
  CBM_10
KCWSERFGYPCCTSSCHVYETDDNGEWGYENQHWCG

SEQ ID NO: 3013 - protein, 36 aa, Anaeromyces robustus
  CBM_10
ECWSEVFGFPCCTSSCHVYEIDDSGEWGYEDNHWCG

SEQ ID NO: 3014 - protein, 35 aa, Anaeromyces robustus
  CBM_10
ECWANELGYKCCPKGCDATVVVEDDLGKWGILGGE

SEQ ID NO: 3015 - protein, 37 aa, Anaeromyces robustus
  CBM_10
SCWSEKLGYPCCPANRCRVYTTDKDGKWGYTKNSWCG

SEQ ID NO: 3016 - protein, 39 aa, Anaeromyces robustus
  CBM_10
KCWSELIGYPCCDSSVTTVFVQDDYGDWGYDFNKNEWCG

SEQ ID NO: 3017 - protein, 33 aa, Anaeromyces robustus
  CBM_10
KGSGYACCKFNTTTVTTTDYTGKWGIEGLRYCL

SEQ ID NO: 3018 - protein, 32 aa, Anaeromyces robustus
  CBM_10
KGYPCCTKKTSNVNYISKNGDQYGYENNKWCG

SEQ ID NO: 3019 - protein, 29 aa, Anaeromyces robustus
  CBM_10
GEKYKCCNSCKVRYTDNYEWGVEDGEWCS

SEQ ID NO: 3020 - protein, 29 aa, Anaeromyces robustus
  CBM_10
GEKYKCCNSCKVRYTDDYEWGVEGGEWCS

SEQ ID NO: 3021 - protein, 39 aa, Anaeromyces robustus
  CBM_10
KCWSELIGYKCCAPNVTAIYASDEYGYWGYDFENNEWCG

SEQ ID NO: 3022 - protein, 22 aa, Anaeromyces robustus
  CBM_10
CWSQKYGYPCCQTCIVYHNDNE

SEQ ID NO: 3023 - protein, 34 aa, Anaeromyces robustus
  CBM_10
CWSQKYGYPCCQTCIVYHNDNEGSWGYEYNGWCG

SEQ ID NO: 3024 - protein, 39 aa, Anaeromyces robustus; identical to SEQ ID NO: 3021
  CBM_10

SEQ ID NO: 3025 - protein, 34 aa, Anaeromyces robustus
  CBM_10
KCWSEKIGYKCCTDAEIYLTDTFGHWSIEDGEWC

SEQ ID NO: 3026 - protein, 36 aa, Anaeromyces robustus
  CBM_10
SCFAEKLGYSCCISPSSAVLHEDKDGKWGIEYGKWC

SEQ ID NO: 3027 - protein, 37 aa, Anaeromyces robustus
  CBM_10
ECWSEKIGYKCCSSPNAVLQLTDIFGYWSVEEDEWCF

SEQ ID NO: 3028 - protein, 35 aa, Anaeromyces robustus
  CBM_10
CFSEKLGFPCCSDPSTVIVFVDESGEWGVENDGWC

SEQ ID NO: 3029 - protein, 35 aa, Anaeromyces robustus
  CBM_10
CFSEKLGFPCCSDPSTVVVFVDESSEWGVENDGWC

SEQ ID NO: 3030 - protein, 36 aa, Anaeromyces robustus
  CBM_10
ECWSKIIGYECCSSPNPHIYVTDILGHWSIENGDWC

SEQ ID NO: 3031 - protein, 34 aa, Anaeromyces robustus
  CBM_10
KCFSEPYFPCCKENKVVLVDEEGEWGIENKKWCG

SEQ ID NO: 3032 - protein, 35 aa, Anaeromyces robustus
  CBM_10
ECFSLSHGYKCCETCNVVEKGKEGDWGIENHKWCG

SEQ ID NO: 3033 - protein, 36 aa, Anaeromyces robustus
  CBM_10
ECWSEEQGYSCCQGCNILLVEEGQQKWGFENNKWCG

SEQ ID NO: 3034 - protein, 20 aa, Anaeromyces robustus
  CBM_10
KCWSMPLGYPCCVGNDVYKK

SEQ ID NO: 3035 - protein, 38 aa, Anaeromyces robustus
  CBM_10
SCSTSILNQGYSCCSSECIVVLTDSDGTWGYENNKWCG

SEQ ID NO: 3036 - protein, 30 aa, Anaeromyces robustus
  CBM_10
QGYKCCSDNCLVVYTDDDGTWGYENDKWCG

SEQ ID NO: 3037 - protein, 31 aa, Anaeromyces robustus
  CBM_10
KGYSCCSENNCKIRYVDEDGNWGAENGQWCG

SEQ ID NO: 3038 - protein, 34 aa, Anaeromyces robustus
  CBM_10
CWSNEYNYPCCKTCIVYEIDDKGSWGYENNEWCG

SEQ ID NO: 3039 - protein, 31 aa, Anaeromyces robustus
  CBM_10
AQGYKCCSSICKQPYVDENGEWGVEDGKWCG

SEQ ID NO: 3040 - protein, 36 aa, Anaeromyces robustus
  CBM_10
SCPSTITNKGYSCCSTCSKVRYVDEDGKWGVENHQW

SEQ ID NO: 3041 - protein, 37 aa, Anaeromyces robustus
  CBM_10
ECWAKEFGYNCCSKDNQNVIYTEEMYSWGYENDNWCG

SEQ ID NO: 3042 - protein, 37 aa, Anaeromyces robustus
  CBM_10
ECWAKEFGYNCCSKDNQNVIYTEDMYSWGYEKDEWCG

SEQ ID NO: 3043 - protein, 37 aa, Anaeromyces robustus
  CBM_10
ECWARESGYDCCSEDNQKVIYTDEMGSWGYENDNWCG

SEQ ID NO: 3044 - protein, 37 aa, Anaeromyces robustus
  CBM_10
CPFAITSQGYKCCSKDCFIVFTDDDGTWGIENDQWCG

SEQ ID NO: 3045 - protein, 18 aa, Anaeromyces robustus
  CBM_10
VFTDDDGTWGIENDQWCG

SEQ ID NO: 3046 - protein, 34 aa, Anaeromyces robustus
  CBM_10
CPGIKLGYSCCEKCNSLITNKDGSWSLENFKICS

SEQ ID NO: 3047 - protein, 24 aa, Anaeromyces robustus
  CBM_10
CFSINFGFPCCSSCVYYYEDDDGK

SEQ ID NO: 3048 - protein, 35 aa, Anaeromyces robustus
  CBM_10
SCWAQNQGYQCCTSCDIVYEDNDGSWGIENGDWCG

SEQ ID NO: 3049 - protein, 35 aa, Anaeromyces robustus
  CBM_10
SCTGIEDGYPCCKTCNAIYNDEQGPWEMENNKWCG

SEQ ID NO: 3050 - protein, 36 aa, Anaeromyces robustus
  CBM_10
ETGRAPNGYPYCKGCIVTATGGRNSYWGWENNASCF

SEQ ID NO: 3051 - protein, 36 aa, Anaeromyces robustus
  CBM_10
FADMAPNGFPYCEGCEIGATSSDGTIWGYENEQSCV

SEQ ID NO: 3052 - protein, 34 aa, Anaeromyces robustus
  CBM_10
NLAPNGYPYCKKCDITATGSGRSLWGWENNASCF

SEQ ID NO: 3053 - protein, 32 aa, Anaeromyces robustus
  CBM_10
APNGYPYCKGCIVTATGGRNSYWGWENNASCF

SEQ ID NO: 3054 - protein, 32 aa, Anaeromyces robustus
  CBM_10
APNGFPYCEGCEIGATSSDGTIWGYENEQSCV

SEQ ID NO: 3055 - protein, 32 aa, Anaeromyces robustus
  CBM_10
APNGYPYCKKCDITATGSGRSLWGWENNASCF

SEQ ID NO: 3056 - protein, 36 aa, Anaeromyces robustus
  CBM_10
ECFSVKLGYPCCTKTNEVIYTDEQGQWGVEDYHWCG

SEQ ID NO: 3057 - protein, 39 aa, Anaeromyces robustus
  CBM_10
ECWSLKLQPAYPCCYMRNKEVVSIDSNGKWSTEHGTWCG

SEQ ID NO: 3058 - protein, 24 aa, Anaeromyces robustus
  CBM_10
TCWSTRLGYPCCEDSNVVYAVDEN

SEQ ID NO: 3059 - protein, 36 aa, Anaeromyces robustus; identical to SEQ ID NO: 2351
  CBM_10

SEQ ID NO: 3060 - protein, 36 aa, Anaeromyces robustus
  CBM_10
SCFSIELGYPCCQTSCEVYYIDEDGDWGIEDNHWCG

SEQ ID NO: 3061 - protein, 35 aa, Anaeromyces robustus; identical to SEQ ID NO: 2465
  CBM_10

SEQ ID NO: 3062 - protein, 21 aa, Anaeromyces robustus
  CBM_10
CNVYYTDNDGEWGVENGNWCG

SEQ ID NO: 3063 - protein, 37 aa, Anaeromyces robustus
  CBM_10
SCWATKLGYKCCTAKCPEVSYVDQDGAWGIENGNWCG

SEQ ID NO: 3064 - protein, 33 aa, Anaeromyces robustus
  CBM_10
SEKLGYPCCSETTDVVSVDANGKWGLENGTICG

SEQ ID NO: 3065 - protein, 34 aa, Anaeromyces robustus
  CBM_10
QCFSFPNYLCCNECNVVLEDEEGKWGYENNRWCG

SEQ ID NO: 3066 - protein, 31 aa, Anaeromyces robustus
  CBM_10
ANAYNNCTHTCRVLVTEDGVEWGAENNDWCI

SEQ ID NO: 3067 - protein, 34 aa, Anaeromyces robustus; identical to SEQ ID NO: 3065
  CBM_10

SEQ ID NO: 3068 - protein, 31 aa, Anaeromyces robustus; identical to SEQ ID NO: 3066
  CBM_10

SEQ ID NO: 3069 - protein, 35 aa, Anaeromyces robustus
  CBM_10
CWSKVLGYPCCTVNTYVYYIDDNGMWGIENDNWCG

SEQ ID NO: 3070 - protein, 31 aa, Anaeromyces robustus
  CBM_10
KFLYNCCKNTCKLVAIQDKIQLGIENGEYCS

SEQ ID NO: 3071 - protein, 22 aa, Anaeromyces robustus
  CBM_10
ECFSVKLGYPCCTKTNEVIYTD

SEQ ID NO: 3072 - protein, 35 aa, Anaeromyces robustus
  CBM_10
TCWSKDYGYPCCKSCFVFEETEEGKWGYEDNHWCG

SEQ ID NO: 3073 - protein, 34 aa, Anaeromyces robustus; identical to SEQ ID NO: 2369
  CBM_10

SEQ ID NO: 3074 - protein, 19 aa, Anaeromyces robustus
  CBM_10
TVIFTDSNGQWGIENGNWC

SEQ ID NO: 3075 - protein, 30 aa, Anaeromyces robustus
  CBM_10
CWAKSLGYNCCSTSSCRTAQFSDADGQWDV

SEQ ID NO: 3076 - protein, 35 aa, Anaeromyces robustus; identical to SEQ ID NO: 2465
  CBM_10

SEQ ID NO: 3077 - protein, 30 aa, Anaeromyces robustus
  CBM_10
TCWALQYGYTCCEDDTIVYTDELGDWGVED

SEQ ID NO: 3078 - protein, 35 aa, Anaeromyces robustus
  CBM_10
CPFAITSQGYKCCKEDNCSVFETDDDGTWGIENDQ

SEQ ID NO: 3079 - protein, 20 aa, Anaeromyces robustus
  CBM_10
AVIYHDNDGDWGVENNQWCL

SEQ ID NO: 3080 - protein, 27 aa, Piromyces finnis
  CBM_10
CFAENLGYQCCSDPETIVITTDEYGEW

SEQ ID NO: 3081 - protein, 35 aa, Piromyces finnis
  CBM_10
CWSSKYGYGCCFNDNDDVIYRDEKGSWGIENNQWC

SEQ ID NO: 3082 - protein, 36 aa, Piromyces finnis
  CBM_10
KCWSEKLGFKCCRIDIQPIFSDYEGIWGVEDDQWCG

SEQ ID NO: 3083 - protein, 36 aa, Piromyces finnis
  CBM_10
CSFEVLGYHCCSSINPKVVKEDSYGKWGEEDGELCG

SEQ ID NO: 3084 - protein, 30 aa, Piromyces finnis
  CBM_10
SCWSEELGYPCCTSTTKVVYTDESGNWGVE

SEQ ID NO: 3085 - protein, 34 aa, Piromyces finnis
  CBM_10
SCWSEPEYPCCKESCTVYYVDDHQWGIENGEWCG

SEQ ID NO: 3086 - protein, 29 aa, Piromyces finnis
  CBM_10
CLSAADYPCCEQCNIVSEEEGDFWGVENN

SEQ ID NO: 3087 - protein, 32 aa, Piromyces finnis
  CBM_10
TKQGFPICKECIITATGSDGISLWGWENSESC

SEQ ID NO: 3088 - protein, 34 aa, Piromyces finnis
  CBM_10
CWSSYYGYSCCSHCNIFLTDELGDWGVENKKWCG

SEQ ID NO: 3089 - protein, 35 aa, Piromyces finnis
  CBM_10
SCWSEELGYSCCSHCTVLLKDESGLWGAEDGKWCG

SEQ ID NO: 3090 - protein, 33 aa, Piromyces finnis
  CBM_10
VKAQGYPCCKSCGQVVYVDEDGKWGVENNDWCG

SEQ ID NO: 3091 - protein, 31 aa, Piromyces finnis
  CBM_10
NQGYPCCSKETQVYYTDESGEWGVENNNWCG

SEQ ID NO: 3092 - protein, 37 aa, Piromyces finnis
  CBM_10
KCWATSLGYPCCKEANPIIFYKDEDGDWGIENNSWCG

SEQ ID NO: 3093 - protein, 30 aa, Piromyces finnis
  CBM_10
CESGEQYKCCKKCNIYVNELGQDWGIENND

SEQ ID NO: 3094 - protein, 29 aa, Piromyces finnis
  CBM_10
EGYDCCEGCTIETEEDGIKWGYENRNWCV

SEQ ID NO: 3095 - protein, 32 aa, Piromyces finnis
  CBM_10
STRFGFPCCNTCELQYIDDFGNWGFENDNWCG

SEQ ID NO: 3096 - protein, 30 aa, Piromyces finnis
  CBM_10
KLGYRCCDSCEIKFIDENIKYGYENGEWCG

SEQ ID NO: 3097 - protein, 35 aa, Piromyces finnis
  CBM_10
CFSVKMGYPCCTQNSEIVYTDSTGSWGLQNGDWCG

SEQ ID NO: 3098 - protein, 35 aa, Piromyces finnis
  CBM_10
SCFSKDLGFPCCSKYAEVVTKDYNGSWGIENGKWC

SEQ ID NO: 3099 - protein, 37 aa, Piromyces finnis
  CBM_10
SCFSKALGYPCCSVGNSDVAFIDNNGKWGIENGNWCG

SEQ ID NO: 3100 - protein, 36 aa, Piromyces finnis
  CBM_10
ECWSEQYNFPCCSPGVKIDFTDNRGSWGLENYSWCG

SEQ ID NO: 3101 - protein, 34 aa, Piromyces finnis
  CBM_10
ECAKNKNNLPCCSTCEIALIDGSGRYGYENGQWC

SEQ ID NO: 3102 - protein, 34 aa, Piromyces finnis
  CBM_10
CWSRAIGFVCCDKCNVLFVDEQGKWSVEDGYWCG

SEQ ID NO: 3103 - protein, 32 aa, Piromyces finnis
  CBM_10
KCFSENLGYSCCEECNVVYTDNDGKWGYENNE

SEQ ID NO: 3104 - protein, 35 aa, Piromyces finnis
  CBM_10
KCFSEVLGYPCCNECSIIYSDADGDWGYENGMWCG

SEQ ID NO: 3105 - protein, 35 aa, Piromyces finnis
  CBM_10
ECWSEKFGIPCCKEALMPLRTTYDGGWSQENGEWC

SEQ ID NO: 3106 - protein, 32 aa, Piromyces finnis
  CBM_10
GTSYSCCIFDDTLIITSDSTGNWGFEGDRWCL

SEQ ID NO: 3107 - protein, 39 aa, Piromyces finnis
  CBM_10
ECWAKAQGYNCCEKRTTAVTYVDKKTGEEWGYEGGKWCG

SEQ ID NO: 3108 - protein, 33 aa, Piromyces finnis
  CBM_10
FSDEYACCKGCDVVSVTSNGNSKWGVENKKWCS

SEQ ID NO: 3109 - protein, 35 aa, Piromyces finnis
  CBM_10
CFSLKLGYPCCSTTTTVVTSDSDGDWGIENNSWCG

SEQ ID NO: 3110 - protein, 35 aa, Piromyces finnis
  CBM_10
ECWSLKQGYSCCRGCKVQTKDEYGKWGIENNEWSG

SEQ ID NO: 3111 - protein, 33 aa, Piromyces finnis
  CBM_10
CFSFPEYMCCEGCEVVEETAEGKWGIEKNNWCG

SEQ ID NO: 3112 - protein, 35 aa, Piromyces finnis
  CBM_10
CWSEPLGFPCCSECVEPERVDDNGEWGIENNEWCG

SEQ ID NO: 3113 - protein, 32 aa, Piromyces finnis
  CBM_10
SQGYKCCKSGCQVVYQDADGDWGVNSQGYWCG

SEQ ID NO: 3114 - protein, 38 aa, Piromyces finnis
  CBM_10
CWSEELGYRCCNNGESIVEYIDESGWWGVTKDTKEWCG

SEQ ID NO: 3115 - protein, 24 aa, Piromyces finnis
  CBM_10
SCWSLALGYSCCKSCIGTVYTDES

SEQ ID NO: 3116 - protein, 16 aa, Piromyces finnis
  CBM_10
TDESGNWGIEKDDWCG

SEQ ID NO: 3117 - protein, 33 aa, Piromyces finnis
  CBM_10
CGAQGYSCCKSSCTVYFEDSDGKWSIENDDWCL

SEQ ID NO: 3118 - protein, 33 aa, Piromyces finnis
  CBM_10
CFSFPDYSCCEGCEVIEETEEGKWGIENYAWCG

SEQ ID NO: 3119 - protein, 31 aa, Piromyces finnis
  CBM_10
CPASITKQGYKCCKAGCEVIYTDADGDWGVE

SEQ ID NO: 3120 - protein, 28 aa, Piromyces finnis
  CBM_10
ACWADAIGYPCCKGCDVITTDDDGDWGV

SEQ ID NO: 3121 - protein, 27 aa, Piromyces finnis
  CBM_10
YDVCEGCEVLVTDLEGKWGAQDGKWCH

SEQ ID NO: 3122 - protein, 28 aa, Piromyces finnis
  CBM_10
YYECCTGCKPIVADDEGRWGAQNGEWCL

SEQ ID NO: 3123 - protein, 27 aa, Piromyces finnis
  CBM_10
KSGYKCCSASCEVIYTDSDGTWGVENN

SEQ ID NO: 3124 - protein, 36 aa, Piromyces finnis
  CBM_10
RCNINSTPYSWCKGCVVTEYGGDGAAFGWENEQSCL

SEQ ID NO: 3125 - protein, 36 aa, Piromyces finnis
  CBM_10
IVSNVEAAYPKCSDCIVFATGKDGSLWGWENESFCR

SEQ ID NO: 3126 - protein, 34 aa, Piromyces finnis
  CBM_10
QTNARGQMICNACTVTATGGDNSLWGYEDDKSCV

SEQ ID NO: 3127 - protein, 30 aa, Piromyces finnis
  CBM_10
SGNLICNGCNVTETGGDQSLWGYEDNASCI

SEQ ID NO: 3128 - protein, 28 aa, Piromyces finnis
  CBM_10
AYPKCSDCIVFATGKDGSLWGWENESFC

SEQ ID NO: 3129 - protein, 36 aa, Piromyces finnis; identical to SEQ ID NO: 3125
  CBM_10

SEQ ID NO: 3130 - protein, 36 aa, Piromyces finnis; identical to SEQ ID NO: 3124
  CBM_10

SEQ ID NO: 3131 - protein, 30 aa, Piromyces finnis; identical to SEQ ID NO: 3127
  CBM_10

SEQ ID NO: 3132 - protein, 34 aa, Piromyces finnis; identical to SEQ ID NO: 3126
  CBM_10

SEQ ID NO: 3133 - protein, 28 aa, Piromyces finnis
  CBM_10
AYPKCSDCIVFATGKDGSLWGWENESFC

SEQ ID NO: 3134 - protein, 31 aa, Piromyces finnis
  CBM_10
KKLGYPCCKYCTIIESDSYGDYGVENNAWCS

SEQ ID NO: 3135 - protein, 35 aa, Piromyces finnis
  CBM_10
SCWSESLGYPCCHHQDIIYTDESGPWGLENNQWCG

SEQ ID NO: 3136 - protein, 31 aa, Piromyces finnis
  CBM_10
INGYPCCKTNKTVVFTDEYGKWSVENNDWCL

SEQ ID NO: 3137 - protein, 37 aa, Piromyces finnis
  CBM_10
SCSSKITQQGYKCCSKNCVVYYTDSDGNWGYENDWCG

SEQ ID NO: 3138 - protein, 37 aa, Piromyces finnis; identical to SEQ ID NO: 3137
  CBM_10

SEQ ID NO: 3139 - protein, 31 aa, Piromyces finnis; identical to SEQ ID NO: 3136
  CBM_10

SEQ ID NO: 3140 - protein, 24 aa, Piromyces finnis
  CBM_10
TYPYCKTTSDVVYTDTMEWGVENN

SEQ ID NO: 3141 - protein, 35 aa, Piromyces finnis
  CBM_10
KCWSEALGYKCCKKCNALYRDSNGLWGIENFKRCG

SEQ ID NO: 3142 - protein, 38 aa, Piromyces finnis
  CBM_10
KCMSELKGYPCCSKEISIVLKHDQYGDWGYDFKKGKWC

SEQ ID NO: 3143 - protein, 35 aa, Piromyces finnis; identical to SEQ ID NO: 3141
  CBM_10

SEQ ID NO: 3144 - protein, 38 aa, Piromyces finnis; identical to SEQ ID NO: 3142
  CBM_10

SEQ ID NO: 3145 - protein, 40 aa, Piromyces finnis
  CBM_10
TCWVSVHGYPCCEGESLEKVYAEDVDGKWGYDFVKKTWCG

SEQ ID NO: 3146 - protein, 34 aa, Piromyces finnis
  CBM_10
CWSLKEGYNCCIGCAVYAITDEGSWGVENGKWCG

SEQ ID NO: 3147 - protein, 42 aa, Piromyces finnis
  CBM_10
KCWSESLGFPCCSDENTIIVESDGDGDWGIELNSNNEWEWCG

SEQ ID NO: 3148 - protein, 41 aa, Piromyces finnis
  CBM_10
KCWSLSQGYPCCDPDAETIYSDESGDWGLALNSNNELDWCG

SEQ ID NO: 3149 - protein, 31 aa, Piromyces finnis
  CBM_10
CWATLINLSYKCCSPNASYYSVDQDGEWGVE

SEQ ID NO: 3150 - protein, 35 aa, Piromyces finnis
  CBM_10
CYSKGSGFPCCKKNTKIIYMDGEGDWGVNNGEWCI

SEQ ID NO: 3151 - protein, 23 aa, Piromyces finnis
  CBM_10
SCFSEALGYECCKGCTVITTDES

SEQ ID NO: 3152 - protein, 35 aa, Piromyces finnis
  CBM_10
SCFATKLGYPCCKNNQIVYTDSDGDWGFENNEWCG

SEQ ID NO: 3153 - protein, 35 aa, Piromyces finnis; identical to SEQ ID NO: 3152
  CBM_10

SEQ ID NO: 3154 - protein, 35 aa, Piromyces finnis; identical to SEQ ID NO: 3152
  CBM_10

SEQ ID NO: 3155 - protein, 36 aa, Piromyces finnis
  CBM_10
CWAESLGYPCCKEKTPNVEYVDESGSWGIENDIWCG

SEQ ID NO: 3156 - protein, 35 aa, Piromyces finnis
  CBM_10
KCWAEAQGYPCCEITKEVVYVDDYLWGIENEEWCG

SEQ ID NO: 3157 - protein, 34 aa, Piromyces finnis
  CBM_10
DCWSERLGYKCCSYSTEVIYTDNDGKWSIENNEW

SEQ ID NO: 3158 - protein, 35 aa, Piromyces finnis
  CBM_10
ECWSSVFGYECCENCNVIESDEHGDWGVKNGEWCG

SEQ ID NO: 3159 - protein, 36 aa, Piromyces finnis
  CBM_10
CWSEALGYKCCSSGCNSIVIFTDENGSWSAENNEWC

SEQ ID NO: 3160 - protein, 20 aa, Piromyces finnis
  CBM_10
RLGYLCCSLPCTVIYTDDDG

SEQ ID NO: 3161 - protein, 16 aa, Piromyces finnis
  CBM_10
TDDDGDWAFQNNEWCG

SEQ ID NO: 3162 - protein, 26 aa, Piromyces finnis
  CBM_10
KCWSTEFGFPCCKGNTIVFTDENGDW

SEQ ID NO: 3163 - protein, 34 aa, Piromyces finnis
  CBM_10
ECFSINLGYPCCSTCTLYFENSIGRWGIENNEWC

SEQ ID NO: 3164 - protein, 35 aa, Piromyces finnis
  CBM_10
SCWAEEQGYQCCSDCDVIYEDNNGLWGIENGTWCG

SEQ ID NO: 3165 - protein, 36 aa, Piromyces finnis
  CBM_10
SCFAKSMGYACCSVGTEVVYTDNDGQWGIENGQWCG

SEQ ID NO: 3166 - protein, 22 aa, Piromyces finnis
  CBM_10
GDYACCSGCESVYVDNDGKWGV

SEQ ID NO: 3167 - protein, 32 aa, Piromyces finnis
  CBM_10
QCFAIKLGYSCCQQTTKVVYEDSDGEWGVENG

SEQ ID NO: 3168 - protein, 38 aa, Piromyces finnis
  CBM_10
KCWSELLGSPCCPPKVTIVYSHDEYGDWGYDFKRKEWC

SEQ ID NO: 3169 - protein, 31 aa, Piromyces finnis
  CBM_10
ELGYKCCSSFIKIDHTDKIGTWGYENGELCG

SEQ ID NO: 3170 - protein, 33 aa, Piromyces finnis
  CBM_10
CFSFPEYLCCDGCNVVEETAEGKWGVENNKWCG

SEQ ID NO: 3171 - protein, 21 aa, Piromyces finnis
  CBM_10
CGVVLEEDGIKWGVENNDWCI

SEQ ID NO: 3172 - protein, 39 aa, Piromyces finnis
  CBM_10
QCWSENIGYPCCQNKDTKVTYHSKSLNKDYGTENGEWCG

SEQ ID NO: 3173 - protein, 32 aa, Piromyces finnis
  CBM_10
AGTSYNCCKIPANVDTVDDVGYWAIQNGQWCF

SEQ ID NO: 3174 - protein, 33 aa, Piromyces finnis
  CBM_10
CPKGGSKYKCCETCKVSYTDSTKWGVEHGKWCS

SEQ ID NO: 3175 - protein, 30 aa, Piromyces finnis
  CBM_10
CHSSGYDCCLSTKAIVTSDVVGDWGIENND

SEQ ID NO: 3176 - protein, 32 aa, Piromyces finnis
  CBM_10
CPSYGIYQCCQSCDIVFTDTEDWGFENGNWCS

SEQ ID NO: 3177 - protein, 40 aa, Piromyces finnis
  CBM_10
CWSLSYGTGYPCCKDKNTKVNYVSKSTGKEWGVENGNWCG

SEQ ID NO: 3178 - protein, 32 aa, Piromyces finnis
  CBM_10
CSQSILNQGYSCCSSGCEVIYTDSDGTWGVEN

SEQ ID NO: 3179 - protein, 36 aa, Piromyces finnis
  CBM_10
ACWSERLGYRCCSFTNDVILEDSDGKWGVENNDWCG

SEQ ID NO: 3180 - protein, 36 aa, Piromyces finnis
  CBM_10
TCWSSSLGYPCCTNTNEVIYEDSDGKWGIENNNWCG

SEQ ID NO: 3181 - protein, 28 aa, Piromyces finnis
  CBM_10
CVALYLGYPCCSPDNTYVVYQDESGDWG

SEQ ID NO: 3182 - protein, 29 aa, Piromyces finnis
  CBM_10
TCFSIKFGYNCCNECNVYYTDNDGKWGVE

SEQ ID NO: 3183 - protein, 40 aa, Piromyces finnis
  CBM_10
CWASSLGYKCCTKTTKVEYVDANGEWGAERDEFGVRNWCG

SEQ ID NO: 3184 - protein, 38 aa, Piromyces finnis
  CBM_10
CWSENLPDPYPCCSSDQVQRIDSTYDGDWGKENGKKCG

SEQ ID NO: 3185 - protein, 35 aa, Piromyces finnis
  CBM_10
ACWSEKFNIPCCQTTKEVVRTTYDGIWGMENGEWC

SEQ ID NO: 3186 - protein, 30 aa, Piromyces finnis
  CBM_10
CSFLPDYPCCQPGAEVVYVDETGNWGVENG

SEQ ID NO: 3187 - protein, 29 aa, Piromyces finnis
  CBM_10
SSKDGYPVCKTTTTVVYTDSEKWGVENGN

SEQ ID NO: 3188 - protein, 35 aa, Piromyces finnis
  CBM_10
SCFSVALGYPCCSGNNVVYSDSDGKWGFENNSWCG

SEQ ID NO: 3189 - protein, 35 aa, Piromyces finnis
  CBM_10
SCFSIKLGYPCCNSNIVYYVDNDGQWGFENNNWCG

SEQ ID NO: 3190 - protein, 35 aa, Piromyces finnis
  CBM_10
TCTGKDQGYQCCNSCSVYYVDNDGRWGIENGEWCG

SEQ ID NO: 3191 - protein, 36 aa, Piromyces finnis
  CBM_10
QCYGATTGKYPCCQGCIVVTTDKNGRWGVENNAWCS

SEQ ID NO: 3192 - protein, 35 aa, Piromyces finnis
  CBM_10
ECWSEKLGYTCCQGCKVYEKDSDGSWGYELNQWCG

SEQ ID NO: 3193 - protein, 30 aa, Piromyces finnis
  CBM_10
SEYSCCSSCIDIVEQDDDSSWGIENGQWCS

SEQ ID NO: 3194 - protein, 27 aa, Piromyces finnis
  CBM_10
FDCCPDGTEVAYVDEYGEWGIINGEWC

SEQ ID NO: 3195 - protein, 35 aa, Piromyces finnis
  CBM_10
ECFSLALGHPCCDSCDVVSTDENGLWGVKDNDWCG

SEQ ID NO: 3196 - protein, 31 aa, Piromyces finnis
  CBM_10
CVGLNLGYPCCSSCNIAYSDETGNWGIENNE

SEQ ID NO: 3197 - protein, 36 aa, Piromyces finnis
  CBM_10
ECFSTKLGYKCCSSCTDVIYIDNDGQWGLENDNWCG

SEQ ID NO: 3198 - protein, 35 aa, Piromyces finnis
  CBM_10
SCFSMALGFSCCEGNKIVYTDDDGDWGYENGEWCG

SEQ ID NO: 3199 - protein, 30 aa, Piromyces finnis
  CBM_10
CFSIALGFPCCKGNDIVYTDNDGPWGVENG

SEQ ID NO: 3200 - protein, 36 aa, Piromyces finnis
  CBM_10
ECWASEQGYDCCESCNVVFVEENGQKWGVENNQWCG

SEQ ID NO: 3201 - protein, 29 aa, Piromyces finnis
  CBM_10
GYECCFDNEVVYEDESGKWGINEKGEWCG

SEQ ID NO: 3202 - protein, 29 aa, Piromyces finnis
  CBM_10
YPCCQNTNFSYYTDSAGNEWGIENNNWCG

SEQ ID NO: 3203 - protein, 37 aa, Piromyces finnis
  CBM_10
CSSKITKQGYKCCSKGCEIYYVDADGDWGFESGDWCG

SEQ ID NO: 3204 - protein, 31 aa, Piromyces finnis
  CBM_10
SCPSKITSQGYKCCKDNCIIYYTDADGDWGV

SEQ ID NO: 3205 - protein, 36 aa, Piromyces finnis
  CBM_10
CFSEVLGYPCCSDPNADVVTTDEYGQWGIENNLWCG

SEQ ID NO: 3206 - protein, 32 aa, Piromyces finnis
  CBM_10
ELGYKCCYDQNTKVEYIDEFGNWGIENGKLCG

SEQ ID NO: 3207 - protein, 35 aa, Piromyces finnis
  CBM_10
ECHSKAGYPCCSPEITEVIYTDDEGNWGSENNNWC

SEQ ID NO: 3208 - protein, 32 aa, Piromyces finnis
  CBM_10
DGYPCCSSVNPEVQYTDDNGNKWGVEDGEWCG

SEQ ID NO: 3209 - protein, 36 aa, Piromyces finnis; identical to SEQ ID NO: 3205
  CBM_10

SEQ ID NO: 3210 - protein, 35 aa, Piromyces finnis; identical to SEQ ID NO: 3207
  CBM_10

SEQ ID NO: 3211 - protein, 32 aa, Piromyces finnis; identical to SEQ ID NO: 3208
  CBM_10

SEQ ID NO: 3212 - protein, 32 aa, Piromyces finnis; identical to SEQ ID NO: 3206
  CBM_10

SEQ ID NO: 3213 - protein, 34 aa, Piromyces finnis
  CBM_10
CWAKSLGYKCCASKCAEVYSTDASGKWSIENNEW

SEQ ID NO: 3214 - protein, 36 aa, Piromyces finnis
  CBM_10
TCFSTSMGYPCCKDTSRVVTTDCDGKWGVENGEWCG

SEQ ID NO: 3215 - protein, 36 aa, Piromyces finnis; identical to SEQ ID NO: 3214
  CBM_10

SEQ ID NO: 3216 - protein, 34 aa, Piromyces finnis; identical to SEQ ID NO: 3213
  CBM_10

SEQ ID NO: 3217 - protein, 32 aa, Piromyces finnis
  CBM_10
EKGYKCCSNNHCRSKYEDEDGIWSIENGEWCG

SEQ ID NO: 3218 - protein, 22 aa, Piromyces finnis
  CBM_10
GYKCCSDNCEVTHSDENGDWGY

SEQ ID NO: 3219 - protein, 28 aa, Piromyces finnis
  CBM_10
CWSDVLGYSCCSKCLEAVYEDQDGKWGV

SEQ ID NO: 3220 - protein, 37 aa, Piromyces finnis
  CBM_10
ECWSKKFGYDCCVLPETRAIYSDANGKYGVEFKQKCG

SEQ ID NO: 3221 - protein, 36 aa, Piromyces finnis
  CBM_10
CDNGGLDYECCSSLNVKLQSIDADAKWGFENGKWCI

SEQ ID NO: 3222 - protein, 31 aa, Piromyces finnis
  CBM_10
GFNYPCCVKTEKGTYSDGDGDWAQENGDWCT

SEQ ID NO: 3223 - protein, 30 aa, Piromyces finnis
  CBM_10
SCWSKALGYPCCSTCTTVIDSDSDGDWGIE

SEQ ID NO: 3224 - protein, 13 aa, Piromyces finnis
  CBM_10
DGKWSVENGDWCL

SEQ ID NO: 3225 - protein, 29 aa, Piromyces finnis
  CBM_10
SCKFEALGYSCCSNCGPVYFTDSDGKWGV

SEQ ID NO: 3226 - protein, 31 aa, Piromyces finnis
  CBM_10
CHPSYPCCNGCDVTYVDNEGEWGVQNNNWCF

SEQ ID NO: 3227 - protein, 29 aa, Piromyces finnis
  CBM_10
CFSETLGYSCCENTTEVVHVDENGEWGIE

SEQ ID NO: 3228 - protein, 36 aa, Piromyces finnis
  CBM_10
ECFSLKFGVPCCKQTKDVVYVDSNGEWGVENNNWCG

SEQ ID NO: 3229 - protein, 39 aa, Piromyces finnis
  CBM_10
ECWVAQFGYPCCAKNNKIVYDVDADGEWGYNFKTKEWCG

SEQ ID NO: 3230 - protein, 37 aa, Piromyces finnis
  CBM_10
KCWSEDFGYPCCKGCIVYEEDEHGQWGYDFTEATWCG

SEQ ID NO: 3231 - protein, 32 aa, Piromyces finnis
  CBM_10
QCHPNYECCNGCDVVYTDAEGKWGVENNNWCI

SEQ ID NO: 3232 - protein, 31 aa, Piromyces finnis
  CBM_10
NPTQYPWCNGCKVYYTDAEGNWGVENNDWCL

SEQ ID NO: 3233 - protein, 32 aa, Piromyces finnis; identical to SEQ ID NO: 3231
  CBM_10

SEQ ID NO: 3234 - protein, 31 aa, Piromyces finnis; identical to SEQ ID NO: 3232
  CBM_10

SEQ ID NO: 3235 - protein, 28 aa, Piromyces finnis
  CBM_10
SCWSLPDYPCCSTCDVVYTDDHNWGVEN

SEQ ID NO: 3236 - protein, 34 aa, Piromyces finnis
  CBM_10
ECWAQEQGFPCCREATEVLYSENGNNWSMENGEW

SEQ ID NO: 3237 - protein, 35 aa, Piromyces finnis
  CBM_10
ECPGIKYGYECCEKCDVVETDELGQWGAINGEWCS

SEQ ID NO: 3238 - protein, 35 aa, Piromyces finnis
  CBM_10
SCWSQGLGFQCCSGCNVEYVDSDGEWGLENGEWCG

SEQ ID NO: 3239 - protein, 34 aa, Piromyces finnis
  CBM_10
ECPGKKYGYPCCEKCDVFLTDKDGAWGVQNSNWC

SEQ ID NO: 3240 - protein, 34 aa, Piromyces finnis; identical to SEQ ID NO: 3239
  CBM_10

SEQ ID NO: 3241 - protein, 35 aa, Piromyces finnis; identical to SEQ ID NO: 3238
  CBM_10

SEQ ID NO: 3242 - protein, 37 aa, Piromyces finnis
  CBM_10
ECWSEVFGYKCCSKGCNSKVYLIDEAGYWGAENGEWC

SEQ ID NO: 3243 - protein, 36 aa, Piromyces finnis
  CBM_10
TCWSLSLGYNCCSAGAEVILVDENGEWGFEMNEWCG

SEQ ID NO: 3244 - protein, 30 aa, Piromyces finnis
  CBM_10
SCWSEKLGYRCCKSSYPVYYTDADGQWGIE

SEQ ID NO: 3245 - protein, 33 aa, Piromyces finnis
  CBM_10
CKSGGGEYKCCKGCQIIYTDNEDWGVENDNWCS

SEQ ID NO: 3246 - protein, 37 aa, Piromyces finnis
  CBM_10
CWSTNLGFPCCQLKTTKVQYGDNTNSQFGIENGQLCG

SEQ ID NO: 3247 - protein, 35 aa, Piromyces finnis
  CBM_10
CWSRKLGYPCCSEGALVVNVDENGKWGIDKDNWCG

SEQ ID NO: 3248 - protein, 37 aa, Piromyces finnis
  CBM_10
ECWSLERGYPCCETNTEVFYTSSNGKTWSIENNDWCG

SEQ ID NO: 3249 - protein, 32 aa, Piromyces finnis
  CBM_10
NTGYPCCSDPKASIITNDISGDWGIEGNTWCL

SEQ ID NO: 3250 - protein, 25 aa, Piromyces finnis
  CBM_10
SYCGGCDVTATGDDGSYWGWENGKS

SEQ ID NO: 3251 - protein, 25 aa, Piromyces finnis
  CBM_10
YCRKCDVTATGDDGSYWGWENGTSC

SEQ ID NO: 3252 - protein, 28 aa, Piromyces finnis
  CBM_10
AYSDCKNCRVVTVEDGVSWGVENNDWCV

SEQ ID NO: 3253 - protein, 27 aa, Piromyces finnis
  CBM_10
QCFSYPDYPCCSGCDAIYEDDDGKWGV

SEQ ID NO: 3254 - protein, 36 aa, Piromyces finnis
  CBM_10
SCWASSEGYKCCQNTCDAIYSEGSKKWGFENGDWCG

SEQ ID NO: 3255 - protein, 31 aa, Piromyces finnis
  CBM_10
SCWAAAEGYACCSSGTPVTLTDSKGKWGIEN

SEQ ID NO: 3256 - protein, 33 aa, Piromyces finnis
  CBM_10
SFKNQGYSCCKGCSVVDTDATGDWGVENGQWCG

SEQ ID NO: 3257 - protein, 33 aa, Piromyces finnis; identical to SEQ ID NO: 3256
  CBM_10

SEQ ID NO: 3258 - protein, 36 aa, Piromyces finnis
  CBM_10
PKAITNQGYKCCSGCSYVYYEDQDGKWGVENNDWCG

SEQ ID NO: 3259 - protein, 35 aa, Piromyces finnis
  CBM_10
CWSLAEGYKCCSEGTPVVLTDSKGKWGIENNDWCG

SEQ ID NO: 3260 - protein, 32 aa, Piromyces finnis
  CBM_10
SCWAASEGYKCCSGCEAIFTDGEKKWGVENGQ

SEQ ID NO: 3261 - protein, 30 aa, Piromyces finnis
  CBM_10
HASKQGYPCCKSCTVAFVDGNEKWGVENND

SEQ ID NO: 3262 - protein, 34 aa, Piromyces finnis
  CBM_10
CWANAEGYNCCKSTTQVVLTDSKGKWGIENNQWC

SEQ ID NO: 3263 - protein, 27 aa, Piromyces finnis
  CBM_10
YKCCKNCNVVLDDNTGKWGVENNQWCG

SEQ ID NO: 3264 - protein, 36 aa, Piromyces finnis
  CBM_10
CWAEALGYKCCSAGNYMVLLTDESGAWGAENGEWCG

SEQ ID NO: 3265 - protein, 35 aa, Piromyces finnis
  CBM_10
CFAKSDGYECCFDNEVVYEDESGKWGINEKGEWCG

SEQ ID NO: 3266 - protein, 27 aa, Piromyces finnis
  CBM_10
TCWSRPLGYECCETCSYIVLSDADGDW

SEQ ID NO: 3267 - protein, 36 aa, Piromyces finnis; identical to SEQ ID NO: 3264
  CBM_10

SEQ ID NO: 3268 - protein, 35 aa, Piromyces finnis; identical to SEQ ID NO: 3265
  CBM_10

SEQ ID NO: 3269 - protein, 27 aa, Piromyces finnis
  CBM_10
TCWSRPLGYECCETCSYIVLSDADGDW

SEQ ID NO: 3270 - protein, 34 aa, Piromyces finnis
  CBM_10
SCSFESIGYSCCKLNCDVIYTDESGDWSVENDEW

SEQ ID NO: 3271 - protein, 34 aa, Piromyces finnis
  CBM_10
CWSLPDYQCCADGTEVIYTDESGDWGVINDEWCG

SEQ ID NO: 3272 - protein, 34 aa, Piromyces finnis
  CBM_10
SCWSLPDYPCCEGDTVIYSDESGDWGVENDEWCG

SEQ ID NO: 3273 - protein, 34 aa, Piromyces finnis
  CBM_10
CFSTSMGYPCCSGCEDIYEDDDGKWGVENDDWCG

SEQ ID NO: 3274 - protein, 34 aa, Piromyces finnis
  CBM_10
CWAEALGYECCSTCQPSQYKDESGEWGVENGEWC

SEQ ID NO: 3275 - protein, 19 aa, Piromyces finnis
  CBM_10
AIFTDGEKKWGVENGQWCG

SEQ ID NO: 3276 - protein, 36 aa, Piromyces finnis
  CBM_10
SCWANALNYPCCKTTTEVVLTDNDGKWGIENNEWCG

SEQ ID NO: 3277 - protein, 19 aa, Piromyces finnis
  CBM_10
AIFTDGEKKWGVENGQWCG

SEQ ID NO: 3278 - protein, 29 aa, Piromyces finnis
  CBM_10
ALGYPCCQSTSSVVFTDNTGKWGIENNDW

SEQ ID NO: 3279 - protein, 36 aa, Piromyces finnis; identical to SEQ ID NO: 3276
  CBM_10

SEQ ID NO: 3280 - protein, 33 aa, Piromyces finnis
  CBM_10
CLSAADYPCCEQCNIVSEEEGDFWGVENNEWCS

SEQ ID NO: 3281 - protein, 34 aa, Piromyces finnis; identical to SEQ ID NO: 3085
  CBM_10

SEQ ID NO: 3282 - protein, 33 aa, Piromyces finnis; identical to SEQ ID NO: 3280
  CBM_10

SEQ ID NO: 3283 - protein, 34 aa, Piromyces finnis
  CBM_10
CWANKLGYDCCKTSKEVYEDVEGKWGVENGNWCG

SEQ ID NO: 3284 - protein, 34 aa, Piromyces finnis; identical to SEQ ID NO: 3085
  CBM_10

SEQ ID NO: 3285 - protein, 35 aa, Piromyces finnis
  CBM_10
KCWSIPFGYKCCDHCKVLLTDESGKWGELNGEWCG

SEQ ID NO: 3286 - protein, 37 aa, Piromyces finnis
  CBM_10
ECWSLKYGYECCSPNNTRVVVTDESGKWGVENSDWCG

SEQ ID NO: 3287 - protein, 34 aa, Piromyces finnis; identical to SEQ ID NO: 3283
  CBM_10

SEQ ID NO: 3288 - protein, 35 aa, Piromyces finnis; identical to SEQ ID NO: 3285
  CBM_10

SEQ ID NO: 3289 - protein, 37 aa, Piromyces finnis; identical to SEQ ID NO: 3286
  CBM_10

SEQ ID NO: 3290 - protein, 33 aa, Piromyces finnis; identical to SEQ ID NO: 3280
  CBM_10

SEQ ID NO: 3291 - protein, 34 aa, Piromyces finnis; identical to SEQ ID NO: 3085
  CBM_10

SEQ ID NO: 3292 - protein, 33 aa, Piromyces finnis
  CBM_10
CSAAILAQGYKCCSSNCQITYVDESGTWGVENG

SEQ ID NO: 3293 - protein, 33 aa, Piromyces finnis; identical to SEQ ID NO: 3292
  CBM_10

SEQ ID NO: 3294 - protein, 32 aa, Piromyces finnis
  CBM_10
SQGYSCCAGNNCSVVLTDESGRWGVENNQWCG

SEQ ID NO: 3295 - protein, 38 aa, Piromyces finnis
  CBM_10
CSANILKQGYKCCSSTNCTIVFTDNDGTWGVENNQWCG

SEQ ID NO: 3296 - protein, 33 aa, Piromyces finnis
  CBM_10
CFSFPEYLCCDGCNVVEETAEGKWGIENNYWCG

SEQ ID NO: 3297 - protein, 29 aa, Piromyces finnis
  CBM_10
KAYDYCNACGVVLEEDGVKWGVENNDWCI

SEQ ID NO: 3298 - protein, 27 aa, Piromyces finnis
  CBM_10
GAPICNGCNVTYTSDDASLWGWENNTS

SEQ ID NO: 3299 - protein, 35 aa, Piromyces finnis
  CBM_10
ECWTSPLGYECCDSCDVIYEDNNGQWGVKNNKWCG

SEQ ID NO: 3300 - protein, 39 aa, Piromyces finnis
  CBM_10
KCEAEEYGYICCPNYLTEVLYQDEEGDWAYDYVMEDWCI

SEQ ID NO: 3301 - protein, 39 aa, Piromyces finnis
  CBM_10
KCWAEFIGYQCCSAENTDVYLHDSNGDWGYDFDTNEWCG

SEQ ID NO: 3302 - protein, 37 aa, Piromyces finnis
  CBM_10
ECWSEELGYPCCKDCTVYETDESGEWGYDFKNMQWCG

SEQ ID NO: 3303 - protein, 35 aa, Piromyces finnis
  CBM_10
SCWAQSQGYSCCSNPGSTKVEFTDASGNWGIENGN

SEQ ID NO: 3304 - protein, 35 aa, Piromyces finnis; identical to SEQ ID NO: 3303
  CBM_10

SEQ ID NO: 3305 - protein, 25 aa, Piromyces finnis
  CBM_10
CFSYPAYPCCKGNTVVYTDNEGSWG

SEQ ID NO: 3306 - protein, 25 aa, Piromyces finnis
  CBM_10
CFSYPAYPCCKGNTVVYTDNEGSWG

SEQ ID NO: 3307 - protein, 37 aa, Piromyces finnis
  CBM_10
ECWAEKLGYKCCPDDVCTTLHSDANGEWSIVNDEWCG

SEQ ID NO: 3308 - protein, 37 aa, Piromyces finnis
  CBM_10
ECWAKKLNYPCCKKDNCMKFYVNDDGAWGFENWKWCG

SEQ ID NO: 3309 - protein, 37 aa, Piromyces finnis; identical to SEQ ID NO: 3307
  CBM_10

SEQ ID NO: 3310 - protein, 37 aa, Piromyces finnis; identical to SEQ ID NO: 3308
  CBM_10

SEQ ID NO: 3311 - protein, 37 aa, Piromyces finnis
  CBM_10
QCWSKPLGYDCCVDPYIQIAYSDDDGDWGYENDEWCG

SEQ ID NO: 3312 - protein, 37 aa, Piromyces finnis; identical to SEQ ID NO: 3311
  CBM_10

SEQ ID NO: 3313 - protein, 35 aa, Piromyces finnis
  CBM_10
SCWSEKLGYKCCKSCDIILKDASGKWGVEDGKWCG

SEQ ID NO: 3314 - protein, 38 aa, Piromyces finnis
  CBM_10
CTSNCMGVGGYPCCKRSCIVVEENASGKWSLEKHDWCL

SEQ ID NO: 3315 - protein, 37 aa, Piromyces finnis; identical to SEQ ID NO: 3308
  CBM_10

SEQ ID NO: 3316 - protein, 37 aa, Piromyces finnis; identical to SEQ ID NO: 3307
  CBM_10

SEQ ID NO: 3317 - protein, 29 aa, Piromyces finnis
  CBM_10
ECWSEVQGYPCCTQTTEVAYTDSDGDWGV

SEQ ID NO: 3318 - protein, 35 aa, Piromyces finnis
  CBM_10
CWSIKLGYPCCPEDTTIITTDDDGDWGIYNENWCG

SEQ ID NO: 3319 - protein, 41 aa, Piromyces finnis
  CBM_10
ECWSLALSIPCCNKNKEIYSKDQDGNWGITTDENGNSIWCG

SEQ ID NO: 3320 - protein, 35 aa, Piromyces finnis
  CBM_10
CWSRAGGYPCCEGGESIALIDQDGIWGQNANGNWC

SEQ ID NO: 3321 - protein, 37 aa, Piromyces finnis
  CBM_10
CWSEKLGYPCCPEEITQPNYKDSEGDWVFNSNGEWCG

SEQ ID NO: 3322 - protein, 35 aa, Piromyces finnis; identical to SEQ ID NO: 3320
  CBM_10

SEQ ID NO: 3323 - protein, 37 aa, Piromyces finnis; identical to SEQ ID NO: 3321
  CBM_10

SEQ ID NO: 3324 - protein, 29 aa, Piromyces finnis
  CBM_10
KCWASLLGYKCCVGTNPAVVFVDDDGKWG

SEQ ID NO: 3325 - protein, 34 aa, Piromyces finnis
  CBM_10
CWSSALGYQCCKGCSVISEDADGKWGFEDKHWCG

SEQ ID NO: 3326 - protein, 35 aa, Piromyces finnis
  CBM_10
SCWSLPDYPCCKTTSLVVSSDAEGDWGYEDNQWCG

SEQ ID NO: 3327 - protein, 33 aa, Piromyces finnis
  CBM_10
CWSLPHYQCCKGNVVVQSDSNGDWGYEDGQWCG

SEQ ID NO: 3328 - protein, 35 aa, Piromyces finnis; identical to SEQ ID NO: 3326
  CBM_10

SEQ ID NO: 3329 - protein, 34 aa, Piromyces finnis
  CBM_10
CWSSTMGYQCCKSCSVIAEDSDGKWGFEDKHWCG

SEQ ID NO: 3330 - protein, 33 aa, Piromyces finnis; identical to SEQ ID NO: 3327
  CBM_10

SEQ ID NO: 3331 - protein, 33 aa, Piromyces finnis
  CBM_10
CWSLPHYQCCKGNEVVFTDHNGDWGFENNQWCG

SEQ ID NO: 3332 - protein, 28 aa, Piromyces finnis
  CBM_10
YPCCKNTSLVVASDAQGDWGYEDNQWCG

SEQ ID NO: 3333 - protein, 30 aa, Piromyces finnis
  CBM_10
KCWSEPDYPCCKNSCYVVLNDGQEWGSENG

SEQ ID NO: 3334 - protein, 30 aa, Piromyces finnis
  CBM_10
ECWSEPNYPCCKYTCTVILNDGSEWGSENG

SEQ ID NO: 3335 - protein, 34 aa, Piromyces finnis
  CBM_10
CLGYPDYPCCPTCDVFLTEEDGNRWGVLYDNWCS

SEQ ID NO: 3336 - protein, 36 aa, Piromyces finnis
  CBM_10
CPSSITSQGYACCRGCDVVYTDENGDWGIENDYWCG

SEQ ID NO: 3337 - protein, 31 aa, Piromyces finnis
  CBM_10
KKQGYPCCSSCIVYFSDKDGQWGVENGKWCG

SEQ ID NO: 3338 - protein, 34 aa, Piromyces finnis
  CBM_10
CFSTKLGYPCCTSTTQVVFTDNDGNWGVENNDWC

SEQ ID NO: 3339 - protein, 34 aa, Piromyces finnis; identical to SEQ ID NO: 3338
  CBM_10

SEQ ID NO: 3340 - protein, 36 aa, Piromyces finnis
  CBM_10
SCWSEIYGYPCCSGCDVIYEESETMRWGVENNDWCG

SEQ ID NO: 3341 - protein, 24 aa, Piromyces finnis
  CBM_10
SEYPCCEDCVVVYEDNQKWGILNN

SEQ ID NO: 3342 - protein, 25 aa, Piromyces finnis
  CBM_10
SEYPCCEDCVVVYEDNQKWGILNND

SEQ ID NO: 3343 - protein, 36 aa, Piromyces finnis
  CBM_10
CAAASQGYPCCKNQNAEVYYQDETGDWGIENGEWCG

SEQ ID NO: 3344 - protein, 36 aa, Piromyces finnis
  CBM_10
QCWSEKLGFPCCSKCGQVVYTDEDGNWSVENNDWCG

SEQ ID NO: 3345 - protein, 33 aa, Piromyces finnis
  CBM_10
SCWSEIYGYPCCSGCDVIYEESETMRWGVENND

SEQ ID NO: 3346 - protein, 26 aa, Piromyces finnis
  CBM_10
SEYPCCEDCVVVYEDNQKWGILNNDW

SEQ ID NO: 3347 - protein, 34 aa, Piromyces finnis
  CBM_10
ACWSKKLGFDCCSGCNSIYTDDDGEWGLENNEWC

SEQ ID NO: 3348 - protein, 35 aa, Piromyces finnis
  CBM_10
ECWSEALGYKCCSHCVAILEDQDGAWGSENGEWCG

SEQ ID NO: 3349 - protein, 35 aa, Piromyces finnis
  CBM_10
QCWSMKYGYPCCEDCQLYLEDESGAWGVLNYDWCG

SEQ ID NO: 3350 - protein, 35 aa, Piromyces finnis; identical to SEQ ID NO: 3348
  CBM_10

SEQ ID NO: 3351 - protein, 34 aa, Piromyces finnis
  CBM_10
TCTGYPDYPCCDSCDVVFSDTLGDWGVQNDQWCG

SEQ ID NO: 3352 - protein, 31 aa, Piromyces finnis
  CBM_10
SCFSEPDYPCCKSTCNVVDTDANGKWGVENG

SEQ ID NO: 3353 - protein, 37 aa, Piromyces finnis
  CBM_10
CWSMAGGFPCCSPENTNVVYRDQDGKWGLDEDGNWCG

SEQ ID NO: 3354 - protein, 36 aa, Piromyces finnis
  CBM_10
QCWSKRLGYECCKQKFEVVETDENGSWSIENNEWCG

SEQ ID NO: 3355 - protein, 38 aa, Piromyces finnis
  CBM_10
CWSNNSISGNYPCCPEGTPIQYSDDEGDWGVYMDNWCG

SEQ ID NO: 3356 - protein, 37 aa, Piromyces finnis; identical to SEQ ID NO: 3353
  CBM_10

SEQ ID NO: 3357 - protein, 36 aa, Piromyces finnis; identical to SEQ ID NO: 3354
  CBM_10

SEQ ID NO: 3358 - protein, 38 aa, Piromyces finnis; identical to SEQ ID NO: 3355
  CBM_10

SEQ ID NO: 3359 - protein, 34 aa, Piromyces finnis
  CBM_10
SCWAGALGYPCCEGCDVVYTDNDGKWGYEDDWCG

SEQ ID NO: 3360 - protein, 37 aa, Piromyces finnis
  CBM_10
CWSLAISNYPCCSSFNTVVTYTDQDGNWGFENDDWCG

SEQ ID NO: 3361 - protein, 34 aa, Piromyces finnis
  CBM_10
CWSEPKYPCCSEGVKVYSKTSSGEWGIENGNWCG

SEQ ID NO: 3362 - protein, 35 aa, Piromyces finnis
  CBM_10
TCWASSLGYDCCEGCDIITTDEYGEWGIENGNWCG

SEQ ID NO: 3363 - protein, 35 aa, Piromyces finnis
  CBM_10
CWAKPLGYNCCHGETQVIYTDNDGQWGSEDGKWCG

SEQ ID NO: 3364 - protein, 37 aa, Piromyces finnis; identical to SEQ ID NO: 3360
  CBM_10

SEQ ID NO: 3365 - protein, 35 aa, Piromyces finnis; identical to SEQ ID NO: 3362
  CBM_10

SEQ ID NO: 3366 - protein, 35 aa, Piromyces finnis; identical to SEQ ID NO: 3363
  CBM_10

SEQ ID NO: 3367 - protein, 37 aa, Piromyces finnis; identical to SEQ ID NO: 3360
  CBM_10

SEQ ID NO: 3368 - protein, 36 aa, Piromyces finnis
  CBM_10
CPVESKGYKCCNDPNLQSMFEDEDGQWYYENDEWCL

SEQ ID NO: 3369 - protein, 37 aa, Piromyces finnis; identical to SEQ ID NO: 3360
  CBM_10

SEQ ID NO: 3370 - protein, 35 aa, Piromyces finnis; identical to SEQ ID NO: 3363
  CBM_10

SEQ ID NO: 3371 - protein, 34 aa, Piromyces finnis; identical to SEQ ID NO: 3361
  CBM_10

SEQ ID NO: 3372 - protein, 35 aa, Piromyces finnis; identical to SEQ ID NO: 3363
  CBM_10

SEQ ID NO: 3373 - protein, 37 aa, Piromyces finnis; identical to SEQ ID NO: 3360
  CBM_10

SEQ ID NO: 3374 - protein, 34 aa, Piromyces finnis; identical to SEQ ID NO: 3361
  CBM_10

SEQ ID NO: 3375 - protein, 36 aa, Piromyces finnis; identical to SEQ ID NO: 3368
  CBM_10

SEQ ID NO: 3376 - protein, 36 aa, Piromyces finnis; identical to SEQ ID NO: 3368
  CBM_10

SEQ ID NO: 3377 - protein, 32 aa, Piromyces finnis
  CBM_10
NTGYSCCSNPNAYVYTTDITGNWSIEGNYWCL

SEQ ID NO: 3378 - protein, 24 aa, Piromyces finnis
  CBM_10
QYSTCKNTCSVEYEDDSKWGIENN

SEQ ID NO: 3379 - protein, 29 aa, Piromyces finnis
  CBM_10
GEKYKCCKKCKVVYTDNYLWGAEHNEWCS

SEQ ID NO: 3380 - protein, 39 aa, Piromyces finnis
  CBM_10
ECWSTSFGYPCCQSKDTTISLTEFGTGNQYGIENGRFCG

SEQ ID NO: 3381 - protein, 28 aa, Piromyces finnis
  CBM_10
GYKCCSHCDVYLTDEVGQWGVENNYWCG

SEQ ID NO: 3382 - protein, 31 aa, Piromyces finnis
  CBM_10
KQGYKCCSGCRTVYYTDDLGDWGVEDGDWCG

SEQ ID NO: 3383 - protein, 28 aa, Piromyces finnis
  CBM_10
NYECCNNCQVIETDDEGRWGSLNGEWCF

SEQ ID NO: 3384 - protein, 31 aa, Piromyces finnis; identical to SEQ ID NO: 3382
  CBM_10

SEQ ID NO: 3385 - protein, 34 aa, Piromyces finnis
  CBM_10
CKFEQYGYKCCSHCDVYLTDEMGQWGVENNYWCG

SEQ ID NO: 3386 - protein, 34 aa, Piromyces finnis; identical to SEQ ID NO: 3385
  CBM_10

SEQ ID NO: 3387 - protein, 28 aa, Piromyces finnis
  CBM_10
NYECCNNCQVIETDDEGRWGSLNGEWCF

SEQ ID NO: 3388 - protein, 31 aa, Piromyces finnis; identical to SEQ ID NO: 3382
  CBM_10

SEQ ID NO: 3389 - protein, 31 aa, Piromyces finnis
  CBM_10
NSGYPCCVFTTTVIMSDRSGNWGIEYGQWCY

SEQ ID NO: 3390 - protein, 37 aa, Piromyces finnis
  CBM_10
ECWSLKEGYQCCQDEKTTIIPTKDGKEWGIENNEWCG

SEQ ID NO: 3391 - protein, 37 aa, Piromyces finnis
  CBM_10
ECWSEVLGYSCCKDKKTKVSYVDASGEWGAEHGQWCG

SEQ ID NO: 3392 - protein, 28 aa, Piromyces finnis
  CBM_10
GEYKCCEKCKVVYSDGEDWGVEHGNWCS

SEQ ID NO: 3393 - protein, 30 aa, Piromyces finnis
  CBM_10
NSGYPCCVKTKTLVSSDAVGDWGIENNDWC

SEQ ID NO: 3394 - protein, 22 aa, Piromyces finnis
  CBM_10
DQYKCCKKCEVIMTDDDGDWGI

SEQ ID NO: 3395 - protein, 37 aa, Piromyces finnis
  CBM_10
CWSIKYGYSCCTNKNTKVSFVEPTGEKYGIEHDQWCG

SEQ ID NO: 3396 - protein, 33 aa, Piromyces finnis
  CBM_10
YNTGYNCCLSDKTPSSTTDNIGKWGIEGGDWCL

SEQ ID NO: 3397 - protein, 37 aa, Piromyces finnis; identical to SEQ ID NO: 3395
  CBM_10

SEQ ID NO: 3398 - protein, 33 aa, Piromyces finnis; identical to SEQ ID NO: 3396
  CBM_10

SEQ ID NO: 3399 - protein, 22 aa, Piromyces finnis
  CBM_10
DQYKCCKKCEVIMTDDDGDWGI

SEQ ID NO: 3400 - protein, 28 aa, Piromyces finnis
  CBM_10
GEYKCCEKCKVVYSDGEDWGVEHGNWCS

SEQ ID NO: 3401 - protein, 30 aa, Piromyces finnis; identical to SEQ ID NO: 3393
  CBM_10

SEQ ID NO: 3402 - protein, 37 aa, Piromyces finnis; identical to SEQ ID NO: 3391
  CBM_10

SEQ ID NO: 3403 - protein, 37 aa, Piromyces finnis; identical to SEQ ID NO: 3391
  CBM_10

SEQ ID NO: 3404 - protein, 28 aa, Piromyces finnis
  CBM_10
GEYKCCEKCKVVYSDGEDWGVEHGNWCS

SEQ ID NO: 3405 - protein, 30 aa, Piromyces finnis; identical to SEQ ID NO: 3393
  CBM_10

SEQ ID NO: 3406 - protein, 37 aa, Piromyces finnis; identical to SEQ ID NO: 3395
  CBM_10

SEQ ID NO: 3407 - protein, 22 aa, Piromyces finnis
  CBM_10
DQYKCCKKCEVIMTDDDGDWGI

SEQ ID NO: 3408 - protein, 33 aa, Piromyces finnis; identical to SEQ ID NO: 3396
  CBM_10

SEQ ID NO: 3409 - protein, 33 aa, Piromyces finnis; identical to SEQ ID NO: 3396
  CBM_10

SEQ ID NO: 3410 - protein, 22 aa, Piromyces finnis
  CBM_10
DQYKCCKKCEVIMTDDDGDWGI

SEQ ID NO: 3411 - protein, 37 aa, Piromyces finnis; identical to SEQ ID NO: 3395
  CBM_10

SEQ ID NO: 3412 - protein, 41 aa, Piromyces finnis
  CBM_10
KCWSEKLGYSCCKNKNTKISYISRSTGKELYYGVEHGQWCG

SEQ ID NO: 3413 - protein, 32 aa, Piromyces finnis
  CBM_10
NSGYSCCSLSNTEVRTTDAVGKWGIEGEEWCL

SEQ ID NO: 3414 - protein, 24 aa, Piromyces finnis
  CBM_10
GEYKCCQECNISYTDTEDWGIENG

SEQ ID NO: 3415 - protein, 37 aa, Piromyces finnis; identical to SEQ ID NO: 3395
  CBM_10

SEQ ID NO: 3416 - protein, 22 aa, Piromyces finnis
  CBM_10
DQYKCCKKCEVIMTDDDGDWGI

SEQ ID NO: 3417 - protein, 33 aa, Piromyces finnis; identical to SEQ ID NO: 3396
  CBM_10

SEQ ID NO: 3418 - protein, 30 aa, Piromyces finnis; identical to SEQ ID NO: 3393
  CBM_10

SEQ ID NO: 3419 - protein, 37 aa, Piromyces finnis; identical to SEQ ID NO: 3391
  CBM_10

SEQ ID NO: 3420 - protein, 28 aa, Piromyces finnis
  CBM_10
GEYKCCEKCKVVYSDGEDWGVEHGNWCS

SEQ ID NO: 3421 - protein, 30 aa, Piromyces finnis; identical to SEQ ID NO: 3393
  CBM_10

SEQ ID NO: 3422 - protein, 28 aa, Piromyces finnis
  CBM_10
GEYKCCEKCKVVYSDGEDWGVEHGNWCS

SEQ ID NO: 3423 - protein, 37 aa, Piromyces finnis; identical to SEQ ID NO: 3391
  CBM_10

SEQ ID NO: 3424 - protein, 38 aa, Piromyces finnis
  CBM_10
ECWSLAEGYPCCKNQNTPVKYESKSRGVKYGIENGDWC

SEQ ID NO: 3425 - protein, 35 aa, Piromyces finnis
  CBM_10
CWASALGFTCCKATKTVVMEDADGAWGVEDGFWCG

SEQ ID NO: 3426 - protein, 34 aa, Piromyces finnis
  CBM_10
ECEFNTLGYSCCPDATVVYEDDHKWGYVNNHWCG

SEQ ID NO: 3427 - protein, 36 aa, Piromyces finnis
  CBM_10
TCWSSKIGYPCCKENNVIYAIDSQGSWGYENDSWCG

SEQ ID NO: 3428 - protein, 35 aa, Piromyces finnis
  CBM_10
ACWSSALGYPCCKSCDAIYQDNDGKWGFENNDWCG

SEQ ID NO: 3429 - protein, 34 aa, Piromyces finnis
  CBM_10
CSGALGYPCCKSACTVYDTDSNGKWSIENNDWCL

SEQ ID NO: 3430 - protein, 32 aa, Piromyces finnis
  CBM_10
TCTGQDSGFPCCNHCEVIYNDNDGPWGIENGE

SEQ ID NO: 3431 - protein, 34 aa, Piromyces finnis
  CBM_10
CFAIAQGYECCNDNEVVYTDESGQWGIKDGQWCG

SEQ ID NO: 3432 - protein, 28 aa, Piromyces finnis
  CBM_10
AYPCCNECEVIYTDNDGDWGVENNEWCL

SEQ ID NO: 3433 - protein, 35 aa, Piromyces finnis
  CBM_10
TCTGMNSGYQCCDTCNVVYTDNDGKWGIMNGEWCG

SEQ ID NO: 3434 - protein, 36 aa, Piromyces finnis
  CBM_10
ACWSTGLGYNCCKSCVDVAYIDNDGKWGVENGNWCL

SEQ ID NO: 3435 - protein, 36 aa, Piromyces finnis; identical to SEQ ID NO: 3165
  CBM_10

SEQ ID NO: 3436 - protein, 29 aa, Piromyces finnis
  CBM_10
GDYACCSGCESVYVDNDGKWGVENGNWCL

SEQ ID NO: 3437 - protein, 35 aa, Piromyces finnis; identical to SEQ ID NO: 3433
  CBM_10

SEQ ID NO: 3438 - protein, 32 aa, Piromyces finnis; identical to SEQ ID NO: 3430
  CBM_10

SEQ ID NO: 3439 - protein, 34 aa, Piromyces finnis; identical to SEQ ID NO: 3431
  CBM_10

SEQ ID NO: 3440 - protein, 28 aa, Piromyces finnis
  CBM_10
AYPCCNECEVIYTDNDGDWGVENNEWCL

SEQ ID NO: 3441 - protein, 35 aa, Piromyces finnis; identical to SEQ ID NO: 3433
  CBM_10

SEQ ID NO: 3442 - protein, 36 aa, Piromyces finnis; identical to SEQ ID NO: 3165
  CBM_10

SEQ ID NO: 3443 - protein, 29 aa, Piromyces finnis
  CBM_10
GDYACCSGCESVYVDNDGKWGVENGNWCL

SEQ ID NO: 3444 - protein, 32 aa, Piromyces finnis; identical to SEQ ID NO: 3430
  CBM_10

SEQ ID NO: 3445 - protein, 28 aa, Piromyces finnis
  CBM_10
AYPCCNECEVIYTDNDGDWGVENNEWCL

SEQ ID NO: 3446 - protein, 34 aa, Piromyces finnis; identical to SEQ ID NO: 3431
  CBM_10

SEQ ID NO: 3447 - protein, 35 aa, Piromyces finnis; identical to SEQ ID NO: 3433
  CBM_10

SEQ ID NO: 3448 - protein, 36 aa, Piromyces finnis; identical to SEQ ID NO: 3165
  CBM_10

SEQ ID NO: 3449 - protein, 29 aa, Piromyces finnis
  CBM_10
GDYACCSGCESVYVDNDGKWGVENGNWCL

SEQ ID NO: 3450 - protein, 34 aa, Piromyces finnis
  CBM_10
CFSEKLGYKCCKACDTIYTDESGDWGFENNDWCG

SEQ ID NO: 3451 - protein, 34 aa, Piromyces finnis; identical to SEQ ID NO: 3429
  CBM_10

SEQ ID NO: 3452 - protein, 38 aa, Piromyces finnis
  CBM_10
ACWAELLGYSCCSTKTCRNAVYTDDDGQWDVENGNWCG

SEQ ID NO: 3453 - protein, 30 aa, Piromyces finnis
  CBM_10
ESGYPYCKTTTDVVYTDSVKWGIENNDWCG

SEQ ID NO: 3454 - protein, 37 aa, Piromyces finnis
  CBM_10
SCWASKLGFKCCTSQCPQEVYVDTDGSWGVENNNWCG

SEQ ID NO: 3455 - protein, 38 aa, Piromyces finnis; identical to SEQ ID NO: 3452
  CBM_10

SEQ ID NO: 3456 - protein, 36 aa, Piromyces finnis
  CBM_10
SCWSEELGYPCCTSTTKVVYTDESGNWGVENNNWCG

SEQ ID NO: 3457 - protein, 38 aa, Piromyces finnis; identical to SEQ ID NO: 3452
  CBM_10

SEQ ID NO: 3458 - protein, 37 aa, Piromyces finnis; identical to SEQ ID NO: 3454
  CBM_10

SEQ ID NO: 3459 - protein, 15 aa, Piromyces finnis
  CBM_10
DASGRWGIENNDWCG

SEQ ID NO: 3460 - protein, 38 aa, Piromyces finnis; identical to SEQ ID NO: 3452
  CBM_10

SEQ ID NO: 3461 - protein, 30 aa, Piromyces finnis; identical to SEQ ID NO: 3453
  CBM_10

SEQ ID NO: 3462 - protein, 37 aa, Piromyces finnis; identical to SEQ ID NO: 3454
  CBM_10

SEQ ID NO: 3463 - protein, 37 aa, Piromyces finnis; identical to SEQ ID NO: 3454
  CBM_10

SEQ ID NO: 3464 - protein, 38 aa, Piromyces finnis; identical to SEQ ID NO: 3452
  CBM_10

SEQ ID NO: 3465 - protein, 15 aa, Piromyces finnis
  CBM_10
DASGRWGIENNDWCG

SEQ ID NO: 3466 - protein, 36 aa, Piromyces finnis
  CBM_10
SCWSEELGYPCCTSTTKVVYTDESGSWGIENGDWCG

SEQ ID NO: 3467 - protein, 38 aa, Piromyces finnis; identical to SEQ ID NO: 3452
  CBM_10

SEQ ID NO: 3468 - protein, 36 aa, Piromyces finnis; identical to SEQ ID NO: 3456
  CBM_10

SEQ ID NO: 3469 - protein, 34 aa, Piromyces finnis
  CBM_10
CKGAQGYPCCQFSCDVYSTDSDGKWSVENNNWCL

SEQ ID NO: 3470 - protein, 27 aa, Piromyces finnis
  CBM_10
GEYPYCSGCESNYQDADGEWYFVDNKW

SEQ ID NO: 3471 - protein, 31 aa, Piromyces finnis
  CBM_10
MGYPCCTNPSTTVFYVDEDGNWGLENDNWCI

SEQ ID NO: 3472 - protein, 37 aa, Piromyces finnis
  CBM_10
CFALKLGFPCCNNNEIYYTDENGNWGLTNTTPVNWCG

SEQ ID NO: 3473 - protein, 29 aa, Piromyces finnis
  CBM_10
QCWSKELGFECCKSCVTQYTDEDGQWGYE

SEQ ID NO: 3474 - protein, 33 aa, Piromyces finnis
  CBM_10
CFATKLGYKCCSECDVTYTDSDGDWGFEGDWCG

SEQ ID NO: 3475 - protein, 31 aa, Piromyces finnis
  CBM_10
CFSLPDYPCCSSGTSVVYTDASGSWGVENNE

SEQ ID NO: 3476 - protein, 35 aa, Piromyces finnis
  CBM_10
QCFSEKQGYPCCSGCDVAYIDSDGDWGYENDSWCG

SEQ ID NO: 3477 - protein, 34 aa, Piromyces finnis
  CBM_10
SCFATKLGYKCCSGCDVTYTDSDGDWGFEGDWCG

SEQ ID NO: 3478 - protein, 35 aa, Piromyces finnis; identical to SEQ ID NO: 3476
  CBM_10

SEQ ID NO: 3479 - protein, 31 aa, Piromyces finnis
  CBM_10
CFSLPDYPCCSSGTSVAYTDASGSWGVENNE

SEQ ID NO: 3480 - protein, 33 aa, Piromyces finnis
  CBM_10
CFSSPIYPCCSKCNIVFTDEEGDWGYEKGDWCG

SEQ ID NO: 3481 - protein, 36 aa, Piromyces finnis
  CBM_10
SCWAEEFGYNCCKHCTVTYSDENGDWGREEDDAWCG

SEQ ID NO: 3482 - protein, 35 aa, Piromyces finnis
  CBM_10
TCWAEKLGYKCCNECTVTYNDENGDWGFENGEWCG

SEQ ID NO: 3483 - protein, 32 aa, Piromyces finnis
  CBM_10
ACWSSTMGYKCCQKCNVVTEDNSGKWGIENNE

SEQ ID NO: 3484 - protein, 32 aa, Piromyces finnis
  CBM_10
ACWSSAIGYKCCQKCDIVTEDNSGKWGIENNE

SEQ ID NO: 3485 - protein, 37 aa, Piromyces finnis
  CBM_10
ACWSQSLGYPCCSSASAKVEYTDADGKWGIENGNWCG

SEQ ID NO: 3486 - protein, 36 aa, Piromyces finnis
  CBM_10
SCWAKPLGYNCCTSTTQAVYTDSDGKWGVENGDWCG

SEQ ID NO: 3487 - protein, 37 aa, Piromyces finnis
  CBM_10
ACWSQKLGYPCCSSSSAQVWFTDNDGEWGVENGDWCG

SEQ ID NO: 3488 - protein, 37 aa, Piromyces finnis; identical to SEQ ID NO: 3487
  CBM_10

SEQ ID NO: 3489 - protein, 37 aa, Piromyces finnis; identical to SEQ ID NO: 3485
  CBM_10

SEQ ID NO: 3490 - protein, 36 aa, Piromyces finnis
  CBM_10
SCWSQPLGYPCCTSTSTAVYTDGDGAWGIENGDWCG

SEQ ID NO: 3491 - protein, 36 aa, Piromyces finnis; identical to SEQ ID NO: 3486
  CBM_10

SEQ ID NO: 3492 - protein, 36 aa, Piromyces finnis; identical to SEQ ID NO: 3490
  CBM_10

SEQ ID NO: 3493 - protein, 37 aa, Piromyces finnis; identical to SEQ ID NO: 3487
  CBM_10

SEQ ID NO: 3494 - protein, 37 aa, Piromyces finnis; identical to SEQ ID NO: 3485
  CBM_10

SEQ ID NO: 3495 - protein, 36 aa, Piromyces finnis; identical to SEQ ID NO: 3486
  CBM_10

SEQ ID NO: 3496 - protein, 36 aa, Piromyces finnis; identical to SEQ ID NO: 3490
  CBM_10

SEQ ID NO: 3497 - protein, 37 aa, Piromyces finnis; identical to SEQ ID NO: 3487
  CBM_10

SEQ ID NO: 3498 - protein, 37 aa, Piromyces finnis; identical to SEQ ID NO: 3487
  CBM_10

SEQ ID NO: 3499 - protein, 37 aa, Piromyces finnis; identical to SEQ ID NO: 3485
  CBM_10

SEQ ID NO: 3500 - protein, 36 aa, Piromyces finnis; identical to SEQ ID NO: 3486
  CBM_10

SEQ ID NO: 3501 - protein, 37 aa, Piromyces finnis; identical to SEQ ID NO: 3487
  CBM_10

SEQ ID NO: 3502 - protein, 37 aa, Piromyces finnis; identical to SEQ ID NO: 3485
  CBM_10

SEQ ID NO: 3503 - protein, 36 aa, Piromyces finnis; identical to SEQ ID NO: 3486
  CBM_10

SEQ ID NO: 3504 - protein, 37 aa, Piromyces finnis; identical to SEQ ID NO: 3485
  CBM_10

SEQ ID NO: 3505 - protein, 36 aa, Piromyces finnis; identical to SEQ ID NO: 3486
  CBM_10

SEQ ID NO: 3506 - protein, 37 aa, Piromyces finnis; identical to SEQ ID NO: 3485
  CBM_10

SEQ ID NO: 3507 - protein, 36 aa, Piromyces finnis; identical to SEQ ID NO: 3490
  CBM_10

SEQ ID NO: 3508 - protein, 36 aa, Piromyces finnis; identical to SEQ ID NO: 3486
  CBM_10

SEQ ID NO: 3509 - protein, 37 aa, Piromyces finnis; identical to SEQ ID NO: 3487
  CBM_10

SEQ ID NO: 3510 - protein, 37 aa, Piromyces finnis; identical to SEQ ID NO: 3485
  CBM_10

SEQ ID NO: 3511 - protein, 36 aa, Piromyces finnis; identical to SEQ ID NO: 3490
  CBM_10

SEQ ID NO: 3512 - protein, 36 aa, Piromyces finnis; identical to SEQ ID NO: 3486
  CBM_10

SEQ ID NO: 3513 - protein, 37 aa, Piromyces finnis; identical to SEQ ID NO: 3485
  CBM_10

SEQ ID NO: 3514 - protein, 36 aa, Piromyces finnis; identical to SEQ ID NO: 3486
  CBM_10

SEQ ID NO: 3515 - protein, 37 aa, Piromyces finnis; identical to SEQ ID NO: 3487
  CBM_10

SEQ ID NO: 3516 - protein, 36 aa, Piromyces finnis; identical to SEQ ID NO: 3490
  CBM_10

SEQ ID NO: 3517 - protein, 37 aa, Piromyces finnis; identical to SEQ ID NO: 3487
  CBM_10

SEQ ID NO: 3518 - protein, 34 aa, Piromyces finnis
  CBM_10
CWSTAFGYSCCKSCGPVYFTDESGNWGIENGDWC

SEQ ID NO: 3519 - protein, 35 aa, Piromyces finnis; identical to SEQ ID NO: 3112
  CBM_10

SEQ ID NO: 3520 - protein, 34 aa, Piromyces finnis; identical to SEQ ID NO: 3518
  CBM_10

SEQ ID NO: 3521 - protein, 28 aa, Piromyces finnis
  CBM_10
CWSEPLGYPCCTGCAYSWYSDDDGEWGV

SEQ ID NO: 3522 - protein, 34 aa, Piromyces finnis; identical to SEQ ID NO: 3518
  CBM_10

SEQ ID NO: 3523 - protein, 28 aa, Piromyces finnis
  CBM_10
CWSEPLGYPCCTGCAYSWYSDDDGEWGV

SEQ ID NO: 3524 - protein, 28 aa, Piromyces finnis
  CBM_10
CWSEPLGYPCCTGCAYSWYSDDDGEWGV

SEQ ID NO: 3525 - protein, 34 aa, Piromyces finnis; identical to SEQ ID NO: 3518
  CBM_10

SEQ ID NO: 3526 - protein, 34 aa, Piromyces finnis
  CBM_10
CKSVEGYPCCKSSCIVYTKENGVNWGVENNNWCV

SEQ ID NO: 3527 - protein, 36 aa, Piromyces finnis
  CBM_10
SCWAKALGYSCCDSCAPVYYFDNDGEWGIVDGQWCG

SEQ ID NO: 3528 - protein, 28 aa, Piromyces finnis
  CBM_10
CWSEPLGYPCCTGCAYSWYSDDDGEWGV

SEQ ID NO: 3529 - protein, 35 aa, Piromyces finnis; identical to SEQ ID NO: 3112
  CBM_10

SEQ ID NO: 3530 - protein, 35 aa, Piromyces finnis; identical to SEQ ID NO: 3112
  CBM_10

SEQ ID NO: 3531 - protein, 34 aa, Piromyces finnis; identical to SEQ ID NO: 3526
  CBM_10

SEQ ID NO: 3532 - protein, 36 aa, Piromyces finnis; identical to SEQ ID NO: 3527
  CBM_10

SEQ ID NO: 3533 - protein, 25 aa, Piromyces finnis
  CBM_10
FTSLGYSCCKSENCMVYYQDESGDW

SEQ ID NO: 3534 - protein, 36 aa, Piromyces finnis
  CBM_10
CSASIMSQGYKCCSKNCQVVYTDADGDWGVENGQWC

SEQ ID NO: 3535 - protein, 36 aa, Piromyces finnis
  CBM_10
CSAAITRQGYKCCSKNCQVVYTDGDGDWGVENGQWC

SEQ ID NO: 3536 - protein, 38 aa, Piromyces finnis
  CBM_10
SCSAKITSQGYKCCSSSCVPSYTDGDGDWAIENGEWCG

SEQ ID NO: 3537 - protein, 36 aa, Piromyces finnis
  CBM_10
QCWSEKLGFPCCSKCGQVVYTDEDGNWSVENNDWCI

SEQ ID NO: 3538 - protein, 37 aa, Piromyces finnis
  CBM_10
CSSKITSQGYKCCSSSCVPSYTDGDGDWAIENGEWCG

SEQ ID NO: 3539 - protein, 36 aa, Piromyces finnis; identical to SEQ ID NO: 3537
  CBM_10

SEQ ID NO: 3540 - protein, 38 aa, Piromyces finnis
  CBM_10
SCSANILAQGYKCCSAGCQVIYTDNDGTWGAENGEWCG

SEQ ID NO: 3541 - protein, 36 aa, Piromyces finnis; identical to SEQ ID NO: 3343
  CBM_10

SEQ ID NO: 3542 - protein, 36 aa, Piromyces finnis; identical to SEQ ID NO: 3343
  CBM_10

SEQ ID NO: 3543 - protein, 36 aa, Piromyces finnis; identical to SEQ ID NO: 3537
  CBM_10

SEQ ID NO: 3544 - protein, 38 aa, Piromyces finnis; identical to SEQ ID NO: 3540
  CBM_10

SEQ ID NO: 3545 - protein, 38 aa, Piromyces finnis; identical to SEQ ID NO: 3536
  CBM_10

SEQ ID NO: 3546 - protein, 38 aa, Piromyces finnis
  CBM_10
SCSANILAQGYKCCSAGCQVVYTDNDGTWGVENNEWCG

SEQ ID NO: 3547 - protein, 37 aa, Piromyces finnis; identical to SEQ ID NO: 3538
  CBM_10

SEQ ID NO: 3548 - protein, 38 aa, Piromyces finnis; identical to SEQ ID NO: 3540
  CBM_10

SEQ ID NO: 3549 - protein, 37 aa, Piromyces finnis
  CBM_10
PTSITNQGYKCCSAEKCEVVYTDESGDWGVEDGDWCG

SEQ ID NO: 3550 - protein, 32 aa, Piromyces finnis
  CBM_10
ALGYPCCSKTNCVAVYTDETGDWDVENNDWCW

SEQ ID NO: 3551 - protein, 38 aa, Piromyces finnis
  CBM_10
CPTSITNQGYKCCSAEKCEVVYTDESGDWGVEDGDWCG

SEQ ID NO: 3552 - protein, 32 aa, Piromyces finnis; identical to SEQ ID NO: 3550
  CBM_10

SEQ ID NO: 3553 - protein, 31 aa, Piromyces finnis; identical to SEQ ID NO: 3119
  CBM_10

SEQ ID NO: 3554 - protein, 31 aa, Piromyces finnis; identical to SEQ ID NO: 3119
  CBM_10

SEQ ID NO: 3555 - protein, 31 aa, Piromyces finnis; identical to SEQ ID NO: 3119
  CBM_10

SEQ ID NO: 3556 - protein, 31 aa, Piromyces finnis; identical to SEQ ID NO: 3119
  CBM_10

SEQ ID NO: 3557 - protein, 32 aa, Piromyces finnis
  CBM_10
SCHPYYNCCNNCDVYYTDNEGKWGVQNNDWCF

SEQ ID NO: 3558 - protein, 34 aa, Piromyces finnis
  CBM_10
CKFESLGYRCCNGCDVVYTDSDGNWGVENGNWCG

SEQ ID NO: 3559 - protein, 36 aa, Piromyces finnis
  CBM_10
SASIMSQGYKCCSKNCQVVYTDADGDWGVENGQWCG

SEQ ID NO: 3560 - protein, 34 aa, Piromyces finnis; identical to SEQ ID NO: 3558
  CBM_10

SEQ ID NO: 3561 - protein, 32 aa, Piromyces finnis; identical to SEQ ID NO: 3557
  CBM_10

SEQ ID NO: 3562 - protein, 31 aa, Piromyces finnis
  CBM_10
SQGYKCCSKNCQVVYTDADGDWGVENGQWCG

SEQ ID NO: 3563 - protein, 37 aa, Piromyces finnis
  CBM_10
CSASITNQGYKCCKVGCQTIYTDADGNWGVENNQWCG

SEQ ID NO: 3564 - protein, 32 aa, Piromyces finnis
  CBM_10
TNQGYPCCKSCGTVYYTDADGEWGVENGDWCG

SEQ ID NO: 3565 - protein, 32 aa, Piromyces finnis; identical to SEQ ID NO: 3564
  CBM_10

SEQ ID NO: 3566 - protein, 37 aa, Piromyces finnis; identical to SEQ ID NO: 3563
  CBM_10

SEQ ID NO: 3567 - protein, 37 aa, Piromyces finnis
  CBM_10
CSSKITSQGYQCCSDNCEVIYTDADGNWGVENGNWCG

SEQ ID NO: 3568 - protein, 37 aa, Piromyces finnis
  CBM_10
CSAAITRQGYKCCSKNCQVVYTDGDGDWGVENGQWCG

SEQ ID NO: 3569 - protein, 37 aa, Piromyces finnis; identical to SEQ ID NO: 3568
  CBM_10

SEQ ID NO: 3570 - protein, 35 aa, Piromyces finnis
  CBM_10
SSITSQGYPCCSSCGTVYYQDADGDWGVENGQWCG

SEQ ID NO: 3571 - protein, 34 aa, Piromyces finnis
  CBM_10
CNGAQGFPCCQNTCEVYTTDSDGDWGLENGNWCG

SEQ ID NO: 3572 - protein, 36 aa, Piromyces finnis
  CBM_10
SCWSTSLGYSCCKSCINVAYKDNDGEWGIENNNWCG

SEQ ID NO: 3573 - protein, 32 aa, Piromyces finnis; identical to SEQ ID NO: 3557
  CBM_10

SEQ ID NO: 3574 - protein, 34 aa, Piromyces finnis; identical to SEQ ID NO: 3558
  CBM_10

SEQ ID NO: 3575 - protein, 32 aa, Piromyces finnis; identical to SEQ ID NO: 3564
  CBM_10

SEQ ID NO: 3576 - protein, 37 aa, Piromyces finnis; identical to SEQ ID NO: 3563
  CBM_10

SEQ ID NO: 3577 - protein, 37 aa, Piromyces finnis; identical to SEQ ID NO: 3563
  CBM_10

SEQ ID NO: 3578 - protein, 32 aa, Piromyces finnis; identical to SEQ ID NO: 3564
  CBM_10

SEQ ID NO: 3579 - protein, 37 aa, Piromyces finnis
  CBM_10
CSAKITSQGYKCCSAGCVIYYTDADGDWGVENNEWCG

SEQ ID NO: 3580 - protein, 34 aa, Piromyces finnis
  CBM_10
CSAKITSQGYKCCSAGCVIYYTDADGDWGVENNQ

SEQ ID NO: 3581 - protein, 35 aa, Piromyces finnis
  CBM_10
CWAKSSGYSCCSTNKCREVVYFDKEGQWDVENGQW

SEQ ID NO: 3582 - protein, 35 aa, Piromyces finnis
  CBM_10
CFSTKLGYPCCKAGTQAVYTDADGDWGVENGDWCG

SEQ ID NO: 3583 - protein, 36 aa, Piromyces finnis
  CBM_10
SCWSKSLGFECCTGSAYVLYTDENGQWGVENGDWCG

SEQ ID NO: 3584 - protein, 32 aa, Piromyces finnis
  CBM_10
SCWAQALGYPCCKNTKDVVTTDSDGDWGIENG

SEQ ID NO: 3585 - protein, 31 aa, Piromyces finnis
  CBM_10
LGYPLCKEKHEDDLVRDEDGYWAIEDGNWCG

SEQ ID NO: 3586 - protein, 32 aa, Piromyces finnis
  CBM_10
TCRSAKVGYKCCKETTEVVARDSLGFWGVENG

SEQ ID NO: 3587 - protein, 35 aa, Piromyces finnis; identical to SEQ ID NO: 3582
  CBM_10

SEQ ID NO: 3588 - protein, 35 aa, Piromyces finnis; identical to SEQ ID NO: 3582
  CBM_10

SEQ ID NO: 3589 - protein, 32 aa, Piromyces finnis; identical to SEQ ID NO: 3584
  CBM_10

SEQ ID NO: 3590 - protein, 35 aa, Piromyces finnis; identical to SEQ ID NO: 3581
  CBM_10

SEQ ID NO: 3591 - protein, 36 aa, Piromyces finnis; identical to SEQ ID NO: 3583
  CBM_10

SEQ ID NO: 3592 - protein, 36 aa, Piromyces finnis; identical to SEQ ID NO: 3486
  CBM_10

SEQ ID NO: 3593 - protein, 36 aa, Piromyces finnis
  CBM_10
SCWAKALGYNCCTSTTQAIYTDSDGKWGVENGDWCG

SEQ ID NO: 3594 - protein, 36 aa, Piromyces finnis; identical to SEQ ID NO: 3593
  CBM_10

SEQ ID NO: 3595 - protein, 36 aa, Piromyces finnis; identical to SEQ ID NO: 3593
  CBM_10

SEQ ID NO: 3596 - protein, 36 aa, Piromyces finnis; identical to SEQ ID NO: 3593
  CBM_10

SEQ ID NO: 3597 - protein, 36 aa, Piromyces finnis; identical to SEQ ID NO: 3593
  CBM_10

SEQ ID NO: 3598 - protein, 36 aa, Piromyces finnis
  CBM_10
TCWAEALGYKCCQTTSNVEFIDTDGKWGFENGDWCG

SEQ ID NO: 3599 - protein, 36 aa, Piromyces finnis
  CBM_10
TCFAEKLGYSCCPDGTTVSYTDGDGKWGVVNGDWCG

SEQ ID NO: 3600 - protein, 36 aa, Piromyces finnis; identical to SEQ ID NO: 3486
  CBM_10

SEQ ID NO: 3601 - protein, 36 aa, Piromyces finnis
  CBM_10
SCWAQALGYPCCKNTKDVVTTDSDGDWGIENGDWCG

SEQ ID NO: 3602 - protein, 36 aa, Piromyces finnis; identical to SEQ ID NO: 3486
  CBM_10

SEQ ID NO: 3603 - protein, 36 aa, Piromyces finnis; identical to SEQ ID NO: 3593
  CBM_10

SEQ ID NO: 3604 - protein, 36 aa, Piromyces finnis; identical to SEQ ID NO: 3486
  CBM_10

SEQ ID NO: 3605 - protein, 36 aa, Piromyces finnis; identical to SEQ ID NO: 3486
  CBM_10

SEQ ID NO: 3606 - protein, 36 aa, Piromyces finnis; identical to SEQ ID NO: 3490
  CBM_10

SEQ ID NO: 3607 - protein, 36 aa, Piromyces finnis; identical to SEQ ID NO: 3486
  CBM_10

SEQ ID NO: 3608 - protein, 36 aa, Piromyces finnis; identical to SEQ ID NO: 3486
  CBM_10

SEQ ID NO: 3609 - protein, 36 aa, Piromyces finnis; identical to SEQ ID NO: 3486
  CBM_10

SEQ ID NO: 3610 - protein, 36 aa, Piromyces finnis; identical to SEQ ID NO: 3593
  CBM_10

SEQ ID NO: 3611 - protein, 36 aa, Piromyces finnis; identical to SEQ ID NO: 3593
  CBM_10

SEQ ID NO: 3612 - protein, 31 aa, Piromyces finnis
  CBM_10
ACWSSSQGYPCCSSSSVVVAFSDASGEWGVE

SEQ ID NO: 3613 - protein, 31 aa, Piromyces finnis
  CBM_10
PKGYKCCKTTSQVYEVDSDGKWGIENNDWCF

SEQ ID NO: 3614 - protein, 37 aa, Piromyces finnis
  CBM_10
CSSKITSQGYKCCASNCDVVYVDNDGNWGVENDEWCG

SEQ ID NO: 3615 - protein, 17 aa, Piromyces finnis
  CBM_10
SCWANALGYPCCTSTTQ

SEQ ID NO: 3616 - protein, 29 aa, Piromyces finnis
  CBM_10
LGYNCCRNTCDIQYKDDDGNWGVENNDWC

SEQ ID NO: 3617 - protein, 36 aa, Piromyces finnis
  CBM_10
CSSKITSQGYKCCASNCDVVYVDNDGNWGVENNDWC

SEQ ID NO: 3618 - protein, 36 aa, Piromyces finnis; identical to SEQ ID NO: 3617
  CBM_10

SEQ ID NO: 3619 - protein, 29 aa, Piromyces finnis
  CBM_10
LGYNCCRNTCDIQYKDDDGNWGVENNDWC

SEQ ID NO: 3620 - protein, 35 aa, Piromyces finnis
  CBM_10
SCWSEALGYPCCEGNVVITSDENGDWGVENNEWCG

SEQ ID NO: 3621 - protein, 37 aa, Piromyces finnis; identical to SEQ ID NO: 3579
  CBM_10

SEQ ID NO: 3622 - protein, 19 aa, Piromyces finnis
  CBM_10
TIYTDADGNWGVENNQWCG

SEQ ID NO: 3623 - protein, 37 aa, Piromyces finnis; identical to SEQ ID NO: 3567
  CBM_10

SEQ ID NO: 3624 - protein, 37 aa, Piromyces finnis; identical to SEQ ID NO: 3567
  CBM_10

SEQ ID NO: 3625 - protein, 37 aa, Piromyces finnis
  CBM_10
CSASITNQGYKCCKVGCQTVYTDADGNWGVENGNWCG

SEQ ID NO: 3626 - protein, 37 aa, Piromyces finnis; identical to SEQ ID NO: 3625
  CBM_10

SEQ ID NO: 3627 - protein, 26 aa, Piromyces finnis
  CBM_10
YGCCAHCNAIYEDEDGLWGVSNGEWC

SEQ ID NO: 3628 - protein, 29 aa, Piromyces finnis
  CBM_10
EGYECCSSCNVIYTDDDGNWGVENDQWCG

SEQ ID NO: 3629 - protein, 36 aa, Piromyces finnis
  CBM_10
KCFSSKLGYPCCTSTTDVITEDEDGKWGLENGDWCG

SEQ ID NO: 3630 - protein, 36 aa, Piromyces finnis; identical to SEQ ID NO: 3599
  CBM_10

SEQ ID NO: 3631 - protein, 29 aa, Piromyces finnis
  CBM_10
TCWAEALGYKCCQTTSNVEFIDTDGKWGF

SEQ ID NO: 3632 - protein, 27 aa, Piromyces finnis
  CBM_10
SCWASSLGYPCCKSTKVVIDTDASGRW

SEQ ID NO: 3633 - protein, 31 aa, Piromyces finnis
  CBM_10
DCWSERLGWPCCSNSNAEVVYVDEDGDWGVE

SEQ ID NO: 3634 - protein, 34 aa, Piromyces finnis
  CBM_10
SCWSTKLGYKCCKGCDVSYTDSDGDWGYESDWCG

SEQ ID NO: 3635 - protein, 32 aa, Piromyces finnis
  CBM_10
CTTSGYPCCKDCNVVYTDETGKWGIANNEWCA

SEQ ID NO: 3636 - protein, 29 aa, Piromyces finnis
  CBM_10
SEYECCNGCNVVDQSDGLKWGVENNNWCI

SEQ ID NO: 3637 - protein, 35 aa, Piromyces finnis
  CBM_10
QCSSKITAQGYSCCSSSNCSIIYTDEDGTWGVENG

SEQ ID NO: 3638 - protein, 27 aa, Piromyces finnis
  CBM_10
GEYPYCSGCESNYQDADGEWYFVDNKW

SEQ ID NO: 3639 - protein, 37 aa, Piromyces finnis; identical to SEQ ID NO: 3472
  CBM_10

SEQ ID NO: 3640 - protein, 31 aa, Piromyces finnis; identical to SEQ ID NO: 3471
  CBM_10

SEQ ID NO: 3641 - protein, 32 aa, Piromyces finnis
  CBM_10
ACWSEAIGYPCCKGCEAISNDESGAWGVENNE

SEQ ID NO: 3642 - protein, 29 aa, Piromyces finnis
  CBM_10
YPCCSSENAEIVYTDSEGDWGLEKGDWCL

SEQ ID NO: 3643 - protein, 30 aa, Piromyces finnis
  CBM_10
CFSLKLGYRCCERSKVVYSDADGLWGVENG

SEQ ID NO: 3644 - protein, 26 aa, Piromyces finnis
  CBM_10
KCWSTEFGFPCCKGNTIVFTDENGDW

SEQ ID NO: 3645 - protein, 28 aa, Piromyces finnis
  CBM_10
YYECCTGCKPIVADDEGRWGAQNGEWCL

SEQ ID NO: 3646 - protein, 27 aa, Piromyces finnis
  CBM_10
YDVCEGCEVLVTDLEGKWGAQDGKWCH

SEQ ID NO: 3647 - protein, 28 aa, Piromyces finnis
  CBM_10
YYECCTGCKPIVADDEGRWGAQNGEWCL

SEQ ID NO: 3648 - protein, 27 aa, Piromyces finnis
  CBM_10
YDVCEGCEVLVTDLEGKWGAQDGKWCH

SEQ ID NO: 3649 - protein, 34 aa, Piromyces finnis
  CBM_10
CTGAQGYSCCNKECTVYYDDEDGDWSIENGEWCL

SEQ ID NO: 3650 - protein, 36 aa, Piromyces finnis
  CBM_10
SCWSESLGYPCCETTCDIVEKDSDGSWGVEYNEWCG

SEQ ID NO: 3651 - protein, 28 aa, Piromyces finnis
  CBM_10
CIAKSLGYQCCPKNISEVYYHDENGDWG

SEQ ID NO: 3652 - protein, 32 aa, Piromyces finnis
  CBM_10
QGYSCCEQNNCNIYYKDDDGDWGLTSSLKWCG

SEQ ID NO: 3653 - protein, 31 aa, Piromyces finnis
  CBM_10
NQMGYKCCRSCNVVLTDSTGKWGVEDNEWCG

SEQ ID NO: 3654 - protein, 27 aa, Piromyces finnis
  CBM_10
GYVCCDHCQSNYEDEFGKWYHTNNHDW

SEQ ID NO: 3655 - protein, 32 aa, Piromyces finnis
  CBM_10
KDLGYKCCKEPCDVIYTDVDGDWGAENNEWCG

SEQ ID NO: 3656 - protein, 36 aa, Piromyces finnis
  CBM_10
ECWSEEFGYKCCKKSCTVFEIDNDGKWGYEDGNWCG

SEQ ID NO: 3657 - protein, 38 aa, Piromyces finnis
  CBM_10
CIAETIGYRCCSSKNKTVYYTDSYGDWGYDFKLNDWCG

SEQ ID NO: 3658 - protein, 33 aa, Piromyces finnis
  CBM_10
QCTFESIGYNCCTTTCNVIYTDENGDWGIENNE

SEQ ID NO: 3659 - protein, 34 aa, Piromyces finnis
  CBM_10
ECWSKKYGYNCCKRCFIYDVTDEGKWGYENNEWC

SEQ ID NO: 3660 - protein, 36 aa, Piromyces finnis
  CBM_10
CWSHKYGYPCCSEGTCHIFTSDENGDWGYENGRWCG

SEQ ID NO: 3661 - protein, 35 aa, Piromyces finnis
  CBM_10
CFSRNLGFNCCENESTSVFFVDDNGSWGVENDEWC

SEQ ID NO: 3662 - protein, 31 aa, Piromyces finnis
  CBM_10
CWSEVYDYSCCKKTTQVMYIDSKGTWGIENG

SEQ ID NO: 3663 - protein, 33 aa, Piromyces finnis
  CBM_10
CWSEPLGYPCCSIEAKPSDEASIWGWENEEWCG

SEQ ID NO: 3664 - protein, 35 aa, Piromyces finnis
  CBM_10
ECFAEKLGKPCCTETLDVVRVDENGQWGMENGQFC

SEQ ID NO: 3665 - protein, 16 aa, Piromyces finnis
  CBM_10
QDESGKWGIENNQWCG

SEQ ID NO: 3666 - protein, 35 aa, Piromyces finnis
  CBM_10
CWSEELGYACCKKTCTIFEIDENGEWGFEDDKWCG

SEQ ID NO: 3667 - protein, 35 aa, Piromyces finnis
  CBM_10
KCFSENLGYSCCEECNVVYTDNDGKWGYENNEWCG

SEQ ID NO: 3668 - protein, 21 aa, Piromyces finnis
  CBM_10
KCFSEVLGYPCCNECSIIYSD

SEQ ID NO: 3669 - protein, 35 aa, Piromyces finnis; identical to SEQ ID NO: 3104
  CBM_10

SEQ ID NO: 3670 - protein, 35 aa, Piromyces finnis; identical to SEQ ID NO: 3667
  CBM_10

SEQ ID NO: 3671 - protein, 35 aa, Piromyces finnis
  CBM_10
SCWSEVYGYSCCRETTTVITSDSKGNWGAENGEWC

SEQ ID NO: 3672 - protein, 33 aa, Piromyces finnis; identical to SEQ ID NO: 3663
  CBM_10

SEQ ID NO: 3673 - protein, 34 aa, Piromyces finnis
  CBM_10
CWSEVYDYSCCKKTTQVMYIDSKGTWGIENGEWC

SEQ ID NO: 3674 - protein, 35 aa, Piromyces finnis; identical to SEQ ID NO: 3661
  CBM_10

SEQ ID NO: 3675 - protein, 35 aa, Piromyces finnis; identical to SEQ ID NO: 3192
  CBM_10

SEQ ID NO: 3676 - protein, 38 aa, Piromyces finnis; identical to SEQ ID NO: 3168
  CBM_10

SEQ ID NO: 3677 - protein, 36 aa, Piromyces finnis; identical to SEQ ID NO: 3629
  CBM_10

SEQ ID NO: 3678 - protein, 17 aa, Piromyces finnis
  CBM_10
YTEDDGNWGLENDQWCG

SEQ ID NO: 3679 - protein, 26 aa, Piromyces finnis
  CBM_10
YGCCAHCNAIYEDEDGLWGVSNGEWC

SEQ ID NO: 3680 - protein, 36 aa, Piromyces finnis
  CBM_10
SCWSSSLGFPCCSGKVVVEYTDASGRWGIQNNNWCG

SEQ ID NO: 3681 - protein, 38 aa, Piromyces finnis
  CBM_10
TCWAKALGYNCCSTNTCRNAVYNDTDGQWDIENNQWCG

SEQ ID NO: 3682 - protein, 28 aa, Piromyces finnis
  CBM_10
CWSDVLGYSCCSKCLEAVYEDQDGKWGV

SEQ ID NO: 3683 - protein, 34 aa, Piromyces finnis
  CBM_10
CWSVEYGFPCCFGSKVIATDYNGDWGYENNQWCG

SEQ ID NO: 3684 - protein, 34 aa, Piromyces finnis
  CBM_10
CWASLLGYPCCESNIVYEVDEYGTWGYEFGHWCG

SEQ ID NO: 3685 - protein, 35 aa, Piromyces finnis
  CBM_10
CWALAYGYPCCKETTTVLSTDESGTWGYENNTWCG

SEQ ID NO: 3686 - protein, 26 aa, Piromyces finnis
  CBM_10
SCWASSLGYPCCKSTKVVIDTDASGR

SEQ ID NO: 3687 - protein, 21 aa, Piromyces finnis
  CBM_10
SCWSLPDYPCCSTCDVVYTDD

SEQ ID NO: 3688 - protein, 34 aa, Piromyces finnis; identical to SEQ ID NO: 3272
  CBM_10

SEQ ID NO: 3689 - protein, 30 aa, Piromyces finnis; identical to SEQ ID NO: 3244
  CBM_10

SEQ ID NO: 3690 - protein, 30 aa, Piromyces finnis
  CBM_10
SCWSEEMGYSCCSHCIVLLKDESGLWGAEN

SEQ ID NO: 3691 - protein, 30 aa, Piromyces finnis; identical to SEQ ID NO: 3393
  CBM_10

SEQ ID NO: 3692 - protein, 37 aa, Piromyces finnis; identical to SEQ ID NO: 3391
  CBM_10

SEQ ID NO: 3693 - protein, 34 aa, Piromyces finnis; identical to SEQ ID NO: 3684
  CBM_10

SEQ ID NO: 3694 - protein, 35 aa, Piromyces finnis; identical to SEQ ID NO: 3685
  CBM_10

SEQ ID NO: 3695 - protein, 30 aa, Piromyces finnis
  CBM_10
DNFPCCSDNTEIIYTDEEGNWGLENDEWCF

SEQ ID NO: 3696 - protein, 38 aa, Piromyces finnis
  CBM_10
ECYFETLGYSCCPSEITEVAYTDEDGNKWGIINNEWCG

SEQ ID NO: 3697 - protein, 38 aa, Piromyces finnis; identical to SEQ ID NO: 3696
  CBM_10

SEQ ID NO: 3698 - protein, 30 aa, Piromyces finnis; identical to SEQ ID NO: 3695
  CBM_10

SEQ ID NO: 3699 - protein, 34 aa, Piromyces finnis
  CBM_10
CWSRSYGFPCCNGCKVYYIDKSGEWGIENGNWCG

SEQ ID NO: 3700 - protein, 34 aa, Piromyces finnis; identical to SEQ ID NO: 3431
  CBM_10

SEQ ID NO: 3701 - protein, 23 aa, Piromyces finnis
  CBM_10
AYPCCNECEVIYTDNDGDWGVEN

SEQ ID NO: 3702 - protein, 35 aa, Piromyces finnis; identical to SEQ ID NO: 3285
  CBM_10

SEQ ID NO: 3703 - protein, 12 aa, Piromyces finnis
  CBM_10
GKWGVENSDWCG

SEQ ID NO: 3704 - protein, 38 aa, Piromyces finnis
  CBM_10
QCWSELIGYPCCDPKNNVVYSHDSYGEWGYNFKTQMWC

SEQ ID NO: 3705 - protein, 33 aa, Piromyces finnis; identical to SEQ ID NO: 3118
  CBM_10

SEQ ID NO: 3706 - protein, 74 aa, Piromyces finnis
  CBM_2
QAEGKIVNASKLKLNNWYIEVPFDPDHQKFQGSWGCEVEEKEDKLVLTGEVTNKTLKVLTETTFGFIIASTGVK

SEQ ID NO: 3707 - protein, 71 aa, Piromyces finnis
  CBM_2
ATGSGMRCSGWCVSFTSSSYKITQTSDGNIVNSGPEYTICNKRENNALDGKGTAHIVTFQASGSSLPTEFT

SEQ ID NO: 3708 - protein, 71 aa, Piromyces finnis; identical to SEQ ID NO: 3707
  CBM_2

SEQ ID NO: 3709 - protein, 71 aa, Piromyces finnis; identical to SEQ ID NO: 3707
  CBM_2

SEQ ID NO: 3710 - protein, 132 aa, Neocallimastix californiae
  CBM_4_9
GYLFHNTFERGIDGWSSRGSAQVSFNKNTAYDGNGSIYCSERGANWSGASRNLSPNVFKPGNAYSFSVVVKYEEGPASQIFYLTLQYDDGSGETQYEKVSIVEVAKGQWTQLYNTNYKIPDRACNMLFYVET

SEQ ID NO: 3711 - protein, 132 aa, Neocallimastix californiae
  CBM_4_9
GYYFHNTFEEDEDTWTGRHTASIQVSQKAAYAGKSSLYCYKREYNWTGAQRTLSPKMFKPGETYSFSVVVRYDEGPASQNFYLTLQYENGTDEVQYDKISIESVKKGEWTQLANANYKIPANAYDMYFYVET

SEQ ID NO: 3712 - protein, 132 aa, Anaeromyces robustus; identical to SEQ ID NO: 3711
  CBM_4_9

SEQ ID NO: 3713 - protein, 130 aa, Anaeromyces robustus
  CBM_4_9
YYFHNTFENGTDRWENRGYASVSQSKDDAYKGSGSLYCDNREYNWSGASRSLSSNVFEAGKEYSFSVIVKYNEGPDSQKFYLTLQYDNGTDEIQYDKIATVNVSKDQWVQLANTNYKIPANASDLIFYVE

SEQ ID NO: 3714 - protein, 131 aa, Piromyces finnis
  CBM_4_9
YYFHNTFENGAERWENRGYASVAQSKDTAYKGNGSLYCEKREYNWSGASRSLSSNVFEPGKEFSFSAVVKYDEGPESQTFFLSLQYNDDSGETQYDKIAIVKVTQGEWVQLANTNYKIPANSSNLMFYIET

SEQ ID NO: 3715 - protein, 109 aa, Neocallimastix californiae
  CBM_6
SMMAWQGGVSTNGLGHTTVTYNRGEWTGVSNVDFGEAATSVKITAASNNGAVIRITTGSPNGDVVGYVSIPATGGNSNFKTVTADINTVSGTKHVFFVASGDVVVDTWQ

SEQ ID NO: 3716 - protein, 108 aa, Neocallimastix californiae
  CBM_6
ASSFAWQYGITIKGQDNVLPVNYVKGAWTGISNVDLGNAKSITLKAYAPNGATIKVCVGSENGTVLGYVDIPKGNSLQNVTGNLDNASGTKNLFLVSSGDATIESWQL

SEQ ID NO: 3717 - protein, 106 aa, Neocallimastix californiae
  CBM_6
AASFAWQSGISVKGQGAVTQVNYGRGAWTGVSNVALGNAKSITLKASSSSGATVKICAGSENGTVLGYVDIPAGGSLQNVTGNLSGASGTKSLFFIASGNLTIESW

SEQ ID NO: 3718 - protein, 108 aa, Neocallimastix californiae
  CBM_6
MAWEGGVSINGLGHTTVTYNKGDWTGVSNVDFGNGAYGIKVSAASRNGAVIKIAAGSETGNALGYINIPATGGTNSFKTVTASLSKITGVKNIFFIASGDVVLDTWQF

SEQ ID NO: 3719 - protein, 104 aa, Neocallimastix californiae
  CBM_6
MAWQSGISVEGHGAVTQVKYGRGAWTGVSNVDLGSASSITLKASSRSGATIKVCTDSENGNALGYVEIPAGGSLQNVTGQLSGATGTKNLFFVSSGDAVIESWQ

SEQ ID NO: 3720 - protein, 108 aa, Anaeromyces robustus; identical to SEQ ID NO: 3718
  CBM_6

SEQ ID NO: 3721 - protein, 107 aa, Anaeromyces robustus
  CBM_6
AASMAWQSGISVEGHGAVTQVKYGRGAWTGVSNVDLGSASSITLKASSRSGATIKVCTDSENGNALGYVEIPAGGSLQNVTGQLSGATGTKNLFFVSSGDAVIESWQ

SEQ ID NO: 3722 - protein, 108 aa, Anaeromyces robustus
  CBM_6
ASSFAWQSGIKIKGQGEVTTVEYPSGGWTGISQVALGDAKSITIKASSQSGATIKICTGNENGNVLGYVEIPSGGNLKEVTGDLTNATGTQDLFLVASNNVSIESWKL

SEQ ID NO: 3723 - protein, 106 aa, Anaeromyces robustus
  CBM_6
AANMAWQNGISVKGQGAVLPVSYTRGAWTGVSNVALGGASSITLKASSQSGATIKICTESENGQAIGYVDIPAGGSLQNVSGTLSGATGTKNLFFVSSGDATIESW

SEQ ID NO: 3724 - protein, 106 aa, Anaeromyces robustus
  CBM_6
AANMAWQYGISVNGQGAVVPVNYNRGAWTGVSNVALGGATSITLKASSKSGATIKICTESENGQALGYVDIPAGGSLQNVSGTLSGATGTKNLFFVSSGDATIESW

SEQ ID NO: 3725 - protein, 104 aa, Piromyces finnis
  CBM_6
AWQAGVSVYGLGHTTVTYRKGTWTGVSGVEFGDNATSVKISAASANGATIRITSGSENGEVIGYVTVPATGDEFVTVTADVSVSGVKDIFFVASDEVVVDTWQF

SEQ ID NO: 3726 - protein, 107 aa, Piromyces finnis
  CBM_6
AASFAWQSGIKIKGQGAVTTVEIPRGGWTGVSHVALGNAKSITIKASSSSGATIKVCTGNEKGDVLGYVEIPAGGSLQEVTAEISNASGTKDLFFVASNSVSMESWQ

SEQ ID NO: 3727 - protein, 104 aa, Piromyces finnis; identical to SEQ ID NO: 3725
  CBM_6

SEQ ID NO: 3728 - protein, 107 aa, Piromyces finnis; identical to SEQ ID NO: 3726
  CBM_6

SEQ ID NO: 3729 - protein, 105 aa, Piromyces finnis
  CBM_6
AWQAGVSVNGLGHTTVSYNRGDWTGVSNVDFGDSATSVKISAASSNGATIRITSGSENGDVIGYVTIPATGGDKNFKTVTANVKASGTKNIFFVASGDVTIDTWQ

SEQ ID NO: 3730 - protein, 107 aa, Piromyces finnis; identical to SEQ ID NO: 3726
  CBM_6

SEQ ID NO: 3731 - protein, 105 aa, Piromyces finnis; identical to SEQ ID NO: 3729
  CBM_6

SEQ ID NO: 3732 - protein, 105 aa, Piromyces finnis; identical to SEQ ID NO: 3729
  CBM_6

SEQ ID NO: 3733 - protein, 107 aa, Piromyces finnis; identical to SEQ ID NO: 3726
  CBM_6

SEQ ID NO: 3734 - protein, 105 aa, Piromyces finnis; identical to SEQ ID NO: 3729
  CBM_6

SEQ ID NO: 3735 - protein, 104 aa, Piromyces finnis; identical to SEQ ID NO: 3725
  CBM_6

SEQ ID NO: 3736 - protein, 104 aa, Piromyces finnis; identical to SEQ ID NO: 3725
  CBM_6

SEQ ID NO: 3737 - protein, 172 aa, Neocallimastix californiae
  CBM-like
AWEIGIPDRTAMEYKHGDHFNQWGLPYKFPQEFPNGVNYYIGKSNYAKDWNYCHVSVPGNGGTYKSVPWNIYFNLNKKPTGTAVLRVSVAANTSTALSVSINGGKNSAEVSNFKDDACVRRDGIRGFYRELEFKFSPNDFKIGENKITLNARKTGGYTNSYQFDGIMYDHIR

SEQ ID NO: 3738 - protein, 176 aa, Anaeromyces robustus
  CBM-like
PTIFEVGVPDRTAEEYLHGDHFNQWGLYNKFAEEFPNSVNFYIGKSDWQFDWNYCQVSIPGGANGNYKACEPWKIHFNINKVPSGNILLRVSIAASSSTALSVSVNGRNQSSEVKDLIDDACIRRDGIRGIWSMKEFTFPASLLKQGENYVSLHTRAIGGYLTYYRFDGIMYDHIR

SEQ ID NO: 3739 - protein, 176 aa, Piromyces finnis
  CBM-like
PTVFEVGIPDRTAEEYLHGDHFNQWGLYNQFQDEFPNSVNFRIGESDWQFDWNYCQVSIPGGADGKYKAAEPWKIYFNLDKVPSGNILVRVSVAASSSTALSVSVNGKNQSAEVKDLVDDACIRRDGIRGIWSMKEFTFSSSLLKQGENYISLHARAIGGYLTYYRFDGIMYDHVR

SEQ ID NO: 3740 - protein, 172 aa, Piromyces finnis
  CBM-like
VWEIGIPDRTAMEYKHGNHFNQWGLYHKFKTEFPNSVNYYVGKSNYATDWNYCHVSIQGADGKYMQSPWNIYFNLNKIPTGTSVLRISIAASSYSALSVALNDGKATAEVKDLVDDACIRRDGIRGIWSMKEFTFSSSLLKQGENYISLHARAIGGYLTYYRFDGIMYDHVR

SEQ ID NO: 3741 - protein, 27 aa, Neocallimastix californiae
  CBM1_1
CGGQNYNGPTCCEAGTTCVKLSDYYYQ

SEQ ID NO: 3742 - protein, 26 aa, Neocallimastix californiae
  CBM1_1
CGGEGYFGPTKCCKGKCISQGPYYSQ

SEQ ID NO: 3743 - protein, 26 aa, Neocallimastix californiae
  CBM1_1
CGGDGYFGPTECCKGKCISQGPYYSQ

SEQ ID NO: 3744 - protein, 27 aa, Neocallimastix californiae
  CBM1_1
CGGEGWNGPTCCNSGSVCVVTNQYYHQ

SEQ ID NO: 3745 - protein, 27 aa, Neocallimastix californiae
  CBM1_1
CGGMNWAGPNCCVEGTYCTFVNPYYSQ

SEQ ID NO: 3746 - protein, 27 aa, Neocallimastix californiae
  CBM1_1
CGGQGYTGPTCCKSGSTCHEINKYYSQ

SEQ ID NO: 3747 - protein, 27 aa, Neocallimastix californiae
  CBM1_1
CGGVNYHGSTKCCGNLTCVYRGEYYSQ

SEQ ID NO: 3748 - protein, 27 aa, Neocallimastix californiae
  CBM1_1
CGGINYNGPTCCPSGYTCKFISDYYYQ

SEQ ID NO: 3749 - protein, 26 aa, Neocallimastix californiae
  CBM1_1
CGGIGFNGPTCCSSGKCVKLNDWYSQ

SEQ ID NO: 3750 - protein, 27 aa, Neocallimastix californiae
  CBM1_1
CGGVNHRGPFCCESGLTCVFVNDYYSQ

SEQ ID NO: 3751 - protein, 26 aa, Anaeromyces robustus
  CBM1_1
CGGEGYFGPTECCKGKCTSQGPYYSQ

SEQ ID NO: 3752 - protein, 27 aa, Anaeromyces robustus
  CBM1_1
CGGATYYGPTCCESNSRCIVHNEYYSQ

SEQ ID NO: 3753 - protein, 27 aa, Anaeromyces robustus
  CBM1_1
CGGKEYTGPTCCNENYHCIYVNEYYSQ

SEQ ID NO: 3754 - protein, 27 aa, Anaeromyces robustus
  CBM1_1
CGGINYTGPTCCPSGYSCKKHNDYYSQ

SEQ ID NO: 3755 - protein, 27 aa, Anaeromyces robustus
  CBM1_1
CGGVGYNGPTCCKGDYYCKSYSDYYSQ

SEQ ID NO: 3756 - protein, 27 aa, Anaeromyces robustus
  CBM1_1
CGGFYFSGPNCCEEGSRCIYQNDYYSQ

SEQ ID NO: 3757 - protein, 27 aa, Piromyces finnis
  CBM1_1
CGGIGYSGPTQCESGSECVATNEFYSQ

SEQ ID NO: 3758 - protein, 26 aa, Piromyces finnis
  CBM1_1
CGGDGYFGPTECCKGKCISQGPYYSQ

SEQ ID NO: 3759 - protein, 36 aa, Neocallimastix californiae
  CBM1_2
NCASIWQQCGGQNYNGPTCCEAGTTCVKLSDYYYQC

SEQ ID NO: 3760 - protein, 35 aa, Neocallimastix californiae
  CBM1_2
TCVALYDQCGGEGYFGPTKCCKGKCISQGPYYSQC

SEQ ID NO: 3761 - protein, 36 aa, Neocallimastix californiae
  CBM1_2
PDLKAYAQCGGLGYEGSTCCQAGTICTVVNEHYSHC

SEQ ID NO: 3762 - protein, 35 aa, Neocallimastix californiae
  CBM1_2
TCVALYDQCGGDGYFGPTECCKGKCISQGPYYSQC

SEQ ID NO: 3763 - protein, 36 aa, Neocallimastix californiae
  CBM1_2
DDIKAYGKCGGNDWTGSTCCMVGTSCQKINEWVSLC

SEQ ID NO: 3764 - protein, 37 aa, Neocallimastix californiae
  CBM1_2
SCAVDFDQCGGVGYNGPTNCCNPDYKCKEYGTYYFQC

SEQ ID NO: 3765 - protein, 36 aa, Neocallimastix californiae
  CBM1_2
PDLKAYAQCGGIGYEGPNCCQAGTVCTEINEHYSHC

SEQ ID NO: 3766 - protein, 37 aa, Neocallimastix californiae
  CBM1_2
KCAGPFEPCGGLRYKGAPTCCQTGYYCSRRNNNYYQC

SEQ ID NO: 3767 - protein, 37 aa, Neocallimastix californiae
  CBM1_2
QCAKGYMPCGGSKFPDAPTCCEKYYYCETADPSYHQC

SEQ ID NO: 3768 - protein, 37 aa, Neocallimastix californiae
  CBM1_2
VCAKAYEMCGGTLFPNQPTCCEPGNTCVIMNPRYHEC

SEQ ID NO: 3769 - protein, 36 aa, Neocallimastix californiae
  CBM1_2
QCANVWGQCGGEGWNGPTCCNSGSVCVVTNQYYHQC

SEQ ID NO: 3770 - protein, 37 aa, Neocallimastix californiae
  CBM1_2
SCANNWAQCGGIDFNGPTTCCDPSAVCKYLNDYYYQC

SEQ ID NO: 3771 - protein, 36 aa, Neocallimastix californiae
  CBM1_2
QCSNKWDQCGGMNWAGPNCCVEGTYCTFVNPYYSQC

SEQ ID NO: 3772 - protein, 36 aa, Neocallimastix californiae
  CBM1_2
QCAEKWTQCGGQGYTGPTCCKSGSTCHEINKYYSQC

SEQ ID NO: 3773 - protein, 37 aa, Neocallimastix californiae
  CBM1_2
ECAEAYRPCGGSYFQDGPNCCEPGFICVDANPLFKQC

SEQ ID NO: 3774 - protein, 37 aa, Neocallimastix californiae
  CBM1_2
QCAKAYQPCGGNDYPNAPTCCEAGFACLMKNPNYHQC

SEQ ID NO: 3775 - protein, 37 aa, Neocallimastix californiae
  CBM1_2
QCAKAYQPCGGNDYPNAPNCCEAGFACLMKNPNYHQC

SEQ ID NO: 3776 - protein, 36 aa, Neocallimastix californiae
  CBM1_2
ACGTDEIPCGGLLYPNAPGCCEGYVCYSMNAYYKEC

SEQ ID NO: 3777 - protein, 35 aa, Neocallimastix californiae
  CBM1_2
ECAKAYEMCGGSFNPVRCCEKGTVCTVFSEYHHEC

SEQ ID NO: 3778 - protein, 37 aa, Neocallimastix californiae
  CBM1_2
ECAKANQPCGGSYYPNAPTCCEPGYECTFRSPFFSLC

SEQ ID NO: 3779 - protein, 37 aa, Neocallimastix californiae
  CBM1_2
SYTPGYNPCGGTNFPDASPCCEQGFKCEFHNEKLAIC

SEQ ID NO: 3780 - protein, 37 aa, Neocallimastix californiae
  CBM1_2
SITKGYHPCGGLYYPDASPCCEEGFRCESNNQYTFVC

SEQ ID NO: 3781 - protein, 37 aa, Neocallimastix californiae
  CBM1_2
KLTPGFYPCGGSLFPDASPCCEEGFTCRYNNEYVSVC

SEQ ID NO: 3782 - protein, 37 aa, Neocallimastix californiae
  CBM1_2
SVTKGYYPCGGLRYPDESPCCEEGFRCQYQNPFYFQC

SEQ ID NO: 3783 - protein, 36 aa, Neocallimastix californiae
  CBM1_2
VCVARYAQCGGVNYHGSTKCCGNLTCVYRGEYYSQC

SEQ ID NO: 3784 - protein, 36 aa, Neocallimastix californiae
  CBM1_2
SCSTPYGQCGGINYNGPTCCPSGYTCKFISDYYYQC

SEQ ID NO: 3785 - protein, 35 aa, Neocallimastix californiae
  CBM1_2
NCAKEFDQCDGINYNGPKCCSVGKCVRLNDYYYQC

SEQ ID NO: 3786 - protein, 35 aa, Neocallimastix californiae
  CBM1_2
NCASQWAQCGGIGFNGPTCCSSGKCVKLNDWYSQC

SEQ ID NO: 3787 - protein, 36 aa, Neocallimastix californiae
  CBM1_2
QCAKHWDQCGGVNHRGPFCCESGLTCVFVNDYYSQC

SEQ ID NO: 3788 - protein, 37 aa, Neocallimastix californiae
  CBM1_2
QCGKAFEMCGGTLFPEAPNCCEPGNICVKKYDTYHQC

SEQ ID NO: 3789 - protein, 38 aa, Neocallimastix californiae
  CBM1_2
ECALKYSPCGGENFPEITTNCCEEGSSCLAHNQYYYQC

SEQ ID NO: 3790 - protein, 37 aa, Neocallimastix californiae
  CBM1_2
KCAKAYEPCGGLEHPNAPTCCEAGFACLQKNPNYHQC

SEQ ID NO: 3791 - protein, 37 aa, Neocallimastix californiae
  CBM1_2
QCAVAYGCCGGSDNPDAPNCCQSGYTCVKDDPRFWQC

SEQ ID NO: 3792 - protein, 37 aa, Neocallimastix californiae
  CBM1_2
QCGKSFEMCGGTLFPNVPNCCEPGNTCVIKHDTYHQC

SEQ ID NO: 3793 - protein, 37 aa, Neocallimastix californiae; identical to SEQ ID NO: 3790
  CBM1_2

SEQ ID NO: 3794 - protein, 37 aa, Neocallimastix californiae
  CBM1_2
KCARVYEICGGKNYPNAPKCCEPGSKCVHFSEDFYQC

SEQ ID NO: 3795 - protein, 37 aa, Neocallimastix californiae
  CBM1_2
KCSGPYEPCGGSSFLDYPRCCPPGYYCLHRNEIYHQC

SEQ ID NO: 3796 - protein, 37 aa, Neocallimastix californiae
  CBM1_2
KCSGPYEPCGGSSFLDYPNCCPPGYYCLHRNEIYHQC

SEQ ID NO: 3797 - protein, 37 aa, Neocallimastix californiae
  CBM1_2
KCSKPYEPCGGSGFLEYPRCCPPGYYCLHRNEIYHQC

SEQ ID NO: 3798 - protein, 37 aa, Neocallimastix californiae
  CBM1_2
KCSKPYEPCGGSGFLDYPRCCPPGYYCLHRNEIYHQC

SEQ ID NO: 3799 - protein, 36 aa, Neocallimastix californiae
  CBM1_2
QCGKAFEMCGGQLFPKAPNCCESGYTCVDRGTYHQC

SEQ ID NO: 3800 - protein, 32 aa, Neocallimastix californiae
  CBM1_2
VCVPAFGQCGGTDYRGSTKCCENLRCVYLNDY

SEQ ID NO: 3801 - protein, 37 aa, Neocallimastix californiae
  CBM1_2
NCANVYEYCGGINYPKAPKCCKPGSKCVKFNEYHHQC

SEQ ID NO: 3802 - protein, 37 aa, Neocallimastix californiae
  CBM1_2
TCAKSYEACGGSRYPNVPKCCTPGNVCVKNNNVFHQC

SEQ ID NO: 3803 - protein, 37 aa, Neocallimastix californiae
  CBM1_2
NCAREFNVCGGISNPYAPKCCKSGYICVSFNKYFSIC

SEQ ID NO: 3804 - protein, 37 aa, Neocallimastix californiae
  CBM1_2
TCSGPYEPCGGISFLDSPSCCPQGYYCLKRNENYHQC

SEQ ID NO: 3805 - protein, 37 aa, Neocallimastix californiae
  CBM1_2
ECARAFEMCGGTLFPNAPNCCEEGSTCNKKYPYYHQC

SEQ ID NO: 3806 - protein, 36 aa, Anaeromyces robustus
  CBM1_2
PDLKAYAQCGGKEYTGPNCCQAGTICTEINEHYSHC

SEQ ID NO: 3807 - protein, 35 aa, Anaeromyces robustus
  CBM1_2
TCVALYDQCGGEGYFGPTECCKGKCTSQGPYYSQC

SEQ ID NO: 3808 - protein, 36 aa, Anaeromyces robustus
  CBM1_2
NCATLWNQCDENGILGPSCCEKGSICKKYSDYYSQC

SEQ ID NO: 3809 - protein, 36 aa, Anaeromyces robustus
  CBM1_2
NCAKVWDQCGGATYYGPTCCESNSRCIVHNEYYSQC

SEQ ID NO: 3810 - protein, 36 aa, Anaeromyces robustus
  CBM1_2
VCAGNWNQCGGKEYTGPTCCNENYHCIYVNEYYSQC

SEQ ID NO: 3811 - protein, 37 aa, Anaeromyces robustus
  CBM1_2
VLTPAYQPCGGKQYPDASSCCVEGYICSRHSSDISIC

SEQ ID NO: 3812 - protein, 36 aa, Anaeromyces robustus
  CBM1_2
KCAKVYDQCGGIGFRGPTCCEPGTTCEFVVDYYSQC

SEQ ID NO: 3813 - protein, 37 aa, Anaeromyces robustus
  CBM1_2
VLTPGYQPCGGRKYRDASPCCVEGYVCSFHSNDISIC

SEQ ID NO: 3814 - protein, 37 aa, Anaeromyces robustus
  CBM1_2
ECAKSYGICGGTAYPDAPTCCEEGNFCWKRYDNLHQC

SEQ ID NO: 3815 - protein, 37 aa, Anaeromyces robustus
  CBM1_2
NCAKAYQPCGGLEYPDAPNCCEAGFACLRKNPNYHQC

SEQ ID NO: 3816 - protein, 37 aa, Anaeromyces robustus
  CBM1_2
QCAKAYDACGGSNYPNSPRCCIEGLTCVYESEAASYC

SEQ ID NO: 3817 - protein, 37 aa, Anaeromyces robustus
  CBM1_2
ECSKAYYPCGGSYYPDLPNCCEPGFVCVETTSVIKQC

SEQ ID NO: 3818 - protein, 35 aa, Anaeromyces robustus
  CBM1_2
QCARAYEMCGGYGYETKCCESGTICKVFSEYHHQC

SEQ ID NO: 3819 - protein, 36 aa, Anaeromyces robustus
  CBM1_2
ICAGGYGQCGGINYTGPTCCPSGYSCKKHNDYYSQC

SEQ ID NO: 3820 - protein, 37 aa, Anaeromyces robustus
  CBM1_2
NCIPDYEKCGGIGYNGPTCCENPNFKCEVINEYFHQC

SEQ ID NO: 3821 - protein, 36 aa, Anaeromyces robustus
  CBM1_2
LCADVWQQCGGVGYNGPTCCKGDYYCKSYSDYYSQC

SEQ ID NO: 3822 - protein, 40 aa, Anaeromyces robustus
  CBM1_2
KCIEAWGQCGGTVNGKKYNGSTCCVSGYKCKEYNTNYAQC

SEQ ID NO: 3823 - protein, 36 aa, Anaeromyces robustus
  CBM1_2
ECSKEFEMCGGSLYPDSPECCEGTFCLKSNSKYHQC

SEQ ID NO: 3824 - protein, 37 aa, Anaeromyces robustus
  CBM1_2
ECIKAYQQCGGLNYKGTISCCEEGYFCHKNDEHYHQC

SEQ ID NO: 3825 - protein, 37 aa, Anaeromyces robustus
  CBM1_2
KCGKVYDICGGTNYPNAPKCCESGSTCVAFSEIHHQC

SEQ ID NO: 3826 - protein, 37 aa, Anaeromyces robustus
  CBM1_2
TCAGAFEICGGTDYPNAPNCCITGYICNKIHVNYYLC

SEQ ID NO: 3827 - protein, 37 aa, Anaeromyces robustus
  CBM1_2
QCAGAFEICGGKDHPDAPNCCISGYVCDKTFKRHYIC

SEQ ID NO: 3828 - protein, 37 aa, Anaeromyces robustus
  CBM1_2
QCAGAFEICGGKDHPDAPNCCISGYACDKTFKRHYIC

SEQ ID NO: 3829 - protein, 37 aa, Anaeromyces robustus
  CBM1_2
KCADAYQSCGGLFNPNAPNCCKEGFTCVKKDPNFYQC

SEQ ID NO: 3830 - protein, 37 aa, Anaeromyces robustus
  CBM1_2
RCASAYNACGGTDYPDAPNCCVPNYVCIKTSSKYHQC

SEQ ID NO: 3831 - protein, 35 aa, Anaeromyces robustus
  CBM1_2
ECVKAYEMCGGMNTEKKCCEQGSRCVEFNEFYHQC

SEQ ID NO: 3832 - protein, 37 aa, Anaeromyces robustus
  CBM1_2
QCAKLYDICGGKLFPDAPTCCEQGSKCIIYDESISRC

SEQ ID NO: 3833 - protein, 37 aa, Anaeromyces robustus
  CBM1_2
ECAKPYQPCGGLGYPDAPNCCEQGYVCQHNDLYYHQC

SEQ ID NO: 3834 - protein, 36 aa, Anaeromyces robustus
  CBM1_2
QCSKEYEMCGGTLYPDAPSCCEGTFCWTKYKEYHQC

SEQ ID NO: 3835 - protein, 33 aa, Anaeromyces robustus
  CBM1_2
TCASLFAQCDGDGYNGPKCCQSGQCVKVNNWYS

SEQ ID NO: 3836 - protein, 36 aa, Anaeromyces robustus
  CBM1_2
ICGKIYEQCGGFYFSGPNCCEEGSRCIYQNDYYSQC

SEQ ID NO: 3837 - protein, 36 aa, Piromyces finnis
  CBM1_2
QYAKKWQQCGGIGYSGPTQCESGSECVATNEFYSQC

SEQ ID NO: 3838 - protein, 36 aa, Piromyces finnis; identical to SEQ ID NO: 3761
  CBM1_2

SEQ ID NO: 3839 - protein, 36 aa, Piromyces finnis
  CBM1_2
EDIEAYGKCGGKDWTGSTCCMVGTSCKEVNEWVSLC

SEQ ID NO: 3840 - protein, 35 aa, Piromyces finnis; identical to SEQ ID NO: 3762
  CBM1_2

SEQ ID NO: 3841 - protein, 36 aa, Piromyces finnis; identical to SEQ ID NO: 3839
  CBM1_2

SEQ ID NO: 3842 - protein, 115 aa, Neocallimastix californiae
  CBM6
NTNYASMMAWQGGVSTNGLGHTTVTYNRGEWTGVSNVDFGEAATSVKITAASNNGAVIRITTGSPNGDVVGYVSIPATGGNSNFKTVTADINTVSGTKHVFFVASGDVVVDTWQF

SEQ ID NO: 3843 - protein, 127 aa, Neocallimastix californiae
  CBM6
GTYEGVSQLSDVDGSKVNNASSFAWQYGITIKGQDNVLPVNYVKGAWTGISNVDLGNAKSITLKAYAPNGATIKVCVGSENGTVLGYVDIPKGNSLQNVTGNLDNASGTKNLFLVSSGDATIESWQL

SEQ ID NO: 3844 - protein, 115 aa, Neocallimastix californiae
  CBM6
KTYYASMMAWEGGVSINGLGHTTVTYNKGDWTGVSNVDFGNGAYGIKVSAASRNGAVIKIAAGSETGNALGYINIPATGGTNSFKTVTASLSKITGVKNIFFIASGDVVLDTWQF

SEQ ID NO: 3845 - protein, 115 aa, Anaeromyces robustus; identical to SEQ ID NO: 3844
  CBM6

SEQ ID NO: 3846 - protein, 114 aa, Piromyces finnis
  CBM6
STNYASMMAWQAGVSVNGLGHTTVSYNRGDWTGVSNVDFGDSATSVKISAASSNGATIRITSGSENGDVIGYVTIPATGGDKNFKTVTANVKASGTKNIFFVASGDVTIDTWQF

SEQ ID NO: 3847 - protein, 114 aa, Piromyces finnis; identical to SEQ ID NO: 3846
  CBM6

SEQ ID NO: 3848 - protein, 114 aa, Piromyces finnis; identical to SEQ ID NO: 3846
  CBM6

SEQ ID NO: 3849 - protein, 114 aa, Piromyces finnis; identical to SEQ ID NO: 3846
  CBM6

SEQ ID NO: 3850 - protein, 118 aa, Piromyces finnis
  CBM6
VYYEAEDGKLDGITVYKDLSGFSGTGYVGRFENPGNSITVTVNAPSTGMYDLSIIYCANMGQKINTLMVNGQSAGDVTFTENKKFESKDVGAIYLNKGKNTIGLVASWGWMWVDAFVI

SEQ ID NO: 3851 - protein, 188 aa, Neocallimastix californiae
  Cellulase
AKKILVAIWKQIAAEFADYDEHLIFEGMNEPRKVGDPAEWNGGDYEGWNFVNEMNDLFVKTIRSTGGNNALRHLMIPTYAACINDGAINNFKFPRGDDKVIVSLHSYSPYNFALNNGAGAVSNFYDGSEIDWAMNTINSNFISKGIPVIIGEFGAMNRNNENDRERWAEYYIKKATSIGVPCVIWDNG

SEQ ID NO: 3852 - protein, 274 aa, Neocallimastix californiae
  Cellulase
VNESGAEFGQGEYPGTYNKHYIYPDVKAIQASIDQGMNIFRVGFAWERLQRSLNAEFDATEFGRLDEVINYITSNGAVAIINPHNFARYKNAVIGTSQVPNSAFSNLWKRLAQKYKNNQKVWFGLVNEPHDMPTAQWFAAARDAVDTIRATGANNNVLVPGNAYTGAWNWKETFYGESNASVALRYFSSADKNIIFETHQYFDSDYSGTHEQCVQRPCNKLFVNFVEWLKANNLKGFIGEFGAAINRDCKACVEEAINYLEQNSANIVGWAWWA

SEQ ID NO: 3853 - protein, 491 aa, Neocallimastix californiae
  Cellulase
MKTSIVLTAVAALAAKASAACFAERLGYPCCKGNTVAYTDNDGKWGVENGNWCGIADTPSPAACWSTSLGYPCCSSSSAQVYYTDNDGKWGVENGDWCGIPTGSTGGSTGGSTGGGSVTPSGEQFTISGNPFSGVEFYINPYYVEEVDGAIAQMSDSSLIAKAEKMKTYSNAIWLDTIKNMQSWLESNLQGAQSQHQSSGKDVLTVFVVYDLPGRDCHALASNGELLANDGDFTRYKSEYIDVIEGHLKTYKSQPVVLIVEPDSLANMVTNLDSTPACRDSEKYYMDGHAYLIKKFGVLPHVAMYLDIGHAFWLGWDDNREKAGKVYAKVISSGAPGKVRGFTDNVANYTPWEDPTLSRGPETEWNPCPDEKRYLQAIQKDFKSAGIQSVYFVCDTSRNGKKVDRKHPGEWCNQTGVGIGARPQASPVSGMEYLDAFYWIKPLGESDGTSDESAARFDGYCGHETAMKPAPEAGQWFQKHFEQGIKNANPP

SEQ ID NO: 3854 - protein, 84 aa, Neocallimastix californiae
  Cellulase
EDENILFEVHQYFDTDYSGSHDTCVQRPCQNNLKEFVEWLKTNNLKGWVGEIGGLANDECKECIEEVLEYLQENRDVIKGVQWW

SEQ ID NO: 3855 - protein, 190 aa, Neocallimastix californiae
  Cellulase
VDSKGRKVQLSGLSWFGGETTNLSPHGLWTNSLANFIKIVKDNGYNHLRYPWTNEMFFEGAKTQSIDQMNNPDLVDLSPLEVMDAVINECGKAGLKVYLDRHRPLSGGQSELWYVDEVDEAKWIEDWQFLAKRYKGNPTVIGADLHNEPHGKACWGCGEEERDWRLAAERCGNAIHEVNPDWLIIVEGND

SEQ ID NO: 3856 - protein, 489 aa, Neocallimastix californiae
  Cellulase
MKTSLALITVTTLAAKASAACFSQSLGYPCCSGNDVVYIDNDGKWGVENGNWCGIADTPAPAACWSTSLGYPCCSSSSAQVYYTDNDGKWGVENNDWCGIPTGSIGGGNSGGNEEVNVTPGEQYTHNGNPFSDVEFFINPYYTAEVDAAIAQMSDSSLIAKAEKMKTYSNAIWLDTIKNMNEWLEKNLKGALAQQSGSKKVLTVFVVYDLPGRDCHALASNGELLANDGDLARYKSEYIDVIEGHLKTYKSQPVVLIVEPDSLANLVTNLESTPACADSEKYYLDGHAYLIQKFGILPHVAMYLDIGHAFWLGWDDNREKAAKVYSKVISSGSPGKVRGFTDNVANYTPWEDPTLSRGPDTEWNPCPDEKRYLEAMHKDFKAAGISSVYFVCDTSRNGKKVDRKHPGEWCNQTGVGIGARPQASPVSGMEYLDAFYWIKPLGESDGTSDESAARFDGYCGHETAMKPAPEAGQWFQKHFEQGIKNANPP

SEQ ID NO: 3857 - protein, 310 aa, Neocallimastix californiae
  Cellulase
VDSKGRKVQLSGLSWFGGETTNLSPHGLWANSLANFIKIVKDNGYNHLRYPWTNEMFFEGAKTQSVDQVNNPDLADLSPLEIMDAVINECGKAGLKVYLDRHRPLSGGQSELWYVDEVDEAKWIEDWQFLAKRYKGNPTVIGADLHNEPHGKACWGCGEEERDWRLAAERCGNAIHEVNPDWLIIVEGNDHYGEEGWQKGESYWWGGMLKGVKEFPVRLNTPNKLVYSAHDYDKNVHMQDWFKEADFPDNMPPIWDDKWGYIVKEDIAPVLIGEFGSLLRDATDVKWLSNLIDYMKENEVHWTFWCLNPN

SEQ ID NO: 3858 - protein, 280 aa, Neocallimastix californiae
  Cellulase
YNKNPIASETCWGNVKTTQELYYKLSDLGFNTFRIPTTWSGHFGDAPDYKINDQWMKRVREIVDYALNTGGYAILNIHHETWNHAFQKNLDSAKKILVAIWKQIAAEFADYDEHLIFEGMNEPRKVGDANEWNGGDYEGWSFVNEMNDLFVKTIRATGGNNALRHLMIPTYAACVMDNAVNNFKFPSGDDKVIVSLHSYSPYNFALNNGAGAISNFNDGSEIDWVMNIINSNFISKGIPVIIGEFGAMNRNNEDDRERWAEYYIKKATSLGIPCVIWDNG

SEQ ID NO: 3859 - protein, 310 aa, Neocallimastix californiae
  Cellulase
VDEKGRKVRLAGISWFGGETTNLSPHGLWAKPLDHFIKVIKDHGYNHIRYPWTNEMLFPGAKTESINAMENPDLVDLTPLEVMDAVIDACGKAGLKVYLDRHRPLSGGQSELWYISKVDEKKWIEDWQFLAKRYKGNPTVIGADLHNEPHGTACWGCGETQRDWRLAAERCGNAIHEVNPDWLIIVEGNDHYGEEGWQKGEGYWWGGMLKGVKENPVRLKKPNKLVYSAHDYDKNVHMQDWFKVSSFPDNMPEIWDDKWGYIVKEDIAPVLIGEFGSLLRDKTDVKWLQNLISYMNKNTVHWTFWCLNPN

SEQ ID NO: 3860 - protein, 103 aa, Neocallimastix californiae
  Cellulase
SFNNFIFPEDDDKVIASVHAYAPYNFALNNGEGAVDKFDAAGKRDLEWNINLMKKRFVDQGIPMILGEYGAMNRDNEEDRATWAEFYMEKVTAMGVPQIWWDN

SEQ ID NO: 3861 - protein, 457 aa, Neocallimastix californiae
  Cellulase
MKASIALTAAAALAAKASAACFAERLGYPCCSGNEVVYTDNDGKWGVENGNWCGIADAPTCWSLSQGYPCCSSSNAEVWYTDASGKWGVENGDWCGIPTGSTGGSTGGSTGGGNVTPSNEQYTISGNPFKGVEFYINPYYVEEVDGAIAQMSDSSLIAKAEKMKTYSNAIWLDTIKNMQSWLESNLQGAQSQHQSSGKDILTVFVVYDLPGRDCHALASNGELLANDGDLARYKSEYIDVIEGHLKTYKSQPVVLIVEPDSLANLVTNLESTPACADSEKYYLEGHAYLIKKLGVLPHVAMYLDIGHAFWLGWDDNREKAGKVYAKVISSGAPGNVRGFTDNVSNYTPWEDPTLSRGPETEWNPCPDEKRYLEAISKDFKSAGIKSVYFVSDSSRNGKKVDRKHPGEWCNQTGVGVGARPQASPISSMEYLDAFYWIKPLGESDGTSDDYSCSLRWL

SEQ ID NO: 3862 - protein, 457 aa, Neocallimastix californiae
  Cellulase
MKFINLVATSILATCALASSCHPQYNCCNSCDVVYTDNEGEWGVENNNWCFINDAKCHPSSCKFEALGYPCCSHCNSIYHDESGDWGVENGDWCGIQESNCGSTPSGTTIRKTTTTTTTKKTYPTITPSFFSTGNIYSNSQYQGEVQSSINKLSGELQQQANRVKYTPTAVWLAWDGAPGEVPKHLGAAGGNTAVFMMYWIPTRDCNSNASQGGASDLNSYKNYVDSVYNSFRSYGNSKIVVVVEPDTLGNMVTSQGNENCRRTAVIHKQALAYAINKFGSLNNVQVYLDAGHSQWLTGYEDETAEIIKEILDMAPQGKIRGFSTNVSNFQPVQREYEYHTRLYDALEKVGVKNMRFIVDTSRNGVDISEEFAKTKTWCNFVGTGFGERPKGNPDPVNMPLLDAYMWLKPPAESDGSSTGARADPVCARSDSLPGAPDAGQWFHEYFVQLLKNANPK

SEQ ID NO: 3863 - protein, 485 aa, Neocallimastix californiae
  Cellulase
MKASFALTAIAALTAKVSAACFSERLGYPCCKGNTVVYTDNDGKWGVENNNWCGIGSTSGSSAACWSQALGYPCCSHKNVVYTDNDGDWGVENGDWCGIIKGGSGSGSGGGSAAIGEQYTINGNPFANVEFYINPYYVEEVDNAISQMSDSSLIAKAEKMKTYSNAIWLDNIKNMQSWLQPNLEGALSQQNSGGTPVLTVFVVYDLPGRDCHALASNGELLANDSDMERYKSEYIDVIEGHLKTYKSQPVVLVIEPDSLANMVTNIESTPACADSQNYYFDGHAYLLKKLGVFPNVALYLDIGHAFWLGWDDNREKAAKVYAKVIQSGAPAKVRGFVDNVANYTPWEDPTLSRGPDTEWNPCPDEKRYLEAMHKDFTSAGIQSVYFFSDSSRNGKKTDRKHPGEWCNQTGCGIGARPKASPISGMEYLDAFYWVKPIGESDGTSDTSAKRYDGYCGHETAMKPAPEAGQWFQKFFEEGLKNANPP

SEQ ID NO: 3864 - protein, 322 aa, Neocallimastix californiae
  Cellulase
MKASIALTAVAALAAKASAACFSERLGYPCCSGDEVVYTDNDGKWGVENGNWCGIADAPAPAACWSTSLGYPCCSSSNAEVWYTDDSGKWGVENGDWCGIPQNEIVKGGQYTISGNPFKGVEFYINPYYVDEVDGAIAQMSDSSLIAKAEKMKTYSNAIWLDTIKNMQSWLESNLKGALAEHNSTGKDILTVFVVYDLPGRDCHALASNGELLANSGDMERYKSEYIDVIEGHLKEYNSQPVVLIVEPDSLANLVTNLESTPACRDSEKYYLDGHAYLIQKLGVLPHVAMYLDIGHAFWLGWDDNREKAGKVYAKVIQFRFT

SEQ ID NO: 3865 - protein, 417 aa, Neocallimastix californiae
  Cellulase
MKTSIALTAVAALAAKASAACFSERLGYPCCSGNEVVYTDNDGKWGVENGNWCGIADAPAPAACWSTSLGYPCCSSSSAEVWYTDDSGKWGVENGDWCGIPTGSTGGSTGGSTGGNATPGEQYTINGNPFKGVEFYINPYYVDEVNGAIAQMSDSSLIAKAEKMKTYSNAIWLDTIKNMQSWLESNLEGALSQQESTGKKVLTVFVVYDLPGRDCHALASNGELLANSGDMERYKTEYIDVIEGHLKKYKSQPVVLIVEPDSLANMVTNIETTPACADSQNYYYDGHAYLLKKFGVLPHVAMYLDIGHAFWLGWDDNREKAGKVYAKVIQSGSPGKVRGFTDNVSNYTPWEDPTLSRGPETEWNPCPDEKRYLEAMHKDFKAAGIESVYFVSDTSRNGHKTDRKHPGEWCNQTGVGI

SEQ ID NO: 3866 - protein, 263 aa, Neocallimastix californiae
  Cellulase
MKTSIALTAVAALAAKASAACFSERLGYPCCSGDEVVYTDNDGKWGVENGNWCGIADAPTCWSLSQGYPCCSSSNAEVWYTDASGKWGVENGDWCGIPTGTTGGNVTPSNEQYTISGNPFKGVEFYINPYYVEEVDGAIAQMSDSSLIAKAEKMKTYSNAIWLDTIKNMQSWLESNLQGAQSQHQSSGKDILTVFVVYDLPGRDCHALASNGELLANDGDLARYKSEYIDVIEGHLKTYKSQPVVLIVEPDSLANLVTNLEST

SEQ ID NO: 3867 - protein, 433 aa, Neocallimastix californiae
  Cellulase
MKVLNILSILTAAGSAIASKCHPYYDCCKGCQTILTDEEGNWGSENGQWCFVDEKKCESVLGTCKFEAIGYPCCSHCDVILTDDDGNWGAENGQWCGIPENCGSTEPSTNQSVAPTENFFDNELYISPNYVKEIESTIPDLSPELQAKAKNVEKVSSAVWLAYEGAPNDVAPHLKAAGSKTVTFILYMIPTRDCNSLASAGGVSDLDKYKGYVDKIANTIKKFPESKVVMVIEPDTLGNLITGETEACKNVHTLHKQALAYAANVFGNMSNVSAYLDAAHSKWLGWAADKVAAVVKEILDNAPNANIRGFSTNVSNYMPIEAEYEYHQKLHDALEEVGIKDKRFIVDTGRSGVDVREEFDVNQTWCNLIYAGLGEPSRGSPDPENMPLLDAFMWLKPPGEADGSDTGSRADPVCGREDSFPGSPDAGSWFGEY

SEQ ID NO: 3868 - protein, 489 aa, Neocallimastix californiae
  Cellulase
MKVSFVLSAIAALAAEVSAACFSERLGYPCCKGNNVVYTDNDGKWGVENNNWCGIGSNSGGSSAACWSQALGYPCCTHKNAVYTDGDGDWGVENGDWCGIIKGGSSGGSGGNGGGDATIGDQYTIEGNPFANVEFYINPYYVEEVDNAISQMSDSSLIAKAEKMKTYSNAIWLDNIKNMQSWLEPNLKGALSQQNSGGTPVLTVFVVYDLPGRDCHALASNGELLANDSDMERYKSEYIDVIEGHLKTYKSQPVVLVIEPDSLANMVTNIESTPACADSQTYYYDGHAYLLKKLGVFPNVALYLDIGHAFWLGWDDNREKAAKVYSKVIQSGSPAKVRGFVDNVANYTPWEDPTLSRGPDTEWNPCPDEKRYLEAMHKDFKAAGIQSVYFFSDSSRNGKKTDRKHPGEWCNQTGCGVGARPKASPISGMEYLDAFYWVKPIGESDGTSDTSAKRYDGYCGHETAMKPAPEAGQWFQKFFEEGIKNANPP

SEQ ID NO: 3869 - protein, 249 aa, Neocallimastix californiae
  Cellulase
INAIEASIEQGMNVFRMGLRWERFQHELFGDLTEFDLTEYKKIVDATTAKGAVLIIDPHNYARYNNNVIGSEEVPIEAFADFWAKLAEVFKDNEKVWFDLVNEPHDMETDDWFKAARAAVDAIRTTGAKNNILISGNGWDGAWSWGKEAWYGESNADVALRYFSSEDENIIFEVHQYFDSDYSGTHDTCVQRPCQNLLKEFVEWLKTNNLKGWLGETSSTLSEGCKECVQEVLEYLEENREHVLGVTWW

SEQ ID NO: 3870 - protein, 80 aa, Neocallimastix californiae
  Cellulase
IIFEVHQYFDSDYSGTHDTCVQRPCQNLLKEFVEWLKTNNLKGWLGETSSTLSEGCKECVQEVLEYLEENREHVLGVTWW

SEQ ID NO: 3871 - protein, 476 aa, Neocallimastix californiae
  Cellulase
MKAFIALSTVIALAAKSSATCWSEKLGYPCCSSSDAEIIYTDKDGNWSIENYEWCGIPKAVTCWSETYGYPCCKTTNKVVYTDEDGKWGVEDKKWCGIIKKEDDDEFPGPEQVPLEGSGNPFKDAEFYINPYYTTEVDAAITKISNASLIAKAEKMKEFSNAIWLDSIKNMNELLESSLNGALAQQESGYKKVLTVFVVYNLPGRDCHALASNGELLANDADFDRYKSEYIDVIEGHLKTYKSQPVVLIVEPNSLTNLVTNLESTPACSDSEKYYREGNAYLIKKFGVLPHVALYLDIGHAYLLGWDDTREKAARLYHDVIRSGAPGNIRGFADNIGGFVPWDDPNLSNGPETEWNPCPDEKRYLKAMYSDFVSAGIHSVKFVTDTSHNGKKFDYSDRELWCKSTSAGVGARPMAIPITTIDYLDAFYWIKPFGNVSELPNQSSFDNVCKDGLEIYSSDTWSQKVFEEGIRNANPP

SEQ ID NO: 3872 - protein, 298 aa, Neocallimastix californiae
  Cellulase
ATGDWINGNNVNAYETAWGNPAATKELINAIKNNGFNSIRIPVSWSNLMSSDYTISEELLKRVNEVVSWVIENDMYAIINIHWDGGWIEKFGTNESTMANQKFVKIWNQVSDYFKNYGEHLIFESLNEEGCWNDVWNRYSNAGDKNKAYSTLNNINQQFVDIVRKSGGNNKSRHLLIAGYCTDIDLTVDSAFKMPTDSENRMMVSVHYYTPSTFTILEKDEDWGKFQGTWGTDADVNELITNFDKLKKRFVDNGVPVIIGEYATVLTNKDKASVHKYLFTCAQYATSLGICPMLWDNG

SEQ ID NO: 3873 - protein, 260 aa, Neocallimastix californiae
  Cellulase
NTHYTYPNIDAISTSIEQGMNAFRMGLRWERFQHELFGELTEFDLTEYKKIVDAVTAMGAVIIVDPHNYARYKDKLIGSEEVPTEAFVDFWKKMANVFKDNDKVWFGLVNEPHDMKTDDWFKIARAAVDGIRSTGANNTILIPGNGWDGAWSWGSQAWYGESNAEVALRYFSSEDENIAFEVHQYFDSDYSGGHGTCEKRPCQNNVKEFVQWLKDNNLKGWFGEFSGHISDSQCKECVQEFLEYLQLNNEYVLGATWWAA

SEQ ID NO: 3874 - protein, 297 aa, Neocallimastix californiae
  Cellulase
TGDWINGRNVNAYETAWGNPAATKDLIKAIKNNGFNSIRIPVSWSNLMSSDYTISQELLKRVNEVVSWVIDTGMYAIINIHWDGGWIEKFGTNESTMANQKFNKIWTQVSDYFKNYGEHLIFESLNEEGCWNDVWNRYSNSGNKNKAYSTLNNINQQFVDIVRKSGGNNKNRHLLIAGYCTDIDLTVDSAFKMPSDSANRMMVSVHYYTPSTFTILEKDEDWGKFQGTWGTDAEIKTLMADFDKLKKRFVDNGVPVIIGEYATVLTNKDKASVHKYLFTCAQYATSLGICPMLWDNG

SEQ ID NO: 3875 - protein, 466 aa, Neocallimastix californiae
  Cellulase
MKFSTVLTTLFAAGALASQCHWQYPCCDNCEVYYTDNEGKWGILNNDWCKINDNRCNANSASNTCSSRITSQGYKCCSNCIVYYTDNDGEWGVEDGNWCGTPDKCKGDNNNSTNNNNNNNNNNNNNNNGGNQQPKPIGDNFFENELYSNFKFQGEVDSSIKKLSGNVKQKAEKVKYVPTAAWLAWEGAPNEVPQYLDEAGSKTVVFVLYMIPTRDCNANASAGGTANIDKYKSYVDKIYNTINKYPNSRIVMILEPDTIGNLVTANNANCRNVQNMHKQALSYAISKFGTQSNVRVYLDAAHGAWLNPHADKTAQVIKEILNNAGNGKLRGISTNVSNYQSVASEYKYHQNLNRALENLGVRGLKFIVDTSRNGANVEGAFNASGTWCNFKGAGLGERPKGNPNPGSMPLLDAYMWIKTPGEADGSSQGSRADPVCARGDSLQGAPDAGSWFHDYFVMLINNANPP

SEQ ID NO: 3876 - protein, 287 aa, Neocallimastix californiae
  Cellulase
VDSKGRKVQLSGLSWFGGETTNLSPHGLWANSLANFIKIVKDNGYNHLRYPWTNEMFFEGAKTQSVDQVNNPDLADLSPLEIMDAVINECGKAGLKVYLDRHRPLSGGQSELWYVDEVDEAKWIEDWQFLAKRYKGNPTVIGADLHNEPHGTACWGCGETKRDWRLAAERCGNAIHKVNPDWLIIVEGNDHYGEEGWQKGEGYWWGGMLKGVKENPVRLNTPNKLVYSAHDYDKNVFMQDWFKESDFPDNMPPIWDDKWGYIVKEDIAPVLIGEFGSLLRDATDVKW

SEQ ID NO: 3877 - protein, 234 aa, Neocallimastix californiae
  Cellulase
MEAIDYFIAAASQRNIRLVLGFTNNWTDYGGMDEWVKGFGGKYHDDFYTNKEIRNAFKRYIKTVITRINRHTNIRYRDDPTIFSWQLANEPRCGNGPSGLPQSGKCTPEVITEWADDISSYIKELDPNHLVSVGVEGFGLEAPKGSKGLYAYKYDEGTDFEALTALPNVDYNTYHYYPIPWGMTDLISHTKDWIESHQAVGKKLNKPVVFEEWGLEVPTDCSKEERIQYYKTWT

SEQ ID NO: 3878 - protein, 310 aa, Neocallimastix californiae
  Cellulase
VDEKGRKVKLAGLSWFGGETPNLSPHGLWAKPLAHFIKVIKDHGYNHIRYPWTNEMFVEGAKTESINAMENPDLVDLTPLEVMDAVIDACGKAGLKVYLDRHRPTAAGQSELWYISKVDEKKWIEDWKFLAKRYKGNPTVIGADLHNEPHGTACWGCGETERDWRLAAERCGNAIHEVNPDWLIIVEGNDHFGEEGWQKGESYWWGGMLKGVKENPVRLNKPNKLVYSAHDYDKNVHMQEWFKLSTFPDNMPEIWDDVWGYISKEDIAPVLISEFGSLLRDKTDVKWLENLVSYMNDNAVHWTFWCLNPN

SEQ ID NO: 3879 - protein, 286 aa, Neocallimastix californiae
  Cellulase
TTKQYETAWGNPETTEAMIKGVKSYGFKSVRIPVAWSNLMSSDYTISPLLLKRVEEVVNYVVKNDMYAIMNIHWDGGWFEKFSTSEQEAFTKYKKVWEQLTDYFKSFDEHLIFESLNEEGCWDSIWNRYSKSGDKAKAYGLLNTINQNFVDIVRNSGGNNTNRHLLLAGYCTDIDLTVDEAYVVPKDDRVMVSVHYYTPSTFTLLEEDADWGKAAPTWGTDDEVNYLINDFNKLKTRFVDKGIPVIIGEYGTTAKNKDTESIHKYLMTCAEYALNLDMCPVVWDAG

SEQ ID NO: 3880 - protein, 291 aa, Neocallimastix californiae
  Cellulase
RVDLALEAYARHNLNVVRAWAFCDECEDATRLVDFSGPEVTLNSENMEKVDYYLAAAAQRNIRVVLTLTNNWTDYGGMDVWVKQFGGKYHDEFYTNRKIVEGYKQYIKAMINRVNTYTGQLYKDDPTIFSWQLANEARCNNGPHGLPVKNCNTDTITNWMDEIASFIHQEDPNHLVSSGIEGIGLTPPSGVDPNTYVYRYDEGTDYEAISALDSIDYNTVHMYPVGWGLKDYSKDGVTWIKAHADVDKKFNKPTVVEEWGLSTSADNVPLEERDPIYTKWMDAVLANDNIG

SEQ ID NO: 3881 - protein, 429 aa, Neocallimastix californiae
  Cellulase
CDVYYTDDEGEWGIQNNNWCFINDANCHPSNVCKFEAIGYPCCSHCNIVYTDDSGNWGIENDDWCGIRDNCGGNTPSSSSTTTTTTTTTTTKKTYPTVAPSFFSSGNIYSNSQYQSEVQSSINKLSGELQQQASRVKYTPTAVWLAWYGAPNEVPKHLGAAGGNTAVFIMYWIPTRDCNSNASQGGASDLNSYKNYVDSVYNTFRSNGNSRIVIVIEPDTIGNIVTSQGNENCRRTAIIHKEALAYAVNKFGSLNNVQVYLDAGHSQWLTGYEDETAAIIKEILDMAPQGKIRGFSTNISNFQPVQREYEYHTRLYDALEKVGISNMRFIVDTSRNGVDISEAFAKTKTWCNFVGTGFGERPKGNPDPINMPLLDAYMWLKPPAESDGSSQGMRADPVCARPDSLPGAPEAGQWFHDYFVQLLRNANPK

SEQ ID NO: 3882 - protein, 268 aa, Neocallimastix californiae
  Cellulase
SVENINQPWAEKNFTAKEIVESYKQLGFNAIRIPVKWAKTINSKTVIEPNLLKSVEEVVRQTLNNNMFAIINLETSNTFMTGFISEDDNIRSETYDGYKGIWKQISNYFKDYDEHLLFESMNDSGYWEDIWNTRTSDGDRQYALDILRQVNQEFINMVRSTGGSNEERYLLVSGYANDPILTQDNFYKIPSDPSHKLMVSLYYYVPNHFTIIDNYYTWGSQDDIKQLQTIMKNLSVRFVIQGVPVVITRYGTIVKNRSSANIHSYLTS

SEQ ID NO: 3883 - protein, 498 aa, Neocallimastix californiae
  Cellulase
KKKKKSYLVKMKASIALSAAAVLAAKVSADCFSSRLGFPCCSSSSAEVWYTDSDGKWGVENDGWCGIPEAPSPAQCWSEAQGYPCCKFTSDVVFTDNDGNWGVENGNWCGIQKKNGNNDNTNLDDVTPDNQITLNGNPFANKIFYINPYYVEEVDGAIAQMIDASLISKAEKMKTFSNAIWLDTIKNMQSWLEPNLKGALAQQKSAGKEVLTVFVVYDLPGRDCHALASNGELLANKGDWARYKSEYIDVIEEKLRTYKSQPVVLIVEPDSLANMVTNLDSTPACRDSERYYMDGHAYLIQKFGVLPHVAMYLDIGHAFWLGWDDNRQKAGKVYSKVIQSGAPGKVRGFTDNVANYTPWEDPTLSRGPETEWNPCPDEKRYLEAIHKDFTAVGIPSVYFVCDTSRNGKKVDRKHPGEWCNQTGVGIGARPQASPISGMPYLDAFYWIKPLGESDGTSDTSAARFDGYCGHETAMKPAPEAGQWFQKHFEQGLKNANPP

SEQ ID NO: 3884 - protein, 245 aa, Neocallimastix californiae
  Cellulase
LDGNGNEFIFRGINIAHAWYTDKTEFSINEINALGANSARIVLACGAKYTKTSYTEVEKIIGWCEKAGLVCVLELHDFTGSDNPSDITTTALNYWKEMKDLVNTHKDYIIINIANEWQGSWNKGSLWGNTYSSAVKSMRNIGIQNAIMIDASGYGQETGPMINYAQSVLSADPNKNVIFSYHVYSVLGKDNTSLYSGFDGIKAKGVCWIVGEFGWWQNGGDVVYKSLMSYCNSNRIGWIAWSWSG

SEQ ID NO: 3885 - protein, 265 aa, Neocallimastix californiae
  Cellulase
TVENINQPWDKKSFTAKEIVESYKQLGFNAIRIPVNWATKINSKTIIEPNLLKSVEEIVHNTIDNNMFAIINLETSNSFMTGFISEDEELRSETYDGYKNIWKQVSNHFKDYDEHLLFESMNDSGYWEDIWNTRTTDGDRQAALDVLRQVNQEFINAVRSTGDNNEKRYLLVSGYANDPILTQDNFYKIPSDPSHKLLVSLYYYVPNHFTTIDNYYTWGSQEDVKQLQTIMKNLSIRFVIQGVPVIITRYGTIVKNRSSANINSY

SEQ ID NO: 3886 - protein, 313 aa, Neocallimastix californiae
  Cellulase
DENDEPVRIAGVNWFGTETAQLSPHGLWSKNLTEILYLIVDHGYNTIRYPYCNDIFKPGASTVSIEYYRNPWAKGLSPLEVMDVVIREATDLGLKIILDRHRPDFQAQSALWYTSAVSEEQWISDWQKLAKRYKDNSGVIGADLHNEPHDEACWGCDDISIDWRLAAERCGNAIHEINPNWLIIVEGIHHIGETCWQCGDNYWWGGYLKKGVVDIINKPVNLKIPNRVVYSTHDYPREVFPQTWFDDPTFPDNMPDKWYNYWSWIKKDNIAPILVGEFGTKLEDDWDRVWLKTLVNYMKENRLHWTFWCLNEN

SEQ ID NO: 3887 - protein, 488 aa, Neocallimastix californiae
  Cellulase
MKASLALTAIAALAAKASAACWSEAYGYPCCSSASTKVIYTDSDGEWGVENGNWCGISKDDPRGGCFSDTLGYPCCTSTTNVIYTDSYGRWGIENSNWCILDDSSNPGYGSDDYTVGSQYSLSGNPFAGHKFYVNPYYVDKVDKAIAQMHDYDSSLKFKAEKMKEYSNAIWLDTINNMEAWLERNLKGALAQQNAEGSRVLTVFVVYDLPGRDCQALASNGELLANNGDMKRYKSEYIDIIDRRLSTYKSQPIVLVIEPNSLANLVTNLENIPACADSEKYYLDGHAYLIKKFGSHPHVAMYLDIGHAFWLGWDDKRASAAKIYSKVINPGAPGKVRGFASNVANYTPWEDPELSRGPDTEWNPCPDEKRYIKAMYKEFKAAGISSVYFIEDTSRNGHKTYRNHSGEWCNQMGSGIGARPKAYPVSGMEYLDAFYWVKPYGESDGTSDESDKSFDGYCGHATAMKPAPEAGQWFQKFFEEGLMNANPP

SEQ ID NO: 3888 - protein, 273 aa, Neocallimastix californiae
  Cellulase
NESGAEFGEGKYPGVYNTDYIYPDVKAIQASIDQGMNIFRVGFSWERMQRTLNSAFDTTEFKRLDEVISYITKNGAVAILNPHNFARYRNSVVGSSQVPNSAFADFWKRMADKYKSNNKVWFGLVNEPHDMPTEQWFSAARDAVNAIRKAGANNNVLVPGNSYTGAWCWTKTHYGSPNSKVALEYFNASDKNIIYEVHQYFDSDYSGTHEQCVQRPCNKLFTDFVDWLKENNLKGFVGELGAAINNDCKACVEEALNYLEKNSDYVVGWTWWA

SEQ ID NO: 3889 - protein, 310 aa, Neocallimastix californiae
  Cellulase
VDQKGRNVKLAGISWFGGETDNLSPHGLWSKSLAHFIKVIKDNGYNHIRYPWTNEMLLSGARTKSINAMENPDLANLTPLEVMDAVINAAGKAGLKVYLDRHRPTAAGQSELWYISKVDEKKWIEDWKFLAKRYKGNPTVIGADIHNEPHGTACWGCGETKRDWRLAAERCGNAIHEVNPDWLIIVEGNDHYGEEGWQKGESYWWGGMLKGVKQYPVRLNKKNKLVYSAHDYDKNVHLQDWFKVSNFPDNMPSIWDDKWGYIAKQNIAPVLISEFGSLLKDKTDVKWLQNLISYMNKNGVHWTFWCLNPN

SEQ ID NO: 3890 - protein, 494 aa, Neocallimastix californiae
  Cellulase
MKASIALTAIAALAAKVYAVPPSCFSLKLGYPCCSNASTPSVYEDSDGKWGVENGNWCGIPEQVKVCWSEKLGYPCCTSTSVSVFEDNDGKWGIENGNWCGIINGPTPTPTPTPKTTPNPEPTIDPTQYKINGNPFKGVDFYLNPYYVEEVENALNNLIDSSLRSKVEKMKTFSNAIWLDTINNMQSWLEPNLKGALAQHQSTGKDVLTVFVVYDLPGRDCHALASNGELLANDADAQRYKTEYIDVIESHLKQYTAQPVVLIIEPDSLANMVTNLDDPHCSQSESYYMDGHAYLLKKFGVLDHVAMYLDIGHAFWLGWDDNREKAAKLYKKVIDSASPGKVRGFVDNVANYTPWEDPTLSRGPDTDWNPCPDEKRYLEAVKKDFTSAGIKSVYFVSDTSRNGHKTDRKHPGEWCNQTGVGVGARPQASPVSGMDYLDAFYWIKPLGESDGTSDESAVRFDGYCGHDTAMKPAPEAGQWFQAHFEQGVENANPP

SEQ ID NO: 3891 - protein, 487 aa, Neocallimastix californiae
  Cellulase
MKSTVALTAVAALAAKASAACWSENLGYKCCSSANAPIVYTDSDGNWGVENGNWCGIPVPETCWAEKLGYSCCTSTSQVVYTDGDGNWGVENGNWCGIITGLTPTPGPSPNPDPTPDNTQFKISGNPFKGVDFYLNPYYVEEVENAIKQMTSSSLKAKAEKMKTYSNAIWLDNIKNMQSWLEPNLKGALAQHQSTGKDVLTVFVVYDLPGRDCHAMASNGELLANDSDAQRYKTEYIDVIESHLKKYTAQPVVLIIEPDSLANMVTNIENTPACAESETYYYDGHAYLLKKFGVLDHVAMYLDIGHAFWLGWDDNREKATKVYKKVIDSGSPGKVRGFVDNVANYTPWEDPTLSRGPDTEWNPCPDEKRYLEAMYKDFTSAGIKSVYFVSDSSRNGHKTDRKHPGEWCNQTGVGIGARPQASPISGMDYLDAFYWIKPLGESDGTSDESADRFDGYCGHDTAMKPAPEAGQWFQKHFEQGLENANPP

SEQ ID NO: 3892 - protein, 487 aa, Neocallimastix californiae
  Cellulase
MKTTIALTAAAALAAKVSAACWSQSLGYSCCTNASTPVVYSDNDGDWGVENGNWCGIPVPETCWAEKLGYSCCTSTSQVVYTDGDGNWGVENGNWCGITTGSTPGPSPSPNPDPTPDNTQYKISGNPFSGVEFYLNPYYVEEVENAIKQMTSSSLKAKAEKMKTYSNAIWLDNIKNMQSWLEPNLKGALSQHQSTGKDVLTVFVVYDLPGRDCHALASNGELLANDSDAQRYKTEYIDVIEKQLKQYTAQPVVLIIEPDSLANMVTNIETTPACAESQDYYFDGHAYLLKKFGVLDHVAMYLDIGHAFWLGWDDNREKASKVYKKVIDSGSPGKVRGFVDNVANYTPWEDPTLSRGPETEWNPCPDEKRYLQAMYKDFTAAGIKSVYFVSDSSRNGHKTDRKHPGEWCNQTGVGIGARPQASPISGMSYLDAFYWIKPLGESDGTSDESAARFDGYCGHDTAMKPAPEAGQWFQKHFEQGLENANPP

SEQ ID NO: 3893 - protein, 285 aa, Neocallimastix californiae
  Cellulase
TKQYETAWGNPVTTEEMIKGVKSYGFSTVRIPVAWSNLMSSNYTISPLLLNRVEEVVNYVVKNDMYAIVNIHWDNGWFTKFATDEEEAFIKYKRIWGQISEHFKDYDEHLIFESLNEEGCWESIWNNYSNEGDKPKAFGLLNTINQNFVDIFRNSGGYNAERFLLLAGYCTGIDHTIDKNYILPKDDKVMVSVHYYGPSTFTILEEDADWGKAAYYWGTEEEINNITNDLIKVKTHFVDNNIPVIIGEYGTATTNKDPESVRKWLRTVAGKATELGICPIVWDAG

SEQ ID NO: 3894 - protein, 489 aa, Neocallimastix californiae
  Cellulase
MKASIALTTIATIAAKASADCFSTRLGYPCCSGNTVAYTDNDGDWGVENGNWCGIGNTSSSASCWSTALGYPCCSSSSAEVWYTDNDGAWGVENGDWCGIPTGSSGGNTPVNPGNDGNDVNVTPGDQYSHNGNPFKDVEFFINPYYTAEVDAAIAQMSDSSLISKAEKMKTFSNAIWLDTIKNMNEWLEKNLKGALAQQTGNKKVLTVFVVYDLPGRDCHALASNGELLANDSDWARYKTEYIDVIEEKLKTYKSQPVVLIIEPDSLANLVTNLDSTPACRDSEKYYLDGHAYLIQKFGVLKHVAMYLDIGHAFWLGWDDNREKAAKVYSKVISSGAPGEVRGFTDNVANYTPWEDPTLSRGPDTEWNPCPDEKRYLEAIHKDFVSAGIKSVYFVSDTSRNGKKVDRKHPGEWCNQTGVGVGARPQANPVSGMDYLDAFYWIKPLGESDGTSDESAARFDGYCGHETAMKPAPEAGQWFQKHFEQGIKN

SEQ ID NO: 3895 - protein, 413 aa, Neocallimastix californiae
  Cellulase
VWYTDNDGAWGVENGDWCGIPTGSSGGNTPVNQGNDGNDVNVTPGDQYSHNGNPFKDVEFFINPYYTAEVDAAIAQMSDSSLISKAEKMKTFSNAIWLDTIKNMNEWLEKNLKGALAQQTGNKKVLTVFVVYDLPGRDCHALASNGELLANDSDWARYKTEYIDVIEEKLKTYKSQPVVLIIEPDSLANLVTNLDSTPACRDSEKYYLDGHAYLIQKFGVLKHVAMYLDIGHAFWLGWDDNREKAAKVYSKVISSGAPGEVRGFTDNVANYTPWEDPTLSRGPDTEWNPCPDEKRYLEAIHKDFVSAGIKSVYFVSDTSRNGKKVDRKHPGEWCNQTGVGVGARPQANPVSGMDYLDAFYWIKPLGESDGTSDESAARFDGYCGHETAMKPAPEAGQWFQKHFEQGIKNANPP

SEQ ID NO: 3896 - protein, 481 aa, Neocallimastix californiae
  Cellulase
MKASIVLSALTAFTLKASADCFSTRLGYPCCSGNDVVYIDNDGKWGVENGNWCGIADTPSQAACWSLSQGYPCCSSSNAEVWYTDASGKWGVENGDWCGIPTGSTGGDATPGEQYTHNGNPFANKIFYINPYYVEEVDGAIAQMSDSSLISKAEKMKTYSNAIWLDSIKNMQSWLESNLKGALSQQNASGQDVLTVFVVYDLPGRDCHALASNGELLANDSDWARYKTEYIDVIEGHLKTYKSQPVVLIIEPDSLANMVTNLDSTPACRDSEKYYMDGHAYLIQKFGVLPHVAMYLDIGHAFWLGWDDNRQKAGKVYSKVISSGAPGKVRGFTDNVANYTPWEDPTLSRGPETEWNPCPDEKRYLEAMYKDFKAAGIESVYFVCDSSRNGKKVDRKHPGEWCNQTGAGVGYRPQANPISGMSYLDAFYWIKPLGESDGTSDESAARFDGYCGHETAMKPAPEAGQWFQKFFEEGLKNANPA

SEQ ID NO: 3897 - protein, 428 aa, Neocallimastix californiae
  Cellulase
CDVIYTDTDGEWGVENYDWCFIDSNRCHGGGNCSPAFQSQGYQCCSNNNCNIVYQDGTGNWGVENNQWCGLSYNCGNTPTTRTTTRTTTRTTTTTTRRPAQTSDNFFENELYSNFKFQGEVDTSIAKLSGQLQEKAKKVKYVPTAAWLAWEGATNEVPQYLNEAGDKTVVFVLYMIPTRDCNANASVGGSGSLDKYKGYVDNIYNTINRYPNSRIVMILEPDTIGNLVTANNDNCRNVQNMHKQALSYAISKFGTQSNVRVYLDAAHGAWLNSHADRTAQVIAEILRNAGNGKIRGISTNISNYQQVSDEYQYHQNLNRALESQGFRGMKFIVDTSRNGQNVTAAFSRNNTWCNFKGAGLGPRPQANPNPNMPLLDAYMWIKTPGEADGSATGSRADPVCARQDSLQGAPDAGSWFHDYFVMLLQNAN

SEQ ID NO: 3898 - protein, 374 aa, Neocallimastix californiae
  Cellulase
WCFIDENKCSSAISKCRFESLGYPCCSHCNVIYTDDDGNWGAENGQWCGIPENCGSTEPTKPERKFENFFENELYINQDYVKKIESTLKDMTPELQAKAKNVEKVATAVWLAWEGAPGEVEPHLKAAGNKTITFILYMIPTRDCNSLASAGGAADFEKYQGYVDSIAATIKKYPDAKVNMVIEPDTLGNLITGETEACKKVHDLHRKALSYAVNVFGNMSNVNAYLDAAHHKWLGWGTDKVAALIKDILDNAPDGDIRGISTNVSNYQSIDNEYQYHTDLHAALEAVGITGKKFIVDTGRSGVDVTEEFNVNQTWCNLIYAGLGEKSRGNPDPEKYPLLDAFMWLKPPAESDGSDVGSRADPVCAREDSFPGAP

SEQ ID NO: 3899 - protein, 101 aa, Neocallimastix californiae
  Cellulase
NNFIFPEDDDKVIAAVHAYSPYNFALNNGDGAVDTFDSAGKNELDWNINLMKKRFVDQGIPMILGEYGAMNRDNEEERAKWAEYYMEKVTALGIPQVWWDN

SEQ ID NO: 3900 - protein, 512 aa, Anaeromyces robustus
  Cellulase
MKTAFALTAVAALAAKVYAVPPSCFSVKLGYPCCSSANVPVAYTDNDGNWGIENGDWCGIPEVETCWSEKLGFPCCSSPSAPVQYTDADGKWSVENGDWCGIPKSGGSGGSGGYNPGGSGGYNPGGSGSGSGSGSGNGDYTIGSQYRHNGNPFKGVEFFINPYYVDEVDKAIAQMTNSSLKAKAEKMKTFSNAIWLDTIKNMNEWLERNLKGALAQQNASNKNVLTVFVVYDLPGRDCHALASNGELLANDSDFARYKSEYIDVIETHLKKYTAQPVVLIIEPDSLANMVTNIENTPACAESETYYYDGHAYLLKKFGVLDHVAMYLDIGHAFWLGWDDNREKATKVYKKVIDSGSPGKVRGFVDNVANYTPWEDPTLSRGPDTEWNPCPDEKRYLEAMYKDFTSAGIKSVYFVSDSSRNGHKTDRKHPGEWCNQTGVGIGARPQASPISGMSYLDAFYWIKPLGESDGTSDESAARFDGYCGHDTAMKPAPEAGQWFQKHFEQGLENANPP

SEQ ID NO: 3901 - protein, 417 aa, Anaeromyces robustus
  Cellulase
CDVIYTDTDGEWGVENYDWCFIDSNRCHGGGNCSPAFQSQGYQCCSNNNCNIVYQDGTGNWGVENNQWCGLSYNCGNTPTTRTTTRTTTRTTTTTTRRPAQTSDNFFENELYSNFKFQGEVDTSIAKLSGQLQEKAKKVKYVPTAAWLAWEGATNEVPQYLNEAGDKTVVFVLYMIPTRDCNANASVGGSGSLDKYKGYVDNIYNTINRYPNSRIVMILEPDTIGNLVTANNDNCRNVQNMHKQALSYAISKFGTQSNVRVYLDAAHGAWLNSHADRTAQVIAEILRNAGNGKIRGISTNISNYQQVSDEYQYHQNLNRALESQGFRGMKFIVDTSRNGQNVTAAFSRNNTWCNFKGAGLGPRPQANPNPNMPLLDAYMWIKTPGEADGSATGSRADPVCARQDSLQGAPDAGSWFH

SEQ ID NO: 3902 - protein, 310 aa, Anaeromyces robustus
  Cellulase
VDEKGRKVKLAGISWFGGETTNLSPHGLWAKPLSHFIKIIKDLGYNHIRYPWTNEMLFPGAKTQSVDQLQNPDLADLTPLEVMDAVIDACGKAGIKVYLDRHRPLSGGQSELWYVAKVDEDKWIEDWQFLAKRYKGNPTVIGADLHNEPHGTACWGCGETKRDWRLAAERCGNAIHKVNPDWLIIVEGNDHYGEEGWQKGEGYWWGGMLKGVKENPVRLNTPNKLVYSAHDYDKNVFMQDWFKVSNFPDNMPEIWDDKWGYIAKEDIAPVLIGEFGSLLMDNKDVKWLQNLISYMNKNDVHWTFWCLNPN

SEQ ID NO: 3903 - protein, 309 aa, Anaeromyces robustus
  Cellulase
DEKGRAVKLAGISWFGGETTNLSPHGLWAKPLSHFIKTIKDLGYNHIRYPWTNEMFKEGAKTESVDSVNNPDLADLTPLEVMDAVIEAAGAAGIKVYLDRHRPLAGGQSELWYIDEVPESQWIEDWQFLAKRYKGNPTVIGADLHNEPHGTACWGCGEEVRDWRLAAERCGNAIHEVNPDWLIIVEGNDHYGEEGWQKGESYWWGGMLKGVKENPVRLKVPNKLVYSAHDYDKNVHLQDWFTTSDFPDNMPEIWDDKWGYIVKEDIAPVLIGEFGSVLRDAVDVKWLTNLVTYMHENGVHWTFWCLNPN

SEQ ID NO: 3904 - protein, 373 aa, Anaeromyces robustus
  Cellulase
MKTVFALAAIAALASKVSAASCWANRLGYQCCKGNTVVYTDSDGKWGVENGNWCGIVDGTQQNATCWSQPLGYPCCQSTSDVIYTDSDGDWGVENGNWCGIIKGGSTGGGTGGGSTTPGEQYTISGNPFSGVEFYINPYYVEEVDNAIAQMTDSSLKAKAEKMKTYPNAIWLDNIKNMQSWLQPNLEKALAQQSGSKKVLTVFVVYDLPGRDCHAMASNGELLANDSDAQRYKTEYIDVIEEQLKKYKSQPIVLIIEPDSLANMVTNIETTPACAESQDYYFDGHAYLLKKFGVLQHVAMYLDIGHAFWLGWDDNREKAAKVYKKVIDSGSPGKVRGFVDNVANYTPWEDPTLSRGPDTEWNPCPDEKRYLEA

SEQ ID NO: 3905 - protein, 289 aa, Anaeromyces robustus
  Cellulase
TVNQFETAWGNPAATKQLITAIKNSGFNSIRIPVAWSNLMSSDYTISSELLKRVNEVVSWVIDSNMYAIINIHYDGGWIEKFGTSESTMANNKFNKIWTQVADYFKNYGEHLIFESLNEEGCWNDVWNRYSNSGDKNKAYSTLNNINQQFVDIVRKSGGNNKSRHLLIAGYCTDIDLTVDSAFKMPTDSANRMMVSVHYYTPSTFTILEKDESWGKFAGTWGTDAEVNALLADFDKLKKRFVDNGVPVIIGEYGTVLTNKDKDSVHKYLFTCAQYATSLGMCPMLWDNG

SEQ ID NO: 3906 - protein, 459 aa, Anaeromyces robustus
  Cellulase
MKFVNLLSSTLFALGALASSCHPNYPCCNGCEVVYTDVDGEWGVENGAWCLLQPSKCYDTCNTESLGYPCCTHCNTIYTDADGDWGIENGDWCGINNSCNGGGQRPPQNPTPIRTTTTTTTTKKTYPTVNPSFFSGNIYSNYQYQSEVQSSINKLSGNLQQQANRVKYVPTAVWLAWDGAPKEVQRHLSSANGSTAVFIMYWIPTRDCNSNASQGGANDLNAYKSYVDDVANTFRSNQGSRIVIVVEPDTIGNMVTSQNNENCRRTAVIHKQALAYAVNRFGSLNNVQVYLDAGHSQWLTGYEDETAAVIKEILDMANQGKIRGFSTNVSNFQPIDKEYEYQTRLYDALENVGITDMRFVIDTSRNGQDISEAFAKTKTWCNLVGTGFGERPKGNPDPINMPLLDAYMWLKPPAESDGSSQGMRADPVCARSDSLPNAPEAGSWFHDYFVQLLRNANPP

SEQ ID NO: 3907 - protein, 274 aa, Anaeromyces robustus
  Cellulase
VNESGAEFGQGKYPGEYNKDYIYPDVKAIQASIDQGMNVFRIGFSWERLQRSLNAELDSTEFDRLDEVVSYVTKNGAVAILNPHNFARYNGQIVGTSQVPNSAFADLWKRIAQKYKSNNKVWFGLVNEPHDMPTAQWFSAARDAVDSIRALGANNNVLVPGNAYTGAWNWKETFYGDSNASTALIYFSSSDKNIIFETHQYFDSDYSGTHKECVQRPCNNLFKNFVEWLKANNLKGFIGELGAAINDDCKACVEEAITYLEQNSDYIVGWAWWA

SEQ ID NO: 3908 - protein, 467 aa, Anaeromyces robustus
  Cellulase
MKTSVILTIIGAIAANVSATCDIEKKLGYPCCSNKNGKVVYKDENGNWGVEHHQWCIFSDNTDETKCWSNELGYPCCKSTTEIVFTDDRGNWGVEDKKWCGVIVDETKPVEEVKNVWTSNNVNPFAESELYVDPNYQQELDNLSSTIKDPTVIEKVEKMKQYSTGIWLDSIQSVNELLESNLDNAYAQQVESGKNVLTTFVLYNLPGRDCHAITTNGELLAKDSDLERYKHEYIDVIEEIIKKHNNQPIAFVVEPTSLPSIATFKKSTPACADTEKYYLEGHSYLIKKLGVLPNVFLYLDVGHAFWLGWDDLREETAKLYAKVIQSGAPGIVRGFADNISNYVPWDDANLTNGPNTEYNPYPDSKRYIESLRKDFVSVGIKNVNFISDTSLTTINNGSSPVEDWCYNAPLGIGARPQANPVSDMSYLDAFVWIKPFYGDKPYDSLCLEERLNTKRLFEKSVKNANPP

SEQ ID NO: 3909 - protein, 257 aa, Anaeromyces robustus
  Cellulase
DFKLWTDSEVKIKEAVEGYKNLGFHSIRIPVKWSTRPTTKTPIEPKLLKAVEEVVRVAIENDMYVIINLETDNFYMNGFISEDKAILTETYDSYKGTWKQIANYFKDYDEHLMFEALNESGYWETIWNTRTADGDRPEALAVLLKVNQEFINTVRSIEGYNQERYLLIEGYACDPILTQDHFYKTPSDPKSSGKLIVSLYYFIPYTFTVIEKYGIWGSSYDVHQLQEVVDDLRYRFVIQGVPVIFTRYGTNIRNRKR

SEQ ID NO: 3910 - protein, 286 aa, Anaeromyces robustus
  Cellulase
LEAYAKHNLNVVRAWAFCDECEDATRLVDFSGPEVKLNSENMEKVDYYLAAAAQRNIRVVLTLTNNWTDYGGMDVWVKQFGGKYHDEFYTNRKLIEGYKQYIKAMINRVNTYTGQRYKDDPTIFSWQLANEARCNNGPHGLPVKDCNTDTITKWMDEIATFIHEEDPNHLVSSGIEGIGLTPPAGVDPNTYVYTYVEGTDYEAISALDSIDYNTVHMYPVGWGLKDYAKDGVKWIQAHADVDKKFNKPTVVEEWGLSTSADNVPLEERDPIYTQWMDAVLANDNIG

SEQ ID NO: 3911 - protein, 258 aa, Anaeromyces robustus
  Cellulase
NKHYIYPNIESIRASVEQGMNVFRMGLRWERFQHELFGEFSEFDVTEYKKVVDATTSMGAVLIIDPHNYARYNDNIVGSKEVPIEAFADFWAKLANIFKDNEKVWFGLVNEPHDMETDDWFKAARAAVDAIRATGATNNILIPGNGWDGAWSWGKEAWYGEANADVALRYFSSEDKNIIFEVHQYFDEDYSGTHDTCIQRPCQNLLKEFVEWLKTNNLKGWVGEIGGTLNDECKECVHELIEYLQENRDYVLGLQWWA

SEQ ID NO: 3912 - protein, 310 aa, Anaeromyces robustus
  Cellulase
VDQNGRKIKLAGISWFGGETNNLSPHGLWAKPLDHFIKTIKDLGYNHIRYPWTNEMLTPGAKTNSIDSTSNPDLVNLTPLEVMDAVINACGKVGLKVYLDRHRPQSGGQSELWYIPEVDESKWIEDWQFLAKRYKGNPTVIGADIHNEPHGEACWGCGESKRDWKAAAERCGNAIHQVNPDWLIIVEGNDHYGEEGWQKGESYWWGGMLKGVKENPIKLNKPNKLVYSAHDYDKNVHMQDWFKESNFPDNMPTIWDDKWGFIAKQNIAPVLIGEFGSLLKDATDSKWLQNLVTYMTKNEIHWTFWCLNPN

SEQ ID NO: 3913 - protein, 448 aa, Anaeromyces robustus
  Cellulase
MKFLSVISLLIAGALASNCDPQYPCCNGCDVKYTDNSGKWGVENNNWCKIDNNKCNSSKASSCKFEALGYPCCSHCESIYEDNSGKWGVENNNWCGIPDTCDNKTPDNNTTPIASNDDPDNFFNNKIYCNQDRKDRVQSSINRLSGELKAKAQKIQDAPTAIWLSWDKAPETVSFHLDEAGNQTAVFILYWIPTRDCNSIASQGGAQSMDEYHTYVNRIVNGFKSHPNSKIVVVVEPDTLGNMITSQSNDNCKKVHNLHKQAIAYAIDTFGQIDNVRTYIDAAHGRWLGSHADEAAAIIKEIIDMAPNSNVRGLSTNVSNYQPTEDEYAYHQKLSAELEKLGVHNMKFIVDTARNGVDVAESLVKTGTWCNVKGTGFGERPRGSPDPVNKPLLDAYMWLKPGGDSDGSSTGDHADPVCEHEDSLPGAGDPGDWFHEYFVQLLTNANPP

SEQ ID NO: 3914 - protein, 192 aa, Piromyces finnis
  Cellulase
WTQVSSYFKDFDEHLIFESLNEEGCWNDVWNRWSNAGDKNKAYGTLNNLNQQFVDIVRNSGGNNKNRHLLLAGYCTDIDLTVDSAFKIPSDSSNRLMVSVHYYTPSTFTILEKDEDWGKFAGSWGTDAEVKALIADFDKLKKRFVDNGIPVIIGEYGTVLTNKNKDSVHKYLFTCAQYATSLGMCPMLWDNG

SEQ ID NO: 3915 - protein, 160 aa, Piromyces finnis
  Cellulase
LNEPRKVGDPVEWTGDQEGYNFVNEMNEVFIKTIRSTGGNNALRHLMIPPYAAGVMDASLNTFRVPRDDDKIIVSLHSYSPYNFALNNGSGAISNFYDGSEIDYVMNTIHQRYISQNIPVIIGEFGAMNRDNEVDRARWAEYYIKKATSIGVPCVLWDNA

SEQ ID NO: 3916 - protein, 245 aa, Piromyces finnis
  Cellulase
ENGKAVFLEDNMEAIDYFIAAASQRNIRLVLGFTNNWTDYGGMDEWVKGYGGKYHDDFYTNTDIRKAFKSYIKLLITRINRHTNIRYSDDPTIFSWQLANEPRCGNGPSGLPQSGKCTPEVITEWANDISSYIKELDPNHLVSVGCEGFGLEAPEGSKGLYAYKYDEGTDFEALTALPNIDYNTYHYYPIPWGMKDLVSHTKDWIESHQAVGKKLNKPVVFEEWGLEIPTDCSKEERIQYYKTWT

SEQ ID NO: 3917 - protein, 291 aa, Piromyces finnis
  Cellulase
RVDLALETYARHNLNVVRAWAFCDECEDATRLVDFSGPEVTLNSENMEKVDYYLAAAAQRNIRVVLTLTNNWTDYGGMDVWVKQFGGKYHDEFYTNRDIVNGYKQYIKAMINRVNTYTGQYYKDDPTIFSWQLANEARCNNGPHGLPVKNCNTDTITKWMDEIASFIHEEDPNHLVSSGIEGIGLTPPAGVDPNTYVYSYIEGTDYEAISALDSIDYNTVHMYPVGWGLKDYTKDGMKWIQAHADVDKKFNKPTVVEEWGLSTSADNVPLEERDPIYTKWMETVLENDNIG

SEQ ID NO: 3918 - protein, 310 aa, Piromyces finnis
  Cellulase
VDEKGRKVILGGLSWFGGETTNLSPHGLWANSLENFIKIVKDHGYNHLRYPWTNEMLFPGAETQSVDQVNNPDLANLSPLEVMDAVIDACGKAGLKVYLDRHRPLSGGQSELWYIPEVPEEQWIEDWQFLAKRYKGNPTVIGADLHNEPHSSACWGCGEIERDWRLAAERCGNAIHEVNPDWLIIVEGNDHYGEEGWQKGESYWWGGMLKGAKEFPVRLNVPNKLVYSAHDYDKNVHMQDWFKEPDFPDNMEPIWDDKWGYLVKENTAPVLISEFGSLLRDATDIKWLGNLVSYMKENDVHWTFWCLNPN

SEQ ID NO: 3919 - protein, 289 aa, Piromyces finnis
  Cellulase
TVNQFETAWGNPAATEQLIGAIKDNGFNSIRIPVAWSNLMSSDYTINSNLLKRVKEVVSWVTNKNMYAIINIHYDGGWFEQFGTSQSTQANQKFNKIWTQVSSYFKDFDEHLIFESLNEEGCWNDVWNRWSNAGDKNKAYGTLNNLNQQFVDIVRNSGGNNKNRHLLLAGYCTDIDLTVDSAFKIPSDSSNRLMVSVHYYTPSTFTILEKDEDWGKFAGSWGTDAEVKALIADFDKLKKRFVDNGIPVIIGEYGTVLTNKNKDSVHKYLFTCAQYATSLGMCPMLWDNG

SEQ ID NO: 3920 - protein, 289 aa, Piromyces finnis; identical to SEQ ID NO: 3919
  Cellulase

SEQ ID NO: 3921 - protein, 281 aa, Piromyces finnis
  Cellulase
YEKNPIGSETCWGNVKTNEDIFKTLMDNQFNVFRIPTTWTGHIGEAPEYKINEQWMKRVHEIVDYPYKNGAFVILNIHHETWNHAFAETVDEAKVELAQVWKQIAEEFKGYGERLIFEGQNEPRKNGTPVEWNGGDKEGWDVVNAMNAVFLETVRSSGGNNAKRHLMIPPYAAACNENSFKNFDFPEDDDKVIASVHAYSPYNFALNNGEGAVDKFDASGKNELDWNINLMKKRFVDQGIPMILGEYGAMNRDNEEERAAWAEYYMEKITALGVPQVWWDN

SEQ ID NO: 3922 - protein, 281 aa, Piromyces finnis; identical to SEQ ID NO: 3921
  Cellulase

SEQ ID NO: 3923 - protein, 289 aa, Piromyces finnis; identical to SEQ ID NO: 3919
  Cellulase

SEQ ID NO: 3924 - protein, 107 aa, Piromyces finnis
  Cellulase
EAYVVPKDDRVMVSVHYYTPSTFTILEEDADWGKAQPTWGSESEVEYLLNDFKKIKTRFVDNGIPVVIGEYGTVTKNKDINSVHKFLKTVAETSLNSGMCPFLWDNG

SEQ ID NO: 3925 - protein, 252 aa, Piromyces finnis
  Cellulase
AWSNLMLDNYIINPLLLSRVKEVVDYIVNNDMYAIVNIHWDMGWFTKFATNEKEAFKKYTSIWGQISQYFKDYDEHLVFESLNEEGCWDEIWNQWSNQGDKKKAFNLLNNINQEFVDIFRNSSENNAKRHLLLAGYCTSLDLTSDELYVIPKDDRVMISVHYYGPSTFTILEEDADWGKAAYSWGTEKEINYLVDELKKIKKNFIDKGIPIIVGEYGTAITNKEPASVIRWLKTVAKTTSSFGMVPCLWDAG

SEQ ID NO: 3926 - protein, 253 aa, Piromyces finnis
  Cellulase
PDVKAIETTIEQGMNAFRICNRWERLQHELFGEFNEFDITEFKKVVDATTAKGAIAIIDPHNYARYNNKLIGSEDVPIEAFVDFWTRLAEIFKDNENVWFGLVNEPHDMETDDWFKAARAAVDGIRSTGAKNNILIPGNGWTGAWSWGKEAWYGEANADVALRYFSSEDENILFEVHQYFDKDYSGTGDQCVQRPCQNLFKEFVEWLKTNNLKGWIGEIGSYLTDECRECVQESIEYLQENNEYVLGTLWWAA

SEQ ID NO: 3927 - protein, 253 aa, Piromyces finnis; identical to SEQ ID NO: 3926
  Cellulase

SEQ ID NO: 3928 - protein, 261 aa, Piromyces finnis
  Cellulase
GYKCCSHCDVYLTDEVGQWGVENNYWCGIPESCNVSGPTNNAPTENFFDNELYISPRYVEEIESSMPDMSDELKAKAKNVMNVSSAVWLAWEGAPNEVEGHLKAAGSKTITFILYMIPTRDCNSLASAGGASDLKKYQGIVDKIANTISKYPDVKVAMVIEPDTLGNLITGSTEACKNVHTLHKNALSYAANVFGNMSNVSAYLDAAHGKWLGWAADKTAAVIKEILDNAPNANIRGFSTNVSNYQSIEKEYAYHEALNAA

SEQ ID NO: 3929 - protein, 380 aa, Piromyces finnis
  Cellulase
NNNNNQWNQWDQGNNNNQWNNNNNNQWNNNNNNNNQWNNNNNQVSNNNGSSGSSQNFFLNEIYANPRFIEEIDSSIPKLSGDLAAKAEKVKQVPTAVWLAWDGAPGEVEGHLAAAGSKTVVFILYMIPTRDCNSLASAGGASDLKKYQGIVDKIANTISKYPDVKVAMVIEPDTLGNLITGSTEACKNVHTLHKNALSYAANVFGNMSNVSAYLDAAHGKWLGWAADKTAAVIKEILDNAPNANIRGFSTNVSNYQSIEKEYAYHEALNAALEKLGITGKKFIVDTGRSGVDVTEEFDVNQTWCNFVYAGLGEPSRGSPDLEKMPLLDAYMWLKPPGEADGSDVGSRADPVCGREDSFPGSPDAGSWFSEYFISMLEKSP

SEQ ID NO: 3930 - protein, 409 aa, Piromyces finnis
  Cellulase
CQVIETDDEGRWGSLNGEWCFIDESKCGDLLNNCKFEQYGYKCCSHCDVYLTDEMGQWGVENNYWCGIPESCNVSGPTNNAPTENFFDNELYISPRYVEEIESSMPDMSDELKAKANNVMNVSSAVWLAWEGAPNEVEGHLKAAGSKTITFILYMIPTRDCNSLASAGGASDLKKYQGIVDKIANTISKYPDVKVAMVIEPDTLGNLITGSTEACKNVHTLHKNALSYAANVFGNMSNVSAYLDAAHGKWLGWAADKTAAVIKEILDNAPNANIRGFSTNVSNYQSIEKEYAYHEALNAALEKLGITGKKFIVDTGRSGVDVTEEFDVNQTWCNFVYAGLGEPSRGSPDLEKMPLLDAYMWLKPPGEADGSDVGSRADPVCGREDSFPGSPDAGSWFSEYFISMLEKSP

SEQ ID NO: 3931 - protein, 409 aa, Piromyces finnis; identical to SEQ ID NO: 3930
  Cellulase

SEQ ID NO: 3932 - protein, 486 aa, Piromyces finnis
  Cellulase
MKASIALTAAAALAAKASAACWSQSLGYPCCSSASAKVEYTDADGKWGIENGNWCGIPAATSSASCWAKPLGYNCCTSTTQAVYTDSDGKWGVENGDWCGIVTGGNSNYDDSNPSIGSQYTHSGNPFKGHKFFINPYYTAEVDAAIAQMSNSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQAFFEEGLKNANPP

SEQ ID NO: 3933 - protein, 448 aa, Piromyces finnis
  Cellulase
MKASIALTAAAALAAKASAACWSQKLGYPCCSSSSAQVWFTDNDGEWGVENGDWCGIVAGSSPSTGGNTSYDDSNPSIGSQYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQKHFEQGLENANPP

SEQ ID NO: 3934 - protein, 442 aa, Piromyces finnis
  Cellulase
MKASIALTAAAALAAKASAACWSQKLGYPCCSSSSAQVWFTDNDGEWGVENGDWCGIVTGGNSNYDDSNPSIGSQYTHSGNPFKGHKFFINPYYTAEVDAAIAQMSNSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQAFFEEGLKNANPP

SEQ ID NO: 3935 - protein, 532 aa, Piromyces finnis
  Cellulase
MKASIALTAAAALAAKASAACWSQSLGYPCCSSASAKVEYTDADGKWGIENGNWCGIPAATSSASCWAKPLGYNCCTSTTQAVYTDSDGKWGVENGDWCGIPKAESCWSQPLGYPCCTSTSTAVYTDGDGAWGIENGDWCGINGNSSQGSTPNVGNDENPVIGSQYTHSGNPFKGHKFFINPYYTAEVDAAIAQMSNSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQAFFEEGLKNANPP

SEQ ID NO: 3936 - protein, 488 aa, Piromyces finnis
  Cellulase
MKASIALTAAAALAAKASAACWSQKLGYPCCSSSSAQVWFTDNDGEWGVENGDWCGIPKAESCWSQPLGYPCCTSTSTAVYTDGDGAWGIENGDWCGINGNSSQGSTPNVGNDENPVIGSQYTHSGNPFKGHKFFINPYYTAEVDAAIAQMSNSSLIAKAEKMKEYSNAIWLDTIENMNNWLERNLKTALAEQNQTGKTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQAFFEEGLKNANPP

SEQ ID NO: 3937 - protein, 486 aa, Piromyces finnis
  Cellulase
MKASIALTAAAALAAKASAACWSQSLGYPCCSSASAKVEYTDADGKWGIENGNWCGIPAATSSASCWAKPLGYNCCTSTTQAVYTDSDGKWGVENGDWCGIVTGGNSNYDDSNPSIGSQYTHSGNPFKGHKFFINPYYTAEVDAAIAQMSNSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQKHFEQGLENANPP

SEQ ID NO: 3938 - protein, 488 aa, Piromyces finnis
  Cellulase
MKASIALTAAAALAAKASAACWSQKLGYPCCSSSSAQVWFTDNDGEWGVENGDWCGIPKAESCWSQPLGYPCCTSTSTAVYTDGDGAWGIENGDWCGINGNSSQGSTPNVGNDENPVIGSQYTHSGNPFKGHKFFINPYYTAEVDAAIAQMSNSSLIAKAEKMKEYSNAIWLDTIENMNNWLERNLKTALAEQNQTGKTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQKHFEQGLENANPP

SEQ ID NO: 3939 - protein, 448 aa, Piromyces finnis
  Cellulase
MKASIALTAAAALAAKASAACWSQKLGYPCCSSSSAQVWFTDNDGEWGVENGDWCGIVAGSSPSTGGNTSYDDSNPSIGSQYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQAFFEEGLKNANPP

SEQ ID NO: 3940 - protein, 492 aa, Piromyces finnis
  Cellulase
MKASIALTAAAALAAKASAACWSQSLGYPCCSSASAKVEYTDADGKWGIENGNWCGIPAATSSASCWAKPLGYNCCTSTTQAVYTDSDGKWGVENGDWCGIVAGSSPSTGGNTSYDDSNPSIGSQYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQAFFEEGLKNANPP

SEQ ID NO: 3941 - protein, 448 aa, Piromyces finnis; identical to SEQ ID NO: 3939
  Cellulase

SEQ ID NO: 3942 - protein, 486 aa, Piromyces finnis; identical to SEQ ID NO: 3932
  Cellulase

SEQ ID NO: 3943 - protein, 492 aa, Piromyces finnis
  Cellulase
MKASIALTAAAALAAKASAACWSQSLGYPCCSSASAKVEYTDADGKWGIENGNWCGIPAATSSASCWAKPLGYNCCTSTTQAVYTDSDGKWGVENGDWCGIVAGSSPSTGGNTSYDDSNPSIGSQYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQKHFEQGLENANPP

SEQ ID NO: 3944 - protein, 532 aa, Piromyces finnis
  Cellulase
MKASIALTAAAALAAKASAACWSQSLGYPCCSSASAKVEYTDADGKWGIENGNWCGIPAATSSASCWAKPLGYNCCTSTTQAVYTDSDGKWGVENGDWCGIPKAESCWSQPLGYPCCTSTSTAVYTDGDGAWGIENGDWCGINGNSSQGSTPNVGNDENPVIGSQYTHSGNPFKGHKFFINPYYTAEVDAAIAQMSNSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQKHFEQGLENANPP

SEQ ID NO: 3945 - protein, 442 aa, Piromyces finnis
  Cellulase
MKASIALTAAAALAAKASAACWSQKLGYPCCSSSSAQVWFTDNDGEWGVENGDWCGIVTGGNSNYDDSNPSIGSQYTHSGNPFKGHKFFINPYYTAEVDAAIAQMSNSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQKHFEQGLENANPP

SEQ ID NO: 3946 - protein, 532 aa, Piromyces finnis; identical to SEQ ID NO: 3935
  Cellulase

SEQ ID NO: 3947 - protein, 492 aa, Piromyces finnis; identical to SEQ ID NO: 3940
  Cellulase

SEQ ID NO: 3948 - protein, 442 aa, Piromyces finnis; identical to SEQ ID NO: 3934
  Cellulase

SEQ ID NO: 3949 - protein, 488 aa, Piromyces finnis; identical to SEQ ID NO: 3936
  Cellulase

SEQ ID NO: 3950 - protein, 459 aa, Piromyces finnis
  Cellulase
MKFSALIGTLFATGALASSCHPYYNCCNNCDVYYTDNEGKWGVQNNDWCFIDNNRCGGNNNSGYCKFESLGYRCCNGCDVVYTDSDGNWGVENGNWCGIRDNCNNNNNNNNYRTTTTTRRTTTTTRVSVPTSDNFFDNTLYSNFKFQAEVQSSINKLSGSLAEKAKKVKYVPTAAWLAWEGAPAEVPQYLDEAGSNTVVFVLYMIPTRDCNANASAGGSSNIEKYKGYVDKIYNTINQYPNSRIVMILEPDTIGNLVTANNDNCRNVQNMHKQALSYAISKFGTQSNVRVYLDAAHGAWLSSHADKTAQVIKEILNNAGNGKLRGISTNVSNYQTVNDEYNYHMRLNSALENLGVRGMKFIVDTSRNGANISGAFNASGTWCNFKGAGLGARPQGSPDPSKPLLDAYMWIKTPGEADGSSSGSRADPVCARYDSLQGAPDAGSWFHDYFVMLVQNANPA

SEQ ID NO: 3951 - protein, 432 aa, Piromyces finnis
  Cellulase
CGIPAATNSASCWAKALGYNCCTSTTQAIYTDSDGKWGVENGDWCGIVTGGNSNYDDSNPSIGSQYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRYDGYCGHRTAMKPAPEAGQWFQAFFEEGLKNANPP

SEQ ID NO: 3952 - protein, 433 aa, Piromyces finnis
  Cellulase
ATNSASCWAKALGYNCCTSTTQAIYTDSDGKWGVENGDWCGIVAGSSPSTGGNTSYDDSNPSIGSQYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNIESTPACAKSEKYYYDGHAYLIKKFGVLPHVSMYLDIGHAFWLGWDDNREKAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRYDGYCGHRTAMKPAPEAGQWFQAFFEEGLKNANPP

SEQ ID NO: 3953 - protein, 433 aa, Piromyces finnis
  Cellulase
ATNSASCWAKALGYNCCTSTTQAIYTDSDGKWGVENGDWCGIVAGSSPSTGGNTSYDDSNPSIGSQYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRYDGYCGHRTAMKPAPEAGQWFQAFFEEGLKNANPP

SEQ ID NO: 3954 - protein, 432 aa, Piromyces finnis
  Cellulase
CGIPAATNSASCWAKALGYNCCTSTTQAIYTDSDGKWGVENGDWCGIVTGGNSNYDDSNPSIGSQYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNIESTPACAKSEKYYYDGHAYLIKKFGVLPHVSMYLDIGHAFWLGWDDNREKAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRYDGYCGHRTAMKPAPEAGQWFQAFFEEGLKNANPP

SEQ ID NO: 3955 - protein, 438 aa, Piromyces finnis
  Cellulase
CGIPAATSSASCWAKPLGYNCCTSTTQAVYTDSDGKWGVENGDWCGIVAGSSPSTGGNTSYDDSNPSIGSQYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNIESTPACAKSEKYYYDGHAYLIKKFGVLPHVSMYLDIGHAFWLGWDDNREKAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRYDGYCGHRTAMKPAPEAGQWFQAFFEEGLKNANPP

SEQ ID NO: 3956 - protein, 427 aa, Piromyces finnis
  Cellulase
ATSSASCWAKPLGYNCCTSTTQAVYTDSDGKWGVENGDWCGIVTGGNSNYDDSNPSIGSQYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRYDGYCGHRTAMKPAPEAGQWFQAFFEEGLKNANPP

SEQ ID NO: 3957 - protein, 432 aa, Piromyces finnis; identical to SEQ ID NO: 3951
  Cellulase

SEQ ID NO: 3958 - protein, 438 aa, Piromyces finnis
  Cellulase
CGIPAATSSASCWAKPLGYNCCTSTTQAVYTDSDGKWGVENGDWCGIVAGSSPSTGGNTSYDDSNPSIGSQYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRYDGYCGHRTAMKPAPEAGQWFQAFFEEGLKNANPP

SEQ ID NO: 3959 - protein, 438 aa, Piromyces finnis; identical to SEQ ID NO: 3958
  Cellulase

SEQ ID NO: 3960 - protein, 427 aa, Piromyces finnis; identical to SEQ ID NO: 3956
  Cellulase

SEQ ID NO: 3961 - protein, 427 aa, Piromyces finnis
  Cellulase
ATSSASCWAKPLGYNCCTSTTQAVYTDSDGKWGVENGDWCGIVTGGNSNYDDSNPSIGSQYTHSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNIESTPACAKSEKYYYDGHAYLIKKFGVLPHVSMYLDIGHAFWLGWDDNREKAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRYDGYCGHRTAMKPAPEAGQWFQAFFEEGLKNANPP

SEQ ID NO: 3962 - protein, 433 aa, Piromyces finnis; identical to SEQ ID NO: 3953
  Cellulase

SEQ ID NO: 3963 - protein, 195 aa, Neocallimastix californiae
  CELLULASE (GLYCOSYL HYDROLASE FAMILY 5) PROTEIN-RELATED
LSTKGHNIVDSKGRKVQLSGLSWFGGETTNLSPHGLWTNSLANFIKIVKDNGYNHLRYPWTNEMFFEGAKTQSIDQMNNPDLVDLSPLEVMDAVINECGKAGLKVYLDRHRPLSGGQSELWYVDEVDEAKWIEDWQFLAKRYKGNPTVIGADLHNEPHGKACWGCGEEERDWRLAAERCGNAIHEVNPDWLIIVE

SEQ ID NO: 3964 - protein, 316 aa, Neocallimastix californiae
  CELLULASE (GLYCOSYL HYDROLASE FAMILY 5) PROTEIN-RELATED
LSTKGHNIVDSKGRKVQLSGLSWFGGETTNLSPHGLWANSLANFIKIVKDNGYNHLRYPWTNEMFFEGAKTQSVDQVNNPDLADLSPLEIMDAVINECGKAGLKVYLDRHRPLSGGQSELWYVDEVDEAKWIEDWQFLAKRYKGNPTVIGADLHNEPHGKACWGCGEEERDWRLAAERCGNAIHEVNPDWLIIVEGNDHYGEEGWQKGESYWWGGMLKGVKEFPVRLNTPNKLVYSAHDYDKNVHMQDWFKEADFPDNMPPIWDDKWGYIVKEDIAPVLIGEFGSLLRDATDVKWLSNLIDYMKENEVHWTFWCLN

SEQ ID NO: 3965 - protein, 316 aa, Neocallimastix californiae
  CELLULASE (GLYCOSYL HYDROLASE FAMILY 5) PROTEIN-RELATED
LSTKGRHIVDEKGRKVRLAGISWFGGETTNLSPHGLWAKPLDHFIKVIKDHGYNHIRYPWTNEMLFPGAKTESINAMENPDLVDLTPLEVMDAVIDACGKAGLKVYLDRHRPLSGGQSELWYISKVDEKKWIEDWQFLAKRYKGNPTVIGADLHNEPHGTACWGCGETQRDWRLAAERCGNAIHEVNPDWLIIVEGNDHYGEEGWQKGEGYWWGGMLKGVKENPVRLKKPNKLVYSAHDYDKNVHMQDWFKVSSFPDNMPEIWDDKWGYIVKEDIAPVLIGEFGSLLRDKTDVKWLQNLISYMNKNTVHWTFWCLN

SEQ ID NO: 3966 - protein, 302 aa, Neocallimastix californiae
  CELLULASE (GLYCOSYL HYDROLASE FAMILY 5) PROTEIN-RELATED
LSTKGHNIVDSKGRKVQLSGLSWFGGETTNLSPHGLWANSLANFIKIVKDNGYNHLRYPWTNEMFFEGAKTQSVDQVNNPDLADLSPLEIMDAVINECGKAGLKVYLDRHRPLSGGQSELWYVDEVDEAKWIEDWQFLAKRYKGNPTVIGADLHNEPHGTACWGCGETKRDWRLAAERCGNAIHKVNPDWLIIVEGNDHYGEEGWQKGEGYWWGGMLKGVKENPVRLNTPNKLVYSAHDYDKNVFMQDWFKESDFPDNMPPIWDDKWGYIVKEDIAPVLIGEFGSLLRDATDVKWLSNLIYY

SEQ ID NO: 3967 - protein, 316 aa, Neocallimastix californiae
  CELLULASE (GLYCOSYL HYDROLASE FAMILY 5) PROTEIN-RELATED
LSTKGKYIVDEKGRKVKLAGLSWFGGETPNLSPHGLWAKPLAHFIKVIKDHGYNHIRYPWTNEMFVEGAKTESINAMENPDLVDLTPLEVMDAVIDACGKAGLKVYLDRHRPTAAGQSELWYISKVDEKKWIEDWKFLAKRYKGNPTVIGADLHNEPHGTACWGCGETERDWRLAAERCGNAIHEVNPDWLIIVEGNDHFGEEGWQKGESYWWGGMLKGVKENPVRLNKPNKLVYSAHDYDKNVHMQEWFKLSTFPDNMPEIWDDVWGYISKEDIAPVLISEFGSLLRDKTDVKWLENLVSYMNDNAVHWTFWCLN

SEQ ID NO: 3968 - protein, 316 aa, Neocallimastix californiae
  CELLULASE (GLYCOSYL HYDROLASE FAMILY 5) PROTEIN-RELATED
LSTKGRNIVDQKGRNVKLAGISWFGGETDNLSPHGLWSKSLAHFIKVIKDNGYNHIRYPWTNEMLLSGARTKSINAMENPDLANLTPLEVMDAVINAAGKAGLKVYLDRHRPTAAGQSELWYISKVDEKKWIEDWKFLAKRYKGNPTVIGADIHNEPHGTACWGCGETKRDWRLAAERCGNAIHEVNPDWLIIVEGNDHYGEEGWQKGESYWWGGMLKGVKQYPVRLNKKNKLVYSAHDYDKNVHLQDWFKVSNFPDNMPSIWDDKWGYIAKQNIAPVLISEFGSLLKDKTDVKWLQNLISYMNKNGVHWTFWCLN

SEQ ID NO: 3969 - protein, 316 aa, Anaeromyces robustus
  CELLULASE (GLYCOSYL HYDROLASE FAMILY 5) PROTEIN-RELATED
LSTKGRYIVDEKGRKVKLAGISWFGGETTNLSPHGLWAKPLSHFIKIIKDLGYNHIRYPWTNEMLFPGAKTQSVDQLQNPDLADLTPLEVMDAVIDACGKAGIKVYLDRHRPLSGGQSELWYVAKVDEDKWIEDWQFLAKRYKGNPTVIGADLHNEPHGTACWGCGETKRDWRLAAERCGNAIHKVNPDWLIIVEGNDHYGEEGWQKGEGYWWGGMLKGVKENPVRLNTPNKLVYSAHDYDKNVFMQDWFKVSNFPDNMPEIWDDKWGYIAKEDIAPVLIGEFGSLLMDNKDVKWLQNLISYMNKNDVHWTFWCLN

SEQ ID NO: 3970 - protein, 351 aa, Anaeromyces robustus
  CELLULASE (GLYCOSYL HYDROLASE FAMILY 5) PROTEIN-RELATED
NQPQPTQPSQPSPTQPATPTQPNNPPVNNNDPIGFLSTKGHLIVDEKGRAVKLAGISWFGGETTNLSPHGLWAKPLSHFIKTIKDLGYNHIRYPWTNEMFKEGAKTESVDSVNNPDLADLTPLEVMDAVIEAAGAAGIKVYLDRHRPLAGGQSELWYIDEVPESQWIEDWQFLAKRYKGNPTVIGADLHNEPHGTACWGCGEEVRDWRLAAERCGNAIHEVNPDWLIIVEGNDHYGEEGWQKGESYWWGGMLKGVKENPVRLKVPNKLVYSAHDYDKNVHLQDWFTTSDFPDNMPEIWDDKWGYIVKEDIAPVLIGEFGSVLRDAVDVKWLTNLVTYMHENGVHWTFWCLN

SEQ ID NO: 3971 - protein, 316 aa, Anaeromyces robustus
  CELLULASE (GLYCOSYL HYDROLASE FAMILY 5) PROTEIN-RELATED
LSTKGRSIVDQNGRKIKLAGISWFGGETNNLSPHGLWAKPLDHFIKTIKDLGYNHIRYPWTNEMLTPGAKTNSIDSTSNPDLVNLTPLEVMDAVINACGKVGLKVYLDRHRPQSGGQSELWYIPEVDESKWIEDWQFLAKRYKGNPTVIGADIHNEPHGEACWGCGESKRDWKAAAERCGNAIHQVNPDWLIIVEGNDHYGEEGWQKGESYWWGGMLKGVKENPIKLNKPNKLVYSAHDYDKNVHMQDWFKESNFPDNMPTIWDDKWGFIAKQNIAPVLIGEFGSLLKDATDSKWLQNLVTYMTKNEIHWTFWCLN

SEQ ID NO: 3972 - protein, 316 aa, Piromyces finnis
  CELLULASE (GLYCOSYL HYDROLASE FAMILY 5) PROTEIN-RELATED
LSTKGKYIVDEKGRKVILGGLSWFGGETTNLSPHGLWANSLENFIKIVKDHGYNHLRYPWTNEMLFPGAETQSVDQVNNPDLANLSPLEVMDAVIDACGKAGLKVYLDRHRPLSGGQSELWYIPEVPEEQWIEDWQFLAKRYKGNPTVIGADLHNEPHSSACWGCGEIERDWRLAAERCGNAIHEVNPDWLIIVEGNDHYGEEGWQKGESYWWGGMLKGAKEFPVRLNVPNKLVYSAHDYDKNVHMQDWFKEPDFPDNMEPIWDDKWGYLVKENTAPVLISEFGSLLRDATDIKWLGNLVSYMKENDVHWTFWCLN

SEQ ID NO: 3973 - protein, 30 aa, Neocallimastix californiae
  Cellulose docking domain, dockering
PCCSSPNAEVYYTDNDGKWSVENNDWCGIP

SEQ ID NO: 3974 - protein, 38 aa, Neocallimastix californiae
  Cellulose docking domain, dockering
ECWAKKLGYSCCTSTSRVEYTDNDGKWGIENGNWCGIV

SEQ ID NO: 3975 - protein, 33 aa, Neocallimastix californiae
  Cellulose docking domain, dockering
GAYQCCNSCTTTYTDNDGRWGYENGDWCGIKYS

SEQ ID NO: 3976 - protein, 41 aa, Neocallimastix californiae
  Cellulose docking domain, dockering
GCWAQSQGYKCCDNPGSTKVEFSDGSGQWGIQNGDWCGIDY

SEQ ID NO: 3977 - protein, 33 aa, Neocallimastix californiae
  Cellulose docking domain, dockering
GNYPCCNTCTATYTDGEGKWAIENGNWCGIKNS

SEQ ID NO: 3978 - protein, 39 aa, Neocallimastix californiae
  Cellulose docking domain, dockering
CPASITRQGYKCCRVGCTVEYTDNDGEWGVEDGDWCGCG

SEQ ID NO: 3979 - protein, 40 aa, Neocallimastix californiae
  Cellulose docking domain, dockering
CNANVIAQGYNCCKSCGTVYFEDGDGKWGVENNNWCGMPL

SEQ ID NO: 3980 - protein, 37 aa, Neocallimastix californiae
  Cellulose docking domain, dockering
AITNQGYKCCSTCGTVYYTDADGDWGVENNDWCGMPT

SEQ ID NO: 3981 - protein, 37 aa, Neocallimastix californiae; identical to SEQ ID NO: 1428
  Cellulose docking domain, dockering

SEQ ID NO: 3982 - protein, 40 aa, Neocallimastix californiae
  Cellulose docking domain, dockering
CPASITNQGYPCCSSCGTVYYTDNDGLWGVENNDWCGMPT

SEQ ID NO: 3983 - protein, 37 aa, Neocallimastix californiae; identical to SEQ ID NO: 1429
  Cellulose docking domain, dockering

SEQ ID NO: 3984 - protein, 37 aa, Neocallimastix californiae
  Cellulose docking domain, dockering
AITNQGYKCCSSCSTVYYSDNDGDWGVENNDWCGMPT

SEQ ID NO: 3985 - protein, 38 aa, Neocallimastix californiae
  Cellulose docking domain, dockering
CSAAITNQGYKCCSANCEVVYTDGDGDWGVENNEWCGC

SEQ ID NO: 3986 - protein, 40 aa, Neocallimastix californiae
  Cellulose docking domain, dockering
CPASITNQGYKCCSSCSTVYYTDNDGAWGVENNDWCGMPT

SEQ ID NO: 3987 - protein, 38 aa, Neocallimastix californiae
  Cellulose docking domain, dockering
CSASIVAQGYKCCSANCEVVYTDNDGDWGVENGQWCGC

SEQ ID NO: 3988 - protein, 37 aa, Neocallimastix californiae; identical to SEQ ID NO: 3984
  Cellulose docking domain, dockering

SEQ ID NO: 3989 - protein, 38 aa, Neocallimastix californiae; identical to SEQ ID NO: 3985
  Cellulose docking domain, dockering

SEQ ID NO: 3990 - protein, 25 aa, Neocallimastix californiae
  Cellulose docking domain, dockering
CWSEKLGYPCCQNTSSVVYTDNDGN

SEQ ID NO: 3991 - protein, 39 aa, Neocallimastix californiae
  Cellulose docking domain, dockering
SCFSVNLGYSCCNGCEVAYTDSDGKWGVENGNWCGIKSS

SEQ ID NO: 3992 - protein, 36 aa, Neocallimastix californiae; identical to SEQ ID NO: 1441
  Cellulose docking domain, dockering

SEQ ID NO: 3993 - protein, 38 aa, Neocallimastix californiae
  Cellulose docking domain, dockering
CFSINLGYKCCSGCDIVYVDQDGNWGVENDQWCGIKNS

SEQ ID NO: 3994 - protein, 40 aa, Neocallimastix californiae
  Cellulose docking domain, dockering
CNANIIAQGYKCCKSCGTVYYEDGDGQWGVENNDWCGMPL

SEQ ID NO: 3995 - protein, 38 aa, Neocallimastix californiae
  Cellulose docking domain, dockering
CPASITRQGYKCCRVGCTVEYTDNDGEWGVEDGDWCGC

SEQ ID NO: 3996 - protein, 39 aa, Neocallimastix californiae
  Cellulose docking domain, dockering
ACWSTSLGYPCCSSSSAQVYYTDNDGKWGVENGDWCGIP

SEQ ID NO: 3997 - protein, 37 aa, Neocallimastix californiae
  Cellulose docking domain, dockering
ACFAERLGYPCCKGNTVAYTDNDGKWGVENGNWCGIA

SEQ ID NO: 3998 - protein, 38 aa, Neocallimastix californiae
  Cellulose docking domain, dockering
YCFAKSDGYDCCFDNEVVYEDETGKWGINDEGEWCGVE

SEQ ID NO: 3999 - protein, 43 aa, Neocallimastix californiae
  Cellulose docking domain, dockering
ACWAEALGYKCCTPGAYTPVLLTDESGDWSAENGEWCGLLKSE

SEQ ID NO: 4000 - protein, 38 aa, Neocallimastix californiae
  Cellulose docking domain, dockering
ECWANAYGYDCCVDGTLTYLEDETGKWGVTSDYQWCGI

SEQ ID NO: 4001 - protein, 39 aa, Neocallimastix californiae
  Cellulose docking domain, dockering
ACWSLSQGYPCCSSSNAEVWYTDASGKWGVENGDWCGIP

SEQ ID NO: 4002 - protein, 28 aa, Neocallimastix californiae
  Cellulose docking domain, dockering
PCCSGNDVVYTDNDGKWGVENGNWCGIA

SEQ ID NO: 4003 - protein, 40 aa, Neocallimastix californiae
  Cellulose docking domain, dockering
SCWSTKFGYPCCKKTCTAIEKDKDGSWAIEGSHWCGIPAN

SEQ ID NO: 4004 - protein, 40 aa, Neocallimastix californiae
  Cellulose docking domain, dockering
KCISEFLGYPCCSSSNTPVYYKDDDGDWGIDSATGDWCGI

SEQ ID NO: 4005 - protein, 40 aa, Neocallimastix californiae
  Cellulose docking domain, dockering
KCVSEFLGYPCCSSSNTLVYYKDDDGDWGVDPATGDWCGI

SEQ ID NO: 4006 - protein, 37 aa, Neocallimastix californiae
  Cellulose docking domain, dockering
SCWSTKLGYPCCKKTCTAIEKDNDGAWAIEGSHWCGI

SEQ ID NO: 4007 - protein, 39 aa, Neocallimastix californiae
  Cellulose docking domain, dockering
TCKFEALGYKCCSHCVSYLEDEDGLWGVENGEWCGITDE

SEQ ID NO: 4008 - protein, 38 aa, Neocallimastix californiae
  Cellulose docking domain, dockering
ECWSNKFGYPCCDTCDVFLTDESGDWGVKDLDWCGVPS

SEQ ID NO: 4009 - protein, 38 aa, Neocallimastix californiae
  Cellulose docking domain, dockering
TCWSESLGYPCCSSNTGVAYIDNDGEWGVENGGWCGIK

SEQ ID NO: 4010 - protein, 39 aa, Neocallimastix californiae
  Cellulose docking domain, dockering
ACWSQKLGYPCCSSSSAEVWYTDNDGKWGVENNDWCGIP

SEQ ID NO: 4011 - protein, 38 aa, Neocallimastix californiae
  Cellulose docking domain, dockering
TCWSESLGYPCCSSNTGVAYIDNDGEWGVENGGWCGIP

SEQ ID NO: 4012 - protein, 40 aa, Neocallimastix californiae
  Cellulose docking domain, dockering
ACWSESQGYKCCKNSNTKVEFTDDSGEWGIENNDWCGIPK

SEQ ID NO: 4013 - protein, 39 aa, Neocallimastix californiae
  Cellulose docking domain, dockering
SCFSEKMGIQCCPEGTEIYYTDNDGNWGIYKNDWCGIAD

SEQ ID NO: 4014 - protein, 38 aa, Neocallimastix californiae
  Cellulose docking domain, dockering
SCWAEALGFKCCETTNEVVFTDDSGKWGVENGEWCGIN

SEQ ID NO: 4015 - protein, 31 aa, Neocallimastix californiae
  Cellulose docking domain, dockering
DYPCCSDPNTTPIETDDSGEWGLENGDWCGI

SEQ ID NO: 4016 - protein, 35 aa, Neocallimastix californiae
  Cellulose docking domain, dockering
LANPFPCCSDPNATVEYTNDKGDWGVENGQWCGII

SEQ ID NO: 4017 - protein, 42 aa, Neocallimastix californiae
  Cellulose docking domain, dockering
ECWSEKYGYPCCERLNHSYIEQGTEEENAYWAIENGNYCGVP

SEQ ID NO: 4018 - protein, 33 aa, Neocallimastix californiae
  Cellulose docking domain, dockering
NPPIPCCTGKDLKVIEEDSNGKWSEENGEKCGI

SEQ ID NO: 4019 - protein, 35 aa, Neocallimastix californiae
  Cellulose docking domain, dockering
PDYPCCSDPNTTPIEIDGSGEWGVENGEWCGIRKN

SEQ ID NO: 4020 - protein, 36 aa, Neocallimastix californiae
  Cellulose docking domain, dockering
ATKDGFSCCKKCDVVLVDDNGKWGVEDNQWCGIDSS

SEQ ID NO: 4021 - protein, 39 aa, Neocallimastix californiae
  Cellulose docking domain, dockering
KCWSEAEGYPCCSSNTAVVLTDSKGKWGIENGDWCGIIE

SEQ ID NO: 4022 - protein, 42 aa, Neocallimastix californiae
  Cellulose docking domain, dockering
SCWASGLGYKCCSGCDVILSDSNGKWGFDFETNDWCGIIESK

SEQ ID NO: 4023 - protein, 28 aa, Neocallimastix californiae
  Cellulose docking domain, dockering
SCWASGLGYKCCSGCDVILSDSNGKWAA

SEQ ID NO: 4024 - protein, 39 aa, Neocallimastix californiae
  Cellulose docking domain, dockering
SCWSEAEGYPCCSSNTAVVLTDSKGKWGIENGDWCGIIE

SEQ ID NO: 4025 - protein, 38 aa, Neocallimastix californiae
  Cellulose docking domain, dockering
SCWASGLGYKCCSGCDVILSDSNGKWGIENGDWCGIIE

SEQ ID NO: 4026 - protein, 37 aa, Neocallimastix californiae
  Cellulose docking domain, dockering
ACFSQSLGYPCCSGNDVVYIDNDGKWGVENGNWCGIA

SEQ ID NO: 4027 - protein, 39 aa, Neocallimastix californiae
  Cellulose docking domain, dockering
ACWSTSLGYPCCSSSSAQVYYTDNDGKWGVENNDWCGIP

SEQ ID NO: 4028 - protein, 39 aa, Neocallimastix californiae
  Cellulose docking domain, dockering
ACWSQPLGYPCCSSPNAEVYYTDNDGKWSVENNDWCGIP

SEQ ID NO: 4029 - protein, 40 aa, Neocallimastix californiae
  Cellulose docking domain, dockering
SCWAAAEGYPCCTSTTTVEIVDSKGKWGIENGNWCGIVEN

SEQ ID NO: 4030 - protein, 40 aa, Neocallimastix californiae
  Cellulose docking domain, dockering
SCWASSQGYNCCSGCDPILTDGSGKWGFENGNWCGIIESK

SEQ ID NO: 4031 - protein, 35 aa, Neocallimastix californiae
  Cellulose docking domain, dockering
SKDGYPCCKGCSVVDQDGSGKWGIENGNWCGIDSS

SEQ ID NO: 4032 - protein, 39 aa, Neocallimastix californiae
  Cellulose docking domain, dockering
PCWSEKLGYKCCSTCTQVYYNDQDGSWGVENNDWCGIPT

SEQ ID NO: 4033 - protein, 39 aa, Neocallimastix californiae
  Cellulose docking domain, dockering
PCWATSLGYKCCSNPNTESVYEDESGEWGVENNDWCGIV

SEQ ID NO: 4034 - protein, 36 aa, Neocallimastix californiae; identical to SEQ ID NO: 1486
  Cellulose docking domain, dockering

SEQ ID NO: 4035 - protein, 38 aa, Neocallimastix californiae
  Cellulose docking domain, dockering
DCWSTVLGYPCCEVNDFIVNTDEYGSWSVENNDWCGIK

SEQ ID NO: 4036 - protein, 39 aa, Neocallimastix californiae
  Cellulose docking domain, dockering
SCWSIALGYPCCEVNDFVVQTDENGDWSVENNDWCGIKN

SEQ ID NO: 4037 - protein, 40 aa, Neocallimastix californiae
  Cellulose docking domain, dockering
ACWSTALGFPCCEVNDNVVHSDEYGDWGVENNDWCGIKNS

SEQ ID NO: 4038 - protein, 41 aa, Neocallimastix californiae
  Cellulose docking domain, dockering
KCFSLNLGYPCCENDSDDNIIFTDENGDWGIENNNWCGIGK

SEQ ID NO: 4039 - protein, 36 aa, Neocallimastix californiae
  Cellulose docking domain, dockering
ACWSQALGYPCCKSTSDVYYTDDDGNWGVENGNWCG

SEQ ID NO: 4040 - protein, 38 aa, Neocallimastix californiae
  Cellulose docking domain, dockering
ECFSIALGYPCCKGNDIVYTDDDGNWGVENNEWCGIND

SEQ ID NO: 4041 - protein, 40 aa, Neocallimastix californiae
  Cellulose docking domain, dockering
SCWAKNLGYPCCSTNTCRTVYYTDADGKWDVENNDWCGIT

SEQ ID NO: 4042 - protein, 38 aa, Neocallimastix californiae
  Cellulose docking domain, dockering
NCWATKLGYPCCKTTTTTEYTDADGEWGIENGNWCGLI

SEQ ID NO: 4043 - protein, 36 aa, Neocallimastix californiae; identical to SEQ ID NO: 1493
  Cellulose docking domain, dockering

SEQ ID NO: 4044 - protein, 38 aa, Neocallimastix californiae
  Cellulose docking domain, dockering
TCWSKKLGYPCCSNKNASVEYTDGDGQWGIENGDWCGI

SEQ ID NO: 4045 - protein, 41 aa, Neocallimastix californiae
  Cellulose docking domain, dockering
NCWARSLGYNCCSTSTCRNAQFSDNDGQWDIENGNWCGIAT

SEQ ID NO: 4046 - protein, 37 aa, Neocallimastix californiae
  Cellulose docking domain, dockering
NCWAKALGYPCCTQATEVVYTDSNGQWGIQNNDWCGK

SEQ ID NO: 4047 - protein, 37 aa, Neocallimastix californiae
  Cellulose docking domain, dockering
KCFSVALGYPCCKGSEVVYTDNDGKWGFENGQWCGIA

SEQ ID NO: 4048 - protein, 34 aa, Neocallimastix californiae
  Cellulose docking domain, dockering
DGYKCCTQSNPTVVYTDASGEWAVENGDWCIIKK

SEQ ID NO: 4049 - protein, 34 aa, Neocallimastix californiae; identical to SEQ ID NO: 1499
  Cellulose docking domain, dockering

SEQ ID NO: 4050 - protein, 36 aa, Neocallimastix californiae
  Cellulose docking domain, dockering
DCFAKALGYECCNDNEIVTSDESGDWGVKDGEWCGI

SEQ ID NO: 4051 - protein, 33 aa, Neocallimastix californiae
  Cellulose docking domain, dockering
NEGYSKCSNCDVQYSDGSGDWGVENGDWCGISS

SEQ ID NO: 4052 - protein, 32 aa, Neocallimastix californiae
  Cellulose docking domain, dockering
DYPCCNECDVVYTDDSGDWGIENNDWCLLKKS

SEQ ID NO: 4053 - protein, 39 aa, Neocallimastix californiae
  Cellulose docking domain, dockering
SCFSVNLGYSCCNGCEVVYTDSDGKWGVENGNWCGIKSS

SEQ ID NO: 4054 - protein, 36 aa, Neocallimastix californiae; identical to SEQ ID NO: 1503
  Cellulose docking domain, dockering

SEQ ID NO: 4055 - protein, 39 aa, Neocallimastix californiae; identical to SEQ ID NO: 4053
  Cellulose docking domain, dockering

SEQ ID NO: 4056 - protein, 36 aa, Neocallimastix californiae; identical to SEQ ID NO: 1503
  Cellulose docking domain, dockering

SEQ ID NO: 4057 - protein, 31 aa, Neocallimastix californiae
  Cellulose docking domain, dockering
EYPCCVGSKVIETDKQGDWGYEDNHWCGIVK

SEQ ID NO: 4058 - protein, 31 aa, Neocallimastix californiae
  Cellulose docking domain, dockering
DYPCCKGNDIITTDSQGDWGYEDKHWCGIIK

SEQ ID NO: 4059 - protein, 40 aa, Neocallimastix californiae
  Cellulose docking domain, dockering
DCWSTVLGYDCCKGCHVYEEDTDGKWGYENKKWCGIDDEV

SEQ ID NO: 4060 - protein, 40 aa, Neocallimastix californiae; identical to SEQ ID NO: 4059
  Cellulose docking domain, dockering

SEQ ID NO: 4061 - protein, 31 aa, Neocallimastix californiae; identical to SEQ ID NO: 4057
  Cellulose docking domain, dockering

SEQ ID NO: 4062 - protein, 31 aa, Neocallimastix californiae; identical to SEQ ID NO: 4058
  Cellulose docking domain, dockering

SEQ ID NO: 4063 - protein, 40 aa, Neocallimastix californiae
  Cellulose docking domain, dockering
SCWAEAEGFRCCKGCEAIYIDGDKRWGVENMEWCGIIESN

SEQ ID NO: 4064 - protein, 38 aa, Neocallimastix californiae
  Cellulose docking domain, dockering
DCWALAEGYNCCSPGTPVSITDSKGKWGIENEEWCGII

SEQ ID NO: 4065 - protein, 36 aa, Neocallimastix californiae
  Cellulose docking domain, dockering
ALKDGYNCCSGCSVSYEDETGKWGIENGQWCGIDSS

SEQ ID NO: 4066 - protein, 40 aa, Neocallimastix californiae
  Cellulose docking domain, dockering
TCWSLPFGYPCCPHCKALTKDENGKWGELNGEWCGIVADK

SEQ ID NO: 4067 - protein, 38 aa, Neocallimastix californiae
  Cellulose docking domain, dockering
ECWSEKYGYECCSPNNTKVVVSDESGKWGVENGNWCGV

SEQ ID NO: 4068 - protein, 40 aa, Neocallimastix californiae
  Cellulose docking domain, dockering
TCWSLPFGYPCCPHCNSLTKDENGKWGELNGEWCGIVADK

SEQ ID NO: 4069 - protein, 38 aa, Neocallimastix californiae
  Cellulose docking domain, dockering
ECWSEKYGYECCSPNNTKVVVSDENGKWGVENGNWCGV

SEQ ID NO: 4070 - protein, 35 aa, Neocallimastix californiae
  Cellulose docking domain, dockering
LCFGYKCCETCEVQYSDDTGSWGIENNDWCGIPDS

SEQ ID NO: 4071 - protein, 29 aa, Neocallimastix californiae
  Cellulose docking domain, dockering
DYPTCSANIEIAYVDDRIWGIENGDWCII

SEQ ID NO: 4072 - protein, 39 aa, Neocallimastix californiae
  Cellulose docking domain, dockering
TCWSLSQGYPCCSSSNAEVWYTDASGKWGVENGDWCGIP

SEQ ID NO: 4073 - protein, 36 aa, Neocallimastix californiae
  Cellulose docking domain, dockering
ACFAERLGYPCCSGNEVVYTDNDGKWGVENGNWCGI

SEQ ID NO: 4074 - protein, 39 aa, Neocallimastix californiae
  Cellulose docking domain, dockering
ECWSKALGYPCCTTTKEVVYTDESGKWGLEGNDEWCGIV

SEQ ID NO: 4075 - protein, 35 aa, Neocallimastix californiae
  Cellulose docking domain, dockering
NGYPCCDKTTEVVYEDEDGKWGVQNGDEWCLIKEN

SEQ ID NO: 4076 - protein, 37 aa, Neocallimastix californiae
  Cellulose docking domain, dockering
VAAQEYGECTSCVVQYKDQDGNWGYENDDWCLINDKK

SEQ ID NO: 4077 - protein, 38 aa, Neocallimastix californiae
  Cellulose docking domain, dockering
TCTGKSEGYKCCDNCDVVYTDDSGAWGIMNGDWCGIKS

SEQ ID NO: 4078 - protein, 33 aa, Neocallimastix californiae
  Cellulose docking domain, dockering
DYPCCSSCTVVYNDSDGDWGVENGNWCKIKADK

SEQ ID NO: 4079 - protein, 36 aa, Neocallimastix californiae
  Cellulose docking domain, dockering
NCFSLALGYPCCSGTTVEYSDNDGDWGFENGDWCGI

SEQ ID NO: 4080 - protein, 38 aa, Neocallimastix californiae
  Cellulose docking domain, dockering
ECWSKALGYDCCKEGTEVVYTDESGKWGVTGDNWCGII

SEQ ID NO: 4081 - protein, 31 aa, Neocallimastix californiae
  Cellulose docking domain, dockering
YPCCTSCNSVYEDDDGKWGVENDDWCLIKKS

SEQ ID NO: 4082 - protein, 34 aa, Neocallimastix californiae
  Cellulose docking domain, dockering
DGYECCKSCDVELTDDDGEWGIENNQWCGIDVEK

SEQ ID NO: 4083 - protein, 37 aa, Neocallimastix californiae
  Cellulose docking domain, dockering
DCFSTKLGYPCCTSTSDVVYTDDDGDWGIENNNWCGI

SEQ ID NO: 4084 - protein, 39 aa, Neocallimastix californiae
  Cellulose docking domain, dockering
TCWSLKLGYPCCQNTNVVYYTDDDGDWSVENNDWCGIVK

SEQ ID NO: 4085 - protein, 37 aa, Neocallimastix californiae
  Cellulose docking domain, dockering
ACFSEKLGYKCCKRNEVVYTDNDGDWGVEDNEWCGIS

SEQ ID NO: 4086 - protein, 38 aa, Neocallimastix californiae
  Cellulose docking domain, dockering
GCWSTALGYPCCKNSSIVYFTDNDGKWSVENNDWCGII

SEQ ID NO: 4087 - protein, 39 aa, Neocallimastix californiae
  Cellulose docking domain, dockering
GCFSEALGYPCCSSGVAVVYTDNDGPWGVENNDWCGITN

SEQ ID NO: 4088 - protein, 38 aa, Neocallimastix californiae
  Cellulose docking domain, dockering
TCFSVALGYNCCQHTTEVIYVDNDGSWGIENNDWCGIG

SEQ ID NO: 4089 - protein, 31 aa, Neocallimastix californiae
  Cellulose docking domain, dockering
DYPCCSTCEASYVDNEGGWNVENNDWCKIDD

SEQ ID NO: 4090 - protein, 35 aa, Neocallimastix californiae
  Cellulose docking domain, dockering
DCFALDLGFKCCNNNEVVYTDQDGKWGYTDDWCGI

SEQ ID NO: 4091 - protein, 39 aa, Neocallimastix californiae
  Cellulose docking domain, dockering
ECFATKLGYDCCSGCDVNYTDGDGAWGIENGNWCGIKDS

SEQ ID NO: 4092 - protein, 39 aa, Neocallimastix californiae
  Cellulose docking domain, dockering
SCFATKLGYGCCTGCEVNYTDDDGAWGIENGNWCGIPDS

SEQ ID NO: 4093 - protein, 41 aa, Neocallimastix californiae
  Cellulose docking domain, dockering
SCWANTLGYQCCNTSNCRNIIYEDNDGQWDVDNNQWCGITS

SEQ ID NO: 4094 - protein, 41 aa, Neocallimastix californiae
  Cellulose docking domain, dockering
SCWSEALGYSCCTNSSSPVVYTDDDGQWSVENNEWCGILKN

SEQ ID NO: 4095 - protein, 24 aa, Neocallimastix californiae
  Cellulose docking domain, dockering
ACWSQPLGYPCCSSPNAEVYYTDN

SEQ ID NO: 4096 - protein, 38 aa, Neocallimastix californiae
  Cellulose docking domain, dockering
CWSQSLGYPCCSSPNAEVYYTDNDGKWSVENNDWCGIP

SEQ ID NO: 4097 - protein, 37 aa, Neocallimastix californiae
  Cellulose docking domain, dockering
GAQGYPCCQNSCIVYSTDADGRWSIENGDWCLIKNNS

SEQ ID NO: 4098 - protein, 39 aa, Neocallimastix californiae
  Cellulose docking domain, dockering
SCWSSRLGYPCCKSCNVVFTDNDGKWGVENDDWCGISST

SEQ ID NO: 4099 - protein, 39 aa, Neocallimastix californiae
  Cellulose docking domain, dockering
NCWASALGFNCCKTTKTVVFEDQDGSWGVEDDFWCGIVE

SEQ ID NO: 4100 - protein, 32 aa, Neocallimastix californiae
  Cellulose docking domain, dockering
AQGYPCCKTATEVFYTDNDGKWSVENDDWCLI

SEQ ID NO: 4101 - protein, 38 aa, Neocallimastix californiae
  Cellulose docking domain, dockering
ASSIIAQGYKCCSSNCEVVYVDDDGNWGVENGQWCGCG

SEQ ID NO: 4102 - protein, 23 aa, Neocallimastix californiae
  Cellulose docking domain, dockering
ACWSQPLGYPCCSSPNAEVYYTD

SEQ ID NO: 4103 - protein, 35 aa, Neocallimastix californiae
  Cellulose docking domain, dockering
CENSGYQCCDNCDVVYEDESGKWGIKDNDWCVLSD

SEQ ID NO: 4104 - protein, 35 aa, Neocallimastix californiae
  Cellulose docking domain, dockering
CPADGYECCSGCSVVDNSDGIKWGVENDNWCIIKN

SEQ ID NO: 4105 - protein, 39 aa, Neocallimastix californiae
  Cellulose docking domain, dockering
TCWSSRLGYSCCTGCEVSYTDNDGDWGYENNDWCGIPDS

SEQ ID NO: 4106 - protein, 35 aa, Neocallimastix californiae
  Cellulose docking domain, dockering
HPQYNCCNSCDVVYTDNEGEWGVENNNWCFINDAK

SEQ ID NO: 4107 - protein, 40 aa, Neocallimastix californiae
  Cellulose docking domain, dockering
SCKFEALGYPCCSHCNSIYHDESGDWGVENGDWCGIQESN

SEQ ID NO: 4108 - protein, 37 aa, Neocallimastix californiae
  Cellulose docking domain, dockering
ACWSQALGYPCCSHKNVVYTDNDGDWGVENGDWCGII

SEQ ID NO: 4109 - protein, 37 aa, Neocallimastix californiae
  Cellulose docking domain, dockering
ACFSERLGYPCCKGNTVVYTDNDGKWGVENNNWCGIG

SEQ ID NO: 4110 - protein, 37 aa, Neocallimastix californiae
  Cellulose docking domain, dockering
WASALGFNCCKTTKTVVFEDQDGSWGVEDDFWCGIVE

SEQ ID NO: 4111 - protein, 39 aa, Neocallimastix californiae
  Cellulose docking domain, dockering
TCWSVKLGYPCCEVSNAIYSVDDNGSWGYENDHWCGLLK

SEQ ID NO: 4112 - protein, 35 aa, Neocallimastix californiae; identical to SEQ ID NO: 1561
  Cellulose docking domain, dockering

SEQ ID NO: 4113 - protein, 37 aa, Neocallimastix californiae
  Cellulose docking domain, dockering
ACFSERLGYPCCSGDEVVYTDNDGKWGVENGNWCGIA

SEQ ID NO: 4114 - protein, 40 aa, Neocallimastix californiae
  Cellulose docking domain, dockering
ACWSTSLGYPCCSSSNAEVWYTDDSGKWGVENGDWCGIPQ

SEQ ID NO: 4115 - protein, 37 aa, Neocallimastix californiae
  Cellulose docking domain, dockering
ACFSERLGYPCCSGNEVVYTDNDGKWGVENGNWCGIA

SEQ ID NO: 4116 - protein, 39 aa, Neocallimastix californiae
  Cellulose docking domain, dockering
ACWSTSLGYPCCSSSSAEVWYTDDSGKWGVENGDWCGIP

SEQ ID NO: 4117 - protein, 37 aa, Neocallimastix californiae; identical to SEQ ID NO: 4115
  Cellulose docking domain, dockering

SEQ ID NO: 4118 - protein, 39 aa, Neocallimastix californiae; identical to SEQ ID NO: 4116
  Cellulose docking domain, dockering

SEQ ID NO: 4119 - protein, 36 aa, Neocallimastix californiae
  Cellulose docking domain, dockering
ACFSERLGYPCCSGDEVVYTDNDGKWGVENGNWCGI

SEQ ID NO: 4120 - protein, 39 aa, Neocallimastix californiae; identical to SEQ ID NO: 4072
  Cellulose docking domain, dockering

SEQ ID NO: 4121 - protein, 37 aa, Neocallimastix californiae; identical to SEQ ID NO: 4113
  Cellulose docking domain, dockering

SEQ ID NO: 4122 - protein, 25 aa, Neocallimastix californiae
  Cellulose docking domain, dockering
TCWSLSQGYPCCSSSNAEVWYTDAS

SEQ ID NO: 4123 - protein, 39 aa, Neocallimastix californiae
  Cellulose docking domain, dockering
NCWAEELGFKCCSSSDAKVEYTDNDGEWSIEDGSWCGIL

SEQ ID NO: 4124 - protein, 40 aa, Neocallimastix californiae
  Cellulose docking domain, dockering
ECWAKALGFECCTSEDIEVQYTDKDGKWGIENYEWCGIIE

SEQ ID NO: 4125 - protein, 40 aa, Neocallimastix californiae
  Cellulose docking domain, dockering
SCWSLAYGYDCCKGCEVSFIDNDGKWGFENEEWCGIKEDC

SEQ ID NO: 4126 - protein, 39 aa, Neocallimastix californiae
  Cellulose docking domain, dockering
TCWSSALGYPCCKGCDITSTDSDGDWGVENNEWCGILSS

SEQ ID NO: 4127 - protein, 32 aa, Neocallimastix californiae
  Cellulose docking domain, dockering
AQYSTCKNTCEIEYEDDNKWGIENNEWCILPG

SEQ ID NO: 4128 - protein, 32 aa, Neocallimastix californiae
  Cellulose docking domain, dockering
DPYPCCEGTTVEYVDDQGEWGVENGEWCGIVK

SEQ ID NO: 4129 - protein, 30 aa, Neocallimastix californiae
  Cellulose docking domain, dockering
DYPCCSSGIEVAYVDDQGEWGVENGEWCGI

SEQ ID NO: 4130 - protein, 36 aa, Neocallimastix californiae
  Cellulose docking domain, dockering
QLKGYNCCRNTCDISYVDEDGNWGVENGNWCGVPFS

SEQ ID NO: 4131 - protein, 33 aa, Neocallimastix californiae
  Cellulose docking domain, dockering
PDYPCCKNTRYSYYTDSAGNEWGVENGDWCGII

SEQ ID NO: 4132 - protein, 32 aa, Neocallimastix californiae
  Cellulose docking domain, dockering
DYPCCNSCDVSYSDSIGDWGIENNDWCGIKSS

SEQ ID NO: 4133 - protein, 39 aa, Neocallimastix californiae
  Cellulose docking domain, dockering
TCWAKKLGYNCCTGCNSIYSDKDGMWGYENEEWCGITDN

SEQ ID NO: 4134 - protein, 34 aa, Neocallimastix californiae
  Cellulose docking domain, dockering
EPDYPCCTSCDVVESDGDQRWGIENNEWCGIPDS

SEQ ID NO: 4135 - protein, 40 aa, Neocallimastix californiae
  Cellulose docking domain, dockering
TCWAKALGYECCKSCLPVVTTDGDGSWSVVNDDWCGLPTS

SEQ ID NO: 4136 - protein, 38 aa, Neocallimastix californiae
  Cellulose docking domain, dockering
TGAQGYPCCKSSCAIYSSDSDGDWSIENGDWCLIDKKA

SEQ ID NO: 4137 - protein, 38 aa, Neocallimastix californiae; identical to SEQ ID NO: 4136
  Cellulose docking domain, dockering

SEQ ID NO: 4138 - protein, 40 aa, Neocallimastix californiae; identical to SEQ ID NO: 4135
  Cellulose docking domain, dockering

SEQ ID NO: 4139 - protein, 32 aa, Neocallimastix californiae
  Cellulose docking domain, dockering
AQGYPCCENSTIVYYTDDDGDWSVENNDWCII

SEQ ID NO: 4140 - protein, 40 aa, Neocallimastix californiae
  Cellulose docking domain, dockering
CSSKITSQGYSCCSASCEIVYTDDDGTWGVENGDWCGCGG

SEQ ID NO: 4141 - protein, 39 aa, Neocallimastix californiae
  Cellulose docking domain, dockering
CPASITNQGYACCAVGCEVVYTDNDGEWGVENNEWCGCG

SEQ ID NO: 4142 - protein, 40 aa, Neocallimastix californiae
  Cellulose docking domain, dockering
CSSAILAQGYSCCSSCGTVYYTDADGDWGVENNDWCGMPT

SEQ ID NO: 4143 - protein, 27 aa, Neocallimastix californiae
  Cellulose docking domain, dockering
ACWSQPLGYPCCSSPNAEVYYTDNDGK

SEQ ID NO: 4144 - protein, 40 aa, Neocallimastix californiae
  Cellulose docking domain, dockering
SCWSKALGYTCCSTCTSVIDSDASGDWGIENGEWCGIPES

SEQ ID NO: 4145 - protein, 36 aa, Neocallimastix californiae
  Cellulose docking domain, dockering
AQGYPCCQKTCEVYSTDSDGSWNIENNDWCLIDKSK

SEQ ID NO: 4146 - protein, 41 aa, Neocallimastix californiae
  Cellulose docking domain, dockering
TCWSETYGYPCCQSTCARLIEDESGAWGAENGEWCGIQAEN

SEQ ID NO: 4147 - protein, 37 aa, Neocallimastix californiae
  Cellulose docking domain, dockering
ECWASIIGYPCCQKSTIVYDEDEYGTWSYEDDHWCGI

SEQ ID NO: 4148 - protein, 41 aa, Neocallimastix californiae; identical to SEQ ID NO: 4146
  Cellulose docking domain, dockering

SEQ ID NO: 4149 - protein, 37 aa, Neocallimastix californiae; identical to SEQ ID NO: 4147
  Cellulose docking domain, dockering

SEQ ID NO: 4150 - protein, 39 aa, Neocallimastix californiae
  Cellulose docking domain, dockering
SCWSIDLGYPCCEPGTEVIYADESGEWGVLNDDWCGIPE

SEQ ID NO: 4151 - protein, 40 aa, Neocallimastix californiae
  Cellulose docking domain, dockering
SCWSTSLGYPCCKTNCEVLDTDDNGNWGVENDEWCGISES

SEQ ID NO: 4152 - protein, 39 aa, Neocallimastix californiae
  Cellulose docking domain, dockering
TCKFEAIGYPCCSHCDVILTDDDGNWGAENGQWCGIPEN

SEQ ID NO: 4153 - protein, 33 aa, Neocallimastix californiae
  Cellulose docking domain, dockering
YYDCCKGCQTILTDEEGNWGSENGQWCFVDEKK

SEQ ID NO: 4154 - protein, 39 aa, Neocallimastix californiae
  Cellulose docking domain, dockering
SCFSEDLGYKCCQGCTVVSTDESGEWGIEDNEWCGIPSS

SEQ ID NO: 4155 - protein, 36 aa, Neocallimastix californiae
  Cellulose docking domain, dockering
WSEPDYPCCKDNSNIVYSDGQGDWGYENENWCGIVK

SEQ ID NO: 4156 - protein, 32 aa, Neocallimastix californiae
  Cellulose docking domain, dockering
PSYPCCTEEQEPVYVDDLGKWGIENNDWCGIK

SEQ ID NO: 4157 - protein, 39 aa, Neocallimastix californiae
  Cellulose docking domain, dockering
SCWSEASGYHCCKLCNISYSDDSGDWGVENNEWCGIPDS

SEQ ID NO: 4158 - protein, 37 aa, Neocallimastix californiae
  Cellulose docking domain, dockering
CTGSNDGYSCCKTCNVAYTDDQGDWGFENDEWCGIKS

SEQ ID NO: 4159 - protein, 30 aa, Neocallimastix californiae
  Cellulose docking domain, dockering
YLCCKEGTEVIYTDEEGDWGLDGKNWCKIK

SEQ ID NO: 4160 - protein, 31 aa, Neocallimastix californiae
  Cellulose docking domain, dockering
DFPCCKGCDVAFSDTTGDWGVENNEWCGIKS

SEQ ID NO: 4161 - protein, 39 aa, Neocallimastix californiae
  Cellulose docking domain, dockering
SCWAKKLGYDCCTGCNSVYSDESGEWGFENDKWCGIVEN

SEQ ID NO: 4162 - protein, 35 aa, Neocallimastix californiae
  Cellulose docking domain, dockering
SEPDYPCCTSCNVVETDGNQRWGIENNEWCGIPDS

SEQ ID NO: 4163 - protein, 31 aa, Neocallimastix californiae
  Cellulose docking domain, dockering
YPCCASCDVVRETDEGEWGIENDEWCGIKES

SEQ ID NO: 4164 - protein, 38 aa, Neocallimastix californiae
  Cellulose docking domain, dockering
GCWAKALGYECCKTCQASQLKDESGDWGIENGEWCGIT

SEQ ID NO: 4165 - protein, 34 aa, Neocallimastix californiae
  Cellulose docking domain, dockering
CALGYPCCKETFEATYTDENGKWAIENDEWCEVK

SEQ ID NO: 4166 - protein, 39 aa, Neocallimastix californiae
  Cellulose docking domain, dockering
SCWAEKLGYKCCKECTVTYNDENGDWGFENGDWCGILRT

SEQ ID NO: 4167 - protein, 39 aa, Neocallimastix californiae
  Cellulose docking domain, dockering
NCWSESLGYPCCTKTTEVVSEDSDGQWGLENDNWCGIVS

SEQ ID NO: 4168 - protein, 33 aa, Neocallimastix californiae
  Cellulose docking domain, dockering
PDYPCCSSCQTIYSDNDGDWGYEDDKWCGIKDS

SEQ ID NO: 4169 - protein, 40 aa, Neocallimastix californiae
  Cellulose docking domain, dockering
SCWSESQGYNCCSGCEVVYEDDSGKWGVENDDWCGIEDSV

SEQ ID NO: 4170 - protein, 32 aa, Neocallimastix californiae
  Cellulose docking domain, dockering
DYPCCEESTDVVYSDESGDWSVENDDWCGIIK

SEQ ID NO: 4171 - protein, 38 aa, Neocallimastix californiae
  Cellulose docking domain, dockering
CSSSIQRQGYKCCKPGCEIIYVDNDGNWGVENGQWCGC

SEQ ID NO: 4172 - protein, 38 aa, Neocallimastix californiae
  Cellulose docking domain, dockering
AITDQGYNCCSSCSFVYYTDSDGNWGVENNDWCGMPSN

SEQ ID NO: 4173 - protein, 39 aa, Neocallimastix californiae
  Cellulose docking domain, dockering
SCWSLSQGYPCCQSCNVTYEDESGKWGVENGNWCGIAKT

SEQ ID NO: 4174 - protein, 36 aa, Neocallimastix californiae
  Cellulose docking domain, dockering
AAGYPCCARSCIVVTKDDDGYWGIENNNWCLIDKDL

SEQ ID NO: 4175 - protein, 37 aa, Neocallimastix californiae; identical to SEQ ID NO: 1625
  Cellulose docking domain, dockering

SEQ ID NO: 4176 - protein, 36 aa, Neocallimastix californiae
  Cellulose docking domain, dockering
SCWAKSLGYNCCSHCSVSYTDENGKWGVENNEWCGI

SEQ ID NO: 4177 - protein, 34 aa, Neocallimastix californiae
  Cellulose docking domain, dockering
SYPTYPCCKGNTVIYTDEQGAWGIENDNWCGIES

SEQ ID NO: 4178 - protein, 37 aa, Neocallimastix californiae
  Cellulose docking domain, dockering
ACWSEKLGYPCCKSTNDVYYEDDDGQWGVENNDWCGI

SEQ ID NO: 4179 - protein, 39 aa, Neocallimastix californiae
  Cellulose docking domain, dockering
TCWSEKLGYPCCNSTNEVVYEDNDGPWGVENNNWCGIIN

SEQ ID NO: 4180 - protein, 40 aa, Neocallimastix californiae
  Cellulose docking domain, dockering
DCWSAAMGYNCCKGCTVYIEDQSGQWGYENHQWCGIDDKV

SEQ ID NO: 4181 - protein, 31 aa, Neocallimastix californiae
  Cellulose docking domain, dockering
EYPCCEGNSIVTSDSQGDWGYENNHWCGIIK

SEQ ID NO: 4182 - protein, 31 aa, Neocallimastix californiae
  Cellulose docking domain, dockering
DYPCCEGNTIVTTDSHGDWGYENNHWCGILK

SEQ ID NO: 4183 - protein, 38 aa, Neocallimastix californiae
  Cellulose docking domain, dockering
SCGAAAIGYPCCENTCTEVYTDEYRWGVENNDWCGLKD

SEQ ID NO: 4184 - protein, 35 aa, Neocallimastix californiae
  Cellulose docking domain, dockering
SEPDYKCCSTCDIVYTDDHNWGVEDDEWCGIDDAK

SEQ ID NO: 4185 - protein, 37 aa, Neocallimastix californiae
  Cellulose docking domain, dockering
CPGSNQGYSCCKTCEVYMTDETGPWNIENDEWCSVKT

SEQ ID NO: 4186 - protein, 42 aa, Neocallimastix californiae
  Cellulose docking domain, dockering
TCWSESLGYPCCSMGCNAINYYTDDDGFWGVENDDWCGIPSQ

SEQ ID NO: 4187 - protein, 39 aa, Neocallimastix californiae
  Cellulose docking domain, dockering
CSAKIVQQGYKCCGNNCIVVYQDNDGYWGVENNQWCGCG

SEQ ID NO: 4188 - protein, 32 aa, Neocallimastix californiae
  Cellulose docking domain, dockering
GKQGYPCCKNTKAVVFRDNDGNWGIENNDWCY

SEQ ID NO: 4189 - protein, 38 aa, Neocallimastix californiae
  Cellulose docking domain, dockering
NCKASLIGYACCSPENTTIQYHDEDGDWGVENGEWCGI

SEQ ID NO: 4190 - protein, 38 aa, Neocallimastix californiae
  Cellulose docking domain, dockering
NCFSKFLGYPCCSSVVEVAYIDEDGKWGIENDAWCGIS

SEQ ID NO: 4191 - protein, 39 aa, Neocallimastix californiae
  Cellulose docking domain, dockering
ACWSDKLGYPCCSGCTENVYEDNDGKWGVENGDWCGIPI

SEQ ID NO: 4192 - protein, 39 aa, Neocallimastix californiae
  Cellulose docking domain, dockering
ECVVASLGYACCSPGNTVVYYQDENGDWGVENDDWCGIT

SEQ ID NO: 4193 - protein, 39 aa, Neocallimastix californiae
  Cellulose docking domain, dockering
DCWSERLGYPCCTSTNGIYFSDNDGDWGIENDDWCGIPK

SEQ ID NO: 4194 - protein, 39 aa, Neocallimastix californiae
  Cellulose docking domain, dockering
SCWSKALGYNCCTSTSDVIFEDSDGQWGIENDDWCGIVK

SEQ ID NO: 4195 - protein, 43 aa, Neocallimastix californiae
  Cellulose docking domain, dockering
NCWSESLGYRCCKDDESIVEYIDEDGWWGVTNDEKPDWCGIIK

SEQ ID NO: 4196 - protein, 31 aa, Neocallimastix californiae; identical to SEQ ID NO: 1647
  Cellulose docking domain, dockering

SEQ ID NO: 4197 - protein, 42 aa, Neocallimastix californiae
  Cellulose docking domain, dockering
CSSKILAQGYKCCSSNCSVVYTDADGTWGVENNQWCGCGNKV

SEQ ID NO: 4198 - protein, 34 aa, Neocallimastix californiae
  Cellulose docking domain, dockering
SQYECCSNCEVIYSDDEGDWGVENYDWCFIDKSK

SEQ ID NO: 4199 - protein, 35 aa, Neocallimastix californiae
  Cellulose docking domain, dockering
TNGYPKCSSCVVYYTDENGDWGVENNDWCLIQKSR

SEQ ID NO: 4200 - protein, 39 aa, Neocallimastix californiae
  Cellulose docking domain, dockering
SCWSSSLGYDCCDDCNTLYTDESGDWGVKNNDWCGIPTS

SEQ ID NO: 4201 - protein, 39 aa, Neocallimastix californiae
  Cellulose docking domain, dockering
SCWSKALGYDCCDDCNTLYTDDSGDWGVKNNDWCGIPQN

SEQ ID NO: 4202 - protein, 38 aa, Neocallimastix californiae
  Cellulose docking domain, dockering
CSTSIIAQGYKCCSDRCEVVYQDGDGDWGVENGEWCGC

SEQ ID NO: 4203 - protein, 39 aa, Neocallimastix californiae
  Cellulose docking domain, dockering
PTSITDQGYKCCSTCGTVYYTDDDGDWGVENNEWCGMPC

SEQ ID NO: 4204 - protein, 38 aa, Neocallimastix californiae
  Cellulose docking domain, dockering
CSASILAQGYECCSDRCEVVYQDGDGDWGVENGEWCGC

SEQ ID NO: 4205 - protein, 39 aa, Neocallimastix californiae
  Cellulose docking domain, dockering
PTSITDQGYSCCSVCGTVYYTDGDGDWGVENNQWCGMPY

SEQ ID NO: 4206 - protein, 41 aa, Neocallimastix californiae
  Cellulose docking domain, dockering
SCWAERLGYPCCSANNQKIYAHDNDGDWGYNWKTNEWCGIS

SEQ ID NO: 4207 - protein, 36 aa, Neocallimastix californiae
  Cellulose docking domain, dockering
CWSEQLGYPCCQGCTVFETDADGSWGYESNHWCGIQ

SEQ ID NO: 4208 - protein, 37 aa, Neocallimastix californiae; identical to SEQ ID NO: 4115
  Cellulose docking domain, dockering

SEQ ID NO: 4209 - protein, 39 aa, Neocallimastix californiae; identical to SEQ ID NO: 4072
  Cellulose docking domain, dockering

SEQ ID NO: 4210 - protein, 38 aa, Neocallimastix californiae
  Cellulose docking domain, dockering
CWASALGFNCCKTTKTVVFEDQDGSWGVEDDFWCGIVE

SEQ ID NO: 4211 - protein, 39 aa, Neocallimastix californiae
  Cellulose docking domain, dockering
TCWSTKLGYPCCEVSNVIYSVDDNGSWGYEDDHWCGLLK

SEQ ID NO: 4212 - protein, 35 aa, Neocallimastix californiae; identical to SEQ ID NO: 1661
  Cellulose docking domain, dockering

SEQ ID NO: 4213 - protein, 37 aa, Neocallimastix californiae; identical to SEQ ID NO: 4115
  Cellulose docking domain, dockering

SEQ ID NO: 4214 - protein, 39 aa, Neocallimastix californiae
  Cellulose docking domain, dockering
ACWSTSLGYPCCSSSNAEVWFTDDSGKWGVENGDWCGIP

SEQ ID NO: 4215 - protein, 38 aa, Neocallimastix californiae
  Cellulose docking domain, dockering
SCFAEKLGYPCCSSCDVLYTDNDGEWGVENDNWCGIKD

SEQ ID NO: 4216 - protein, 38 aa, Neocallimastix californiae
  Cellulose docking domain, dockering
NCFSISLGFPCCKGNTVVYSDNDGDWGVENNEWCGISN

SEQ ID NO: 4217 - protein, 40 aa, Neocallimastix californiae
  Cellulose docking domain, dockering
CSSKIISQGYKCCSSNCEVVYTDDDGTWGVENEEWCGCGN

SEQ ID NO: 4218 - protein, 39 aa, Neocallimastix californiae
  Cellulose docking domain, dockering
CSSKITDLGYKCCSSGCQVVYTDDDGTWGVENEEWCGCG

SEQ ID NO: 4219 - protein, 40 aa, Neocallimastix californiae
  Cellulose docking domain, dockering
CSAKILKQGYECCPSGCDVIYTDDDGDWGVNNGDWCGCGT

SEQ ID NO: 4220 - protein, 32 aa, Neocallimastix californiae
  Cellulose docking domain, dockering
PSYPCCSSGIESAYEDDLGKWGIENGDWCGIK

SEQ ID NO: 4221 - protein, 39 aa, Neocallimastix californiae
  Cellulose docking domain, dockering
SCAAEAFGYNCCNGCTVVTTDETGDWGVENDEWCGIPSS

SEQ ID NO: 4222 - protein, 34 aa, Neocallimastix californiae
  Cellulose docking domain, dockering
SEPDYPCCSGNTEIIYSDASGDWGYENNNWCGII

SEQ ID NO: 4223 - protein, 32 aa, Neocallimastix californiae; identical to SEQ ID NO: 4220
  Cellulose docking domain, dockering

SEQ ID NO: 4224 - protein, 39 aa, Neocallimastix californiae; identical to SEQ ID NO: 4221
  Cellulose docking domain, dockering

SEQ ID NO: 4225 - protein, 34 aa, Neocallimastix californiae; identical to SEQ ID NO: 4222
  Cellulose docking domain, dockering

SEQ ID NO: 4226 - protein, 39 aa, Neocallimastix californiae
  Cellulose docking domain, dockering
SCFSKDMGYPCCSTCEVAYTDSDGGWGVENGEWCGIKDS

SEQ ID NO: 4227 - protein, 41 aa, Neocallimastix californiae
  Cellulose docking domain, dockering
SCWASTIGFPCCKSSCEVAYTDNDGDWAIENDEWCGIDPSK

SEQ ID NO: 4228 - protein, 38 aa, Neocallimastix californiae
  Cellulose docking domain, dockering
KCWAYKLGYPCCEGNTIIEINEDGKWGIENDEWCGVIE

SEQ ID NO: 4229 - protein, 42 aa, Neocallimastix californiae
  Cellulose docking domain, dockering
GCWSEPLGYPCCKETKKIEYYDDNGPWGMENDDWCGIDDEKC

SEQ ID NO: 4230 - protein, 39 aa, Neocallimastix californiae
  Cellulose docking domain, dockering
NCWSLKQNYPCCKITKKVQFTDENGKWGVEKGNWCGIIE

SEQ ID NO: 4231 - protein, 39 aa, Neocallimastix californiae
  Cellulose docking domain, dockering
ECWSTSLGYPCCETTKDIIYNSNKGSWGYENDSWCGINE

SEQ ID NO: 4232 - protein, 38 aa, Neocallimastix californiae
  Cellulose docking domain, dockering
NCWTLDQSYPCCSSLSAKVDGYSDKWGYENGDWCGLTD

SEQ ID NO: 4233 - protein, 40 aa, Neocallimastix californiae
  Cellulose docking domain, dockering
SCWSTSLGYPCCKTNCDVVVTDGDGDWGVENDEWCGISNS

SEQ ID NO: 4234 - protein, 39 aa, Neocallimastix californiae
  Cellulose docking domain, dockering
ACWSLALGYPCCEPGTTAIYTDDSGDWGVLNDDWCGIQE

SEQ ID NO: 4235 - protein, 40 aa, Neocallimastix californiae
  Cellulose docking domain, dockering
DCWSEKLGWPCCSKGNTEVYYVDDDGDWGVENDDWCGMEK

SEQ ID NO: 4236 - protein, 36 aa, Neocallimastix californiae
  Cellulose docking domain, dockering
EKGLGFPCCQECTVVTSDDDGDWGVENNEWCGIPNS

SEQ ID NO: 4237 - protein, 36 aa, Neocallimastix californiae
  Cellulose docking domain, dockering
KGMDFPCCQGCEVYYTDDDGEWGFENNQWCGINSET

SEQ ID NO: 4238 - protein, 40 aa, Neocallimastix californiae
  Cellulose docking domain, dockering
KCWAKDLGFSCCQACEVTYTDNDGDWGFENGDWCGIIEQN

SEQ ID NO: 4239 - protein, 40 aa, Neocallimastix californiae
  Cellulose docking domain, dockering
SCWSTALGYPCCDTCVSVSFEDGDGKWGIQNDDWCGLQKS

SEQ ID NO: 4240 - protein, 38 aa, Neocallimastix californiae
  Cellulose docking domain, dockering
SGAQGYPCCKSSCDVYSSDNDGNWSIENDDWCLIDEAK

SEQ ID NO: 4241 - protein, 38 aa, Neocallimastix californiae; identical to SEQ ID NO: 4240
  Cellulose docking domain, dockering

SEQ ID NO: 4242 - protein, 40 aa, Neocallimastix californiae; identical to SEQ ID NO: 4239
  Cellulose docking domain, dockering

SEQ ID NO: 4243 - protein, 40 aa, Neocallimastix californiae
  Cellulose docking domain, dockering
CSSKITAQGYKCCSANCEVVYTDDDGNWGVENNNWCGCGT

SEQ ID NO: 4244 - protein, 32 aa, Neocallimastix californiae
  Cellulose docking domain, dockering
GAQGYPCCKTETTVYFTDDDGNWSVENGDWCL

SEQ ID NO: 4245 - protein, 40 aa, Neocallimastix californiae
  Cellulose docking domain, dockering
ACWSEPLGYPCCSSCSYVYYVDDDGNWGVENDDWCGLLTS

SEQ ID NO: 4246 - protein, 40 aa, Neocallimastix californiae
  Cellulose docking domain, dockering
CSSSFTSQGYGCCSRCGEVYFTDESGNWGIENGDWCGLPS

SEQ ID NO: 4247 - protein, 38 aa, Neocallimastix californiae
  Cellulose docking domain, dockering
SKKITSQGYSCCPANCQIVYTDSDGTWGVHNDQWCGCG

SEQ ID NO: 4248 - protein, 31 aa, Neocallimastix californiae
  Cellulose docking domain, dockering
YPCCSTCTSVFEDKDGKWGVENEEWCLIKKS

SEQ ID NO: 4249 - protein, 38 aa, Neocallimastix californiae
  Cellulose docking domain, dockering
ECWSKALGYDCCKEGTDVIYTDESGKWGMDGDDWCGII

SEQ ID NO: 4250 - protein, 35 aa, Neocallimastix californiae
  Cellulose docking domain, dockering
QNGYECCKSCDVVFTDDDGEWGVEDGQWCGIDKEK

SEQ ID NO: 4251 - protein, 35 aa, Neocallimastix californiae; identical to SEQ ID NO: 1701
  Cellulose docking domain, dockering

SEQ ID NO: 4252 - protein, 39 aa, Neocallimastix californiae
  Cellulose docking domain, dockering
TCKFEALGYKCCSNCIAVFEDDDGYWGSENNEWCGITEE

SEQ ID NO: 4253 - protein, 39 aa, Neocallimastix californiae
  Cellulose docking domain, dockering
ECWSNKSGYPCCDSCDIYLDDETGKWGVMNGDWCGIPTS

SEQ ID NO: 4254 - protein, 38 aa, Neocallimastix californiae
  Cellulose docking domain, dockering
VGAQGYPCCKSTCDVYSTDNDGKWGIENNDWCLIDKSK

SEQ ID NO: 4255 - protein, 40 aa, Neocallimastix californiae
  Cellulose docking domain, dockering
ACWSVGLGYQCCKSCNVEYKDNDGEWGIENNKWCGISKDC

SEQ ID NO: 4256 - protein, 39 aa, Neocallimastix californiae
  Cellulose docking domain, dockering
ACWSVGLGYQCCKSCDVVFKDNDGEWGVENEKWCGISKD

SEQ ID NO: 4257 - protein, 38 aa, Neocallimastix californiae
  Cellulose docking domain, dockering
IGAQGYPCCKSTCDVYSTDNDGKWGIENNDWCLIDNSK

SEQ ID NO: 4258 - protein, 37 aa, Neocallimastix californiae
  Cellulose docking domain, dockering
TCFSERLGYPCCKDNKVLYTNDIGNWGIENGNWCGIK

SEQ ID NO: 4259 - protein, 32 aa, Neocallimastix californiae
  Cellulose docking domain, dockering
DGYPPCQETTEVLYTDDSEWGVENDGWCVICK

SEQ ID NO: 4260 - protein, 37 aa, Neocallimastix californiae
  Cellulose docking domain, dockering
TCFSERLGYPCCKGNEVLYTDNDGKWGVENDEWCGIK

SEQ ID NO: 4261 - protein, 39 aa, Neocallimastix californiae
  Cellulose docking domain, dockering
ECWSERLGWPCCSKENTDVYYVDDDGEWGVENDDWCGMS

SEQ ID NO: 4262 - protein, 37 aa, Neocallimastix californiae
  Cellulose docking domain, dockering
GAQGYPCCQSSCNVISTDSDGKWSVENDDWCLIDSSK

SEQ ID NO: 4263 - protein, 39 aa, Neocallimastix californiae
  Cellulose docking domain, dockering
ACWSIGKGYNCCKSCNVVYKDNDGEWGVENDKWCGISAD

SEQ ID NO: 4264 - protein, 40 aa, Neocallimastix californiae
  Cellulose docking domain, dockering
GCWSEKLGYPCCTSEKAKVSYSDENGHWGIENNQWCGIIN

SEQ ID NO: 4265 - protein, 41 aa, Neocallimastix californiae
  Cellulose docking domain, dockering
ECWANKVGYPCCDFDNNNVIYKDKDGSWGLTNENEWCGIIN

SEQ ID NO: 4266 - protein, 41 aa, Neocallimastix californiae; identical to SEQ ID NO: 4265
  Cellulose docking domain, dockering

SEQ ID NO: 4267 - protein, 33 aa, Neocallimastix californiae
  Cellulose docking domain, dockering
VCAQGYPCCKGKSEIYFVDKDGNWGYENGDWCL

SEQ ID NO: 4268 - protein, 40 aa, Neocallimastix californiae
  Cellulose docking domain, dockering
CSAKILAQGYSCCPKGCRVYVTDDDGDWGYVNNEWCGCKV

SEQ ID NO: 4269 - protein, 39 aa, Neocallimastix californiae
  Cellulose docking domain, dockering
CPASITDQGYPCCSTGCTVYYTDNDGDWGVENNQWCGCG

SEQ ID NO: 4270 - protein, 39 aa, Neocallimastix californiae
  Cellulose docking domain, dockering
CPASITSQGYECCSENCEIVYTDDDGNWGVENNQWCGCG

SEQ ID NO: 4271 - protein, 40 aa, Neocallimastix californiae
  Cellulose docking domain, dockering
TCWASFYGYSCCKGCKVRYVDNLGSWGYEGNQWCGIDTES

SEQ ID NO: 4272 - protein, 40 aa, Neocallimastix californiae
  Cellulose docking domain, dockering
YCWSESKGYPCCKSCDVVTVDRHGSWGIENGQWCGVKSEA

SEQ ID NO: 4273 - protein, 40 aa, Neocallimastix californiae
  Cellulose docking domain, dockering
KCWAKSLGYSCCKSCKVYTVDKHGSWGVEDGKWCGIDAET

SEQ ID NO: 4274 - protein, 40 aa, Neocallimastix californiae
  Cellulose docking domain, dockering
TCWSSGYGYPCCNNCKVYFIDETGEWGIQDGNWCGIVDSK

SEQ ID NO: 4275 - protein, 40 aa, Neocallimastix californiae
  Cellulose docking domain, dockering
TCWSSFYGYDCCKGCKVRYVDNLGSWGYEGNKWCGIDADT

SEQ ID NO: 4276 - protein, 40 aa, Neocallimastix californiae
  Cellulose docking domain, dockering
TCWSESKGYKCCKYCDVISVDRFGSWGVENGEWCGIDYET

SEQ ID NO: 4277 - protein, 40 aa, Neocallimastix californiae
  Cellulose docking domain, dockering
CSSSITAQGYKCCSSCGTVYYTDGDGDWGVENGNWCGMPT

SEQ ID NO: 4278 - protein, 37 aa, Neocallimastix californiae; identical to SEQ ID NO: 1727
  Cellulose docking domain, dockering

SEQ ID NO: 4279 - protein, 40 aa, Neocallimastix californiae
  Cellulose docking domain, dockering
SCWATKLGYKCCTAECPVVYYTDDDGKWSVENDDWCGIIK

SEQ ID NO: 4280 - protein, 37 aa, Neocallimastix californiae
  Cellulose docking domain, dockering
SCWATKIGYSCCKSTTQVEYTDDDGKWGIENDDWCGI

SEQ ID NO: 4281 - protein, 33 aa, Neocallimastix californiae
  Cellulose docking domain, dockering
GAQGYPCCKSTKQVYYTDDDGSWGIEDGDWCII

SEQ ID NO: 4282 - protein, 39 aa, Neocallimastix californiae
  Cellulose docking domain, dockering
CSSNITRQGYKCCSKNCVVVYTDNDGTWGVENEEWCGCS

SEQ ID NO: 4283 - protein, 39 aa, Neocallimastix californiae
  Cellulose docking domain, dockering
DCFATKLGYPCCSIGYPSILTDKDGDWSVENGQWCGIPS

SEQ ID NO: 4284 - protein, 39 aa, Neocallimastix californiae
  Cellulose docking domain, dockering
DCWSIKFGYPCCITSSEALVTDDNGQWGSENGQWCGIVN

SEQ ID NO: 4285 - protein, 32 aa, Neocallimastix californiae
  Cellulose docking domain, dockering
HAYSECRGCAVYYVEDGVNWGVENDDWCLIPS

SEQ ID NO: 4286 - protein, 32 aa, Neocallimastix californiae
  Cellulose docking domain, dockering
EYTCCEGCNVIEEDGSGKWGIENNQWCGIKDS

SEQ ID NO: 4287 - protein, 34 aa, Neocallimastix californiae
  Cellulose docking domain, dockering
KGTGYGCCVFKNTIVETVDESGKWGHEGNEWCLV

SEQ ID NO: 4288 - protein, 41 aa, Neocallimastix californiae
  Cellulose docking domain, dockering
NCWSLADGYPCCRKETTKIEYVSKSSGKEWGLENGDWCGIT

SEQ ID NO: 4289 - protein, 33 aa, Neocallimastix californiae
  Cellulose docking domain, dockering
NESYSCCKKCDVIYTDEYKWGVEGGDWCIIPYS

SEQ ID NO: 4290 - protein, 40 aa, Neocallimastix californiae
  Cellulose docking domain, dockering
TCWSKALGYECCKSCSPVYFTDEDGEWGVVGNDWCGIPAS

SEQ ID NO: 4291 - protein, 39 aa, Neocallimastix californiae
  Cellulose docking domain, dockering
CRGAQGYPCCKKSCAIYSTDGDGDWSIENNDWCLIDNSI

SEQ ID NO: 4292 - protein, 39 aa, Neocallimastix californiae; identical to SEQ ID NO: 4028
  Cellulose docking domain, dockering

SEQ ID NO: 4293 - protein, 39 aa, Neocallimastix californiae
  Cellulose docking domain, dockering
DCVVASMGYACCSPNNTEVYFQDENGDWGVENNDWCGIT

SEQ ID NO: 4294 - protein, 39 aa, Neocallimastix californiae
  Cellulose docking domain, dockering
QCWSDKLGFPCCSGCIDTVYTDNDGKWGVQNDDWCGIPT

SEQ ID NO: 4295 - protein, 43 aa, Neocallimastix californiae
  Cellulose docking domain, dockering
TCWSETLGYRCCKDNENIVQYIDEDGWWGVTNDEQPDWCGIVK

SEQ ID NO: 4296 - protein, 40 aa, Neocallimastix californiae
  Cellulose docking domain, dockering
KCWSTSLGYSCCKTCTDVVFVDSSGKWGVEGDDWCGIPTS

SEQ ID NO: 4297 - protein, 35 aa, Neocallimastix californiae
  Cellulose docking domain, dockering
QGYSCCKSNCNVYEEDSDGKWSIENDEWCLIDDSK

SEQ ID NO: 4298 - protein, 37 aa, Neocallimastix californiae
  Cellulose docking domain, dockering
ACFAERLGYPCCSGNEVVYTDNDGKWGVENGNWCGIA

SEQ ID NO: 4299 - protein, 41 aa, Neocallimastix californiae
  Cellulose docking domain, dockering
CSSAVTSQGYKCCSANNCNVYFTDDAGKWGIENDDWCGISN

SEQ ID NO: 4300 - protein, 36 aa, Neocallimastix californiae
  Cellulose docking domain, dockering
DAILKQGYKCCASGCSVIYTDDDGTWGVENGEWCGC

SEQ ID NO: 4301 - protein, 41 aa, Neocallimastix californiae
  Cellulose docking domain, dockering
DCWSESLGFPCCPSSYCEIVKTDSHGSWGFRNNEWCGISTD

SEQ ID NO: 4302 - protein, 38 aa, Neocallimastix californiae
  Cellulose docking domain, dockering
ACFSERLGYPCCKGNNVVYTDNDGKWGVENNNWCGIGS

SEQ ID NO: 4303 - protein, 37 aa, Neocallimastix californiae
  Cellulose docking domain, dockering
ACWSQALGYPCCTHKNAVYTDGDGDWGVENGDWCGII

SEQ ID NO: 4304 - protein, 39 aa, Neocallimastix californiae
  Cellulose docking domain, dockering
CSSKIIAQGYKCCSSGCEVVYTDDDGTWGVENDEWCGCN

SEQ ID NO: 4305 - protein, 32 aa, Neocallimastix californiae
  Cellulose docking domain, dockering
GAQGYPCCKSNKTVYYTDDDGDWSVENDDWCL

SEQ ID NO: 4306 - protein, 34 aa, Neocallimastix californiae
  Cellulose docking domain, dockering
PGYTCCEGCKVSEIDGDGISWGIENGEWCIVPLS

SEQ ID NO: 4307 - protein, 32 aa, Neocallimastix californiae
  Cellulose docking domain, dockering
EYSCCKSCTVIAEDDNGQWGIEDDEWCGIRDS

SEQ ID NO: 4308 - protein, 39 aa, Neocallimastix californiae
  Cellulose docking domain, dockering
QCTGSNQGYQCCNGCKVEYTDGDGPWGVENGQWCGIKNT

SEQ ID NO: 4309 - protein, 39 aa, Neocallimastix californiae
  Cellulose docking domain, dockering
DCFSTRLGFPCCSSWNKKVEFSDGDGNWGIENGSWCGIG

SEQ ID NO: 4310 - protein, 40 aa, Neocallimastix californiae
  Cellulose docking domain, dockering
SCWSTSLGYPCCSSCVNAAYQDNDGYWGVENDDWCGIPKS

SEQ ID NO: 4311 - protein, 40 aa, Neocallimastix californiae
  Cellulose docking domain, dockering
SCMGAQGYPCCKSTCLVYSEDGDGQWSIENNDWCLIDKSK

SEQ ID NO: 4312 - protein, 39 aa, Neocallimastix californiae
  Cellulose docking domain, dockering
KCWSLAEGYPCCEKKGTKVRHVSKNGNEWGVEHGDWCGI

SEQ ID NO: 4313 - protein, 40 aa, Neocallimastix californiae
  Cellulose docking domain, dockering
ECWAKELGFECCTSKDIEVQYTDKDGNWGIENDTWCGIIE

SEQ ID NO: 4314 - protein, 39 aa, Neocallimastix californiae
  Cellulose docking domain, dockering
NCWAEELGFKCCSSSDAKVEYTDNDGEWSIEDGNWCGIL

SEQ ID NO: 4315 - protein, 31 aa, Neocallimastix californiae
  Cellulose docking domain, dockering
DFPCCNGNTVVYTDIQGDWGYENDNWCGIVK

SEQ ID NO: 4316 - protein, 40 aa, Neocallimastix californiae
  Cellulose docking domain, dockering
DCWSTAMGYNCCSGCNVEIEDDSGKWGIENNQWCGIDNNI

SEQ ID NO: 4317 - protein, 31 aa, Neocallimastix californiae
  Cellulose docking domain, dockering
EYPCCNGDTVVYTDGQGDWGYENGDWCGIKK

SEQ ID NO: 4318 - protein, 32 aa, Neocallimastix californiae
  Cellulose docking domain, dockering
EYKCCESCKVWYTDEQGDWGVENNDWCSIKYS

SEQ ID NO: 4319 - protein, 41 aa, Neocallimastix californiae
  Cellulose docking domain, dockering
DCWSEKLGYSCCQKTCKIKYTGTDGKWGIENNQWCGIIDRI

SEQ ID NO: 4320 - protein, 39 aa, Neocallimastix californiae; identical to SEQ ID NO: 4028
  Cellulose docking domain, dockering

SEQ ID NO: 4321 - protein, 40 aa, Neocallimastix californiae
  Cellulose docking domain, dockering
DCWVAQFGYPCCSSNNRVVYASDNEGDWGYNFVTKEWCGI

SEQ ID NO: 4322 - protein, 38 aa, Neocallimastix californiae
  Cellulose docking domain, dockering
CWSEVLGYPCCKGCTIFEEDEDGQWGYDFKEATWCGIQ

SEQ ID NO: 4323 - protein, 36 aa, Neocallimastix californiae; identical to SEQ ID NO: 1774
  Cellulose docking domain, dockering

SEQ ID NO: 4324 - protein, 40 aa, Neocallimastix californiae
  Cellulose docking domain, dockering
KCWSLKYDYKCCTLRTTEPNYFSKTANNWYGIENGEWCGI

SEQ ID NO: 4325 - protein, 30 aa, Neocallimastix californiae
  Cellulose docking domain, dockering
EYPCCKECNVYYTDTEDWGIENGEWCSIPH

SEQ ID NO: 4326 - protein, 34 aa, Neocallimastix californiae
  Cellulose docking domain, dockering
RNTGYNCCLFTTTVITSDSVGDWGVENDDWCLIE

SEQ ID NO: 4327 - protein, 33 aa, Neocallimastix californiae
  Cellulose docking domain, dockering
KYRCCLKTCKASYTDSTGDWAVESNNWCLIPYT

SEQ ID NO: 4328 - protein, 38 aa, Neocallimastix californiae
  Cellulose docking domain, dockering
DAILKQGYKCCSKDCTIIYTDDDGSWGVENDEWCGCSN

SEQ ID NO: 4329 - protein, 41 aa, Neocallimastix californiae
  Cellulose docking domain, dockering
CPSSITSQGYKCCSSDNCNVYATDDDGKWGIEDGDWCGISK

SEQ ID NO: 4330 - protein, 36 aa, Neocallimastix californiae; identical to SEQ ID NO: 1774
  Cellulose docking domain, dockering

SEQ ID NO: 4331 - protein, 39 aa, Neocallimastix californiae; identical to SEQ ID NO: 4001
  Cellulose docking domain, dockering

SEQ ID NO: 4332 - protein, 20 aa, Neocallimastix californiae
  Cellulose docking domain, dockering
VYTDNDGKWGVENGNWCGID

SEQ ID NO: 4333 - protein, 30 aa, Neocallimastix californiae
  Cellulose docking domain, dockering
DYPCCSAGAEVVYEDDQGQWGVENGEWCGI

SEQ ID NO: 4334 - protein, 34 aa, Neocallimastix californiae
  Cellulose docking domain, dockering
WAAPYPCCKGNEVVYTDDQGDWGVEDGDWCGIVK

SEQ ID NO: 4335 - protein, 38 aa, Neocallimastix californiae
  Cellulose docking domain, dockering
ECWSKKYGYPCCDTCNVFIIDKYGEWGIKDNDWCGIPS

SEQ ID NO: 4336 - protein, 39 aa, Neocallimastix californiae
  Cellulose docking domain, dockering
TCKFEALGYKCCSHCISYIEDEDGSWGVENGKWCGISDE

SEQ ID NO: 4337 - protein, 39 aa, Neocallimastix californiae
  Cellulose docking domain, dockering
TCWSETYGYPCCKTTNKVVYTDEDGKWGVEDKKWCGIIK

SEQ ID NO: 4338 - protein, 39 aa, Neocallimastix californiae
  Cellulose docking domain, dockering
TCWSEKLGYPCCSSSDAEIIYTDKDGNWSIENYEWCGIP

SEQ ID NO: 4339 - protein, 38 aa, Neocallimastix californiae
  Cellulose docking domain, dockering
YCFAKSDGYDCCFDNEVVYEDDSGKWGINDEGEWCGVE

SEQ ID NO: 4340 - protein, 41 aa, Neocallimastix californiae
  Cellulose docking domain, dockering
SCWAEALGYKCCSADAFTPVIFTDSDGDWSAENGEWCGILK

SEQ ID NO: 4341 - protein, 38 aa, Neocallimastix californiae
  Cellulose docking domain, dockering
TCWSKTYGYDCCAEGTAVYLEDESGKWGVTDDYQWCGI

SEQ ID NO: 4342 - protein, 39 aa, Neocallimastix californiae
  Cellulose docking domain, dockering
KCRAQVKGFPCCKPNTEIFSVDADGYWGYNEETGEWCGI

SEQ ID NO: 4343 - protein, 31 aa, Neocallimastix californiae
  Cellulose docking domain, dockering
YNCCESCNIYTEEEGDKWGVENDEWCSIKFK

SEQ ID NO: 4344 - protein, 36 aa, Neocallimastix californiae
  Cellulose docking domain, dockering
WSEPDYPCCKYSCEVYFTDDHKWGIENGEWCGISDS

SEQ ID NO: 4345 - protein, 35 aa, Neocallimastix californiae; identical to SEQ ID NO: 1795
  Cellulose docking domain, dockering

SEQ ID NO: 4346 - protein, 39 aa, Neocallimastix californiae
  Cellulose docking domain, dockering
SCWANELGYACCKSAKTVYATDKDGKWSVENNEWCGIVE

SEQ ID NO: 4347 - protein, 37 aa, Neocallimastix californiae
  Cellulose docking domain, dockering
ECFSEKLGYKCCYGTRVVLTDSDGKWGVENNQWCGIS

SEQ ID NO: 4348 - protein, 38 aa, Neocallimastix californiae
  Cellulose docking domain, dockering
TSINNLGYPCCEGCEILYTDDDGDWGVENEDWCGIPYH

SEQ ID NO: 4349 - protein, 39 aa, Neocallimastix californiae
  Cellulose docking domain, dockering
NCWSHRYGYPCCTKTNEVLYSDSDGDWGIENGEWCGVAR

SEQ ID NO: 4350 - protein, 41 aa, Neocallimastix californiae
  Cellulose docking domain, dockering
NCWAEEYGYSCCSGCGIVVEEPGNVNWGIEYDKWCGIINSK

SEQ ID NO: 4351 - protein, 33 aa, Neocallimastix californiae
  Cellulose docking domain, dockering
NAEYPYCNNCVTVYEDDQKWGILNNQWCRILPN

SEQ ID NO: 4352 - protein, 39 aa, Neocallimastix californiae
  Cellulose docking domain, dockering
QCTGQNQGYQCCNGCKVEYTDNDGKWGIENNQWCGIKNT

SEQ ID NO: 4353 - protein, 40 aa, Neocallimastix californiae
  Cellulose docking domain, dockering
DCFSTRLGYPCCSSWNKQVAYTDNDGNWGVENGNWCGISN

SEQ ID NO: 4354 - protein, 38 aa, Neocallimastix californiae
  Cellulose docking domain, dockering
SCFSEKLGYKCCEGNVVEYIDEDGKWGIENDQWCGISD

SEQ ID NO: 4355 - protein, 38 aa, Neocallimastix californiae
  Cellulose docking domain, dockering
CSANIKNQGYSCCSNCIVYYTDNDGKWGIENESWCGIP

SEQ ID NO: 4356 - protein, 39 aa, Neocallimastix californiae
  Cellulose docking domain, dockering
CPSTIKDQGYPCCKSCNVILTDESGDWGVENNDWCGISE

SEQ ID NO: 4357 - protein, 39 aa, Neocallimastix californiae
  Cellulose docking domain, dockering
GCKAEALGYKCCSTCVSILEDENGLWGAENGEWCGITDK

SEQ ID NO: 4358 - protein, 38 aa, Neocallimastix californiae
  Cellulose docking domain, dockering
ECWSTQFGYPCCDTCDVFLSDESGDWGVKDLDWCGIPS

SEQ ID NO: 4359 - protein, 33 aa, Neocallimastix californiae
  Cellulose docking domain, dockering
PNYKCCKDCQVVYEDEDGKWGYENDEWCGMKSS

SEQ ID NO: 4360 - protein, 41 aa, Neocallimastix californiae
  Cellulose docking domain, dockering
ECWSESLGFPCCPSDYCEVAKTDSSGSWGIFDNNWCGISTD

SEQ ID NO: 4361 - protein, 35 aa, Neocallimastix californiae
  Cellulose docking domain, dockering
SEPDYPCCKSSCEVYYTDEHKWGVENGDWCGITDS

SEQ ID NO: 4362 - protein, 33 aa, Neocallimastix californiae
  Cellulose docking domain, dockering
GEYPCCESCNIYSEEEGDKWGIENNDWCSIKFK

SEQ ID NO: 4363 - protein, 37 aa, Neocallimastix californiae
  Cellulose docking domain, dockering
CWSIAFGYPCCTNTYTQVVMNDESGEWGVENDDWCGI

SEQ ID NO: 4364 - protein, 40 aa, Neocallimastix californiae
  Cellulose docking domain, dockering
QCWSIAVGYPCCSNANAEIIMTDESGNWGIENDDWCGILN

SEQ ID NO: 4365 - protein, 37 aa, Neocallimastix californiae
  Cellulose docking domain, dockering
CWSEEFGYPCCKNKDTKVSSTDQSGTWGIENGKWCGL

SEQ ID NO: 4366 - protein, 38 aa, Neocallimastix californiae
  Cellulose docking domain, dockering
ECWSKKYGYPCCENTEQKPITYDATGSWGYENNSFCGL

SEQ ID NO: 4367 - protein, 31 aa, Neocallimastix californiae
  Cellulose docking domain, dockering
YPCCNGCDVIEETEEGKWGVENDEWCGLKDS

SEQ ID NO: 4368 - protein, 33 aa, Neocallimastix californiae
  Cellulose docking domain, dockering
LAFAYEECKGCGVVYEDDMKWGVENDDWCIIPA

SEQ ID NO: 4369 - protein, 37 aa, Neocallimastix californiae
  Cellulose docking domain, dockering
TCFSIELGYPCCKDNKVIYTDERGDWGKENHQWCGIG

SEQ ID NO: 4370 - protein, 35 aa, Neocallimastix californiae
  Cellulose docking domain, dockering
KLNPSYPCCKGNEVVYTDESGDWGVENNSWCGISN

SEQ ID NO: 4371 - protein, 39 aa, Neocallimastix californiae
  Cellulose docking domain, dockering
SCFSIVQGYPCCETCHIDYTDESGDWGVEDDKWCGIRDD

SEQ ID NO: 4372 - protein, 38 aa, Neocallimastix californiae
  Cellulose docking domain, dockering
SWSNELGYPSCQSTKEIKFYAEQGGFGYENGSWCGLEN

SEQ ID NO: 4373 - protein, 40 aa, Neocallimastix californiae
  Cellulose docking domain, dockering
ECWAKALGYECCKSENPKVYTVDGDGEWAIENSEWCGIIK

SEQ ID NO: 4374 - protein, 40 aa, Neocallimastix californiae
  Cellulose docking domain, dockering
KCWSLDLGYPCCNPKNTNVVYTDGTGKWGVENGDWCGIIN

SEQ ID NO: 4375 - protein, 34 aa, Neocallimastix californiae
  Cellulose docking domain, dockering
NCWSLDQGYPCCEGQYQKYDDDWGYQNNEWCGII

SEQ ID NO: 4376 - protein, 35 aa, Neocallimastix californiae
  Cellulose docking domain, dockering
SNPFPCCKNDDVKEIGKDMDGAWGEENGTKCGIRN

SEQ ID NO: 4377 - protein, 38 aa, Neocallimastix californiae
  Cellulose docking domain, dockering
ECFAKRLGYSCCTTTKEVVSIDPNGKWGIENGHICGIE

SEQ ID NO: 4378 - protein, 40 aa, Neocallimastix californiae
  Cellulose docking domain, dockering
KCLSEFIGYPCCSPEFTTIYAQDEYGDWSYDFVKNEWCGL

SEQ ID NO: 4379 - protein, 39 aa, Neocallimastix californiae
  Cellulose docking domain, dockering
ECWSEELGYPCCKGCRVYETDSDGSWGYEFNQWCGIISA

SEQ ID NO: 4380 - protein, 40 aa, Neocallimastix californiae
  Cellulose docking domain, dockering
ECWSEELGYPCCKGCRVYETDSDGSWGYEFNQWCGIISAK

SEQ ID NO: 4381 - protein, 33 aa, Neocallimastix californiae; identical to SEQ ID NO: 1831
  Cellulose docking domain, dockering

SEQ ID NO: 4382 - protein, 37 aa, Neocallimastix californiae
  Cellulose docking domain, dockering
TCFSIELGYPCCTDNKVIYTDERGDWGKENHQWCGIG

SEQ ID NO: 4383 - protein, 34 aa, Neocallimastix californiae
  Cellulose docking domain, dockering
KLNPSYPCCTGNEVVYTDENGDWGVENNSWCGIS

SEQ ID NO: 4384 - protein, 39 aa, Neocallimastix californiae
  Cellulose docking domain, dockering
SCFSIVQGYPCCKTCHIDYTDESGDWGVEDDKWCGIKDS

SEQ ID NO: 4385 - protein, 37 aa, Neocallimastix californiae; identical to SEQ ID NO: 4382
  Cellulose docking domain, dockering

SEQ ID NO: 4386 - protein, 34 aa, Neocallimastix californiae
  Cellulose docking domain, dockering
KLNPSYPCCTGNEVVYTDESGDWGVENNSWCGIS

SEQ ID NO: 4387 - protein, 37 aa, Neocallimastix californiae; identical to SEQ ID NO: 4382
  Cellulose docking domain, dockering

SEQ ID NO: 4388 - protein, 39 aa, Neocallimastix californiae; identical to SEQ ID NO: 4384
  Cellulose docking domain, dockering

SEQ ID NO: 4389 - protein, 34 aa, Neocallimastix californiae; identical to SEQ ID NO: 4383
  Cellulose docking domain, dockering

SEQ ID NO: 4390 - protein, 37 aa, Neocallimastix californiae
  Cellulose docking domain, dockering
CWSAPDYPCCSNNANIIYSDGQGDWGYENDNWCGIVN

SEQ ID NO: 4391 - protein, 39 aa, Neocallimastix californiae
  Cellulose docking domain, dockering
SCSAEAYGYKCCKGCTVVTSDETGDWGVENNEWCGIPSS

SEQ ID NO: 4392 - protein, 32 aa, Neocallimastix californiae
  Cellulose docking domain, dockering
PSYPCCSTSTSVVYEDELGKWGIENDDWCGIK

SEQ ID NO: 4393 - protein, 40 aa, Neocallimastix californiae
  Cellulose docking domain, dockering
QCWSTKLGYGCCEGCHTYEVDDNGKWGYENGKWCGIVEDK

SEQ ID NO: 4394 - protein, 40 aa, Neocallimastix californiae
  Cellulose docking domain, dockering
TCWSEKLDYPCCTSTCYVYSTDVDGEWGYEDNHWCGVPAS

SEQ ID NO: 4395 - protein, 39 aa, Neocallimastix californiae
  Cellulose docking domain, dockering
SCKFEEIGYSCCSHCDVVYTDEDGDWGTEDGKWCGIPEN

SEQ ID NO: 4396 - protein, 41 aa, Neocallimastix californiae
  Cellulose docking domain, dockering
SCWAEEQGYPCCSDTNRKVEQIDDNGNAWAIENNDWCGLPK

SEQ ID NO: 4397 - protein, 33 aa, Neocallimastix californiae
  Cellulose docking domain, dockering
DYPCCSNENTAVITTDEQGDWGVENGDWCGIIN

SEQ ID NO: 4398 - protein, 36 aa, Neocallimastix californiae
  Cellulose docking domain, dockering
QAILSQGYKCCSSDCVVIFTDDDGTWGIENDEWCGC

SEQ ID NO: 4399 - protein, 39 aa, Neocallimastix californiae
  Cellulose docking domain, dockering
FSITSQGYKCCKDNNCSVIETDDAGKWGIEDDDWCGISN

SEQ ID NO: 4400 - protein, 38 aa, Neocallimastix californiae; identical to SEQ ID NO: 4067
  Cellulose docking domain, dockering

SEQ ID NO: 4401 - protein, 38 aa, Neocallimastix californiae
  Cellulose docking domain, dockering
SCWSLPFGYPCCPHCKVLTEDENGKWGELNGEWCGIVA

SEQ ID NO: 4402 - protein, 38 aa, Neocallimastix californiae
  Cellulose docking domain, dockering
NCWANILGYQCCENTKEVFLKDESGSWGIENDDWCGIV

SEQ ID NO: 4403 - protein, 38 aa, Neocallimastix californiae
  Cellulose docking domain, dockering
SCWADALGYNCCIYTKEVIYTDESGDWGVENNEWCGII

SEQ ID NO: 4404 - protein, 39 aa, Neocallimastix californiae
  Cellulose docking domain, dockering
GCFSEEMGYPCCSDCSVVYTDSDGGWGVEGDDWCGIKDK

SEQ ID NO: 4405 - protein, 41 aa, Neocallimastix californiae
  Cellulose docking domain, dockering
TCWSKALGYPCCKSSCEVIYSDDDGEWGVEDADWCGIEASK

SEQ ID NO: 4406 - protein, 39 aa, Neocallimastix californiae
  Cellulose docking domain, dockering
CWSKKFGYDCCNGCTSYEEDSNGKWGYEENKWCGIVSEN

SEQ ID NO: 4407 - protein, 40 aa, Neocallimastix californiae
  Cellulose docking domain, dockering
ACWSEKLGYPCCVSSCYVYESDNEGEWGYEDNHWCGISSS

SEQ ID NO: 4408 - protein, 37 aa, Neocallimastix californiae
  Cellulose docking domain, dockering
CSASILAQGYECCSDNCEVVYTDADGDWGVENEQWCG

SEQ ID NO: 4409 - protein, 40 aa, Neocallimastix californiae
  Cellulose docking domain, dockering
CSVRITSQGYECCSSCGTVYYTDDDGEWGVENNNWCGMPT

SEQ ID NO: 4410 - protein, 40 aa, Neocallimastix californiae
  Cellulose docking domain, dockering
PSNIAAQGYQCCSPGNCSIYLEDDTGRWGIENDEWCGTPS

SEQ ID NO: 4411 - protein, 40 aa, Neocallimastix californiae
  Cellulose docking domain, dockering
CSAKILSQGYKCCKKGCAIIYTDDDGTWGVENGEWCGCTS

SEQ ID NO: 4412 - protein, 40 aa, Neocallimastix californiae
  Cellulose docking domain, dockering
QCMAEIIGYPCCDKNVKTVYEKDVYGDWGYDFKKGEWCGL

SEQ ID NO: 4413 - protein, 38 aa, Neocallimastix californiae
  Cellulose docking domain, dockering
ECWSEVFGYPCCKGCYVYETDDDGKWGYENQHWCGIQS

SEQ ID NO: 4414 - protein, 39 aa, Neocallimastix californiae
  Cellulose docking domain, dockering
ECAFEKIGYKCCESTTEVVFEDGSGTWGVENNEWCGITN

SEQ ID NO: 4415 - protein, 34 aa, Neocallimastix californiae
  Cellulose docking domain, dockering
PADGYECCNGCSVVEQSDGYKWGVENNKWCIIKN

SEQ ID NO: 4416 - protein, 35 aa, Neocallimastix californiae
  Cellulose docking domain, dockering
TTSGYKCCDDCNVTYEDSTGKWGIKDNDWCAISDK

SEQ ID NO: 4417 - protein, 38 aa, Neocallimastix californiae
  Cellulose docking domain, dockering
SCWSTKLGYGCCTGCDVSYTDNDGDWGYENDWCGIPTT

SEQ ID NO: 4418 - protein, 34 aa, Neocallimastix californiae
  Cellulose docking domain, dockering
KNQGYSYCNLCDVIYNDNDGRWGIENGEWCGIKS

SEQ ID NO: 4419 - protein, 38 aa, Neocallimastix californiae
  Cellulose docking domain, dockering
NCFSINLGYPCCNGNTVYYTDNDGQWGYENNNWCGIKE

SEQ ID NO: 4420 - protein, 40 aa, Neocallimastix californiae
  Cellulose docking domain, dockering
ECWSEKYGYPCCDSCIDVNFEDSNGYWGIQNGEICGIPKE

SEQ ID NO: 4421 - protein, 38 aa, Neocallimastix californiae
  Cellulose docking domain, dockering
YCFSEELGYPCCSSGVLVYEKDEHGSWGIENNDWCGII

SEQ ID NO: 4422 - protein, 36 aa, Neocallimastix californiae
  Cellulose docking domain, dockering
DCFSIPLGYPCCSEGTPEYYTDENGSWGVENDDWCG

SEQ ID NO: 4423 - protein, 39 aa, Neocallimastix californiae
  Cellulose docking domain, dockering
NCWSSNLGYSCCPSGTPVYFTDENGDWGIINDDWCGIVD

SEQ ID NO: 4424 - protein, 39 aa, Neocallimastix californiae; identical to SEQ ID NO: 4423
  Cellulose docking domain, dockering

SEQ ID NO: 4425 - protein, 36 aa, Neocallimastix californiae; identical to SEQ ID NO: 4422
  Cellulose docking domain, dockering

SEQ ID NO: 4426 - protein, 39 aa, Neocallimastix californiae
  Cellulose docking domain, dockering
YCFSEELGYPCCSSGVLVYEKDEHGSWGIENNDWCGIIG

SEQ ID NO: 4427 - protein, 39 aa, Neocallimastix californiae
  Cellulose docking domain, dockering
CSSRITSQGYKCCSNCIVYYTDNDGEWGVEDGNWCGTPD

SEQ ID NO: 4428 - protein, 35 aa, Neocallimastix californiae
  Cellulose docking domain, dockering
HWQYPCCDNCEVYYTDNEGKWGILNNDWCKINDNR

SEQ ID NO: 4429 - protein, 36 aa, Neocallimastix californiae; identical to SEQ ID NO: 1879
  Cellulose docking domain, dockering

SEQ ID NO: 4430 - protein, 38 aa, Neocallimastix californiae
  Cellulose docking domain, dockering
PCWSEKLGYPCCKPTNTEILEVDKYGEWGMENGERCGI

SEQ ID NO: 4431 - protein, 37 aa, Neocallimastix californiae
  Cellulose docking domain, dockering
TCWSALLGYKCCKKSFSPLYKDKNGIWSVENDKWCGV

SEQ ID NO: 4432 - protein, 38 aa, Neocallimastix californiae; identical to SEQ ID NO: 4430
  Cellulose docking domain, dockering

SEQ ID NO: 4433 - protein, 38 aa, Neocallimastix californiae
  Cellulose docking domain, dockering
CPSSITRQGYKCCRVGCTVEYTDNDGEWGVEDGDWCGC

SEQ ID NO: 4434 - protein, 38 aa, Neocallimastix californiae
  Cellulose docking domain, dockering
CNANIIAQGYKCCRVGCTVEYTDNDGEWGVEDGDWCGC

SEQ ID NO: 4435 - protein, 39 aa, Neocallimastix californiae
  Cellulose docking domain, dockering
GCFSESLGYNCCKGCDIILTDDYGSWGVENNDWCGINDS

SEQ ID NO: 4436 - protein, 31 aa, Neocallimastix californiae
  Cellulose docking domain, dockering
PDYPCCTGNEVVYTDSDGDWGYENNQWCGIA

SEQ ID NO: 4437 - protein, 32 aa, Neocallimastix californiae
  Cellulose docking domain, dockering
EYKCCSEGIESIFEDSIGKWGIEDNEWCGIKA

SEQ ID NO: 4438 - protein, 41 aa, Neocallimastix californiae
  Cellulose docking domain, dockering
KCWALAEGYPCCKNKDAKVYSTDKHGKKWGIEDNNWCGIIE

SEQ ID NO: 4439 - protein, 34 aa, Neocallimastix californiae
  Cellulose docking domain, dockering
RNSGYSCCVLTKKVELTDNVGQWGVENGEWCLFE

SEQ ID NO: 4440 - protein, 41 aa, Neocallimastix californiae
  Cellulose docking domain, dockering
GCWAKALGSNCCSTSSCRNVVYFDYDGQWDVENGEWCGIST

SEQ ID NO: 4441 - protein, 39 aa, Neocallimastix californiae
  Cellulose docking domain, dockering
SCWSKSLGYPCCSGKSAVLYTDASGQWGVENGDWCGIAK

SEQ ID NO: 4442 - protein, 39 aa, Neocallimastix californiae
  Cellulose docking domain, dockering
ECFAEKLGYSCCNECNIIYTDNDGEWGIENDEWCGLKDR

SEQ ID NO: 4443 - protein, 38 aa, Neocallimastix californiae
  Cellulose docking domain, dockering
ECTFESIGYKCCSNSCTVVYTDESGDWGVENGEWCGII

SEQ ID NO: 4444 - protein, 40 aa, Neocallimastix californiae
  Cellulose docking domain, dockering
DCWSQSLGYGCCSGCIDVIMTDNDGEWGVENNDWCGIPKT

SEQ ID NO: 4445 - protein, 39 aa, Neocallimastix californiae
  Cellulose docking domain, dockering
CSGAQGYPCCKSTCSSYFQDNDGEWGVENDDWCLINKSI

SEQ ID NO: 4446 - protein, 36 aa, Neocallimastix californiae
  Cellulose docking domain, dockering
KCFSVDIGYPCCTNNSPVYYTDDDGKWGVQNGDWCG

SEQ ID NO: 4447 - protein, 38 aa, Neocallimastix californiae
  Cellulose docking domain, dockering
SCWSKKLGYPCCSKNASTVYTDADGKWGVENNEWCGIN

SEQ ID NO: 4448 - protein, 39 aa, Neocallimastix californiae
  Cellulose docking domain, dockering
SCFSIVQGYPCCETCHIDYTDESGDWGVEDDKWCGIKDS

SEQ ID NO: 4449 - protein, 41 aa, Neocallimastix californiae
  Cellulose docking domain, dockering
TCWSIELGYPCCSTSECKVVYEEDDDGKWGAENNDWCGITS

SEQ ID NO: 4450 - protein, 40 aa, Neocallimastix californiae
  Cellulose docking domain, dockering
ECWSEKLGYSCCSENNTRVVLTDDDGKWGAENGEWCGIRA

SEQ ID NO: 4451 - protein, 39 aa, Neocallimastix californiae
  Cellulose docking domain, dockering
TCWSAAEGFPCCSTTTAVVLTDSKGKWGIENNNWCGIVE

SEQ ID NO: 4452 - protein, 40 aa, Neocallimastix californiae
  Cellulose docking domain, dockering
SCWATSQGYPCCTGCDAIYTDGSGKWGFENNNWCGIVDSQ

SEQ ID NO: 4453 - protein, 36 aa, Neocallimastix californiae
  Cellulose docking domain, dockering
AKKDGFNCCNGCTVTYTDASGKWGVENNQWCGIDSS

SEQ ID NO: 4454 - protein, 36 aa, Neocallimastix californiae
  Cellulose docking domain, dockering
NNTGYHCCSDPNTTVYTSDSSGDWGVEGDYWCLIVK

SEQ ID NO: 4455 - protein, 37 aa, Neocallimastix californiae; identical to SEQ ID NO: 1906
  Cellulose docking domain, dockering

SEQ ID NO: 4456 - protein, 39 aa, Neocallimastix californiae
  Cellulose docking domain, dockering
CPNSSDGYPCCPDCNVVYTDENNQVWGNLNDEWCSIPYR

SEQ ID NO: 4457 - protein, 38 aa, Neocallimastix californiae
  Cellulose docking domain, dockering
RCPGENLGYNCCSSCIEPYEEDENGKWAVVDESWCSLP

SEQ ID NO: 4458 - protein, 31 aa, Neocallimastix californiae
  Cellulose docking domain, dockering
PDFPCCTSTTEVVEVDENGEWGIENGNWCGI

SEQ ID NO: 4459 - protein, 38 aa, Neocallimastix californiae
  Cellulose docking domain, dockering
ECFSNGLGYPCCNSCDIIYIDESGNWGVENGDWCGIKD

SEQ ID NO: 4460 - protein, 38 aa, Neocallimastix californiae
  Cellulose docking domain, dockering
SCFAISLGYSCCEGSEIVYTDDDGDWGYENDNWCGIEN

SEQ ID NO: 4461 - protein, 38 aa, Neocallimastix californiae
  Cellulose docking domain, dockering
SCPGKSEGYQCCSSCNVVFTDENGSWGVENNEWCGIRN

SEQ ID NO: 4462 - protein, 40 aa, Neocallimastix californiae
  Cellulose docking domain, dockering
ECFATILGFNCCASCINSIYDDDDGHWGLENNDWCGIPEN

SEQ ID NO: 4463 - protein, 39 aa, Neocallimastix californiae
  Cellulose docking domain, dockering
GCWAKALGYECCKTCQTTVSKDENGEWGIENDEWCGITT

SEQ ID NO: 4464 - protein, 34 aa, Neocallimastix californiae
  Cellulose docking domain, dockering
CALGYPCCENTFEATYTDENGKWAIENGDWCEVK

SEQ ID NO: 4465 - protein, 32 aa, Neocallimastix californiae
  Cellulose docking domain, dockering
DYPCCSECNSVYSDESGEWGVENNDWCLLKKS

SEQ ID NO: 4466 - protein, 36 aa, Neocallimastix californiae
  Cellulose docking domain, dockering
DCFAKAQGFECCNDSEVVYSDDSGDWGVVNGQWCGI

SEQ ID NO: 4467 - protein, 34 aa, Neocallimastix californiae
  Cellulose docking domain, dockering
KNEGYSKCDNCEVVYSDDSGNWGVQNNDWCGISN

SEQ ID NO: 4468 - protein, 33 aa, Neocallimastix californiae
  Cellulose docking domain, dockering
EGQEYNCCKGCDVIYTDTSDWGVEDDDWCSIPY

SEQ ID NO: 4469 - protein, 40 aa, Neocallimastix californiae
  Cellulose docking domain, dockering
ECWATELGYPCCELKTTKIEFTDSGSGKQFGVENNHICGI

SEQ ID NO: 4470 - protein, 34 aa, Neocallimastix californiae
  Cellulose docking domain, dockering
IGVQGYPCCKNTSTVFYTDDDGDWGVENNNWCVI

SEQ ID NO: 4471 - protein, 38 aa, Neocallimastix californiae
  Cellulose docking domain, dockering
EKILAQGYKCCSDKNCIVYYEDSDGYWGIENDDWCGCG

SEQ ID NO: 4472 - protein, 40 aa, Neocallimastix californiae
  Cellulose docking domain, dockering
KCTSEKLGYPCCSSNNNKVYYTDNDGDWGFDENTNNWCGL

SEQ ID NO: 4473 - protein, 40 aa, Neocallimastix californiae
  Cellulose docking domain, dockering
TCWSERLGYSCCQGCQVVEVDNDGNWGIENDQWCGIPLDR

SEQ ID NO: 4474 - protein, 38 aa, Neocallimastix californiae
  Cellulose docking domain, dockering
KCWSKKFGIECCKQTKEVVRETYDGLWGKENGEWCGLG

SEQ ID NO: 4475 - protein, 34 aa, Neocallimastix californiae
  Cellulose docking domain, dockering
SPAYPCCSKCNVVYTDEEGEWGYEKGSWCGIKDT

SEQ ID NO: 4476 - protein, 40 aa, Neocallimastix californiae
  Cellulose docking domain, dockering
TCWSEKLGYDCCKHCTVSYTDESGEWGVEEDDVWCGILKT

SEQ ID NO: 4477 - protein, 40 aa, Neocallimastix californiae
  Cellulose docking domain, dockering
ECWSEKLGYKCCKYCNVEYEDEEGKWGLENDEWCGIKKSS

SEQ ID NO: 4478 - protein, 37 aa, Neocallimastix californiae
  Cellulose docking domain, dockering
GCWSKKFNIPCCKSTDAVVRSTYDGEWGLENGEWCGL

SEQ ID NO: 4479 - protein, 40 aa, Neocallimastix californiae
  Cellulose docking domain, dockering
NCWSEVLGYPCCTSSCHVYSTDSDGQWGYEDDHWCGIADS

SEQ ID NO: 4480 - protein, 40 aa, Neocallimastix californiae
  Cellulose docking domain, dockering
TCWSKKFGYGCCEGCRAYEEDADGKWGYENNEWCGIVEQN

SEQ ID NO: 4481 - protein, 40 aa, Neocallimastix californiae
  Cellulose docking domain, dockering
VCWSKALGYNCCTTTSVVQYEDQDGPWGIENNDWCGIIKN

SEQ ID NO: 4482 - protein, 38 aa, Neocallimastix californiae
  Cellulose docking domain, dockering
DCWSSRLGYPCCTSTNSIYFSDGDGDWGIENNQWCGLP

SEQ ID NO: 4483 - protein, 38 aa, Neocallimastix californiae
  Cellulose docking domain, dockering
TCFSEKLGYKCCEGSDVELIDEDGMWGIENGQWCGISN

SEQ ID NO: 4484 - protein, 31 aa, Neocallimastix californiae
  Cellulose docking domain, dockering
KYNCCQGCKVKYVDSEKWGYENGEWCSIPYS

SEQ ID NO: 4485 - protein, 39 aa, Neocallimastix californiae
  Cellulose docking domain, dockering
ACWSIEEGYPCCQKKTTKVKHVSKNGNEWGVENNNWCGI

SEQ ID NO: 4486 - protein, 39 aa, Neocallimastix californiae
  Cellulose docking domain, dockering
ECWAEALGYKCCTNTKSVNFTDENGSWGFENNVRCGIIE

SEQ ID NO: 4487 - protein, 39 aa, Neocallimastix californiae
  Cellulose docking domain, dockering
CWSRSIGFVCCDKCNVLYVDEQGQWGVEDGYWCGINPSK

SEQ ID NO: 4488 - protein, 34 aa, Neocallimastix californiae
  Cellulose docking domain, dockering
KKNTLPCCTTCDIYLIDATGRYGYENGEWCNTPF

SEQ ID NO: 4489 - protein, 38 aa, Neocallimastix californiae
  Cellulose docking domain, dockering
ECFATKLGYSCCTTTKNVISVNSYGKWGIENGKLCGIE

SEQ ID NO: 4490 - protein, 39 aa, Neocallimastix californiae
  Cellulose docking domain, dockering
SLSEDKRFPCCSSNDVEVAGKEMDGSWGYENGKKCGIRN

SEQ ID NO: 4491 - protein, 38 aa, Neocallimastix californiae
  Cellulose docking domain, dockering
YCWAVKYGYSCCKETTVIEEVDENGRWGFENGGRCGFI

SEQ ID NO: 4492 - protein, 35 aa, Neocallimastix californiae
  Cellulose docking domain, dockering
SEPEYRCCNPETQVFYSDDQGKWGIENGEWCGIIE

SEQ ID NO: 4493 - protein, 38 aa, Neocallimastix californiae
  Cellulose docking domain, dockering
VCWSERLGYPCCVGYTDTIFADADGEWGLQNDDWCGIT

SEQ ID NO: 4494 - protein, 37 aa, Neocallimastix californiae
  Cellulose docking domain, dockering
KCFTLDLGYPCCKKNKDLVLEDEDGKWGNEDGEWCGL

SEQ ID NO: 4495 - protein, 38 aa, Neocallimastix californiae
  Cellulose docking domain, dockering
ECWSESYGYKCCTDPDAKIEYDGDGNLWGVENGEWCGI

SEQ ID NO: 4496 - protein, 36 aa, Neocallimastix californiae
  Cellulose docking domain, dockering
SFANNYGYPGCKNATKIRYSGVEGSWGYENGSWCGI

SEQ ID NO: 4497 - protein, 39 aa, Neocallimastix californiae
  Cellulose docking domain, dockering
SPKILAQGYSCCPKGCRVYETDEDGDWGYVDNEWCGCKV

SEQ ID NO: 4498 - protein, 33 aa, Neocallimastix californiae
  Cellulose docking domain, dockering
ICAKGYPCCKGDSEIYLVDEDGNWGYEDDEWCL

SEQ ID NO: 4499 - protein, 40 aa, Neocallimastix californiae
  Cellulose docking domain, dockering
KCWSSGYGYPCCNNCKVYFVDDNGEWGIENGNWCGIVDSK

SEQ ID NO: 4500 - protein, 40 aa, Neocallimastix californiae
  Cellulose docking domain, dockering
YCWSESKGYPCCKYCDVVSVDRYGSWGIENGKWCGVKSDV

SEQ ID NO: 4501 - protein, 40 aa, Neocallimastix californiae
  Cellulose docking domain, dockering
TCWSETKGYKCCKSCDVVTVDRFGSWGVENGEWCGIDYDI

SEQ ID NO: 4502 - protein, 40 aa, Neocallimastix californiae
  Cellulose docking domain, dockering
TCWASFYGYDCCNGCKVKSVDSLGSWGFEGGKWCGIDTET

SEQ ID NO: 4503 - protein, 40 aa, Neocallimastix californiae
  Cellulose docking domain, dockering
TCWSSFYGYSCCKGCKVRYVDDLGSWGYEGGKWCGIDSEI

SEQ ID NO: 4504 - protein, 40 aa, Neocallimastix californiae
  Cellulose docking domain, dockering
KCWSKSLGYSCCKTCNVYTVDKSGSWGYEDGKWCGIDAET

SEQ ID NO: 4505 - protein, 38 aa, Neocallimastix californiae
  Cellulose docking domain, dockering
ECFATKLGYPCCSVGYPTVLKDESGSWSVENGEWCGVS

SEQ ID NO: 4506 - protein, 38 aa, Neocallimastix californiae
  Cellulose docking domain, dockering
ECWSSSLGYPCCTSTKDAILVDDNGKWGSENGNWCGIV

SEQ ID NO: 4507 - protein, 38 aa, Neocallimastix californiae
  Cellulose docking domain, dockering
ECWSKKYGYECCSSENTRVVVTDETGKWGVENGQWCGV

SEQ ID NO: 4508 - protein, 40 aa, Neocallimastix californiae
  Cellulose docking domain, dockering
ACWSLPFGYKCCTHCKVLTKDENGKWGEEKGEWCGIIEEK

SEQ ID NO: 4509 - protein, 38 aa, Neocallimastix californiae
  Cellulose docking domain, dockering
ECWSLKLNYPCCDRNNTISFYRNDYGAWGNVDNKWCGL

SEQ ID NO: 4510 - protein, 37 aa, Neocallimastix californiae
  Cellulose docking domain, dockering
ECFSERLGYRCCYGNKVVLTDADGKWGVENNQWCGIS

SEQ ID NO: 4511 - protein, 40 aa, Neocallimastix californiae
  Cellulose docking domain, dockering
ACWANALGYPCCKTAYAIYYTDNDGNWSIENNEWCGIDES

SEQ ID NO: 4512 - protein, 38 aa, Neocallimastix californiae
  Cellulose docking domain, dockering
GCTFESIGYNCCSSTTDVIYQDENGDWGVENNDWCGII

SEQ ID NO: 4513 - protein, 39 aa, Neocallimastix californiae
  Cellulose docking domain, dockering
NCFSEKLGYPCCIGCNVIYTDDDGDWGIEQGSWCGINDK

SEQ ID NO: 4514 - protein, 41 aa, Neocallimastix californiae
  Cellulose docking domain, dockering
TCWAESLGYPCCTGKNPIVYEHDSNGDWGYNWKTNEWCGIS

SEQ ID NO: 4515 - protein, 36 aa, Neocallimastix californiae
  Cellulose docking domain, dockering
CWSDALGYPCCHGCTVYETDADGSWGYESNQWCGIQ

SEQ ID NO: 4516 - protein, 38 aa, Neocallimastix californiae
  Cellulose docking domain, dockering
TCWSTGLGYPCCSLTNTDVYYIDESGNWGIENDDWCGI

SEQ ID NO: 4517 - protein, 39 aa, Neocallimastix californiae
  Cellulose docking domain, dockering
ECFSTKLGYPCCQQTKDVVYEDNDGQWGVENNDWCGITK

SEQ ID NO: 4518 - protein, 43 aa, Neocallimastix californiae
  Cellulose docking domain, dockering
TCWSEAYGYHCCKNPDTVLIEPRSKSNPGREWYGVEDNKWCGI

SEQ ID NO: 4519 - protein, 35 aa, Neocallimastix californiae
  Cellulose docking domain, dockering
KQTEYNCCVFSTTENVQTTEEGKWGVEFNKWCLID

SEQ ID NO: 4520 - protein, 32 aa, Neocallimastix californiae
  Cellulose docking domain, dockering
NDKYKCCSHCNVSYTDSTKWGIENNHWCHIPS

SEQ ID NO: 4521 - protein, 33 aa, Neocallimastix californiae
  Cellulose docking domain, dockering
QYECCSGCDVFYSDNEALWGVENGNWCVIQNSV

SEQ ID NO: 4522 - protein, 35 aa, Neocallimastix californiae
  Cellulose docking domain, dockering
ATDYPNCNSCDVYYTDATGKWGVENRNWCIIQESR

SEQ ID NO: 4523 - protein, 35 aa, Neocallimastix californiae
  Cellulose docking domain, dockering
VHAYEDCEGCYVVTEEDGIKWGVENNDWCKIVSSK

SEQ ID NO: 4524 - protein, 33 aa, Neocallimastix californiae
  Cellulose docking domain, dockering
PTYMCCEGCDVYDQTEEGMWGIENDNWCGIKDS

SEQ ID NO: 4525 - protein, 33 aa, Neocallimastix californiae
  Cellulose docking domain, dockering
PSYKCCQGCNVIEEDASGKWGIENNEWCGIKDS

SEQ ID NO: 4526 - protein, 41 aa, Neocallimastix californiae
  Cellulose docking domain, dockering
TCWATKLGYSCCKSTKEVVYTDADGRWGVENNNWCGIIDSG

SEQ ID NO: 4527 - protein, 40 aa, Neocallimastix californiae
  Cellulose docking domain, dockering
GCWATKLGYKCCTAKCPVEEYVDNDGSWGIENNNWCGITK

SEQ ID NO: 4528 - protein, 42 aa, Neocallimastix californiae
  Cellulose docking domain, dockering
ECWSENLGYKCCTKKCDAIFVLTDELGNWGMENKEWCGIPKN

SEQ ID NO: 4529 - protein, 39 aa, Neocallimastix californiae
  Cellulose docking domain, dockering
ECSASKFGYPCCKGCTVYEKDEVGEWGYENDEWCSIKAT

SEQ ID NO: 4530 - protein, 39 aa, Neocallimastix californiae
  Cellulose docking domain, dockering
NCWAAKLGFNCCKTTKTVVYEDADGNWGVEDDYWCGIIE

SEQ ID NO: 4531 - protein, 38 aa, Neocallimastix californiae
  Cellulose docking domain, dockering
QCWSTKLGYPCCEDANVIYTVDENGSWGYEDDHWCGIV

SEQ ID NO: 4532 - protein, 34 aa, Neocallimastix californiae; identical to SEQ ID NO: 1983
  Cellulose docking domain, dockering

SEQ ID NO: 4533 - protein, 38 aa, Neocallimastix californiae; identical to SEQ ID NO: 1984
  Cellulose docking domain, dockering

SEQ ID NO: 4534 - protein, 35 aa, Neocallimastix californiae
  Cellulose docking domain, dockering
NEKGYNSCTLGTKVSFTDVNGIWGIENDKWCAILS

SEQ ID NO: 4535 - protein, 40 aa, Neocallimastix californiae
  Cellulose docking domain, dockering
SCWASSEGYSCCKGCESIFTDGVRRWGVENDQWCGIIEAN

SEQ ID NO: 4536 - protein, 36 aa, Neocallimastix californiae
  Cellulose docking domain, dockering
ASKDGYSCCKSCTIVLDDESGKWGVENGDWCGIDTS

SEQ ID NO: 4537 - protein, 38 aa, Neocallimastix californiae
  Cellulose docking domain, dockering
ECWSLSEGYKCCSAGTTVALVDSKGKWGIENGDWCGII

SEQ ID NO: 4538 - protein, 39 aa, Neocallimastix californiae
  Cellulose docking domain, dockering
DCWATKLDYPCCSYSTQVFETDENGQWSIENGEWCGIVS

SEQ ID NO: 4539 - protein, 39 aa, Neocallimastix californiae
  Cellulose docking domain, dockering
NCWSNALGYPCCKTTTTVISTDSDGQWGVENNEWCGIPK

SEQ ID NO: 4540 - protein, 39 aa, Neocallimastix californiae
  Cellulose docking domain, dockering
DCFSEKLGYPCCKKTKDIVYSDEDGPWGVEDNSWCGIQR

SEQ ID NO: 4541 - protein, 38 aa, Neocallimastix californiae
  Cellulose docking domain, dockering
IGADGYPCCSQECTSYFRDESGDWSVENGDWCLIDTSI

SEQ ID NO: 4542 - protein, 38 aa, Neocallimastix californiae
  Cellulose docking domain, dockering
SCWSEALGYPCCQGEVEYVESNENGDWGLENNEWCGLP

SEQ ID NO: 4543 - protein, 39 aa, Neocallimastix californiae
  Cellulose docking domain, dockering
SCWSEALGYPCCQGEVELVESNEDGDWGLENNEWCGIPK

SEQ ID NO: 4544 - protein, 38 aa, Neocallimastix californiae
  Cellulose docking domain, dockering
ACWSEAYGFPCCQGEIGYIESDEYGDWSVENNKWCGVP

SEQ ID NO: 4545 - protein, 39 aa, Neocallimastix californiae
  Cellulose docking domain, dockering
ECPNQKNGYPCCQTCDVYLTDADGKWGVENGNWCSIKDS

SEQ ID NO: 4546 - protein, 40 aa, Neocallimastix californiae
  Cellulose docking domain, dockering
ECWSSKLGYKCCSRGCNTAVVVTDNDGAWGVENGEWCGVQ

SEQ ID NO: 4547 - protein, 33 aa, Neocallimastix californiae
  Cellulose docking domain, dockering
PDYPCCSTCDVYLTEDNGSRWGVENNDWCSIKN

SEQ ID NO: 4548 - protein, 33 aa, Neocallimastix californiae
  Cellulose docking domain, dockering
SEPDYPCCKNTCRVVYTDSSEWGVENGNWCGIP

SEQ ID NO: 4549 - protein, 24 aa, Neocallimastix californiae
  Cellulose docking domain, dockering
CWSEKLGYPCCQNTSSVVYTDNDG

SEQ ID NO: 4550 - protein, 39 aa, Neocallimastix californiae
  Cellulose docking domain, dockering
CWSEKLGYPCCQNTSSVAYTDSDGKWGVENGNWCGIKSS

SEQ ID NO: 4551 - protein, 36 aa, Neocallimastix californiae
  Cellulose docking domain, dockering
WSEPDYKCCTTCDIVYTDDHNWGVENGEWCGIDDSK

SEQ ID NO: 4552 - protein, 38 aa, Neocallimastix californiae
  Cellulose docking domain, dockering
ECGAAALGYPCCQSTCTEVYTDEYRWGVENGDWCGLKD

SEQ ID NO: 4553 - protein, 40 aa, Neocallimastix californiae
  Cellulose docking domain, dockering
ECWSEILGYPCCKGCKIYETDSDGSWGYEFNQWCGIISSR

SEQ ID NO: 4554 - protein, 40 aa, Neocallimastix californiae
  Cellulose docking domain, dockering
KCLSEFLGYPCCSSELTTVYAEDEYGEWSYDFTKNEWCGL

SEQ ID NO: 4555 - protein, 37 aa, Neocallimastix californiae
  Cellulose docking domain, dockering
NCFSIALGFPCCKGNTVIYTDDDGDWGVENEEWCGIS

SEQ ID NO: 4556 - protein, 38 aa, Neocallimastix californiae
  Cellulose docking domain, dockering
SCFAKALGYECCSTCDVVYTDDDGDWGVDNGEWCGIKD

SEQ ID NO: 4557 - protein, 40 aa, Neocallimastix californiae
  Cellulose docking domain, dockering
KCWAYARNYKCCSNPNTKVETEDKYGKWGIENNEWCGIDT

SEQ ID NO: 4558 - protein, 38 aa, Neocallimastix californiae
  Cellulose docking domain, dockering
KCWSNFLGYPCCKKTDDIIYNAVKGSWGYENNSWCGLD

SEQ ID NO: 4559 - protein, 35 aa, Neocallimastix californiae
  Cellulose docking domain, dockering
ELDDGYPCCKTTNVVIETDGNGEWGIENDQWCGIR

SEQ ID NO: 4560 - protein, 35 aa, Neocallimastix californiae
  Cellulose docking domain, dockering
LDEPYPCCVYATEIIYTNENGKWSMENGDWCGIIE

SEQ ID NO: 4561 - protein, 37 aa, Neocallimastix californiae
  Cellulose docking domain, dockering
DCKGLSEGYPCCSSLSMKTSGYDDQWGYEDNDWCRLT

SEQ ID NO: 4562 - protein, 39 aa, Neocallimastix californiae
  Cellulose docking domain, dockering
KCWSVSKGYPCCVGDNPSIEFVDSDGQWGLENGNWCGIA

SEQ ID NO: 4563 - protein, 40 aa, Neocallimastix californiae
  Cellulose docking domain, dockering
KCWSLSQGYPCCSIQPYHIELSDESGDWGIENGDWCGIPK

SEQ ID NO: 4564 - protein, 38 aa, Neocallimastix californiae
  Cellulose docking domain, dockering
DCWATKKGFPCCSNKDTSIVSVDSEGQWGMENGQWCGI

SEQ ID NO: 4565 - protein, 39 aa, Neocallimastix californiae
  Cellulose docking domain, dockering
QCPAAKNGYKCCNACKVKTTDKNGDWGVENGEWCSIPYT

SEQ ID NO: 4566 - protein, 43 aa, Neocallimastix californiae
  Cellulose docking domain, dockering
KCWSKSQGYSCCKDATTTVRTTDSKGYLWGIENNEWCGITGNQ

SEQ ID NO: 4567 - protein, 35 aa, Neocallimastix californiae
  Cellulose docking domain, dockering
RSTGYSCCMFNTTAIATKDSDGYWGVENGQWCLFE

SEQ ID NO: 4568 - protein, 35 aa, Neocallimastix californiae
  Cellulose docking domain, dockering
SSGYICCRTTDCEVVSSDEAGDWCMEGNLWCLISK

SEQ ID NO: 4569 - protein, 40 aa, Neocallimastix californiae
  Cellulose docking domain, dockering
ECWSLAEGYPCCQHATKVENIDEQGRKWSVENDDWCGIIE

SEQ ID NO: 4570 - protein, 38 aa, Neocallimastix californiae
  Cellulose docking domain, dockering
SGAILSQGYKCCSSGCSVVYTDGDGTWGFENDQWCGCN

SEQ ID NO: 4571 - protein, 41 aa, Neocallimastix californiae
  Cellulose docking domain, dockering
CPASIASQGYKCCSSNNCDVYLTDESGKWGVENNDWCGISN

SEQ ID NO: 4572 - protein, 41 aa, Neocallimastix californiae
  Cellulose docking domain, dockering
CPATITSQGYKCCSSNNCDVYLTDESGRWGVENNDWCGISN

SEQ ID NO: 4573 - protein, 39 aa, Neocallimastix californiae
  Cellulose docking domain, dockering
CSAAILSQGYKCCSGGCSVVYTDGDGTWGVENGQWCGCA

SEQ ID NO: 4574 - protein, 34 aa, Neocallimastix californiae
  Cellulose docking domain, dockering
HENGYPYCKNTKIVVYTDDVEWGVENNEWCVIKD

SEQ ID NO: 4575 - protein, 37 aa, Neocallimastix californiae
  Cellulose docking domain, dockering
EDKNLGYPCCQNCYVIESDENGDYGIENGEWCSIPYS

SEQ ID NO: 4576 - protein, 37 aa, Neocallimastix californiae
  Cellulose docking domain, dockering
CKCWSEKLGYPCCVGNTVYTTDESGSWGLENDDWCGI

SEQ ID NO: 4577 - protein, 38 aa, Neocallimastix californiae
  Cellulose docking domain, dockering
ECFSLVLGFPCCSSCDSIYEDDDGKWGVENNNWCGIKN

SEQ ID NO: 4578 - protein, 39 aa, Neocallimastix californiae
  Cellulose docking domain, dockering
SCWSEEQGYQCCSGCDIVYEDNTGFWGVENNEWCGINSS

SEQ ID NO: 4579 - protein, 38 aa, Neocallimastix californiae
  Cellulose docking domain, dockering
CKFEAIGYPCCSHCNIVYTDDSGNWGIENDDWCGIRDN

SEQ ID NO: 4580 - protein, 35 aa, Neocallimastix californiae
  Cellulose docking domain, dockering
HPNYDCCNGCDVYYTDDEGEWGIQNNNWCFINDAN

SEQ ID NO: 4581 - protein, 39 aa, Neocallimastix californiae
  Cellulose docking domain, dockering
ECWAKALGYECCSSCQPSAFKDESGEWGIENNQWCGIIS

SEQ ID NO: 4582 - protein, 34 aa, Neocallimastix californiae
  Cellulose docking domain, dockering
CALGYECCKTTTTVIYTDESGKWGIENNEWCEIK

SEQ ID NO: 4583 - protein, 39 aa, Neocallimastix californiae
  Cellulose docking domain, dockering
SCWSLANGYDCCEGCEVAYTDADGKWGYENDEWCGIKED

SEQ ID NO: 4584 - protein, 33 aa, Neocallimastix californiae
  Cellulose docking domain, dockering
AQYSNCKNTCEIAYEDENKWGIENEDWCILPDS

SEQ ID NO: 4585 - protein, 38 aa, Neocallimastix californiae
  Cellulose docking domain, dockering
SCWASSLGYSCCKGCDIIITDSNGDWGVEDNEWCGILS

SEQ ID NO: 4586 - protein, 36 aa, Neocallimastix californiae
  Cellulose docking domain, dockering
AQGYPCCAYSCTAYEKDRDGEWSVENNDWCLINKAI

SEQ ID NO: 4587 - protein, 40 aa, Neocallimastix californiae
  Cellulose docking domain, dockering
SCFSKALGYNCCKSCSGVYYVDKDGEWGIENGQWCGMASS

SEQ ID NO: 4588 - protein, 37 aa, Neocallimastix californiae
  Cellulose docking domain, dockering
CPGEGTEYKCCSSCLDVYEEDENGPWAIEDEQWCSLP

SEQ ID NO: 4589 - protein, 32 aa, Neocallimastix californiae
  Cellulose docking domain, dockering
PYYPCCKTTTEIVSTDNSGDWGIENDEWCGIG

SEQ ID NO: 4590 - protein, 30 aa, Neocallimastix californiae
  Cellulose docking domain, dockering
YGYPCCSNCELTYQDETGKWGVEGEEWCGL

SEQ ID NO: 4591 - protein, 39 aa, Neocallimastix californiae
  Cellulose docking domain, dockering
SCWSLKYGYLCCNSDSTSVVKTNKYGNWGKENGKWCGIK

SEQ ID NO: 4592 - protein, 42 aa, Neocallimastix californiae
  Cellulose docking domain, dockering
KCPFKAIGYGCCKNSKTEIVFTDSFGNYGVEKGKRCGIIDDS

SEQ ID NO: 4593 - protein, 30 aa, Neocallimastix californiae
  Cellulose docking domain, dockering
EYRCCKECNVIFTDSEDWGIEDGDWCSIPY

SEQ ID NO: 4594 - protein, 40 aa, Neocallimastix californiae
  Cellulose docking domain, dockering
NCWSLSLGYKCCTLRTTEPNYYSKSAGKWYGIENDEWCGI

SEQ ID NO: 4595 - protein, 34 aa, Neocallimastix californiae
  Cellulose docking domain, dockering
RNTGYHCCLYTTEVETTDAVGQWGIEAGEWCLFE

SEQ ID NO: 4596 - protein, 37 aa, Neocallimastix californiae
  Cellulose docking domain, dockering
ECFSEKLGFPCCVETKEVVNVDENGQWGIENNNWCGI

SEQ ID NO: 4597 - protein, 43 aa, Neocallimastix californiae
  Cellulose docking domain, dockering
SCWSLPLGYNCCSSDNTEVYYTDDDGQWGVENGDWCGIMSDKC

SEQ ID NO: 4598 - protein, 40 aa, Neocallimastix californiae
  Cellulose docking domain, dockering
KCWSEPLGYECCDPKDNTYYYEDDDGYWGLVDGEWCGIIA

SEQ ID NO: 4599 - protein, 38 aa, Neocallimastix californiae
  Cellulose docking domain, dockering
SKPDYPCCSRCDIKVILDDGDNKQWGIENSNWCGLPDN

SEQ ID NO: 4600 - protein, 37 aa, Neocallimastix californiae
  Cellulose docking domain, dockering
ECWSLKLGYPCCKESIEVYTTDENGSWGVENEQWCGI

SEQ ID NO: 4601 - protein, 37 aa, Neocallimastix californiae
  Cellulose docking domain, dockering
ECFANKLGYPCCTQTNEIVSIDENGKWGLENGQICGI

SEQ ID NO: 4602 - protein, 40 aa, Neocallimastix californiae
  Cellulose docking domain, dockering
NCWSTALGYPCCSSANAEVYFTDESGDWGIENNTWCGIPN

SEQ ID NO: 4603 - protein, 40 aa, Neocallimastix californiae
  Cellulose docking domain, dockering
PCWAKELGYECCSTNSCRNAIYTDDDGEWDVENGNWCGIT

SEQ ID NO: 4604 - protein, 42 aa, Neocallimastix californiae
  Cellulose docking domain, dockering
PSSMLRQGYKCCEINNCNIYHKDGDGDWGLDRNLKWCGIRFE

SEQ ID NO: 4605 - protein, 38 aa, Neocallimastix californiae
  Cellulose docking domain, dockering
KKFNQMGYKCCNSCNAVYTDSTGRWGVENRQWCGIRND

SEQ ID NO: 4606 - protein, 40 aa, Neocallimastix californiae
  Cellulose docking domain, dockering
DCWSSPFGYDCCKLKKTQPYSYSNSAGHWYGIENGEWCGI

SEQ ID NO: 4607 - protein, 31 aa, Neocallimastix californiae
  Cellulose docking domain, dockering
GTGFNCCLFTTIVATTDSVGQWGVENGEWCL

SEQ ID NO: 4608 - protein, 31 aa, Neocallimastix californiae
  Cellulose docking domain, dockering
EYPCCKECNIYYTDSEDWGIEDGKWCSIPHS

SEQ ID NO: 4609 - protein, 40 aa, Neocallimastix californiae
  Cellulose docking domain, dockering
ATYLDKNYTCCSNDNIEIKSINMDGEWGLENNNWCGLRNS

SEQ ID NO: 4610 - protein, 32 aa, Neocallimastix californiae
  Cellulose docking domain, dockering
DYPCCNNNNIAVVITDDKGNWGIENGEWCGIL

SEQ ID NO: 4611 - protein, 34 aa, Neocallimastix californiae
  Cellulose docking domain, dockering
PDYPCCRNKKTDVVYTDDNGNWGIENENWCGIIR

SEQ ID NO: 4612 - protein, 40 aa, Neocallimastix californiae
  Cellulose docking domain, dockering
ECWSEKFGVSCCPEYTKINYSDGDGDWHYNYATGEWCGIR

SEQ ID NO: 4613 - protein, 39 aa, Neocallimastix californiae
  Cellulose docking domain, dockering
KCWAEKHGYECCLENHLDYVTDKYGKRWSEENGKKCGIA

SEQ ID NO: 4614 - protein, 37 aa, Neocallimastix californiae
  Cellulose docking domain, dockering
CWAEKFGFKCCKENHIDNVSDSDGDWAQENGDWCGLK

SEQ ID NO: 4615 - protein, 33 aa, Neocallimastix californiae
  Cellulose docking domain, dockering
DYSCCKDKNIDVIYTDNMGNWGIENGEWCGIIR

SEQ ID NO: 4616 - protein, 28 aa, Neocallimastix californiae
  Cellulose docking domain, dockering
KCWSTSLGYSCCKTCTDIILVDSNGKWG

SEQ ID NO: 4617 - protein, 38 aa, Neocallimastix californiae
  Cellulose docking domain, dockering
KCWSASLGYPCCENTTSVAVSDASGDWGVEQDQWCGII

SEQ ID NO: 4618 - protein, 38 aa, Neocallimastix californiae
  Cellulose docking domain, dockering
TCFSEKLGYPCCSIGYATVITDNDGLWSVENDDWCGVT

SEQ ID NO: 4619 - protein, 39 aa, Neocallimastix californiae
  Cellulose docking domain, dockering
DCFSSRLGFPCCSSSSAEVWYTDSDGKWGVENDGWCGIP

SEQ ID NO: 4620 - protein, 40 aa, Neocallimastix californiae
  Cellulose docking domain, dockering
QCWSEAQGYPCCKFTSDVVFTDNDGNWGVENGNWCGIQKK

SEQ ID NO: 4621 - protein, 39 aa, Neocallimastix californiae
  Cellulose docking domain, dockering
SCWSNSLGYNCCSDSNTQVYYEDQDGQWGIENNNWCGIS

SEQ ID NO: 4622 - protein, 39 aa, Neocallimastix californiae
  Cellulose docking domain, dockering
PCWSESLGYKCCSSCGQVYFTDENGRWSVENDDWCGLLA

SEQ ID NO: 4623 - protein, 37 aa, Neocallimastix californiae
  Cellulose docking domain, dockering
EKILKQGYKCCPANCQIVYADNDGTWGVDNNQWCGCG

SEQ ID NO: 4624 - protein, 40 aa, Neocallimastix californiae
  Cellulose docking domain, dockering
CSSSFTSQGYKCCSYCSTVYYTDDSGKWGIENGNWCGLPS

SEQ ID NO: 4625 - protein, 37 aa, Neocallimastix californiae
  Cellulose docking domain, dockering
NCFSVNLGYPCCNGNTVYYTDDDGKWGYENDNWCGIK

SEQ ID NO: 4626 - protein, 38 aa, Neocallimastix californiae
  Cellulose docking domain, dockering
ECTGRNQGYQCCNSCDVYYTDNDGRWGVENNAWCGIKN

SEQ ID NO: 4627 - protein, 41 aa, Neocallimastix californiae
  Cellulose docking domain, dockering
CSTKFTQQGYKCCSSCLPVMYTDESGKWGVENNNWCGLPSN

SEQ ID NO: 4628 - protein, 40 aa, Neocallimastix californiae
  Cellulose docking domain, dockering
CPAAITNQGYKCCSAKCNPVVYKDESGDWGVENNQWCGCP

SEQ ID NO: 4629 - protein, 39 aa, Neocallimastix californiae
  Cellulose docking domain, dockering
PTAITSQGYKCCRNKCNPVVYQDEAGDWGVENNQWCGCP

SEQ ID NO: 4630 - protein, 39 aa, Neocallimastix californiae; identical to SEQ ID NO: 4629
  Cellulose docking domain, dockering

SEQ ID NO: 4631 - protein, 40 aa, Neocallimastix californiae
  Cellulose docking domain, dockering
CNSKVTQQGYKCCSTCTATVYVDDAGKWGVENNDWCGIPT

SEQ ID NO: 4632 - protein, 39 aa, Neocallimastix californiae
  Cellulose docking domain, dockering
CNSKVTQQGYKCCSTCTETFYVDDAGKWGIENNDWCGIP

SEQ ID NO: 4633 - protein, 39 aa, Neocallimastix californiae
  Cellulose docking domain, dockering
PTAITSQGYKCCSAKCNPVVYQDEAGDWGVENNQWCGCP

SEQ ID NO: 4634 - protein, 39 aa, Neocallimastix californiae
  Cellulose docking domain, dockering
CWSEALGYNCCYGCISYYEDDDGKWGVENNQWCGILEST

SEQ ID NO: 4635 - protein, 31 aa, Neocallimastix californiae
  Cellulose docking domain, dockering
KYPCCESCDVVTTDQNGKWGIENGHWCSIKY

SEQ ID NO: 4636 - protein, 39 aa, Neocallimastix californiae
  Cellulose docking domain, dockering
KCWSKKFGIECCKHTKTVVRKTYDGPWGKENGKWCGIGK

SEQ ID NO: 4637 - protein, 42 aa, Neocallimastix californiae
  Cellulose docking domain, dockering
ECEAKEYGYPCCPAEFNTVKYHNELGDWGFDLEHSEWCSITT

SEQ ID NO: 4638 - protein, 37 aa, Neocallimastix californiae
  Cellulose docking domain, dockering
ECWSLKLGYSCCKESTKVYTTDESGSWGVENGQWCGI

SEQ ID NO: 4639 - protein, 37 aa, Neocallimastix californiae
  Cellulose docking domain, dockering
EPDYPCCSKCDIEVAFNEGEHKLWGIENSNWCGIPES

SEQ ID NO: 4640 - protein, 30 aa, Neocallimastix californiae
  Cellulose docking domain, dockering
EYECCSPGTKVEYTDEEALWGVENGNWCYI

SEQ ID NO: 4641 - protein, 30 aa, Neocallimastix californiae; identical to SEQ ID NO: 4640
  Cellulose docking domain, dockering

SEQ ID NO: 4642 - protein, 29 aa, Neocallimastix californiae
  Cellulose docking domain, dockering
EYECCSPGTKVEYTDEEALWGVENGNWCY

SEQ ID NO: 4643 - protein, 31 aa, Neocallimastix californiae
  Cellulose docking domain, dockering
NKFKCCSPGTKVEYTDEEALWGVENGNWCYI

SEQ ID NO: 4644 - protein, 39 aa, Neocallimastix californiae
  Cellulose docking domain, dockering
ECWAEEFGYECCLFSSMVSYVDDKGRYWDFQNGNWCGVT

SEQ ID NO: 4645 - protein, 40 aa, Neocallimastix californiae
  Cellulose docking domain, dockering
KCRSEVKGYPCCPPEITEIYMVDTDGDWGFDEKTNNWCGF

SEQ ID NO: 4646 - protein, 44 aa, Neocallimastix californiae
  Cellulose docking domain, dockering
TCWSEKYGYPCCKDPNTLLVSPQSKSNPDHEWYGVENNEWCGIA

SEQ ID NO: 4647 - protein, 33 aa, Neocallimastix californiae
  Cellulose docking domain, dockering
NDQYKCCQHCKVVYTDSQKWGIEDNEWCHIPYT

SEQ ID NO: 4648 - protein, 36 aa, Neocallimastix californiae
  Cellulose docking domain, dockering
KNTGYPCCSNPDAQVYTTDSSGDWSIEGDFWCLVEK

SEQ ID NO: 4649 - protein, 37 aa, Neocallimastix californiae; identical to SEQ ID NO: 2101
  Cellulose docking domain, dockering

SEQ ID NO: 4650 - protein, 31 aa, Neocallimastix californiae
  Cellulose docking domain, dockering
YPCCADCNVVAETEDGEWGVENGQWCGIKET

SEQ ID NO: 4651 - protein, 32 aa, Neocallimastix californiae
  Cellulose docking domain, dockering
KYHVCKNCSVAAYQNDIYWGFENNQWCEISSE

SEQ ID NO: 4652 - protein, 38 aa, Neocallimastix californiae
  Cellulose docking domain, dockering
SCLDKYGYRCCSTCTISYTDDTGNWGVENDEWCIVEDS

SEQ ID NO: 4653 - protein, 39 aa, Neocallimastix californiae
  Cellulose docking domain, dockering
ECWATSLGYSCCSEGADIILEDENGKWGLENDDWCGIIE

SEQ ID NO: 4654 - protein, 40 aa, Neocallimastix californiae
  Cellulose docking domain, dockering
DCWSKSLGYSCCTSCEISYEDTDGKWGYENDDWCGIVENK

SEQ ID NO: 4655 - protein, 40 aa, Neocallimastix californiae
  Cellulose docking domain, dockering
ACWSEAYGYPCCSSASTKVIYTDSDGEWGVENGNWCGISK

SEQ ID NO: 4656 - protein, 39 aa, Neocallimastix californiae
  Cellulose docking domain, dockering
GCFSDTLGYPCCTSTTNVIYTDSYGRWGIENSNWCILDD

SEQ ID NO: 4657 - protein, 39 aa, Neocallimastix californiae
  Cellulose docking domain, dockering
SCFSLALGYNCCKHTTEVISVDNDGSWGIENNEWCGIGN

SEQ ID NO: 4658 - protein, 38 aa, Neocallimastix californiae
  Cellulose docking domain, dockering
GCFSEALGYPCCSDGVAVVYTDNDGPWGVENNDWCGIS

SEQ ID NO: 4659 - protein, 40 aa, Neocallimastix californiae
  Cellulose docking domain, dockering
SCWSSALGYPCCSSSNVPIIETDGDGQWGIENDEWCGVPK

SEQ ID NO: 4660 - protein, 40 aa, Neocallimastix californiae
  Cellulose docking domain, dockering
CSSLAQNTNYPYCKYSTAVYYVDEDGQWSVENNEWCLIQS

SEQ ID NO: 4661 - protein, 31 aa, Neocallimastix californiae
  Cellulose docking domain, dockering
MYKCCKSCNIVLDDGDKWGVENGEWCSITNE

SEQ ID NO: 4662 - protein, 39 aa, Neocallimastix californiae
  Cellulose docking domain, dockering
KCWAEAYGYPCCSKCLPVIDTTNDKEWALENGNWCGLPS

SEQ ID NO: 4663 - protein, 41 aa, Neocallimastix californiae
  Cellulose docking domain, dockering
NCWSEALGYPCCPSGITTVYEHDEDGDWSYNFSKEEWCGII

SEQ ID NO: 4664 - protein, 41 aa, Neocallimastix californiae
  Cellulose docking domain, dockering
HCLSEFYGYPCCSPELTEVYAQDDYGDWGYDFSKSEWCGLT

SEQ ID NO: 4665 - protein, 40 aa, Neocallimastix californiae
  Cellulose docking domain, dockering
DCWSKSLGYDCCKEGTSVAYTDDSGKWGVVGDQWCGIIES

SEQ ID NO: 4666 - protein, 31 aa, Neocallimastix californiae
  Cellulose docking domain, dockering
YPCCKTCTSVYEDDDGKWGVENDDWCLIKSS

SEQ ID NO: 4667 - protein, 35 aa, Neocallimastix californiae
  Cellulose docking domain, dockering
QSGYPCCKSCDVVDTDDDGQWGVENNDWCSIDTEK

SEQ ID NO: 4668 - protein, 41 aa, Neocallimastix californiae
  Cellulose docking domain, dockering
TCWVSVYGYPCCEGKIKEHVYATDNDGKWGYDFSKKIWCGI

SEQ ID NO: 4669 - protein, 38 aa, Neocallimastix californiae
  Cellulose docking domain, dockering
DCWSLEQGYNCCVGCTTFLTTDEGNWGIENAEWCGIPS

SEQ ID NO: 4670 - protein, 37 aa, Neocallimastix californiae
  Cellulose docking domain, dockering
CRCWAEKLGYNCCTSKEVYFEDEDGKWGVENDDWCGI

SEQ ID NO: 4671 - protein, 32 aa, Neocallimastix californiae
  Cellulose docking domain, dockering
KYNYPYCKTTSSVVYTDDFEWGIENDDWCIIK

SEQ ID NO: 4672 - protein, 40 aa, Neocallimastix californiae
  Cellulose docking domain, dockering
ECWSKKLGWPCCSEGNVDIYYTDEDGDWGVENNDWCGMEK

SEQ ID NO: 4673 - protein, 39 aa, Neocallimastix californiae
  Cellulose docking domain, dockering
SCWSEKFNIPCCKSTTSVERSTYNGDFGKENGQWCGLGE

SEQ ID NO: 4674 - protein, 40 aa, Neocallimastix californiae
  Cellulose docking domain, dockering
TCWSEILGYSCCHTTCTSVEDDADGSWGIEGNEWCGIPKN

SEQ ID NO: 4675 - protein, 36 aa, Neocallimastix californiae
  Cellulose docking domain, dockering
ALGYPCCTYQCSILYTDEDGDWSVENDDWCLIDKSI

SEQ ID NO: 4676 - protein, 40 aa, Neocallimastix californiae
  Cellulose docking domain, dockering
KCWAESLGYPCCSGKNPKVYAHDNDGDWGYNFATGEWCGI

SEQ ID NO: 4677 - protein, 37 aa, Neocallimastix californiae
  Cellulose docking domain, dockering
ACWSESLGYSCCHGCTIYETDDDGSWGYENDSWCGIQ

SEQ ID NO: 4678 - protein, 38 aa, Neocallimastix californiae
  Cellulose docking domain, dockering
GCWASKIGYPCCKKKNGKIYKVNSYGSWGIEKSNWCGM

SEQ ID NO: 4679 - protein, 39 aa, Neocallimastix californiae
  Cellulose docking domain, dockering
KCWSEELGFLCCKESKTKVKLEDINGKWGKEKGRWCGII

SEQ ID NO: 4680 - protein, 37 aa, Neocallimastix californiae
  Cellulose docking domain, dockering
CHHDVYDCCTGCKPIVADDEGLWGAENGDWCLIDSEK

SEQ ID NO: 4681 - protein, 31 aa, Neocallimastix californiae
  Cellulose docking domain, dockering
PNYKVCKGCEVVVTDIEGAWGAENGEWCYID

SEQ ID NO: 4682 - protein, 40 aa, Neocallimastix californiae; identical to SEQ ID NO: 4554
  Cellulose docking domain, dockering

SEQ ID NO: 4683 - protein, 40 aa, Neocallimastix californiae; identical to SEQ ID NO: 4553
  Cellulose docking domain, dockering

SEQ ID NO: 4684 - protein, 33 aa, Neocallimastix californiae
  Cellulose docking domain, dockering
KTAYPCCSHCNVSISEEYIRWGIENGDWCMINF

SEQ ID NO: 4685 - protein, 41 aa, Neocallimastix californiae
  Cellulose docking domain, dockering
KCWSKALGYECCDSCNVVFIDDKKQKWGSMNKQWCGIDKVK

SEQ ID NO: 4686 - protein, 39 aa, Neocallimastix californiae
  Cellulose docking domain, dockering
SCWSSSLGYSCCKSTNEVKYTAINGSFGYENDSWCGINK

SEQ ID NO: 4687 - protein, 40 aa, Neocallimastix californiae
  Cellulose docking domain, dockering
SCWSVSLGYPCCSEDNQGIYLIDENGSWGLENNDWCGIID

SEQ ID NO: 4688 - protein, 38 aa, Neocallimastix californiae
  Cellulose docking domain, dockering
LKESKKFPCCSSNNVKVAGKDMDGSWGYENGVKCGIRS

SEQ ID NO: 4689 - protein, 38 aa, Neocallimastix californiae
  Cellulose docking domain, dockering
KCWTLSDGYPCCESLASKVEGENDEWGYENGGWCGLTK

SEQ ID NO: 4690 - protein, 36 aa, Neocallimastix californiae
  Cellulose docking domain, dockering
KCFSEALGYPCCTNNSPIYYVDNDGNWGVQNNNWCG

SEQ ID NO: 4691 - protein, 38 aa, Neocallimastix californiae
  Cellulose docking domain, dockering
SCWSTALGYPCCSSGTVVTYTDNDGDWGINNNNWCGII

SEQ ID NO: 4692 - protein, 40 aa, Neocallimastix californiae
  Cellulose docking domain, dockering
NCMAELLGYICCPTTITIVYDHDEYGDWGYDFAKKEWCGL

SEQ ID NO: 4693 - protein, 37 aa, Neocallimastix californiae
  Cellulose docking domain, dockering
TCWSKKLGYPCCNGCKIYESDLDGLWGYEKHQWCGIQ

SEQ ID NO: 4694 - protein, 40 aa, Neocallimastix californiae; identical to SEQ ID NO: 4692
  Cellulose docking domain, dockering

SEQ ID NO: 4695 - protein, 37 aa, Neocallimastix californiae; identical to SEQ ID NO: 4693
  Cellulose docking domain, dockering

SEQ ID NO: 4696 - protein, 37 aa, Neocallimastix californiae
  Cellulose docking domain, dockering
CWSESVGYPCCTGCEVVEVEDDKKWGVESNEWCGIPT

SEQ ID NO: 4697 - protein, 41 aa, Neocallimastix californiae
  Cellulose docking domain, dockering
QCMAELAGYTCCPPEIDTVYFQDEYGDWGVNPENNNWCGIT

SEQ ID NO: 4698 - protein, 40 aa, Neocallimastix californiae
  Cellulose docking domain, dockering
NCWANKLSYRCCSTSDADVVFKDGSGEWAIENGDWCGIIK

SEQ ID NO: 4699 - protein, 39 aa, Neocallimastix californiae
  Cellulose docking domain, dockering
GCWANDIKYECCESNDGEVYFIDDDGKWGIENGSWCGII

SEQ ID NO: 4700 - protein, 35 aa, Neocallimastix californiae
  Cellulose docking domain, dockering
QGYSCCKSSCNVYEEDSDGKWSIENDEWCLIDDSK

SEQ ID NO: 4701 - protein, 35 aa, Neocallimastix californiae; identical to SEQ ID NO: 4700
  Cellulose docking domain, dockering

SEQ ID NO: 4702 - protein, 36 aa, Neocallimastix californiae
  Cellulose docking domain, dockering
YKENGYGSCSLQTKIIAVDNDGIWGIENNKWCAILS

SEQ ID NO: 4703 - protein, 37 aa, Neocallimastix californiae; identical to SEQ ID NO: 2157
  Cellulose docking domain, dockering

SEQ ID NO: 4704 - protein, 33 aa, Neocallimastix californiae
  Cellulose docking domain, dockering
KEYPCCEGCKTAYRDNNGKWGYENNNWCSIKYS

SEQ ID NO: 4705 - protein, 41 aa, Neocallimastix californiae
  Cellulose docking domain, dockering
ECWSDVLGYSCCKKNCYVYYTDKDGKWGVEDNQWCGIIESV

SEQ ID NO: 4706 - protein, 41 aa, Neocallimastix californiae
  Cellulose docking domain, dockering
TCWSVKYGYSCCETSCNVYETDAAGDWGYEDHHWCGINKEK

SEQ ID NO: 4707 - protein, 40 aa, Neocallimastix californiae
  Cellulose docking domain, dockering
DCWSEKLGYSCCQTSCHVYETDEDGEWGYEEGHWCGIPST

SEQ ID NO: 4708 - protein, 38 aa, Neocallimastix californiae
  Cellulose docking domain, dockering
ACWSTAQGYPCCSECQDPIYEDDDGKWGVEDNDWCGIS

SEQ ID NO: 4709 - protein, 40 aa, Neocallimastix californiae
  Cellulose docking domain, dockering
KCIAETLGYHCCSSDNTTVYAHDSNGDWGFDFEKKEWCGI

SEQ ID NO: 4710 - protein, 38 aa, Neocallimastix californiae
  Cellulose docking domain, dockering
SCWSEILGYLCCSECIKVVEVDSNGKWGIENNHWCGIP

SEQ ID NO: 4711 - protein, 39 aa, Neocallimastix californiae
  Cellulose docking domain, dockering
NCWAASEGYKCCKAGTAVVLTDSKGKWGIENNQWCGIVQ

SEQ ID NO: 4712 - protein, 40 aa, Neocallimastix californiae
  Cellulose docking domain, dockering
TCWAASQGYKCCNSCQPVYTDGSRRWGVENNQWCGIIESK

SEQ ID NO: 4713 - protein, 37 aa, Neocallimastix californiae
  Cellulose docking domain, dockering
HATKLGYKCCKSCTIYLNDSTGKWGVENNQWCGIDTS

SEQ ID NO: 4714 - protein, 39 aa, Neocallimastix californiae
  Cellulose docking domain, dockering
SCFSLKLGYPCCSNASTPSVYEDSDGKWGVENGNWCGIP

SEQ ID NO: 4715 - protein, 37 aa, Neocallimastix californiae
  Cellulose docking domain, dockering
CWSEKLGYPCCTSTSVSVFEDNDGKWGIENGNWCGII

SEQ ID NO: 4716 - protein, 40 aa, Neocallimastix californiae
  Cellulose docking domain, dockering
QCYAELLNYPCCSSSITEVFAHDNLGDWGYDFEKKTWCGL

SEQ ID NO: 4717 - protein, 36 aa, Neocallimastix californiae
  Cellulose docking domain, dockering
CWSEKFGYSCCKKCVVYETDNNGKWGYENNHWCGIP

SEQ ID NO: 4718 - protein, 36 aa, Neocallimastix californiae
  Cellulose docking domain, dockering
HCFSESLGYPCCTNNSKVYYTDKHGSWGLQDNEWCG

SEQ ID NO: 4719 - protein, 38 aa, Neocallimastix californiae
  Cellulose docking domain, dockering
YCFSEALGYPCCTNNSRVYFIGESGSWGIQDDQWCGII

SEQ ID NO: 4720 - protein, 39 aa, Neocallimastix californiae
  Cellulose docking domain, dockering
QCWSLKLGYSCCPTGTKVYSTDSDGDWGVHNHKWCGIIK

SEQ ID NO: 4721 - protein, 38 aa, Neocallimastix californiae
  Cellulose docking domain, dockering
CKAAIKGYSCCSQCKVKYTDNDGDWGVENNQWCSIPYT

SEQ ID NO: 4722 - protein, 38 aa, Neocallimastix californiae
  Cellulose docking domain, dockering
DCFSQALGYPCCSNPNTSVKATDKDGEWGIENNAWCGI

SEQ ID NO: 4723 - protein, 38 aa, Neocallimastix californiae
  Cellulose docking domain, dockering
ACWSENLGYKCCSSANAPIVYTDSDGNWGVENGNWCGI

SEQ ID NO: 4724 - protein, 38 aa, Neocallimastix californiae
  Cellulose docking domain, dockering
TCWAEKLGYSCCTSTSQVVYTDGDGNWGVENGNWCGII

SEQ ID NO: 4725 - protein, 38 aa, Neocallimastix californiae
  Cellulose docking domain, dockering
TCWAEKLGYSCCTSTSQVVYTDGDGNWGVENGNWCGIT

SEQ ID NO: 4726 - protein, 38 aa, Neocallimastix californiae
  Cellulose docking domain, dockering
ACWSQSLGYSCCTNASTPVVYSDNDGDWGVENGNWCGI

SEQ ID NO: 4727 - protein, 37 aa, Neocallimastix californiae
  Cellulose docking domain, dockering
TCWSKKLGYPCCKGCKLYSTDDDGSWGYESNQWCGIQ

SEQ ID NO: 4728 - protein, 41 aa, Neocallimastix californiae
  Cellulose docking domain, dockering
SCWSELIGYPCCSSENTTVYQQDEYGDWGYDFTKQEWCGIS

SEQ ID NO: 4729 - protein, 42 aa, Neocallimastix californiae
  Cellulose docking domain, dockering
DCWAENLGYSCCSPENTYIYSSDENGDWGFDFENQQWCGIIS

SEQ ID NO: 4730 - protein, 39 aa, Neocallimastix californiae
  Cellulose docking domain, dockering
SCWAKKLGYKCCTAKCPGEYYIDEYGSWGVENNDWCGIN

SEQ ID NO: 4731 - protein, 39 aa, Neocallimastix californiae
  Cellulose docking domain, dockering
SCWSEKLGYKCCKTSYPVYFTDSDGQWGVENGNWCGIVH

SEQ ID NO: 4732 - protein, 32 aa, Neocallimastix californiae
  Cellulose docking domain, dockering
EYPCCKGCNVVEEDASGKWGIENNYWCAIKDS

SEQ ID NO: 4733 - protein, 33 aa, Neocallimastix californiae
  Cellulose docking domain, dockering
NAYSNCYGCQVVTEEDGYKWGVENNDWCIINGN

SEQ ID NO: 4734 - protein, 39 aa, Neocallimastix californiae
  Cellulose docking domain, dockering
ECFSVHLGFPCCQNTQEIIYSDNDGDWGVENNSWCGIKN

SEQ ID NO: 4735 - protein, 34 aa, Neocallimastix californiae
  Cellulose docking domain, dockering
YLDYPCCSSCNVILVEDDGSRWGVQDNNWCSIKN

SEQ ID NO: 4736 - protein, 36 aa, Neocallimastix californiae
  Cellulose docking domain, dockering
WSEPDYPCCKNTCNVILNDGSEWGSENGEWCGIPSS

SEQ ID NO: 4737 - protein, 39 aa, Neocallimastix californiae
  Cellulose docking domain, dockering
KCWSEPLGYPCCSECGYSYYSDSDGEWGVENDDWCGLLP

SEQ ID NO: 4738 - protein, 39 aa, Neocallimastix californiae
  Cellulose docking domain, dockering
GCWTEELGYPCCQTCQISQFKDESGDWGYENDDWCGIID

SEQ ID NO: 4739 - protein, 34 aa, Neocallimastix californiae
  Cellulose docking domain, dockering
CAQGYPCCQSTTSVIYTENNVKWGIENDNWCEIK

SEQ ID NO: 4740 - protein, 42 aa, Neocallimastix californiae
  Cellulose docking domain, dockering
ACWSEKLGYPCCPSDRCHVLVTDESGSWGVYQNEWCGIDTNV

SEQ ID NO: 4741 - protein, 41 aa, Neocallimastix californiae
  Cellulose docking domain, dockering
DCWSTPLGYQCCPSGCKAEVYETDDNGKWGYENGKWCGVPK

SEQ ID NO: 4742 - protein, 33 aa, Neocallimastix californiae
  Cellulose docking domain, dockering
RNSGYNCCLFSTSVITTDNVGKWGIENDEWCLF

SEQ ID NO: 4743 - protein, 40 aa, Neocallimastix californiae
  Cellulose docking domain, dockering
SCWSTKLGYKCCTLRTTKPIYYSKSADKWYGVENDEWCGI

SEQ ID NO: 4744 - protein, 31 aa, Neocallimastix californiae
  Cellulose docking domain, dockering
QYNCCEECNVVYTDSEDWGIENGKWCSIPYS

SEQ ID NO: 4745 - protein, 33 aa, Neocallimastix californiae
  Cellulose docking domain, dockering
RNSGYNCCLFSTSVITTDKVGQWGIENDEWCLF

SEQ ID NO: 4746 - protein, 31 aa, Neocallimastix californiae
  Cellulose docking domain, dockering
QYNCCKECNVVYTDSEDWGIEDGKWCSIPHS

SEQ ID NO: 4747 - protein, 40 aa, Neocallimastix californiae
  Cellulose docking domain, dockering
SCWSTKLGYKCCTLRTTKPTYYSKSADKWYGVENDEWCGI

SEQ ID NO: 4748 - protein, 30 aa, Neocallimastix californiae
  Cellulose docking domain, dockering
YPCCESCEIFYTDTEDWGIENGNWCSIPHS

SEQ ID NO: 4749 - protein, 40 aa, Neocallimastix californiae
  Cellulose docking domain, dockering
SCWSTKFGYKCCTLRTTEPSTFSESDGKWYGIENGKKCGI

SEQ ID NO: 4750 - protein, 33 aa, Neocallimastix californiae
  Cellulose docking domain, dockering
RNSGYNCCLFTTTVETTDSVGDWGIENGDWCLF

SEQ ID NO: 4751 - protein, 38 aa, Neocallimastix californiae
  Cellulose docking domain, dockering
ECWSEKLGYPCCTSGAQVYYTDADGQWGVENNNWCGII

SEQ ID NO: 4752 - protein, 40 aa, Neocallimastix californiae
  Cellulose docking domain, dockering
DCFATKLGYPCCTTTTEVVFTDNDGKWGVENNNWCGMADE

SEQ ID NO: 4753 - protein, 39 aa, Neocallimastix californiae
  Cellulose docking domain, dockering
ECWSERLGYPCCKSSTEVFFEDSDGQWSVENDDWCGIQK

SEQ ID NO: 4754 - protein, 39 aa, Neocallimastix californiae
  Cellulose docking domain, dockering
NCWSKALGYPCCTSTNDVIYKDNDGEWGIENDDWCGITK

SEQ ID NO: 4755 - protein, 37 aa, Neocallimastix californiae
  Cellulose docking domain, dockering
DCFSTRLGYPCCSGNTVAYTDNDGDWGVENGNWCGIG

SEQ ID NO: 4756 - protein, 39 aa, Neocallimastix californiae
  Cellulose docking domain, dockering
SCWSTALGYPCCSSSSAEVWYTDNDGAWGVENGDWCGIP

SEQ ID NO: 4757 - protein, 21 aa, Neocallimastix californiae
  Cellulose docking domain, dockering
VWYTDNDGAWGVENGDWCGIP

SEQ ID NO: 4758 - protein, 40 aa, Neocallimastix californiae
  Cellulose docking domain, dockering
KCISEVLGYPCCPPEITEVYVTDINGDWAYDYEKQVWCGL

SEQ ID NO: 4759 - protein, 37 aa, Neocallimastix californiae
  Cellulose docking domain, dockering
ECWSESLNYPCCDNCVVYEVDDNGKWGYDFQTQTWCG

SEQ ID NO: 4760 - protein, 37 aa, Neocallimastix californiae; identical to SEQ ID NO: 4298
  Cellulose docking domain, dockering

SEQ ID NO: 4761 - protein, 39 aa, Neocallimastix californiae; identical to SEQ ID NO: 4072
  Cellulose docking domain, dockering

SEQ ID NO: 4762 - protein, 39 aa, Neocallimastix californiae
  Cellulose docking domain, dockering
ECWSEALGYPCCSECINAYAEDADGKWGIENDNWCGLLS

SEQ ID NO: 4763 - protein, 35 aa, Neocallimastix californiae
  Cellulose docking domain, dockering
MKLGYRCCSSCEIKYIDNNIKYGYEDGEWCGIPDE

SEQ ID NO: 4764 - protein, 37 aa, Neocallimastix californiae
  Cellulose docking domain, dockering
ATRFGFPCCEKCILQYVDDFGNWGFENDNWCGISPNI

SEQ ID NO: 4765 - protein, 34 aa, Neocallimastix californiae
  Cellulose docking domain, dockering
EVKGYECCEGCTVEYEENNIKWGYENRNWCVIPY

SEQ ID NO: 4766 - protein, 32 aa, Neocallimastix californiae
  Cellulose docking domain, dockering
EYSCCEKCKVRYSDKHGDWGIENKEWCSIKYT

SEQ ID NO: 4767 - protein, 41 aa, Neocallimastix californiae
  Cellulose docking domain, dockering
DCWSEILGYSCCKKTCKTKYSDKHGNWGVENKQWCGIIDEK

SEQ ID NO: 4768 - protein, 41 aa, Neocallimastix californiae
  Cellulose docking domain, dockering
DCWSEILGYSCCKETCKTKYTDKHGNWGVENKQWCGIIDEK

SEQ ID NO: 4769 - protein, 29 aa, Neocallimastix californiae
  Cellulose docking domain, dockering
ECWSEVLGYPCCKSCTVYDTDSDGQWGYE

SEQ ID NO: 4770 - protein, 40 aa, Neocallimastix californiae
  Cellulose docking domain, dockering
NCWVEQFGYPCCSSRNKIVYAHDGEGDWGYDFSKMEWCGI

SEQ ID NO: 4771 - protein, 39 aa, Neocallimastix californiae; identical to SEQ ID NO: 4001
  Cellulose docking domain, dockering

SEQ ID NO: 4772 - protein, 37 aa, Neocallimastix californiae
  Cellulose docking domain, dockering
DCFSTRLGYPCCSGNDVVYIDNDGKWGVENGNWCGIA

SEQ ID NO: 4773 - protein, 40 aa, Neocallimastix californiae
  Cellulose docking domain, dockering
ECWSQRLGYNCCTTSCYIYEKDQDGNWGYENNEWCGIPSS

SEQ ID NO: 4774 - protein, 37 aa, Neocallimastix californiae; identical to SEQ ID NO: 2229
  Cellulose docking domain, dockering

SEQ ID NO: 4775 - protein, 35 aa, Neocallimastix californiae
  Cellulose docking domain, dockering
HGIYKCCSSSDAEVWYVDDDGNWGVENGEWCFIDT

SEQ ID NO: 4776 - protein, 38 aa, Neocallimastix californiae
  Cellulose docking domain, dockering
CWSRKLGYRCCSADNTEVIVIDKDGKWGVEDQEWCGII

SEQ ID NO: 4777 - protein, 38 aa, Neocallimastix californiae
  Cellulose docking domain, dockering
QCWSEPLGYPCCQKCSIIETNESGSWGFELNQWCGIPT

SEQ ID NO: 4778 - protein, 39 aa, Neocallimastix californiae
  Cellulose docking domain, dockering
KCLSEIIGYSCCPLGYENIYHDNYGDWGYDFENDTWCGL

SEQ ID NO: 4779 - protein, 30 aa, Neocallimastix californiae
  Cellulose docking domain, dockering
YPCCKTCEVVYTDTEDWGIEDANWCSIPHS

SEQ ID NO: 4780 - protein, 34 aa, Neocallimastix californiae
  Cellulose docking domain, dockering
RNSGYNCCLFTTKVETSDTVGDWGIENNEWCLFE

SEQ ID NO: 4781 - protein, 40 aa, Neocallimastix californiae
  Cellulose docking domain, dockering
ACWSTKLGYKCCTLRTTEPIHYSKSADKWYGVENDEWCGI

SEQ ID NO: 4782 - protein, 38 aa, Neocallimastix californiae
  Cellulose docking domain, dockering
SCWSTSLGFPCCSGNSIVYFTDSNGQWGIENDQWCGKP

SEQ ID NO: 4783 - protein, 40 aa, Neocallimastix californiae
  Cellulose docking domain, dockering
NCWSSKYGYKCCSTSTCRNSVFADTDGQWDVENGQWCGIS

SEQ ID NO: 4784 - protein, 39 aa, Neocallimastix californiae
  Cellulose docking domain, dockering
CIGAQGYPCCKTTCSVFSTDSDGKWGIENDNWCLIDSSK

SEQ ID NO: 4785 - protein, 41 aa, Neocallimastix californiae
  Cellulose docking domain, dockering
TCWSTSLGYPCCKSCNTSAVFEDNDGKWGIENDDWCGIPKS

SEQ ID NO: 4786 - protein, 37 aa, Neocallimastix californiae
  Cellulose docking domain, dockering
GCWSERFNIPCCKSTNTVVRSTYDGEWGMENGEWCGL

SEQ ID NO: 4787 - protein, 40 aa, Neocallimastix californiae
  Cellulose docking domain, dockering
CSSKITAQGYKCCSDPNCVVYYTDADGTWGVENGQWCGCG

SEQ ID NO: 4788 - protein, 37 aa, Neocallimastix californiae
  Cellulose docking domain, dockering
SQKIIAQGYKCCADSNCTVYYTDADGTWGVENGEWCG

SEQ ID NO: 4789 - protein, 39 aa, Neocallimastix californiae
  Cellulose docking domain, dockering
ECAFEKIGYKCCESTTDVVFEDGSGTWGVENNEWCGITN

SEQ ID NO: 4790 - protein, 33 aa, Neocallimastix californiae
  Cellulose docking domain, dockering
SSGYPYCKSTTEVIYTDDVNWGVENGDWCVIKT

SEQ ID NO: 4791 - protein, 38 aa, Neocallimastix californiae
  Cellulose docking domain, dockering
CTCWAQAQGYQCCTSTSEVVFTDESGDWGVENGEWCGI

SEQ ID NO: 4792 - protein, 35 aa, Neocallimastix californiae
  Cellulose docking domain, dockering
SCYGYKCCERCEVEYSDDTGSWGVENGDWCGIPDS

SEQ ID NO: 4793 - protein, 33 aa, Neocallimastix californiae; identical to SEQ ID NO: 4790
  Cellulose docking domain, dockering

SEQ ID NO: 4794 - protein, 38 aa, Neocallimastix californiae; identical to SEQ ID NO: 4791
  Cellulose docking domain, dockering

SEQ ID NO: 4795 - protein, 35 aa, Neocallimastix californiae; identical to SEQ ID NO: 4792
  Cellulose docking domain, dockering

SEQ ID NO: 4796 - protein, 39 aa, Neocallimastix californiae
  Cellulose docking domain, dockering
TCWSVKLGYPCCEVSNAIYSVDDNGSWGVEDDFWCGIVE

SEQ ID NO: 4797 - protein, 35 aa, Neocallimastix californiae
  Cellulose docking domain, dockering
EPDYPCCKLSSTRVEYTDASGSWGIENGNWCGIVK

SEQ ID NO: 4798 - protein, 38 aa, Neocallimastix californiae
  Cellulose docking domain, dockering
TCWAEALGYSCCPSGTPVSYTDASGDWGYVNDWCGIVK

SEQ ID NO: 4799 - protein, 42 aa, Neocallimastix californiae
  Cellulose docking domain, dockering
ACWSDSLGYPCCSSADIQVVSEDSSGKWGIENNNWCGIPKET

SEQ ID NO: 4800 - protein, 31 aa, Neocallimastix californiae
  Cellulose docking domain, dockering
YNCCKGCDVIEESDEGKWGIENGYWCGIKDS

SEQ ID NO: 4801 - protein, 33 aa, Neocallimastix californiae
  Cellulose docking domain, dockering
RAYDECKACNVVYVEGDEKWGVENNDWCIIPSK

SEQ ID NO: 4802 - protein, 33 aa, Neocallimastix californiae
  Cellulose docking domain, dockering
ASKYKCCDSCKVSVDDGNKWGILNGEWCSITYD

SEQ ID NO: 4803 - protein, 38 aa, Neocallimastix californiae
  Cellulose docking domain, dockering
QCWAEAYGYSCCTKCVSVVDISNNRKWGIENNRWCGIP

SEQ ID NO: 4804 - protein, 40 aa, Neocallimastix californiae
  Cellulose docking domain, dockering
CPSAITAQGYKCCSSCGTVYYTDGDGEWGVENGDWCGMPT

SEQ ID NO: 4805 - protein, 37 aa, Neocallimastix californiae
  Cellulose docking domain, dockering
CSASIIAQGYKCCSANCEVVYTDNDGDWGVENNEWCG

SEQ ID NO: 4806 - protein, 37 aa, Neocallimastix californiae
  Cellulose docking domain, dockering
SCWSTQLGYKCCTKTNFIVYTDKDGYWGVENKQWCGI

SEQ ID NO: 4807 - protein, 38 aa, Neocallimastix californiae
  Cellulose docking domain, dockering
SCWSSSLSYGCCSGCKVLYTDKDGKWGIENGDWCGIPK

SEQ ID NO: 4808 - protein, 38 aa, Neocallimastix californiae
  Cellulose docking domain, dockering
ECPGKKYGYPCCESCDVFLEDESGIWGAENGQWCSIKT

SEQ ID NO: 4809 - protein, 39 aa, Neocallimastix californiae
  Cellulose docking domain, dockering
ECWSEAFGYKCCSAGCNSVVVVIDESGYWSAENGEWCGI

SEQ ID NO: 4810 - protein, 41 aa, Neocallimastix californiae
  Cellulose docking domain, dockering
SPAFQSQGYQCCSNNNCNIVYQDGTGNWGVENNQWCGLSYN

SEQ ID NO: 4811 - protein, 34 aa, Neocallimastix californiae
  Cellulose docking domain, dockering
PQYPCCSGCDVIYTDTDGEWGVENYDWCFIDSNR

SEQ ID NO: 4812 - protein, 40 aa, Neocallimastix californiae
  Cellulose docking domain, dockering
CSSTIKSQGYACCRSCDIIYSDESGDWGIENSYWCGISNS

SEQ ID NO: 4813 - protein, 39 aa, Neocallimastix californiae
  Cellulose docking domain, dockering
CSANIKKQGYSCCSSCIIYFTDNDGKWGVENGKWCGIQE

SEQ ID NO: 4814 - protein, 40 aa, Neocallimastix californiae; identical to SEQ ID NO: 4812
  Cellulose docking domain, dockering

SEQ ID NO: 4815 - protein, 39 aa, Neocallimastix californiae; identical to SEQ ID NO: 4813
  Cellulose docking domain, dockering

SEQ ID NO: 4816 - protein, 40 aa, Neocallimastix californiae
  Cellulose docking domain, dockering
SCKFTQLGYPCCDNPKTVSVYTDESGDWGIENGDWCGIDL

SEQ ID NO: 4817 - protein, 38 aa, Neocallimastix californiae
  Cellulose docking domain, dockering
SCTGMNLGYPCCDDCNVVYTDHDGKWGVQNDDWCGIKS

SEQ ID NO: 4818 - protein, 37 aa, Neocallimastix californiae
  Cellulose docking domain, dockering
CWSAKFGYPCCKETTVVEAVDENGRWGLENGGRCGFI

SEQ ID NO: 4819 - protein, 40 aa, Neocallimastix californiae
  Cellulose docking domain, dockering
KCHFLDINYKCCTTTMTSSYEDIDGLWGNETNGEWCGIEE

SEQ ID NO: 4820 - protein, 39 aa, Neocallimastix californiae
  Cellulose docking domain, dockering
TCWSEPLGYPCCTGIIETEYTDKDGEWGLQNGDWCGITD

SEQ ID NO: 4821 - protein, 36 aa, Neocallimastix californiae
  Cellulose docking domain, dockering
SFANAYGYPGCKSTTEIKYYDEEGSWGYENGTWCGI

SEQ ID NO: 4822 - protein, 34 aa, Neocallimastix californiae
  Cellulose docking domain, dockering
KGYKWCSDPNTKRYPYNDEDFWGVENGNWCVIKN

SEQ ID NO: 4823 - protein, 39 aa, Neocallimastix californiae
  Cellulose docking domain, dockering
KCWSEPLGYPCCTGIIKTEYTDKDGEWGLQNGDWCGITD

SEQ ID NO: 4824 - protein, 39 aa, Neocallimastix californiae
  Cellulose docking domain, dockering
KCWSEPLGYPCCTGNTKTEYTDKDGEWGLQNGDWCGINE

SEQ ID NO: 4825 - protein, 32 aa, Neocallimastix californiae
  Cellulose docking domain, dockering
SKYKCCESCNVSYDDGNKWGVLNGEWCSLTYE

SEQ ID NO: 4826 - protein, 38 aa, Neocallimastix californiae
  Cellulose docking domain, dockering
DCFSTRLGYPCCSPNNTNVVYADNDGDWGIENGNWCGM

SEQ ID NO: 4827 - protein, 34 aa, Neocallimastix californiae
  Cellulose docking domain, dockering
GASYPCCENTCAVQYTDADGQWGIENGEWCSISK

SEQ ID NO: 4828 - protein, 40 aa, Neocallimastix californiae
  Cellulose docking domain, dockering
TCWSSAMGYSCCKSCDSFNYKDNDGEWGIENDAWCGIPKE

SEQ ID NO: 4829 - protein, 32 aa, Neocallimastix californiae
  Cellulose docking domain, dockering
GALGYPCCKSTCNVYSSDESGQWGIEDNNWCL

SEQ ID NO: 4830 - protein, 30 aa, Neocallimastix californiae
  Cellulose docking domain, dockering
AYEYCQGCRVFYEDDQQWGVENNDWCIIPS

SEQ ID NO: 4831 - protein, 32 aa, Neocallimastix californiae
  Cellulose docking domain, dockering
EYICCEGCNVIEETAEGKWGIEKNQWCGIKSS

SEQ ID NO: 4832 - protein, 29 aa, Neocallimastix californiae
  Cellulose docking domain, dockering
YSKTGYPYCSLENIDIAYTHETGSWGFEN

SEQ ID NO: 4833 - protein, 33 aa, Neocallimastix californiae
  Cellulose docking domain, dockering
PDYPCCTNTKTAVYTDNAGNEWGMENNNWCGII

SEQ ID NO: 4834 - protein, 35 aa, Neocallimastix californiae
  Cellulose docking domain, dockering
LKGYNCCKNSCNVTYKDNDGNWDVENGNWCGVPFS

SEQ ID NO: 4835 - protein, 39 aa, Neocallimastix californiae
  Cellulose docking domain, dockering
CFSEALGYPCCSDSNAAVVTTDEFGHWGIENNEWCGILG

SEQ ID NO: 4836 - protein, 34 aa, Neocallimastix californiae
  Cellulose docking domain, dockering
HNSGYNCCVFDTTAVQTVDVVGKWGIENGDWCLF

SEQ ID NO: 4837 - protein, 40 aa, Neocallimastix californiae
  Cellulose docking domain, dockering
SCWSKSLGYPCCTSKTTELIYFSKSANKWYGVENDEWCGI

SEQ ID NO: 4838 - protein, 31 aa, Neocallimastix californiae
  Cellulose docking domain, dockering
TYKCCSSCEILYTDTEEWGIEDGEWCSIPHS

SEQ ID NO: 4839 - protein, 36 aa, Neocallimastix californiae
  Cellulose docking domain, dockering
AILKKGYKCCSKDCFIVFTDDDGTWGIENDQWCGCD

SEQ ID NO: 4840 - protein, 39 aa, Neocallimastix californiae
  Cellulose docking domain, dockering
FAITSQGYKCCKEDNCSVIETDDAGKWGIEDGQWCGISD

SEQ ID NO: 4841 - protein, 32 aa, Neocallimastix californiae
  Cellulose docking domain, dockering
AQGYPCCQSTTKVEYTDGDGNWGVENGDWCII

SEQ ID NO: 4842 - protein, 38 aa, Neocallimastix californiae
  Cellulose docking domain, dockering
SYRITSQGYKCCSRNCVVVYSDADGNWGVENGEWCGCA

SEQ ID NO: 4843 - protein, 40 aa, Neocallimastix californiae
  Cellulose docking domain, dockering
ECWSEVLGYPCCTSSCHVYETDSDGEWGYENKQWCGIPST

SEQ ID NO: 4844 - protein, 39 aa, Neocallimastix californiae
  Cellulose docking domain, dockering
NCWSKKLGYPCCTSSSQVYETDANGEWGYEDNHWCGIPK

SEQ ID NO: 4845 - protein, 38 aa, Neocallimastix californiae
  Cellulose docking domain, dockering
SCFSKSLGYPCCTSKNPRIYFSDSKGNWSYENGKWCGA

SEQ ID NO: 4846 - protein, 38 aa, Neocallimastix californiae
  Cellulose docking domain, dockering
KCFATALGYPCCSPYAKERFRDKNGRWGIEYGAWCGLF

SEQ ID NO: 4847 - protein, 38 aa, Neocallimastix californiae
  Cellulose docking domain, dockering
KCFTIPLGYPCCTKTKEVTYTNGYGTWGTENGDWCGLK

SEQ ID NO: 4848 - protein, 40 aa, Neocallimastix californiae
  Cellulose docking domain, dockering
CWSKTLGYDCCKNTCNVVYSDNDGEWGVENNEWCGIIQSN

SEQ ID NO: 4849 - protein, 25 aa, Neocallimastix californiae
  Cellulose docking domain, dockering
EYPCCTHCDIYYVDENGNWGIENNN

SEQ ID NO: 4850 - protein, 35 aa, Neocallimastix californiae
  Cellulose docking domain, dockering
HAYSNCNSTCRVVTVEDGVSWGVENNDWCIIKPSL

SEQ ID NO: 4851 - protein, 33 aa, Neocallimastix californiae
  Cellulose docking domain, dockering
PDYPCCEECNVYEEDDSGKWGIENNQWCGIKDS

SEQ ID NO: 4852 - protein, 40 aa, Neocallimastix californiae
  Cellulose docking domain, dockering
SEKIQSQGYKCCSDKNCAVVYSDNDGTWGVENGQWCGCNN

SEQ ID NO: 4853 - protein, 30 aa, Neocallimastix californiae
  Cellulose docking domain, dockering
TGYPCCQSNKTVYFSDESGDWSVENNNWCL

SEQ ID NO: 4854 - protein, 39 aa, Neocallimastix californiae
  Cellulose docking domain, dockering
KCRFESLGYPCCSHCNVIYTDDDGNWGAENGQWCGIPEN

SEQ ID NO: 4855 - protein, 39 aa, Neocallimastix californiae
  Cellulose docking domain, dockering
VCWSEALGYPCCSTCSSPVYSDNDGNWGIENGDWCGLLA

SEQ ID NO: 4856 - protein, 39 aa, Neocallimastix californiae
  Cellulose docking domain, dockering
DCVVKSLGYPCCSPNNTEVFYTDENGDWGVENGDWCGIT

SEQ ID NO: 4857 - protein, 40 aa, Neocallimastix californiae
  Cellulose docking domain, dockering
ACWATALGYDCCSTNVCRTVYYEDNDGKWDVENGQWCGIT

SEQ ID NO: 4858 - protein, 37 aa, Neocallimastix californiae
  Cellulose docking domain, dockering
NCWSLALGYPCCVGNDVIFVDESGEWGVENNNWCGIV

SEQ ID NO: 4859 - protein, 36 aa, Neocallimastix californiae; identical to SEQ ID NO: 2319
  Cellulose docking domain, dockering

SEQ ID NO: 4860 - protein, 40 aa, Neocallimastix californiae
  Cellulose docking domain, dockering
ECWSLKDGYPCCKTTFTVIEVDENGKKWGFENNNWCGING

SEQ ID NO: 4861 - protein, 40 aa, Neocallimastix californiae
  Cellulose docking domain, dockering
QCWATKYDYPCCKKTTEVIEKDEHGKWGFENNDWCGIVDS

SEQ ID NO: 4862 - protein, 38 aa, Neocallimastix californiae
  Cellulose docking domain, dockering
NCWSIDLGYPCCIENNVVEVNENGKWGIENNNWCGIIE

SEQ ID NO: 4863 - protein, 39 aa, Neocallimastix californiae
  Cellulose docking domain, dockering
KCWASEFNYPCCKTTSKVIEVNEYGKWGIENNDWCGIIN

SEQ ID NO: 4864 - protein, 39 aa, Neocallimastix californiae
  Cellulose docking domain, dockering
KCWASEFGYPCCKTTTEVIEKDEHGKWGFENKEWCGIVD

SEQ ID NO: 4865 - protein, 34 aa, Neocallimastix californiae
  Cellulose docking domain, dockering
HNSGYNCCILTKSVKLIDNVGQWGVENGEWCLFE

SEQ ID NO: 4866 - protein, 41 aa, Neocallimastix californiae
  Cellulose docking domain, dockering
NCWAISEGYPCCKNKNTQVQDISSDGRKWGFENDDWCGIIE

SEQ ID NO: 4867 - protein, 31 aa, Neocallimastix californiae
  Cellulose docking domain, dockering
SEYSCCSSCDVYYVDEFEWGVEDGSWCLTPF

SEQ ID NO: 4868 - protein, 38 aa, Neocallimastix californiae
  Cellulose docking domain, dockering
YCWSLPQGYPCCKKTTNVTYRDETGNWGFEFGNWCGMV

SEQ ID NO: 4869 - protein, 36 aa, Neocallimastix californiae
  Cellulose docking domain, dockering
FSKFGYSCCKKETTAILTTDRDADWGVEDGKWCAIK

SEQ ID NO: 4870 - protein, 32 aa, Neocallimastix californiae
  Cellulose docking domain, dockering
AQGYPCCESSTIVYYTDGDGDWSVENGDWCII

SEQ ID NO: 4871 - protein, 38 aa, Neocallimastix californiae
  Cellulose docking domain, dockering
CSAKIIQQGYSCCQPGCTVVYTDNDGDWGVENNAWCGC

SEQ ID NO: 4872 - protein, 38 aa, Neocallimastix californiae
  Cellulose docking domain, dockering
ACFSEKLGYPCCSANNKNVVYTDSDGDWGVENNNWCGM

SEQ ID NO: 4873 - protein, 38 aa, Neocallimastix californiae
  Cellulose docking domain, dockering
DCWATALGYKCCQSTSVVVETDANGKWGIENNEWCGIV

SEQ ID NO: 4874 - protein, 40 aa, Neocallimastix californiae
  Cellulose docking domain, dockering
CSSKITAQGYSCCSKYCTIVYTDNDGTWGYENGDWCGCGD

SEQ ID NO: 4875 - protein, 34 aa, Neocallimastix californiae
  Cellulose docking domain, dockering
RNTGYNCCLFTTTVVTTDSVGDWGVENEDWCLFE

SEQ ID NO: 4876 - protein, 40 aa, Neocallimastix californiae
  Cellulose docking domain, dockering
KCWSLKYDYKCCTLRTTEPSYFSKTANNWYGIENGEWCGI

SEQ ID NO: 4877 - protein, 30 aa, Neocallimastix californiae
  Cellulose docking domain, dockering
EYPCCKECNVYYTDTEDWGIEDGEWCSIPY

SEQ ID NO: 4878 - protein, 37 aa, Neocallimastix californiae
  Cellulose docking domain, dockering
FSITRYGYKCCSSCSKVYYTDKDGKWGIENRDWCGIP

SEQ ID NO: 4879 - protein, 38 aa, Neocallimastix californiae
  Cellulose docking domain, dockering
CSTAIINQGYKCCSDGCTVIYIDSDGDWGAENGEWCGC

SEQ ID NO: 4880 - protein, 37 aa, Neocallimastix californiae
  Cellulose docking domain, dockering
CFALSDGYECCFDNEVVYEDETGKWGINDKGEWCGVE

SEQ ID NO: 4881 - protein, 41 aa, Neocallimastix californiae
  Cellulose docking domain, dockering
ECWAEALGYKCCSDDGFHPVIYQDESGDWSADNGEWCGVIK

SEQ ID NO: 4882 - protein, 38 aa, Neocallimastix californiae
  Cellulose docking domain, dockering
ECWSKAQGYDCCAEGTSVFLEDESGKWGVTPNGLWCGI

SEQ ID NO: 4883 - protein, 30 aa, Neocallimastix californiae
  Cellulose docking domain, dockering
DCCKNSNLKVSYVDNNGYWGIESESWCKIN

SEQ ID NO: 4884 - protein, 39 aa, Neocallimastix californiae
  Cellulose docking domain, dockering
KCWSESLGYKCCSLDIEPIFTDNDGIWGMENEQWCGIIN

SEQ ID NO: 4885 - protein, 40 aa, Neocallimastix californiae
  Cellulose docking domain, dockering
NCWSLDIGYGCCSSNNTDILYNNEDGSWGIENGQWCGIVN

SEQ ID NO: 4886 - protein, 37 aa, Neocallimastix californiae
  Cellulose docking domain, dockering
CSSKILAQGYPCCSDNCTVVYTDDDGTWGVENGQWCG

SEQ ID NO: 4887 - protein, 38 aa, Neocallimastix californiae
  Cellulose docking domain, dockering
VGAQGYPCCQNTCTVYSTDADGKWGIENNDWCLINKSK

SEQ ID NO: 4888 - protein, 39 aa, Neocallimastix californiae
  Cellulose docking domain, dockering
SCWSASLGYPCCKSCSVYYSDNDGKWGIENDNWCGILSS

SEQ ID NO: 4889 - protein, 38 aa, Neocallimastix californiae
  Cellulose docking domain, dockering
TCWSTRLGYPCCEDSNVVYAVDENGIWGYENKHWCGIT

SEQ ID NO: 4890 - protein, 39 aa, Neocallimastix californiae
  Cellulose docking domain, dockering
NCWASALGFKCCKTTSTVIFEDQDGSWGIEDDFWCGIIE

SEQ ID NO: 4891 - protein, 38 aa, Neocallimastix californiae
  Cellulose docking domain, dockering
TCFSIPLGYPCCTSTKEVIDTNEYGTWGIENGDWCGLK

SEQ ID NO: 4892 - protein, 39 aa, Neocallimastix californiae
  Cellulose docking domain, dockering
SCFSSALGIPCCSSKNAEIYYSDIKGNWGIENGDWCGIS

SEQ ID NO: 4893 - protein, 38 aa, Neocallimastix californiae
  Cellulose docking domain, dockering
SCFSKSLGFPCCSSKNKDIYFTDEKGNWGIENGEWCGI

SEQ ID NO: 4894 - protein, 38 aa, Neocallimastix californiae
  Cellulose docking domain, dockering
SCFSVALGFPCCSSSATEVFRDSYGSWGVEYGEWCGMS

SEQ ID NO: 4895 - protein, 42 aa, Neocallimastix californiae
  Cellulose docking domain, dockering
KCWSLSQGYPCCKKETTAINYTSSSTGAEWGIENGNWCGITD

SEQ ID NO: 4896 - protein, 34 aa, Neocallimastix californiae
  Cellulose docking domain, dockering
KGTGYACCIFKNTIVETVDESGQWGHEGNDWCLM

SEQ ID NO: 4897 - protein, 39 aa, Neocallimastix californiae
  Cellulose docking domain, dockering
DCWALAEGYNCCSGCSVSYEDETGKWGIENGQWCGIDSS

SEQ ID NO: 4898 - protein, 25 aa, Neocallimastix californiae
  Cellulose docking domain, dockering
CSVSYEDETGKWGIENGQWCGIDSS

SEQ ID NO: 4899 - protein, 40 aa, Neocallimastix californiae
  Cellulose docking domain, dockering
GCWSKTYGYPCCSSASTKVMYTDNDGEWGVENGNWCGIVK

SEQ ID NO: 4900 - protein, 38 aa, Neocallimastix californiae
  Cellulose docking domain, dockering
SCFSYTLGYPCCTSTTNVIYTDSYGRWGIEKGNWCFLG

SEQ ID NO: 4901 - protein, 38 aa, Neocallimastix californiae
  Cellulose docking domain, dockering
CWIKDYFSCCDEGAEVIYEDHNGKWGIQGANDWCLIVE

SEQ ID NO: 4902 - protein, 39 aa, Neocallimastix californiae
  Cellulose docking domain, dockering
ECWSLELGYPCCKTTKDVVYTDNSGDWGLENGDWCGIVE

SEQ ID NO: 4903 - protein, 35 aa, Neocallimastix californiae
  Cellulose docking domain, dockering
ALAYEDCKSCYIHYEDSDGYWGYNGDEWCIINEEY

SEQ ID NO: 4904 - protein, 41 aa, Neocallimastix californiae
  Cellulose docking domain, dockering
YCFAEVLGYKCCEDQNGPRTSIDADGEWYEDKYGNWCGYSN

SEQ ID NO: 4905 - protein, 36 aa, Neocallimastix californiae
  Cellulose docking domain, dockering
DCWSEKYGYPCCPKSKVITVDKHGKWGIENGDYCGV

SEQ ID NO: 4906 - protein, 39 aa, Neocallimastix californiae
  Cellulose docking domain, dockering
ECFSIKLGYPCCNTCNVSTTDQDGSWGIENNQWCGIKDS

SEQ ID NO: 4907 - protein, 30 aa, Neocallimastix californiae
  Cellulose docking domain, dockering
EYPCCTSTKTVMYTDEKGPWGIENGNWCGI

SEQ ID NO: 4908 - protein, 39 aa, Neocallimastix californiae
  Cellulose docking domain, dockering
ECFATKLNYKCCSGCDVAFVDNDGKWGYENNNWCGLKDT

SEQ ID NO: 4909 - protein, 40 aa, Neocallimastix californiae
  Cellulose docking domain, dockering
KCWSTALGYSCCKSCLAAVFSDNDGKWAVEEDNWCGIPKS

SEQ ID NO: 4910 - protein, 41 aa, Neocallimastix californiae
  Cellulose docking domain, dockering
SCWATKLGFNCCKNTSAVYETDANGRWGIENGNWCGIIESS

SEQ ID NO: 4911 - protein, 40 aa, Neocallimastix californiae
  Cellulose docking domain, dockering
SCWATKLGYKCCTAKCPEVSYVDQDGAWGVENGNWCGITK

SEQ ID NO: 4912 - protein, 35 aa, Neocallimastix californiae
  Cellulose docking domain, dockering
AIMAQGYPCCSANCQVVYTDADGEWGVENGDWCGC

SEQ ID NO: 4913 - protein, 32 aa, Neocallimastix californiae
  Cellulose docking domain, dockering
AQGFPCCESSTIVYYTDGDGDWSVENNDWCII

SEQ ID NO: 4914 - protein, 36 aa, Neocallimastix californiae
  Cellulose docking domain, dockering
ACWSTSLGYPCCSGNEVVYTDNDGKWGVENGNWCGI

SEQ ID NO: 4915 - protein, 27 aa, Neocallimastix californiae
  Cellulose docking domain, dockering
CCSGNEVVYTDNDGKWGVENGNWCGIA

SEQ ID NO: 4916 - protein, 41 aa, Neocallimastix californiae
  Cellulose docking domain, dockering
CSSSILSQGYKCCSSKCTIVYVDEDGTWGIENDEWCGCNDN

SEQ ID NO: 4917 - protein, 42 aa, Neocallimastix californiae
  Cellulose docking domain, dockering
CSSSITNQGYSCCSSSNCNIIYTDKDGKWGVENNTWCGITSN

SEQ ID NO: 4918 - protein, 39 aa, Neocallimastix californiae
  Cellulose docking domain, dockering
CSASILKQGYSCCSSRCTVTFTDEDGDWGVENGQWCGCG

SEQ ID NO: 4919 - protein, 24 aa, Neocallimastix californiae
  Cellulose docking domain, dockering
QCFSISLGYPCCQGNTVVYTDKDG

SEQ ID NO: 4920 - protein, 36 aa, Neocallimastix californiae
  Cellulose docking domain, dockering
SNNTGYDCCADSNARVQYTDESGNWSIENGNWCLIC

SEQ ID NO: 4921 - protein, 34 aa, Neocallimastix californiae
  Cellulose docking domain, dockering
DGYECCKSCNIVLTDESGNWGVEDGQWCGIDEDK

SEQ ID NO: 4922 - protein, 38 aa, Neocallimastix californiae
  Cellulose docking domain, dockering
ECWAAEQGYPCCTTTTEVAFADASGKWGIEDGNWCGII

SEQ ID NO: 4923 - protein, 31 aa, Neocallimastix californiae
  Cellulose docking domain, dockering
YPCCQGCVVVTSDSDGDWGVEDGQWCLIKKT

SEQ ID NO: 4924 - protein, 42 aa, Neocallimastix californiae
  Cellulose docking domain, dockering
SCWSETYGYKCCSKGCSSNVLTNDEYGYWGAENGEWCGIPES

SEQ ID NO: 4925 - protein, 36 aa, Neocallimastix californiae
  Cellulose docking domain, dockering
ASNQGYSCCKDCTVVYEDEAGKWGVENDQWCGIDTT

SEQ ID NO: 4926 - protein, 39 aa, Neocallimastix californiae
  Cellulose docking domain, dockering
DCWAAAEGFKCCSPGVKSILTDSKGSWGIENDEWCGIVD

SEQ ID NO: 4927 - protein, 40 aa, Neocallimastix californiae
  Cellulose docking domain, dockering
SCWATAQGYGCCTGCEAIMTDDNRKWGFENGNWCGIIDSV

SEQ ID NO: 4928 - protein, 32 aa, Neocallimastix californiae
  Cellulose docking domain, dockering
GKQGYPCCKNTKDVYYRDADGNWGIENNNWCY

SEQ ID NO: 4929 - protein, 40 aa, Neocallimastix californiae
  Cellulose docking domain, dockering
CSAKIVQQGYKCCSSSNCVVQYVDSDGYWAVENNQWCGCG

SEQ ID NO: 4930 - protein, 40 aa, Neocallimastix californiae
  Cellulose docking domain, dockering
CSANILKQGYKCCPSGCVVVFTDNDGTWGVNNGEWCGCNT

SEQ ID NO: 4931 - protein, 33 aa, Neocallimastix californiae
  Cellulose docking domain, dockering
DYPCCSECTVVYTDESGDWGVENNEWCLIKKSK

SEQ ID NO: 4932 - protein, 37 aa, Neocallimastix californiae
  Cellulose docking domain, dockering
DCFALDLGFKCCNDATVVYTDDSGDWGYVNNDWCGIG

SEQ ID NO: 4933 - protein, 38 aa, Neocallimastix californiae
  Cellulose docking domain, dockering
DCFAIKLGYKCCKTTTVTIYEDNDGPWGIENDEWCGLK

SEQ ID NO: 4934 - protein, 37 aa, Neocallimastix californiae; identical to SEQ ID NO: 2395
  Cellulose docking domain, dockering

SEQ ID NO: 4935 - protein, 30 aa, Neocallimastix californiae; identical to SEQ ID NO: 2397
  Cellulose docking domain, dockering

SEQ ID NO: 4936 - protein, 40 aa, Neocallimastix californiae
  Cellulose docking domain, dockering
KCVSELVGFPCCPENNKAVYNRDEFGDWGYDFAKGTWCGL

SEQ ID NO: 4937 - protein, 32 aa, Neocallimastix californiae
  Cellulose docking domain, dockering
PQFPCCKNNVVVYTDGSGDWGFENNNWCGIIK

SEQ ID NO: 4938 - protein, 32 aa, Neocallimastix californiae
  Cellulose docking domain, dockering
PDYPCCKGNTVVLTDVKGDWGVENNAWCGINK

SEQ ID NO: 4939 - protein, 21 aa, Neocallimastix californiae
  Cellulose docking domain, dockering
VYTDEDGNWGVENDQWCGCED

SEQ ID NO: 4940 - protein, 38 aa, Neocallimastix californiae
  Cellulose docking domain, dockering
TSILEKGYSCCPKDCKVLYTDEEGTWGINNYKWCICNS

SEQ ID NO: 4941 - protein, 32 aa, Neocallimastix californiae
  Cellulose docking domain, dockering
EFNYPCCSLGYDKIVYSDKYAYWGFENGDWCV

SEQ ID NO: 4942 - protein, 40 aa, Neocallimastix californiae
  Cellulose docking domain, dockering
ECWSLQYGIPCCSYYYHGDIETDERGKWGIRGTEKCGILK

SEQ ID NO: 4943 - protein, 38 aa, Neocallimastix californiae
  Cellulose docking domain, dockering
CTCWATKLGYPCCTTTSQSLFTDENGEWGVENNDWCGI

SEQ ID NO: 4944 - protein, 34 aa, Neocallimastix californiae
  Cellulose docking domain, dockering
HPNGYPYCKQTNEVVFTDTVEWGVENGAWCVIKS

SEQ ID NO: 4945 - protein, 30 aa, Neocallimastix californiae; identical to SEQ ID NO: 2405
  Cellulose docking domain, dockering

SEQ ID NO: 4946 - protein, 40 aa, Neocallimastix californiae
  Cellulose docking domain, dockering
ECWSKALGYECCSKDNTRVVVSDDSGKWGVENGQWCGINK

SEQ ID NO: 4947 - protein, 40 aa, Neocallimastix californiae
  Cellulose docking domain, dockering
TCWSERKGFPCCSSKDTKVDYEDSDGKWGHENNQWCGIRT

SEQ ID NO: 4948 - protein, 37 aa, Neocallimastix californiae
  Cellulose docking domain, dockering
NCFSIDLGYPCCKKTQKVESKDSDGTWGYENGGWCGL

SEQ ID NO: 4949 - protein, 29 aa, Neocallimastix californiae
  Cellulose docking domain, dockering
AQGYPCCAYSCDSLFTDSDGEWSVENENW

SEQ ID NO: 4950 - protein, 40 aa, Neocallimastix californiae
  Cellulose docking domain, dockering
SCWSKASGFNCCKNCGKVYFIDKDGEWGIENNDWCGMPKT

SEQ ID NO: 4951 - protein, 40 aa, Neocallimastix californiae
  Cellulose docking domain, dockering
CWSLQYGYDCCKKKETEPYYYSQSIKKWYGVEDGEWCGIE

SEQ ID NO: 4952 - protein, 34 aa, Neocallimastix californiae
  Cellulose docking domain, dockering
GTGYDCCQYTTIPTYTDKQGYWAMEDEEWCIIDQ

SEQ ID NO: 4953 - protein, 35 aa, Neocallimastix californiae
  Cellulose docking domain, dockering
EGANYKCCTTTCEVYYSDESGDWGVEDNDWCSMPY

SEQ ID NO: 4954 - protein, 31 aa, Neocallimastix californiae
  Cellulose docking domain, dockering
DFPCCTGKDIVYSDGSGDWGFENGSWCGIVP

SEQ ID NO: 4955 - protein, 33 aa, Neocallimastix californiae
  Cellulose docking domain, dockering
EYPCCTDSNTPVMEEDTLGKWGIENGSWCGIKA

SEQ ID NO: 4956 - protein, 35 aa, Neocallimastix californiae
  Cellulose docking domain, dockering
KGSGYSCCIFDTTPVVSKDNTGYWGVENGQWCLFE

SEQ ID NO: 4957 - protein, 43 aa, Neocallimastix californiae
  Cellulose docking domain, dockering
KCWSEAQDYPCCKEPTTSVVSKDSKGYLWGVENNEWCGITGTQ

SEQ ID NO: 4958 - protein, 33 aa, Neocallimastix californiae
  Cellulose docking domain, dockering
PDYPCCKSCVEVYEDDLGKWGIENDVWCGIKDS

SEQ ID NO: 4959 - protein, 29 aa, Neocallimastix californiae
  Cellulose docking domain, dockering
CCEGCKVIQEDKDGKWGYENNEWCGIKDS

SEQ ID NO: 4960 - protein, 33 aa, Neocallimastix californiae
  Cellulose docking domain, dockering
EGREYKCCKSCDIIYTDTSDWGVEDDDWCSIPY

SEQ ID NO: 4961 - protein, 40 aa, Neocallimastix californiae
  Cellulose docking domain, dockering
SCWSQDLGYPCCQSTVDVRYTDKDGLWGVENGNWCGIINS

SEQ ID NO: 4962 - protein, 35 aa, Neocallimastix californiae; identical to SEQ ID NO: 2421
  Cellulose docking domain, dockering

SEQ ID NO: 4963 - protein, 40 aa, Neocallimastix californiae
  Cellulose docking domain, dockering
SCWAQGLGYPCCEGCEASFTDGDGDWAIENGNWCGIDPKK

SEQ ID NO: 4964 - protein, 39 aa, Neocallimastix californiae
  Cellulose docking domain, dockering
TCWSELLGFPCCVGTVTVEYTDEDGEWGLQNGDWCGIPK

SEQ ID NO: 4965 - protein, 39 aa, Neocallimastix californiae
  Cellulose docking domain, dockering
QCWSQSQGFPCCSPDTPVFSTDESGKWGIENDDWCGIIE

SEQ ID NO: 4966 - protein, 38 aa, Neocallimastix californiae
  Cellulose docking domain, dockering
GCWSTALGYPCCKNSSIVYFTDNDGKWSVEDNEWCGIS

SEQ ID NO: 4967 - protein, 26 aa, Neocallimastix californiae
  Cellulose docking domain, dockering
GCWSTALGYPCCKNSSIVYFTDNDGK

SEQ ID NO: 4968 - protein, 41 aa, Neocallimastix californiae
  Cellulose docking domain, dockering
ECWSEQLGYPCCNSGNKEVVFEDENGNWGISPKTNDWCGIR

SEQ ID NO: 4969 - protein, 32 aa, Neocallimastix californiae
  Cellulose docking domain, dockering
GFKCCSSSDAKVEYTDNDGKWSIEDGNWCGIL

SEQ ID NO: 4970 - protein, 40 aa, Neocallimastix californiae
  Cellulose docking domain, dockering
ECWALELGFECCTSEDIEVQYTDKDGKWGIENYEWCGIIE

SEQ ID NO: 4971 - protein, 40 aa, Neocallimastix californiae
  Cellulose docking domain, dockering
CASTIKDQGYSCCKTCTVSYTDESGEWGIENNHWCGISKS

SEQ ID NO: 4972 - protein, 17 aa, Neocallimastix californiae
  Cellulose docking domain, dockering
DNDGDWGFENDNWCGLN

SEQ ID NO: 4973 - protein, 34 aa, Neocallimastix californiae
  Cellulose docking domain, dockering
EQYSCCKSTCTPSLSDNTGDWAVENGAWCSIPYT

SEQ ID NO: 4974 - protein, 34 aa, Neocallimastix californiae
  Cellulose docking domain, dockering
YGYGCCKGCKVRATDSTGEWGYENGKWCGIDTEY

SEQ ID NO: 4975 - protein, 39 aa, Neocallimastix californiae
  Cellulose docking domain, dockering
SCWSNALGYECCKGCTVIESDASGDWGIENNQWCGIPSS

SEQ ID NO: 4976 - protein, 39 aa, Neocallimastix californiae
  Cellulose docking domain, dockering
SCWSKSLGYDCCKECNTVYTDGDGDWGFENNQWCGISDS

SEQ ID NO: 4977 - protein, 30 aa, Neocallimastix californiae
  Cellulose docking domain, dockering
PCCSKCNVVYTDDEGDWGFEKGAWCSIREN

SEQ ID NO: 4978 - protein, 39 aa, Neocallimastix californiae
  Cellulose docking domain, dockering
TCWAEQYGYDCCKHCNVTYTDETGDWGKEDDAWCGILNT

SEQ ID NO: 4979 - protein, 42 aa, Neocallimastix californiae
  Cellulose docking domain, dockering
ECWANAYGYDCCVDGTLTYLEDETGKWGVTSDYQWCGLLKSE

SEQ ID NO: 4980 - protein, 42 aa, Neocallimastix californiae; identical to SEQ ID NO: 4979
  Cellulose docking domain, dockering

SEQ ID NO: 4981 - protein, 30 aa, Neocallimastix californiae
  Cellulose docking domain, dockering
ECWANAYGYDCCVDGTLTYLEDETGKWGVT

SEQ ID NO: 4982 - protein, 37 aa, Neocallimastix californiae
  Cellulose docking domain, dockering
ECWSAKFGYKCCDSSTEISFEDEKGKWGIDGSSWCGI

SEQ ID NO: 4983 - protein, 39 aa, Neocallimastix californiae
  Cellulose docking domain, dockering
ECFSAKLGYSCCTTGIASVKNDENGYWGIENDEWCGVAS

SEQ ID NO: 4984 - protein, 39 aa, Neocallimastix californiae
  Cellulose docking domain, dockering
CSAKITSQGYPCCSSSCTVVYTDESGDWGVENNQWCGCG

SEQ ID NO: 4985 - protein, 32 aa, Neocallimastix californiae; identical to SEQ ID NO: 2629
  Cellulose docking domain, dockering

SEQ ID NO: 4986 - protein, 40 aa, Neocallimastix californiae
  Cellulose docking domain, dockering
NCWSSGYGYSCCKTCKIYYTDDIGEWGIENGQWCGIVDSR

SEQ ID NO: 4987 - protein, 32 aa, Neocallimastix californiae
  Cellulose docking domain, dockering
PFYPCCEKNTVVFTDKQGKWGIENGSWCGIGK

SEQ ID NO: 4988 - protein, 39 aa, Neocallimastix californiae
  Cellulose docking domain, dockering
CWSVSLGYKCCTLRTTKPYYYSKSVDKWYGVENNEWCGI

SEQ ID NO: 4989 - protein, 31 aa, Neocallimastix californiae
  Cellulose docking domain, dockering
EYKCCKGCEVVYTDSEDWGIEDGKWCSIPHS

SEQ ID NO: 4990 - protein, 19 aa, Neocallimastix californiae
  Cellulose docking domain, dockering
YTDNDGEWGINNGEWCGCG

SEQ ID NO: 4991 - protein, 25 aa, Neocallimastix californiae
  Cellulose docking domain, dockering
ECFSIKLGYPCCQGNTVYYIDNDGQ

SEQ ID NO: 4992 - protein, 34 aa, Neocallimastix californiae
  Cellulose docking domain, dockering
GTSYSCCVLTTTVVTTDGTGKWGIEGNQWCLMKE

SEQ ID NO: 4993 - protein, 32 aa, Neocallimastix californiae
  Cellulose docking domain, dockering
QYHCCNECNVVLEDEEGKWGFENNKWCGLKDS

SEQ ID NO: 4994 - protein, 34 aa, Neocallimastix californiae
  Cellulose docking domain, dockering
AYSNCTHTCNVIVTEDGVEWGAENQDWCIIDPSI

SEQ ID NO: 4995 - protein, 39 aa, Neocallimastix californiae
  Cellulose docking domain, dockering
NCWAEKLGYPCCSSSKDVLFEDSDGQWSVENDNWCGIPK

SEQ ID NO: 4996 - protein, 26 aa, Neocallimastix californiae
  Cellulose docking domain, dockering
CSAKIIAQGYECCPSDCETIYTDDDG

SEQ ID NO: 4997 - protein, 32 aa, Neocallimastix californiae
  Cellulose docking domain, dockering
YPYCNGCESNYTDGDGDWYFVDNNWCKVNEKK

SEQ ID NO: 4998 - protein, 33 aa, Neocallimastix californiae
  Cellulose docking domain, dockering
YECCNNNEVVYTDETGDWGLTDTVPPQWCSIGK

SEQ ID NO: 4999 - protein, 32 aa, Neocallimastix californiae
  Cellulose docking domain, dockering
NGYQCCKNSSTVAVYSDKDGEWGVENNDWCII

SEQ ID NO: 5000 - protein, 40 aa, Neocallimastix californiae
  Cellulose docking domain, dockering
ACWSVGLGYSCCKSCIAAVYTDNDGKWGVENDKWCGIPTS

SEQ ID NO: 5001 - protein, 37 aa, Neocallimastix californiae
  Cellulose docking domain, dockering
GAAGYPCCKSSCTVYAEDSDGKWSIENDNWCLIDQSK

SEQ ID NO: 5002 - protein, 38 aa, Neocallimastix californiae
  Cellulose docking domain, dockering
CPAAIRNQGYKCCKAGCQVIYKDSDGDWGVENNQWCGC

SEQ ID NO: 5003 - protein, 26 aa, Neocallimastix californiae
  Cellulose docking domain, dockering
SEKFTKQGYKCCSSCSFVYYTDESGD

SEQ ID NO: 5004 - protein, 39 aa, Neocallimastix californiae
  Cellulose docking domain, dockering
NCWAYKLGYQCCLGDNVKSIYNDVDGDWNYLNGRWCGIM

SEQ ID NO: 5005 - protein, 35 aa, Neocallimastix californiae; identical to SEQ ID NO: 2465
  Cellulose docking domain, dockering

SEQ ID NO: 5006 - protein, 19 aa, Neocallimastix californiae
  Cellulose docking domain, dockering
VVYVDKDGEWGVENGNWCG

SEQ ID NO: 5007 - protein, 33 aa, Neocallimastix californiae
  Cellulose docking domain, dockering
RLGYNCCKYRSTPVYEKDNDGLWGIEDNDWCGV

SEQ ID NO: 5008 - protein, 33 aa, Neocallimastix californiae
  Cellulose docking domain, dockering
NQGYECCPSDCEVIYTDNDGDWGVNNNQWCGCG

SEQ ID NO: 5009 - protein, 37 aa, Neocallimastix californiae
  Cellulose docking domain, dockering
CSSNIKAQGYKCCSANCIVYYTDADGDWGIENDEWCG

SEQ ID NO: 5010 - protein, 35 aa, Neocallimastix californiae
  Cellulose docking domain, dockering
DYGYKCCKGENVIPIVTESVGQWGIENDDWCGIVS

SEQ ID NO: 5011 - protein, 40 aa, Neocallimastix californiae
  Cellulose docking domain, dockering
QCWSEVVGYSCCSSNETTVYAHDDNGDWGYDFNKQEWCGL

SEQ ID NO: 5012 - protein, 31 aa, Neocallimastix californiae
  Cellulose docking domain, dockering
YNCCTKCDYRLEDEYGQWGFENGKWCSVTFE

SEQ ID NO: 5013 - protein, 33 aa, Neocallimastix californiae
  Cellulose docking domain, dockering
RYPCCSNVTITLIKDMYGNKWGMENKNYCGILY

SEQ ID NO: 5014 - protein, 31 aa, Neocallimastix californiae
  Cellulose docking domain, dockering
YECCQGCEVFEETEEGKWGAENGEWCGIKNS

SEQ ID NO: 5015 - protein, 36 aa, Neocallimastix californiae
  Cellulose docking domain, dockering
SCGAAAIGYPCCENTCTEVYTDEYRWGVEDDEWCGI

SEQ ID NO: 5016 - protein, 36 aa, Neocallimastix californiae; identical to SEQ ID NO: 1774
  Cellulose docking domain, dockering

SEQ ID NO: 5017 - protein, 29 aa, Neocallimastix californiae
  Cellulose docking domain, dockering
ACWSQPLGYPCCSSPNAEVYYTDNDGKWS

SEQ ID NO: 5018 - protein, 34 aa, Neocallimastix californiae; identical to SEQ ID NO: 2478
  Cellulose docking domain, dockering

SEQ ID NO: 5019 - protein, 31 aa, Neocallimastix californiae
  Cellulose docking domain, dockering
EYPCCQECNVLYTDTEDWGIENGSWCSIPYT

SEQ ID NO: 5020 - protein, 36 aa, Neocallimastix californiae; identical to SEQ ID NO: 2480
  Cellulose docking domain, dockering

SEQ ID NO: 5021 - protein, 26 aa, Neocallimastix californiae
  Cellulose docking domain, dockering
ACWSQPLGYPCCSSPNAEVYYTDNDG

SEQ ID NO: 5022 - protein, 38 aa, Neocallimastix californiae
  Cellulose docking domain, dockering
ACWSQPLGYPCCSSPNAEVYYTDNDGKWSVENNDWCGI

SEQ ID NO: 5023 - protein, 37 aa, Neocallimastix californiae; identical to SEQ ID NO: 1478
  Cellulose docking domain, dockering

SEQ ID NO: 5024 - protein, 38 aa, Neocallimastix californiae; identical to SEQ ID NO: 4042
  Cellulose docking domain, dockering

SEQ ID NO: 5025 - protein, 39 aa, Neocallimastix californiae; identical to SEQ ID NO: 4028
  Cellulose docking domain, dockering

SEQ ID NO: 5026 - protein, 39 aa, Neocallimastix californiae; identical to SEQ ID NO: 4028
  Cellulose docking domain, dockering

SEQ ID NO: 5027 - protein, 39 aa, Neocallimastix californiae; identical to SEQ ID NO: 4028
  Cellulose docking domain, dockering

SEQ ID NO: 5028 - protein, 32 aa, Neocallimastix californiae; identical to SEQ ID NO: 2488
  Cellulose docking domain, dockering

SEQ ID NO: 5029 - protein, 29 aa, Neocallimastix californiae
  Cellulose docking domain, dockering
ACWSQPLGYPCCSSPNAEVYYTDNDGKWS

SEQ ID NO: 5030 - protein, 33 aa, Neocallimastix californiae
  Cellulose docking domain, dockering
HCWSLDHGYKCCKGENVEVEYTDSKGQWGKENG

SEQ ID NO: 5031 - protein, 36 aa, Neocallimastix californiae; identical to SEQ ID NO: 1774
  Cellulose docking domain, dockering

SEQ ID NO: 5032 - protein, 33 aa, Neocallimastix californiae
  Cellulose docking domain, dockering
AQGYPCCKTATEVFYTDNDGNWGVENGQWCGCG

SEQ ID NO: 5033 - protein, 38 aa, Neocallimastix californiae; identical to SEQ ID NO: 5022
  Cellulose docking domain, dockering

SEQ ID NO: 5034 - protein, 39 aa, Neocallimastix californiae; identical to SEQ ID NO: 4028
  Cellulose docking domain, dockering

SEQ ID NO: 5035 - protein, 37 aa, Neocallimastix californiae; identical to SEQ ID NO: 1478
  Cellulose docking domain, dockering

SEQ ID NO: 5036 - protein, 39 aa, Neocallimastix californiae; identical to SEQ ID NO: 4028
  Cellulose docking domain, dockering

SEQ ID NO: 5037 - protein, 27 aa, Neocallimastix californiae
  Cellulose docking domain, dockering
ACWSQPLGYPCCSSPNAEVYYTDNDGK

SEQ ID NO: 5038 - protein, 37 aa, Neocallimastix californiae; identical to SEQ ID NO: 1478
  Cellulose docking domain, dockering

SEQ ID NO: 5039 - protein, 34 aa, Neocallimastix californiae; identical to SEQ ID NO: 2478
  Cellulose docking domain, dockering

SEQ ID NO: 5040 - protein, 39 aa, Neocallimastix californiae; identical to SEQ ID NO: 4028
  Cellulose docking domain, dockering

SEQ ID NO: 5041 - protein, 39 aa, Neocallimastix californiae; identical to SEQ ID NO: 4028
  Cellulose docking domain, dockering

SEQ ID NO: 5042 - protein, 29 aa, Neocallimastix californiae
  Cellulose docking domain, dockering
ACWSQPLGYPCCSSPNAEVYYTDNDGKWS

SEQ ID NO: 5043 - protein, 31 aa, Neocallimastix californiae; identical to SEQ ID NO: 2503
  Cellulose docking domain, dockering

SEQ ID NO: 5044 - protein, 39 aa, Neocallimastix californiae; identical to SEQ ID NO: 4028
  Cellulose docking domain, dockering

SEQ ID NO: 5045 - protein, 41 aa, Anaeromyces robustus; identical to SEQ ID NO: 4627
  Cellulose docking domain, dockering

SEQ ID NO: 5046 - protein, 40 aa, Anaeromyces robustus; identical to SEQ ID NO: 4628
  Cellulose docking domain, dockering

SEQ ID NO: 5047 - protein, 39 aa, Anaeromyces robustus; identical to SEQ ID NO: 4629
  Cellulose docking domain, dockering

SEQ ID NO: 5048 - protein, 38 aa, Anaeromyces robustus; identical to SEQ ID NO: 4725
  Cellulose docking domain, dockering

SEQ ID NO: 5049 - protein, 40 aa, Anaeromyces robustus
  Cellulose docking domain, dockering
TCWSEKLGFPCCSSPSAPVQYTDADGKWSVENGDWCGIPK

SEQ ID NO: 5050 - protein, 38 aa, Anaeromyces robustus
  Cellulose docking domain, dockering
SCFSVKLGYPCCSSANVPVAYTDNDGNWGIENGDWCGI

SEQ ID NO: 5051 - protein, 39 aa, Anaeromyces robustus; identical to SEQ ID NO: 4738
  Cellulose docking domain, dockering

SEQ ID NO: 5052 - protein, 34 aa, Anaeromyces robustus; identical to SEQ ID NO: 4739
  Cellulose docking domain, dockering

SEQ ID NO: 5053 - protein, 39 aa, Anaeromyces robustus; identical to SEQ ID NO: 4737
  Cellulose docking domain, dockering

SEQ ID NO: 5054 - protein, 38 aa, Anaeromyces robustus; identical to SEQ ID NO: 4751
  Cellulose docking domain, dockering

SEQ ID NO: 5055 - protein, 40 aa, Anaeromyces robustus; identical to SEQ ID NO: 4752
  Cellulose docking domain, dockering

SEQ ID NO: 5056 - protein, 26 aa, Anaeromyces robustus
  Cellulose docking domain, dockering
CSSKITAQGYKCCSDPNCTVYYTDAD

SEQ ID NO: 5057 - protein, 40 aa, Anaeromyces robustus; identical to SEQ ID NO: 4783
  Cellulose docking domain, dockering

SEQ ID NO: 5058 - protein, 38 aa, Anaeromyces robustus; identical to SEQ ID NO: 4782
  Cellulose docking domain, dockering

SEQ ID NO: 5059 - protein, 38 aa, Anaeromyces robustus; identical to SEQ ID NO: 4798
  Cellulose docking domain, dockering

SEQ ID NO: 5060 - protein, 35 aa, Anaeromyces robustus; identical to SEQ ID NO: 4797
  Cellulose docking domain, dockering

SEQ ID NO: 5061 - protein, 42 aa, Anaeromyces robustus; identical to SEQ ID NO: 4799
  Cellulose docking domain, dockering

SEQ ID NO: 5062 - protein, 33 aa, Anaeromyces robustus; identical to SEQ ID NO: 4801
  Cellulose docking domain, dockering

SEQ ID NO: 5063 - protein, 31 aa, Anaeromyces robustus; identical to SEQ ID NO: 4800
  Cellulose docking domain, dockering

SEQ ID NO: 5064 - protein, 41 aa, Anaeromyces robustus; identical to SEQ ID NO: 4785
  Cellulose docking domain, dockering

SEQ ID NO: 5065 - protein, 39 aa, Anaeromyces robustus; identical to SEQ ID NO: 4784
  Cellulose docking domain, dockering

SEQ ID NO: 5066 - protein, 39 aa, Anaeromyces robustus; identical to SEQ ID NO: 4762
  Cellulose docking domain, dockering

SEQ ID NO: 5067 - protein, 41 aa, Anaeromyces robustus; identical to SEQ ID NO: 4810
  Cellulose docking domain, dockering

SEQ ID NO: 5068 - protein, 34 aa, Anaeromyces robustus; identical to SEQ ID NO: 4811
  Cellulose docking domain, dockering

SEQ ID NO: 5069 - protein, 39 aa, Anaeromyces robustus; identical to SEQ ID NO: 4714
  Cellulose docking domain, dockering

SEQ ID NO: 5070 - protein, 37 aa, Anaeromyces robustus; identical to SEQ ID NO: 4715
  Cellulose docking domain, dockering

SEQ ID NO: 5071 - protein, 37 aa, Anaeromyces robustus; identical to SEQ ID NO: 4715
  Cellulose docking domain, dockering

SEQ ID NO: 5072 - protein, 39 aa, Anaeromyces robustus; identical to SEQ ID NO: 4714
  Cellulose docking domain, dockering

SEQ ID NO: 5073 - protein, 34 aa, Anaeromyces robustus; identical to SEQ ID NO: 4827
  Cellulose docking domain, dockering

SEQ ID NO: 5074 - protein, 38 aa, Anaeromyces robustus; identical to SEQ ID NO: 4826
  Cellulose docking domain, dockering

SEQ ID NO: 5075 - protein, 30 aa, Anaeromyces robustus; identical to SEQ ID NO: 4830
  Cellulose docking domain, dockering

SEQ ID NO: 5076 - protein, 32 aa, Anaeromyces robustus; identical to SEQ ID NO: 4831
  Cellulose docking domain, dockering

SEQ ID NO: 5077 - protein, 37 aa, Anaeromyces robustus
  Cellulose docking domain, dockering
GALGYPCCKSTCNVYSSDESGQWGIEDNNWCLIDASK

SEQ ID NO: 5078 - protein, 40 aa, Anaeromyces robustus; identical to SEQ ID NO: 4828
  Cellulose docking domain, dockering

SEQ ID NO: 5079 - protein, 36 aa, Anaeromyces robustus
  Cellulose docking domain, dockering
GALGYPCCKSTCNVYSSDESGQWGIENDAWCGIPKE

SEQ ID NO: 5080 - protein, 36 aa, Anaeromyces robustus
  Cellulose docking domain, dockering
GALGYSCCKSCDSFNYKDNDGEWGIENDAWCGIPKE

SEQ ID NO: 5081 - protein, 33 aa, Anaeromyces robustus
  Cellulose docking domain, dockering
GYSCCKSCDSFNYKDNDGEWGIENDAWCGIPKE

SEQ ID NO: 5082 - protein, 40 aa, Anaeromyces robustus; identical to SEQ ID NO: 4816
  Cellulose docking domain, dockering

SEQ ID NO: 5083 - protein, 38 aa, Anaeromyces robustus; identical to SEQ ID NO: 4817
  Cellulose docking domain, dockering

SEQ ID NO: 5084 - protein, 39 aa, Anaeromyces robustus; identical to SEQ ID NO: 4840
  Cellulose docking domain, dockering

SEQ ID NO: 5085 - protein, 36 aa, Anaeromyces robustus; identical to SEQ ID NO: 4839
  Cellulose docking domain, dockering

SEQ ID NO: 5086 - protein, 38 aa, Anaeromyces robustus; identical to SEQ ID NO: 4872
  Cellulose docking domain, dockering

SEQ ID NO: 5087 - protein, 38 aa, Anaeromyces robustus; identical to SEQ ID NO: 4873
  Cellulose docking domain, dockering

SEQ ID NO: 5088 - protein, 35 aa, Anaeromyces robustus; identical to SEQ ID NO: 4850
  Cellulose docking domain, dockering

SEQ ID NO: 5089 - protein, 33 aa, Anaeromyces robustus; identical to SEQ ID NO: 4851
  Cellulose docking domain, dockering

SEQ ID NO: 5090 - protein, 38 aa, Anaeromyces robustus; identical to SEQ ID NO: 4889
  Cellulose docking domain, dockering

SEQ ID NO: 5091 - protein, 34 aa, Anaeromyces robustus; identical to SEQ ID NO: 2552
  Cellulose docking domain, dockering

SEQ ID NO: 5092 - protein, 39 aa, Anaeromyces robustus; identical to SEQ ID NO: 4890
  Cellulose docking domain, dockering

SEQ ID NO: 5093 - protein, 30 aa, Anaeromyces robustus; identical to SEQ ID NO: 4853
  Cellulose docking domain, dockering

SEQ ID NO: 5094 - protein, 40 aa, Anaeromyces robustus; identical to SEQ ID NO: 4852
  Cellulose docking domain, dockering

SEQ ID NO: 5095 - protein, 32 aa, Anaeromyces robustus; identical to SEQ ID NO: 4841
  Cellulose docking domain, dockering

SEQ ID NO: 5096 - protein, 38 aa, Anaeromyces robustus; identical to SEQ ID NO: 4842
  Cellulose docking domain, dockering

SEQ ID NO: 5097 - protein, 39 aa, Anaeromyces robustus; identical to SEQ ID NO: 4855
  Cellulose docking domain, dockering

SEQ ID NO: 5098 - protein, 39 aa, Anaeromyces robustus; identical to SEQ ID NO: 4856
  Cellulose docking domain, dockering

SEQ ID NO: 5099 - protein, 36 aa, Anaeromyces robustus; identical to SEQ ID NO: 2561
  Cellulose docking domain, dockering

SEQ ID NO: 5100 - protein, 37 aa, Anaeromyces robustus; identical to SEQ ID NO: 4880
  Cellulose docking domain, dockering

SEQ ID NO: 5101 - protein, 41 aa, Anaeromyces robustus; identical to SEQ ID NO: 4881
  Cellulose docking domain, dockering

SEQ ID NO: 5102 - protein, 35 aa, Anaeromyces robustus; identical to SEQ ID NO: 4903
  Cellulose docking domain, dockering

SEQ ID NO: 5103 - protein, 38 aa, Anaeromyces robustus; identical to SEQ ID NO: 4901
  Cellulose docking domain, dockering

SEQ ID NO: 5104 - protein, 39 aa, Anaeromyces robustus; identical to SEQ ID NO: 4902
  Cellulose docking domain, dockering

SEQ ID NO: 5105 - protein, 38 aa, Anaeromyces robustus; identical to SEQ ID NO: 4901
  Cellulose docking domain, dockering

SEQ ID NO: 5106 - protein, 35 aa, Anaeromyces robustus; identical to SEQ ID NO: 4912
  Cellulose docking domain, dockering

SEQ ID NO: 5107 - protein, 32 aa, Anaeromyces robustus; identical to SEQ ID NO: 4913
  Cellulose docking domain, dockering

SEQ ID NO: 5108 - protein, 30 aa, Anaeromyces robustus; identical to SEQ ID NO: 4907
  Cellulose docking domain, dockering

SEQ ID NO: 5109 - protein, 39 aa, Anaeromyces robustus; identical to SEQ ID NO: 4908
  Cellulose docking domain, dockering

SEQ ID NO: 5110 - protein, 39 aa, Anaeromyces robustus; identical to SEQ ID NO: 4906
  Cellulose docking domain, dockering

SEQ ID NO: 5111 - protein, 39 aa, Anaeromyces robustus; identical to SEQ ID NO: 4975
  Cellulose docking domain, dockering

SEQ ID NO: 5112 - protein, 39 aa, Anaeromyces robustus; identical to SEQ ID NO: 4976
  Cellulose docking domain, dockering

SEQ ID NO: 5113 - protein, 32 aa, Anaeromyces robustus; identical to SEQ ID NO: 4938
  Cellulose docking domain, dockering

SEQ ID NO: 5114 - protein, 32 aa, Anaeromyces robustus; identical to SEQ ID NO: 4937
  Cellulose docking domain, dockering

SEQ ID NO: 5115 - protein, 39 aa, Anaeromyces robustus
  Cellulose docking domain, dockering
DCWSSAMGYACCNGCDVAYEDGSGKWGIENNNWCGIDDK

SEQ ID NO: 5116 - protein, 34 aa, Anaeromyces robustus; identical to SEQ ID NO: 4921
  Cellulose docking domain, dockering

SEQ ID NO: 5117 - protein, 31 aa, Anaeromyces robustus; identical to SEQ ID NO: 4923
  Cellulose docking domain, dockering

SEQ ID NO: 5118 - protein, 38 aa, Anaeromyces robustus; identical to SEQ ID NO: 4922
  Cellulose docking domain, dockering

SEQ ID NO: 5119 - protein, 35 aa, Anaeromyces robustus
  Cellulose docking domain, dockering
NNTGYDCCADSNARVQYTDESGNWSIENGNWCLIC

SEQ ID NO: 5120 - protein, 36 aa, Anaeromyces robustus
  Cellulose docking domain, dockering
QCFSISLGYPCCQGNTVVYTDKDGKWGLENGQWCGI

SEQ ID NO: 5121 - protein, 32 aa, Anaeromyces robustus
  Cellulose docking domain, dockering
QTKNGYPVCKTTTTVVYTDSDKWGVENGEWCI

SEQ ID NO: 5122 - protein, 40 aa, Anaeromyces robustus; identical to SEQ ID NO: 4936
  Cellulose docking domain, dockering

SEQ ID NO: 5123 - protein, 38 aa, Anaeromyces robustus
  Cellulose docking domain, dockering
SCWSESFGYPCCHSCYVFETDDNGKWGFENNTWCGIQS

SEQ ID NO: 5124 - protein, 40 aa, Anaeromyces robustus; identical to SEQ ID NO: 4857
  Cellulose docking domain, dockering

SEQ ID NO: 5125 - protein, 37 aa, Anaeromyces robustus; identical to SEQ ID NO: 4858
  Cellulose docking domain, dockering

SEQ ID NO: 5126 - protein, 40 aa, Anaeromyces robustus; identical to SEQ ID NO: 4929
  Cellulose docking domain, dockering

SEQ ID NO: 5127 - protein, 32 aa, Anaeromyces robustus; identical to SEQ ID NO: 4928
  Cellulose docking domain, dockering

SEQ ID NO: 5128 - protein, 42 aa, Anaeromyces robustus
  Cellulose docking domain, dockering
NCWAKSLGYNCCSTSSCRTAQFSDADGQWDVENGNWCGITTS

SEQ ID NO: 5129 - protein, 38 aa, Anaeromyces robustus
  Cellulose docking domain, dockering
TCWSKSLGYPCCTSKSTVIFTDSNGQWGIENGNWCGKP

SEQ ID NO: 5130 - protein, 33 aa, Anaeromyces robustus; identical to SEQ ID NO: 4955
  Cellulose docking domain, dockering

SEQ ID NO: 5131 - protein, 31 aa, Anaeromyces robustus; identical to SEQ ID NO: 4954
  Cellulose docking domain, dockering

SEQ ID NO: 5132 - protein, 39 aa, Anaeromyces robustus
  Cellulose docking domain, dockering
ACFSEASGYGCCKGCDVAYTDDSGDWGVENGEWCGIPDS

SEQ ID NO: 5133 - protein, 38 aa, Anaeromyces robustus
  Cellulose docking domain, dockering
CSSKILAQGYPCCSDNCTVVYTDDDGTWGVENGQWCGC

SEQ ID NO: 5134 - protein, 32 aa, Anaeromyces robustus
  Cellulose docking domain, dockering
GAQGYPCCKTATQVYFSDNDGDWSVENNNWCL

SEQ ID NO: 5135 - protein, 40 aa, Anaeromyces robustus; identical to SEQ ID NO: 4946
  Cellulose docking domain, dockering

SEQ ID NO: 5136 - protein, 39 aa, Anaeromyces robustus
  Cellulose docking domain, dockering
KCWSLEYGYKCCSHCKVLLKDDYGKWGEMNGQWCGIDPA

SEQ ID NO: 5137 - protein, 35 aa, Anaeromyces robustus
  Cellulose docking domain, dockering
HPDYECCKGCQTILTDDEGNWGAENNQWCFIDENK

SEQ ID NO: 5138 - protein, 39 aa, Anaeromyces robustus; identical to SEQ ID NO: 4854
  Cellulose docking domain, dockering

SEQ ID NO: 5139 - protein, 39 aa, Anaeromyces robustus; identical to SEQ ID NO: 4926
  Cellulose docking domain, dockering

SEQ ID NO: 5140 - protein, 40 aa, Anaeromyces robustus; identical to SEQ ID NO: 4927
  Cellulose docking domain, dockering

SEQ ID NO: 5141 - protein, 36 aa, Anaeromyces robustus; identical to SEQ ID NO: 4925
  Cellulose docking domain, dockering

SEQ ID NO: 5142 - protein, 33 aa, Anaeromyces robustus; identical to SEQ ID NO: 4958
  Cellulose docking domain, dockering

SEQ ID NO: 5143 - protein, 34 aa, Anaeromyces robustus
  Cellulose docking domain, dockering
DPDYPCCEGCKVIQEDKDGKWGYENNEWCGIKDS

SEQ ID NO: 5144 - protein, 33 aa, Anaeromyces robustus
  Cellulose docking domain, dockering
QAFSDCSTCRVVTVDDNIYWGVENNDWCIVPST

SEQ ID NO: 5145 - protein, 35 aa, Anaeromyces robustus
  Cellulose docking domain, dockering
NPDYPCCNNCEVIYVDSDGEWGVENNNWCAIDASQ

SEQ ID NO: 5146 - protein, 33 aa, Anaeromyces robustus
  Cellulose docking domain, dockering
DYPFCKGCTVVYTDNDGDWGVENNDWCLIKKSN

SEQ ID NO: 5147 - protein, 40 aa, Anaeromyces robustus; identical to SEQ ID NO: 4930
  Cellulose docking domain, dockering

SEQ ID NO: 5148 - protein, 41 aa, Anaeromyces robustus
  Cellulose docking domain, dockering
CSSSIRSLGYSCCSDNNCTVYATDESGKWGIENDQWCGISN

SEQ ID NO: 5149 - protein, 37 aa, Anaeromyces robustus
  Cellulose docking domain, dockering
ERKNLGYKCCQYCDIVYTDSDGDYGFENNDWCGIADS

SEQ ID NO: 5150 - protein, 33 aa, Anaeromyces robustus
  Cellulose docking domain, dockering
HPNGYPYCKQTNEVVFTDTVEWGVENGAWCVIK

SEQ ID NO: 5151 - protein, 38 aa, Anaeromyces robustus; identical to SEQ ID NO: 4943
  Cellulose docking domain, dockering

SEQ ID NO: 5152 - protein, 38 aa, Anaeromyces robustus; identical to SEQ ID NO: 4933
  Cellulose docking domain, dockering

SEQ ID NO: 5153 - protein, 37 aa, Anaeromyces robustus; identical to SEQ ID NO: 2395
  Cellulose docking domain, dockering

SEQ ID NO: 5154 - protein, 41 aa, Anaeromyces robustus
  Cellulose docking domain, dockering
CSAKIQAQGYKCCSDKNCTIFYSDNDGNWGVENGQWCGCEN

SEQ ID NO: 5155 - protein, 31 aa, Anaeromyces robustus
  Cellulose docking domain, dockering
VVGYPCCKTNKQVYFTDNDGNWSFENNNWCL

SEQ ID NO: 5156 - protein, 36 aa, Anaeromyces robustus
  Cellulose docking domain, dockering
KLLGYNCCRNTCSISYKDDDGNWGIENGNWCGIPFT

SEQ ID NO: 5157 - protein, 33 aa, Anaeromyces robustus
  Cellulose docking domain, dockering
PDYQCCRNTRVSQYTDSAGNEWGIENNQWCGII

SEQ ID NO: 5158 - protein, 40 aa, Anaeromyces robustus; identical to SEQ ID NO: 4963
  Cellulose docking domain, dockering

SEQ ID NO: 5159 - protein, 39 aa, Anaeromyces robustus
  Cellulose docking domain, dockering
TCFSIDMGYPCCSTCTVVYTDSDGGWGVENGEWCGVPSS

SEQ ID NO: 5160 - protein, 40 aa, Anaeromyces robustus; identical to SEQ ID NO: 5000
  Cellulose docking domain, dockering

SEQ ID NO: 5161 - protein, 37 aa, Anaeromyces robustus; identical to SEQ ID NO: 5001
  Cellulose docking domain, dockering

SEQ ID NO: 5162 - protein, 32 aa, Anaeromyces robustus; identical to SEQ ID NO: 4941
  Cellulose docking domain, dockering

SEQ ID NO: 5163 - protein, 39 aa, Anaeromyces robustus
  Cellulose docking domain, dockering
DCWSQPLGYPCCSSSNKNVIYTDKDGDWGIENNGWCGFL

SEQ ID NO: 5164 - protein, 40 aa, Anaeromyces robustus; identical to SEQ ID NO: 4942
  Cellulose docking domain, dockering

SEQ ID NO: 5165 - protein, 40 aa, Anaeromyces robustus
  Cellulose docking domain, dockering
KCWSEKLGYPCCKNSNTDVAYIDADGKWGVENHEWCGITK

SEQ ID NO: 5166 - protein, 40 aa, Anaeromyces robustus
  Cellulose docking domain, dockering
PTSITSQGYRCCKENNCSVIETDDSGKWGIEDGQWCGISN

SEQ ID NO: 5167 - protein, 36 aa, Anaeromyces robustus
  Cellulose docking domain, dockering
AILKKGYKCCSNDCFVIYTDDDGTWGIENDQWCGCD

SEQ ID NO: 5168 - protein, 39 aa, Anaeromyces robustus; identical to SEQ ID NO: 4995
  Cellulose docking domain, dockering

SEQ ID NO: 5169 - protein, 38 aa, Anaeromyces robustus
  Cellulose docking domain, dockering
ECWSEKLGYPCCSYSKNVLFEDNDGQWSVENDNWCGIP

SEQ ID NO: 5170 - protein, 32 aa, Anaeromyces robustus; identical to SEQ ID NO: 2629
  Cellulose docking domain, dockering

SEQ ID NO: 5171 - protein, 39 aa, Anaeromyces robustus; identical to SEQ ID NO: 4984
  Cellulose docking domain, dockering

SEQ ID NO: 5172 - protein, 31 aa, Anaeromyces robustus
  Cellulose docking domain, dockering
VVGYPCCKNNKTVYFTDNSGKWSVENNNWCL

SEQ ID NO: 5173 - protein, 41 aa, Anaeromyces robustus
  Cellulose docking domain, dockering
CSSKITKQGYKCCSSKSCIVYYTDNAGNWGVENGEWCGCAN

SEQ ID NO: 5174 - protein, 40 aa, Anaeromyces robustus
  Cellulose docking domain, dockering
ECWSESKGYSCCKGCDIYTNDRFGAWGIEKGKWCGIKPQK

SEQ ID NO: 5175 - protein, 40 aa, Anaeromyces robustus
  Cellulose docking domain, dockering
NCWASWYGYECCKGCKVKGEDSKGKWGWENGKWCGIDEDY

SEQ ID NO: 5176 - protein, 40 aa, Anaeromyces robustus
  Cellulose docking domain, dockering
KCWSSGYGYPCCDNCKVYYIDKIGEWGIKNGNWCGIVDRK

SEQ ID NO: 5177 - protein, 34 aa, Anaeromyces robustus
  Cellulose docking domain, dockering
NGYPCCKKCDVYSYDRHGYWGIEKGNWCGIDTIK

SEQ ID NO: 5178 - protein, 40 aa, Anaeromyces robustus
  Cellulose docking domain, dockering
ECWASWYGYGCCKGCKVRATDSTGEWGYENGKWCGIDTEY

SEQ ID NO: 5179 - protein, 40 aa, Anaeromyces robustus
  Cellulose docking domain, dockering
TCWSEELGYKCCKGCKVYSVDRNGSWGVEDKQWCGIDSEV

SEQ ID NO: 5180 - protein, 37 aa, Anaeromyces robustus
  Cellulose docking domain, dockering
CKSTSYPCCSSCNLPVYSTDSDGKWSIENNNWCNFNT

SEQ ID NO: 5181 - protein, 36 aa, Anaeromyces robustus
  Cellulose docking domain, dockering
DCFAIKLGYKCCNNEAVVLVDNDGKWGYNGDWCGIG

SEQ ID NO: 5182 - protein, 31 aa, Anaeromyces robustus
  Cellulose docking domain, dockering
PCCSHCNGIYHDNDGDWGVENNQWCLIKSSK

SEQ ID NO: 5183 - protein, 40 aa, Anaeromyces robustus
  Cellulose docking domain, dockering
KCWSEELGYKCCKYCNVLMEDENGQWGFENDEWCGITESA

SEQ ID NO: 5184 - protein, 34 aa, Anaeromyces robustus
  Cellulose docking domain, dockering
SPTYPCCSKCNVVYTDDEGDWGFEKGAWCSIREN

SEQ ID NO: 5185 - protein, 39 aa, Anaeromyces robustus; identical to SEQ ID NO: 4978
  Cellulose docking domain, dockering

SEQ ID NO: 5186 - protein, 39 aa, Anaeromyces robustus
  Cellulose docking domain, dockering
SCWSKASGFNCCKNCGKVYFIDKDGEWGIENNDWCGMPK

SEQ ID NO: 5187 - protein, 36 aa, Anaeromyces robustus
  Cellulose docking domain, dockering
AQGYPCCAYSCDSLFTDSDGEWSVENENWCLINKSI

SEQ ID NO: 5188 - protein, 36 aa, Anaeromyces robustus
  Cellulose docking domain, dockering
SCWSIAFGYGCCEGCTTVYTDKDGAWGYENENWCGI

SEQ ID NO: 5189 - protein, 33 aa, Anaeromyces robustus
  Cellulose docking domain, dockering
AQYSNCKSTCEVSYEDDQKWGIENGQWCILPES

SEQ ID NO: 5190 - protein, 39 aa, Anaeromyces robustus
  Cellulose docking domain, dockering
TCWSEALGYPCCKGCESATTDSSGAWGIEDGEWCGIPST

SEQ ID NO: 5191 - protein, 32 aa, Anaeromyces robustus
  Cellulose docking domain, dockering
DYPCCSKGAEVIYTDESGDWGLENGDWCFIKE

SEQ ID NO: 5192 - protein, 39 aa, Anaeromyces robustus
  Cellulose docking domain, dockering
SCWSAPYGYPCCKSCEIHTTNDSGKWGMENNKWCGIPDS

SEQ ID NO: 5193 - protein, 38 aa, Anaeromyces robustus
  Cellulose docking domain, dockering
SCTGIEDGYPCCKTCNAIYNDEQGPWGYENNEWCGIKT

SEQ ID NO: 5194 - protein, 40 aa, Anaeromyces robustus
  Cellulose docking domain, dockering
SCWASSLGYGCCNGCEAITVDGSGKWGFENGAWCGIIDSK

SEQ ID NO: 5195 - protein, 35 aa, Anaeromyces robustus
  Cellulose docking domain, dockering
SKDGYPCCKGCSVTYEDASGKWGVENNAWCGIDSS

SEQ ID NO: 5196 - protein, 38 aa, Anaeromyces robustus
  Cellulose docking domain, dockering
TCWSTAEGYPCCTPGTAVTLTDSKGKWGIENGSWCGIT

SEQ ID NO: 5197 - protein, 26 aa, Anaeromyces robustus
  Cellulose docking domain, dockering
TCWSTAEGYPCCTPGTAVTLTDSKGK

SEQ ID NO: 5198 - protein, 35 aa, Anaeromyces robustus; identical to SEQ ID NO: 5195
  Cellulose docking domain, dockering

SEQ ID NO: 5199 - protein, 38 aa, Anaeromyces robustus
  Cellulose docking domain, dockering
SCWSTKLGYPCCSAGNKDVYYNDDDGLWGVENGDWCGI

SEQ ID NO: 5200 - protein, 40 aa, Anaeromyces robustus
  Cellulose docking domain, dockering
SCFSIALGYPCCKGNTIVYTDDSGDWGVENNNWCGIPSNS

SEQ ID NO: 5201 - protein, 32 aa, Anaeromyces robustus; identical to SEQ ID NO: 4999
  Cellulose docking domain, dockering

SEQ ID NO: 5202 - protein, 39 aa, Anaeromyces robustus
  Cellulose docking domain, dockering
CPGYELGYECCNNNEVVYTDETGDWGLTDTVPPQWCSIG

SEQ ID NO: 5203 - protein, 32 aa, Anaeromyces robustus; identical to SEQ ID NO: 4997
  Cellulose docking domain, dockering

SEQ ID NO: 5204 - protein, 32 aa, Anaeromyces robustus
  Cellulose docking domain, dockering
HAYDECKGCTVYYEDDTKWGVENDDWCIIPSS

SEQ ID NO: 5205 - protein, 31 aa, Anaeromyces robustus
  Cellulose docking domain, dockering
YPCCEGCNVYEETEEGKWGIENDAWCGVKDS

SEQ ID NO: 5206 - protein, 38 aa, Anaeromyces robustus
  Cellulose docking domain, dockering
ECWSERLGYPCCTSGAQVYYSDADGQWGVENNNWCGII

SEQ ID NO: 5207 - protein, 38 aa, Anaeromyces robustus
  Cellulose docking domain, dockering
DCFATKLGYPCCTTTTEVVYTDSDGQWGVENNNWCGIN

SEQ ID NO: 5208 - protein, 29 aa, Anaeromyces robustus
  Cellulose docking domain, dockering
DYPCCSSSVGVSFVDESGSWGIENGNWCG

SEQ ID NO: 5209 - protein, 39 aa, Anaeromyces robustus
  Cellulose docking domain, dockering
SCFAAKLNYKCCSTCDVAYTDGDGDWGFENNEWCGIKDS

SEQ ID NO: 5210 - protein, 40 aa, Anaeromyces robustus
  Cellulose docking domain, dockering
DCFSIQMGYPCCNGCDVVSFDDGKPWGIENGNWCGIKENV

SEQ ID NO: 5211 - protein, 32 aa, Anaeromyces robustus
  Cellulose docking domain, dockering
KLNPSYPCCEGDVVVYVDKDGEWGVENGNWCG

SEQ ID NO: 5212 - protein, 40 aa, Anaeromyces robustus
  Cellulose docking domain, dockering
SCFSVALGYPCCESSCNVYYTDNDGEWGVENGNWCGLKDS

SEQ ID NO: 5213 - protein, 32 aa, Anaeromyces robustus
  Cellulose docking domain, dockering
PDYPCCEGTDVVYSDASGDWGVENGQWCGIVE

SEQ ID NO: 5214 - protein, 32 aa, Anaeromyces robustus
  Cellulose docking domain, dockering
PDYPCCKEGAEAIYEDAQGKWGVENGQWCGIE

SEQ ID NO: 5215 - protein, 38 aa, Anaeromyces robustus
  Cellulose docking domain, dockering
TCWALQYGYTCCEDDTIVYTDELGDWGVEDGQWCGIKK

SEQ ID NO: 5216 - protein, 40 aa, Anaeromyces robustus
  Cellulose docking domain, dockering
SCWSTALNYPCCKNSCDVVISDDDGDWGVEDGQWCGITKN

SEQ ID NO: 5217 - protein, 38 aa, Anaeromyces robustus
  Cellulose docking domain, dockering
ECAVLSQGYPCCQQTCDVVYVDDYKWGVENGEWCGIKD

SEQ ID NO: 5218 - protein, 33 aa, Anaeromyces robustus
  Cellulose docking domain, dockering
PDYKCCSGCDIVYTDNHNWGVENGEWCGIDDKQ

SEQ ID NO: 5219 - protein, 44 aa, Anaeromyces robustus
  Cellulose docking domain, dockering
DCWAKALGFKCCDEENPQVYYTDESGDWSVEFKGDSGEWCGIIK

SEQ ID NO: 5220 - protein, 37 aa, Anaeromyces robustus
  Cellulose docking domain, dockering
SCWANRLGYQCCKGNTVVYTDSDGKWGVENGNWCGIV

SEQ ID NO: 5221 - protein, 38 aa, Anaeromyces robustus
  Cellulose docking domain, dockering
TCWSQPLGYPCCQSTSDVIYTDSDGDWGVENGNWCGII

SEQ ID NO: 5222 - protein, 40 aa, Anaeromyces robustus
  Cellulose docking domain, dockering
TCWSKSIGYECCKETTTAIYNDENGKWGYENGDWCGIVEE

SEQ ID NO: 5223 - protein, 32 aa, Anaeromyces robustus
  Cellulose docking domain, dockering
EYPCCKGCDISYSDESGDWGVENGKWCGIKAS

SEQ ID NO: 5224 - protein, 35 aa, Anaeromyces robustus
  Cellulose docking domain, dockering
SEPDYPCCNSCNIVETDALGRWGVENGEWCGIPDS

SEQ ID NO: 5225 - protein, 15 aa, Anaeromyces robustus
  Cellulose docking domain, dockering
DGDWGVENGNWCGIP

SEQ ID NO: 5226 - protein, 33 aa, Anaeromyces robustus; identical to SEQ ID NO: 2684
  Cellulose docking domain, dockering
  MOD_RES (24)..(24): Any amino acid

SEQ ID NO: 5227 - protein, 37 aa, Anaeromyces robustus
  Cellulose docking domain, dockering
DCFSERLGYPCCVYTTKVEYVDADGDWGVENGNWCGM

SEQ ID NO: 5228 - protein, 39 aa, Anaeromyces robustus
  Cellulose docking domain, dockering
ECFSVSLGYPCCQKTTKVVVVDEDGEWGAEDGNWCGLKA

SEQ ID NO: 5229 - protein, 37 aa, Anaeromyces robustus
  Cellulose docking domain, dockering
ECFSIKLGYPCCQNTSDVILTDEDGKWGAENGDWCGI

SEQ ID NO: 5230 - protein, 39 aa, Anaeromyces robustus
  Cellulose docking domain, dockering
ECWAEKLGYGCCKTTTTPILEDDDGKWGVENDEWCGIME

SEQ ID NO: 5231 - protein, 39 aa, Anaeromyces robustus
  Cellulose docking domain, dockering
SCWAEKLGYKCCEKCTVTFNDENGDWGFENGDWCGILRT

SEQ ID NO: 5232 - protein, 34 aa, Anaeromyces robustus
  Cellulose docking domain, dockering
SPNYPCCSECKTIYTDQTGDWGYENEQWCGIKDS

SEQ ID NO: 5233 - protein, 26 aa, Anaeromyces robustus
  Cellulose docking domain, dockering
EEKDMGYPCCDNCEVVTTDSDGGWGY

SEQ ID NO: 5234 - protein, 40 aa, Anaeromyces robustus
  Cellulose docking domain, dockering
ECWAEALGYSCCKGCDIIYSDNDGDWSVENDEWCGIISKK

SEQ ID NO: 5235 - protein, 39 aa, Anaeromyces robustus
  Cellulose docking domain, dockering
ECWSEASGYSCCKLKTTTVEFTDSKGNKYGIENGHFCGI

SEQ ID NO: 5236 - protein, 32 aa, Anaeromyces robustus
  Cellulose docking domain, dockering
DEYKCCKKCNVVYRDDYDWGVENNDWCSIPHS

SEQ ID NO: 5237 - protein, 38 aa, Anaeromyces robustus; identical to SEQ ID NO: 5002
  Cellulose docking domain, dockering

SEQ ID NO: 5238 - protein, 40 aa, Anaeromyces robustus; identical to SEQ ID NO: 4971
  Cellulose docking domain, dockering

SEQ ID NO: 5239 - protein, 38 aa, Anaeromyces robustus
  Cellulose docking domain, dockering
CSASIKNQGFSCCEGCTKYYSDNDGDWGFENDNWCGLN

SEQ ID NO: 5240 - protein, 34 aa, Anaeromyces robustus
  Cellulose docking domain, dockering
EPEFKCCTKSCTVYFTDDHEWGVEDDEWCGIPES

SEQ ID NO: 5241 - protein, 33 aa, Anaeromyces robustus
  Cellulose docking domain, dockering
SFYPCCETCNVFSEEDGDRWGVENDQWCSIKYK

SEQ ID NO: 5242 - protein, 31 aa, Anaeromyces robustus
  Cellulose docking domain, dockering
YPCCEGCDVYEESEEGKWGIEKDAWCGIKDS

SEQ ID NO: 5243 - protein, 32 aa, Anaeromyces robustus
  Cellulose docking domain, dockering
HAYEECKGCVVYYEDDTKWGIENDDWCIIPSS

SEQ ID NO: 5244 - protein, 35 aa, Anaeromyces robustus
  Cellulose docking domain, dockering
HPNYPCCNGCEVVYTDVDGEWGVENGAWCLLQPSK

SEQ ID NO: 5245 - protein, 39 aa, Anaeromyces robustus
  Cellulose docking domain, dockering
TCNTESLGYPCCTHCNTIYTDADGDWGIENGDWCGINNS

SEQ ID NO: 5246 - protein, 36 aa, Anaeromyces robustus
  Cellulose docking domain, dockering
QCWSEKLGYQCCKSTKDIVFTDNDGNWGIENGNWCG

SEQ ID NO: 5247 - protein, 39 aa, Anaeromyces robustus
  Cellulose docking domain, dockering
TCFSVNLGFKCCSGCNVIYTDNDGDWGVENDQWCGIPDE

SEQ ID NO: 5248 - protein, 38 aa, Anaeromyces robustus
  Cellulose docking domain, dockering
ECWSLRLGYNCCKYRSTPVYEKDNDGLWGIEDNDWCGV

SEQ ID NO: 5249 - protein, 33 aa, Anaeromyces robustus
  Cellulose docking domain, dockering
TQDYPCCKGCIVKYVDDYEWGVEENNWCYIPFK

SEQ ID NO: 5250 - protein, 38 aa, Anaeromyces robustus
  Cellulose docking domain, dockering
SLKRNHPYPCCEKSETEVVYISSNGDEWGTENGDWCGI

SEQ ID NO: 5251 - protein, 33 aa, Anaeromyces robustus
  Cellulose docking domain, dockering
ENGYPYCKTTTLVLYTDDLEWGYENDEWCVMRE

SEQ ID NO: 5252 - protein, 37 aa, Anaeromyces robustus
  Cellulose docking domain, dockering
EEKNLGYPCCKYCVIVESDSYGDYGIENDQWCSIPYS

SEQ ID NO: 5253 - protein, 37 aa, Anaeromyces robustus
  Cellulose docking domain, dockering
CKCWSEKLGYPCCTNKNVVHVDENGQWGIENDMWCGI

SEQ ID NO: 5254 - protein, 39 aa, Anaeromyces robustus
  Cellulose docking domain, dockering
SCWATKLGYKCCTAKCPEVSYVDQDGAWGVENGNWCGIT

SEQ ID NO: 5255 - protein, 41 aa, Anaeromyces robustus; identical to SEQ ID NO: 4910
  Cellulose docking domain, dockering

SEQ ID NO: 5256 - protein, 40 aa, Anaeromyces robustus; identical to SEQ ID NO: 4911
  Cellulose docking domain, dockering

SEQ ID NO: 5257 - protein, 41 aa, Anaeromyces robustus; identical to SEQ ID NO: 4910
  Cellulose docking domain, dockering

SEQ ID NO: 5258 - protein, 39 aa, Anaeromyces robustus; identical to SEQ ID NO: 5004
  Cellulose docking domain, dockering

SEQ ID NO: 5259 - protein, 40 aa, Anaeromyces robustus
  Cellulose docking domain, dockering
QCWAEAKGYKCCQDPNTPVYETDSDGKWGIEDGQWCGIVE

SEQ ID NO: 5260 - protein, 37 aa, Anaeromyces robustus
  Cellulose docking domain, dockering
KCWAKRYGYECCSENAKYYKEDSNGPWGKEPDGTKCG

SEQ ID NO: 5261 - protein, 37 aa, Anaeromyces robustus
  Cellulose docking domain, dockering
NWSKKLGYPLCKESKEVLYEDKDGKWGYENDWCGIAE

SEQ ID NO: 5262 - protein, 40 aa, Anaeromyces robustus
  Cellulose docking domain, dockering
PCWSESLGYSCCTFCSPIIYSDESGDWGVINNEWCGIPSN

SEQ ID NO: 5263 - protein, 37 aa, Anaeromyces robustus
  Cellulose docking domain, dockering
GAQGYPCCTKSCDSIYQDGDGDWSLENNNWCLIDKSI

SEQ ID NO: 5264 - protein, 39 aa, Anaeromyces robustus
  Cellulose docking domain, dockering
SCWANALGYRCCKSSQEVIATDKDGEWSVEDGHWCGIPK

SEQ ID NO: 5265 - protein, 39 aa, Anaeromyces robustus
  Cellulose docking domain, dockering
GCFAEDLGFKCCSYSTMEVYSDSNGKWSVESGEWCGIDP

SEQ ID NO: 5266 - protein, 36 aa, Anaeromyces robustus
  Cellulose docking domain, dockering
KCWAEKLGYSCCQGCHVIYVDNDGEWGVENNAWCGI

SEQ ID NO: 5267 - protein, 38 aa, Anaeromyces robustus
  Cellulose docking domain, dockering
ECFSIKLGYPCCQGNTVYYIDNDGQWGFENNNWCGMKN

SEQ ID NO: 5268 - protein, 38 aa, Anaeromyces robustus
  Cellulose docking domain, dockering
NCTGKLQGYQCCLTCNVVTTDADGRWGIENGNWCGIKN

SEQ ID NO: 5269 - protein, 40 aa, Anaeromyces robustus
  Cellulose docking domain, dockering
TCWSEKLGYPCCNNSCYAFTTDNDGEWGYEDGHWCGVPAS

SEQ ID NO: 5270 - protein, 40 aa, Anaeromyces robustus
  Cellulose docking domain, dockering
KCWSKKYGYECCQGCTAYEVDEFGKWGYEKNHWCGIIEEN

SEQ ID NO: 5271 - protein, 39 aa, Anaeromyces robustus
  Cellulose docking domain, dockering
KCWSKKLGFPCCKTNKVVLFEDADGKWGVENDNWCGIIE

SEQ ID NO: 5272 - protein, 41 aa, Anaeromyces robustus
  Cellulose docking domain, dockering
NCWAYELGYQCCFETGPEKARQQDQYGKWGVEWGRWCGIIE

SEQ ID NO: 5273 - protein, 32 aa, Anaeromyces robustus
  Cellulose docking domain, dockering
DFPCCSPDNTYIFFSDNNGDWGIENGDWCGII

SEQ ID NO: 5274 - protein, 39 aa, Anaeromyces robustus
  Cellulose docking domain, dockering
NCWSAVFGYPCCKYTKVVRSTDENGDWGIEYDHWCGIPK

SEQ ID NO: 5275 - protein, 20 aa, Anaeromyces robustus
  Cellulose docking domain, dockering
FTDDNGKWSVENDEWCGIVE

SEQ ID NO: 5276 - protein, 39 aa, Anaeromyces robustus
  Cellulose docking domain, dockering
ECWSLKQGYSCCQNKNTKVSYISKNGDEWGVENNEWCGI

SEQ ID NO: 5277 - protein, 31 aa, Anaeromyces robustus
  Cellulose docking domain, dockering
KYKCCQQCKVRYTDDYEWGVEDGEWCSIPYS

SEQ ID NO: 5278 - protein, 38 aa, Anaeromyces robustus
  Cellulose docking domain, dockering
GCWSEKFNIPCCQSTSEVVRKTYDGEWGIEDGKWCSIG

SEQ ID NO: 5279 - protein, 31 aa, Anaeromyces robustus
  Cellulose docking domain, dockering
EYKCCESCNVVYTDFQKWGYEDNEWCSIPYS

SEQ ID NO: 5280 - protein, 39 aa, Anaeromyces robustus
  Cellulose docking domain, dockering
NCFSIKFGYPCCNGCDVIYVDEDGKWSVENDSWCGLMDS

SEQ ID NO: 5281 - protein, 34 aa, Anaeromyces robustus
  Cellulose docking domain, dockering
TQYACCKDPNTYISTTDKTGDWGIEGNYWCLIDK

SEQ ID NO: 5282 - protein, 38 aa, Anaeromyces robustus
  Cellulose docking domain, dockering
DCWALKYNYKCCIETTDVIETDEHGDWGVENGDWCGIV

SEQ ID NO: 5283 - protein, 38 aa, Anaeromyces robustus
  Cellulose docking domain, dockering
SCWSKKLGYECCAGCSVAYTDSDGEWGLENDQWCGIPD

SEQ ID NO: 5284 - protein, 35 aa, Anaeromyces robustus
  Cellulose docking domain, dockering
CKSSGYPCCENCEVIYDDGNTKWGLLNNDWCALSD

SEQ ID NO: 5285 - protein, 31 aa, Anaeromyces robustus
  Cellulose docking domain, dockering
EYDCCSGCTVVDQGDGKIKWGVENNQWCIIK

SEQ ID NO: 5286 - protein, 40 aa, Anaeromyces robustus
  Cellulose docking domain, dockering
NCWSEVFGYKCCSEDNKNAEYTDINGKWGVENDDWCGIIE

SEQ ID NO: 5287 - protein, 42 aa, Anaeromyces robustus
  Cellulose docking domain, dockering
ECWADSYGYPCCSEGILALPFYTDEKGNKWGRENDDYCGIIE

SEQ ID NO: 5288 - protein, 38 aa, Anaeromyces robustus
  Cellulose docking domain, dockering
YIGNGYPCCKDQRPEKKTYLDMDGDWTIEDGKWCGFYD

SEQ ID NO: 5289 - protein, 33 aa, Anaeromyces robustus
  Cellulose docking domain, dockering
NAYSNCQGCRVILEENGVKWGVENNDWCIVSSS

SEQ ID NO: 5290 - protein, 33 aa, Anaeromyces robustus
  Cellulose docking domain, dockering
EYMCCKGCDVVEDDGETTKWGIENNEWCGLKES

SEQ ID NO: 5291 - protein, 39 aa, Anaeromyces robustus
  Cellulose docking domain, dockering
TCWSKGLGYDCCKGCNTIYTDGSGDWGVENNQWCGIPES

SEQ ID NO: 5292 - protein, 39 aa, Anaeromyces robustus
  Cellulose docking domain, dockering
SCWSNALGYECCKGCTVIETDGSGDWGVENNQWCGIPSS

SEQ ID NO: 5293 - protein, 41 aa, Anaeromyces robustus
  Cellulose docking domain, dockering
ECWAEPLGFKCCSSPDAQIFTSDSDGDWAIENGQWCGIMKK

SEQ ID NO: 5294 - protein, 36 aa, Anaeromyces robustus
  Cellulose docking domain, dockering
KCWAEALGFECCKTSVPVTYTDKDGKWGVENGNWCG

SEQ ID NO: 5295 - protein, 40 aa, Anaeromyces robustus
  Cellulose docking domain, dockering
TCWAEPLGFKCCTGTDPKIVYSDEDGDWAIENGQWCGVVK

SEQ ID NO: 5296 - protein, 37 aa, Anaeromyces robustus
  Cellulose docking domain, dockering
CFALSDGYECCFDNEVVYEDETGKWGINENGEWCGVE

SEQ ID NO: 5297 - protein, 34 aa, Anaeromyces robustus
  Cellulose docking domain, dockering
TSKYRCCTECNVSYTGSDGHTWGIEYGQWCSIPY

SEQ ID NO: 5298 - protein, 40 aa, Anaeromyces robustus
  Cellulose docking domain, dockering
ECWASFEGYPCCEDPKTPVSYVNKQTRVEYGFEHGEWCGI

SEQ ID NO: 5299 - protein, 40 aa, Anaeromyces robustus
  Cellulose docking domain, dockering
SCWAEAQGYQCCKNICDVVYTDDSGSWGLENNDWCGIPNT

SEQ ID NO: 5300 - protein, 40 aa, Anaeromyces robustus
  Cellulose docking domain, dockering
SCWSQRLGFPCCNGCDVAYTDSDGDWGLENNNWCGIDKSK

SEQ ID NO: 5301 - protein, 38 aa, Anaeromyces robustus
  Cellulose docking domain, dockering
QCFSQSLGFPCCNNCNVVYTDESGSWGVENNDWCGIKS

SEQ ID NO: 5302 - protein, 40 aa, Anaeromyces robustus
  Cellulose docking domain, dockering
TCWAEALSYKCCSNPNTPVVLTDKSGEWGIENGNWCGIIP

SEQ ID NO: 5303 - protein, 40 aa, Anaeromyces robustus
  Cellulose docking domain, dockering
TCWAEALHYKCCTDPDTPVKGTDEFGKWGKENGEWCGIYL

SEQ ID NO: 5304 - protein, 39 aa, Anaeromyces robustus
  Cellulose docking domain, dockering
HCWSLDHGYKCCKGENVEVEYTDSKGQWGKENGEWCGII

SEQ ID NO: 5305 - protein, 40 aa, Anaeromyces robustus
  Cellulose docking domain, dockering
TCWAEALNYKCCSDPDTPVRSTDEFGKWGRENHEWCGINH

SEQ ID NO: 5306 - protein, 40 aa, Anaeromyces robustus
  Cellulose docking domain, dockering
HCWSLNYGYKCCKDENVEVITTDIYGQWGKEDGKWCGIIP

SEQ ID NO: 5307 - protein, 33 aa, Anaeromyces robustus
  Cellulose docking domain, dockering
ISDKYQCCKDKKSIYTDDDGDWAYTNGEWCGVK

SEQ ID NO: 5308 - protein, 40 aa, Anaeromyces robustus
  Cellulose docking domain, dockering
HCWALDYGYKCCKGENVIPIVTESVGQWGIENDDWCGIVS

SEQ ID NO: 5309 - protein, 39 aa, Anaeromyces robustus
  Cellulose docking domain, dockering
TCWAEKISYKCCTDPDTVVIETDELGKWGVENGDWCGII

SEQ ID NO: 5310 - protein, 36 aa, Anaeromyces robustus
  Cellulose docking domain, dockering
TCFSVAMGYPCCKSNKVVYTDESGEWGIENNEWCGI

SEQ ID NO: 5311 - protein, 39 aa, Anaeromyces robustus
  Cellulose docking domain, dockering
SCFSIAQGYPCCQSCKIKYTDESGKWGVEDGKWCGIKDS

SEQ ID NO: 5312 - protein, 32 aa, Anaeromyces robustus
  Cellulose docking domain, dockering
TLTPSYPCCKGDKVIYTDKNGDWGVENGEWCG

SEQ ID NO: 5313 - protein, 41 aa, Anaeromyces robustus
  Cellulose docking domain, dockering
FCWSESLGVRCCKGAENIVEYMDQEGWWGVTEEDQWCGIVK

SEQ ID NO: 5314 - protein, 36 aa, Anaeromyces robustus
  Cellulose docking domain, dockering
NCWSEKLGYKCCTGCTVITTDESGKWGIENNEWCGI

SEQ ID NO: 5315 - protein, 30 aa, Anaeromyces robustus
  Cellulose docking domain, dockering
EYPCCKGNVVYYTDEQGAWGVENGNWCGIS

SEQ ID NO: 5316 - protein, 35 aa, Anaeromyces robustus
  Cellulose docking domain, dockering
AIIQEGYECCPIGCKIYYTDSSGDWGIYNNDWCGC

SEQ ID NO: 5317 - protein, 36 aa, Anaeromyces robustus
  Cellulose docking domain, dockering
ILYGYPCCSECSTVYYQDKNGEWGIENGDWCGMPYK

SEQ ID NO: 5318 - protein, 34 aa, Anaeromyces robustus
  Cellulose docking domain, dockering
PYSYPYCKTTKDVAFDDGTLQWGVENDNWCIIKG

SEQ ID NO: 5319 - protein, 37 aa, Anaeromyces robustus
  Cellulose docking domain, dockering
CNCWAQKLGYPCCTEKVIYYSDGDGDWGFENNQWCGI

SEQ ID NO: 5320 - protein, 40 aa, Anaeromyces robustus
  Cellulose docking domain, dockering
CPSSITNQGYPCCSSCSTVYYVDNDGKWGVENNDWCGIPT

SEQ ID NO: 5321 - protein, 38 aa, Anaeromyces robustus
  Cellulose docking domain, dockering
CSSRIIALGYKCCSVGCQVSYTDNDGDWSFENGQWCGC

SEQ ID NO: 5322 - protein, 33 aa, Anaeromyces robustus
  Cellulose docking domain, dockering
GTGYACCIFSDTTLASQDPSGDWGKEGDKFCLF

SEQ ID NO: 5323 - protein, 38 aa, Anaeromyces robustus; identical to SEQ ID NO: 2789
  Cellulose docking domain, dockering

SEQ ID NO: 5324 - protein, 35 aa, Anaeromyces robustus
  Cellulose docking domain, dockering
KGTGYPCCIFDTTKAVLHDDDGDWGIEGDYCLIVN

SEQ ID NO: 5325 - protein, 38 aa, Anaeromyces robustus
  Cellulose docking domain, dockering
EKGYRCCKNPNTKIEYISKNGDEWGVENNDWCGITNSQ

SEQ ID NO: 5326 - protein, 34 aa, Anaeromyces robustus
  Cellulose docking domain, dockering
NGYKCCSNINAEVQYHDKDGDWSIENNEWCIIKK

SEQ ID NO: 5327 - protein, 37 aa, Anaeromyces robustus
  Cellulose docking domain, dockering
TCKAEEIGYSCCKKQKEVIYTDDLGEWGIENGDWCGI

SEQ ID NO: 5328 - protein, 29 aa, Anaeromyces robustus
  Cellulose docking domain, dockering
GDYPVCKTTSEIVFTDTEKWGIENNEWCI

SEQ ID NO: 5329 - protein, 41 aa, Anaeromyces robustus
  Cellulose docking domain, dockering
DCWAEKLGFKCCDPKKCRDVVYFDYDGQWDVENGEWCGITT

SEQ ID NO: 5330 - protein, 40 aa, Anaeromyces robustus
  Cellulose docking domain, dockering
DCWGDEMGYSCCKEKKTIVMYTDISGRWSVEGGKWCAIKN

SEQ ID NO: 5331 - protein, 39 aa, Anaeromyces robustus
  Cellulose docking domain, dockering
CSANITKQGYKCCPSGCIVIYTDDDGTWGINNGEWCGCN

SEQ ID NO: 5332 - protein, 41 aa, Anaeromyces robustus
  Cellulose docking domain, dockering
CPATITAQNYPCCSDNNCDVYAVDESGKWGLENNQWCGISN

SEQ ID NO: 5333 - protein, 36 aa, Anaeromyces robustus
  Cellulose docking domain, dockering
NILNKGYSCCPYKCEVIYTDEDGTWGIYDNEWCGCN

SEQ ID NO: 5334 - protein, 37 aa, Anaeromyces robustus
  Cellulose docking domain, dockering
KCFSTVLGYPCCKNTKEVSVKDCDGSWGVENDQWCGI

SEQ ID NO: 5335 - protein, 38 aa, Anaeromyces robustus
  Cellulose docking domain, dockering
NCWAKKLGYSCCASKCAEVYYTDANGKWGVENGKWCGI

SEQ ID NO: 5336 - protein, 32 aa, Anaeromyces robustus
  Cellulose docking domain, dockering
GTYKCCKSCDIVYTDTTNWGVENNEWCSIPYK

SEQ ID NO: 5337 - protein, 40 aa, Anaeromyces robustus
  Cellulose docking domain, dockering
SCWSTEYGYPCCVLKSTVIEYDDVENGRKYGIEDNKICGI

SEQ ID NO: 5338 - protein, 32 aa, Anaeromyces robustus
  Cellulose docking domain, dockering
YKCCKNTCKVYLEDSSDYWNIENGEWCSIPYS

SEQ ID NO: 5339 - protein, 33 aa, Anaeromyces robustus
  Cellulose docking domain, dockering
SDYECCVYPDTQLVYYTNVGPWGIENNSWCLIN

SEQ ID NO: 5340 - protein, 39 aa, Anaeromyces robustus
  Cellulose docking domain, dockering
DCWSEKLGYKCCSTCGQVYYADKDGEWGYTNDWCGIPSS

SEQ ID NO: 5341 - protein, 39 aa, Anaeromyces robustus
  Cellulose docking domain, dockering
CTAPDGYKCCKESCAYYDKDSKGYWGLENKEWCYIDTAK

SEQ ID NO: 5342 - protein, 40 aa, Anaeromyces robustus
  Cellulose docking domain, dockering
ECWAESKGYPCCDPSNTNVIMEDIDGKWGLENNQWCGIVN

SEQ ID NO: 5343 - protein, 39 aa, Anaeromyces robustus
  Cellulose docking domain, dockering
ECWATKLGYPCCTGKYPGISYTDKDGSWSIENGQWCGVI

SEQ ID NO: 5344 - protein, 34 aa, Anaeromyces robustus
  Cellulose docking domain, dockering
KGTGYPCCILESTAFRTYDRSGYWGLEGGNYCLI

SEQ ID NO: 5345 - protein, 39 aa, Anaeromyces robustus
  Cellulose docking domain, dockering
TCWSEALGYPCCRDPRTTIYKTEKDGKEWGIESNQWCGI

SEQ ID NO: 5346 - protein, 42 aa, Anaeromyces robustus
  Cellulose docking domain, dockering
CPGYAEGYNCCKNCEVTYISHSDPNKKWGFFSNGDWCSIPYS

SEQ ID NO: 5347 - protein, 35 aa, Anaeromyces robustus
  Cellulose docking domain, dockering
KKLGYPCCSNKNGKVVYKDENGNWGVEHHQWCIFS

SEQ ID NO: 5348 - protein, 39 aa, Anaeromyces robustus
  Cellulose docking domain, dockering
KCWSNELGYPCCKSTTEIVFTDDRGNWGVEDKKWCGVIV

SEQ ID NO: 5349 - protein, 40 aa, Anaeromyces robustus
  Cellulose docking domain, dockering
GCWSEKLGYKCCNTCFPVYYTDNDGQWGIVNGEWCGIAKT

SEQ ID NO: 5350 - protein, 36 aa, Anaeromyces robustus
  Cellulose docking domain, dockering
GCSSKSLGYPCCKSSNNVVSTDELGKWGVENGDWCY

SEQ ID NO: 5351 - protein, 39 aa, Anaeromyces robustus
  Cellulose docking domain, dockering
ECWAKILGSPCCLTTKVVVEIDDFGKWGIENGAWCGIIE

SEQ ID NO: 5352 - protein, 39 aa, Anaeromyces robustus
  Cellulose docking domain, dockering
ECWSLKLGSPCCTTTKEIIYTDDDGNWGIENNDWCGIID

SEQ ID NO: 5353 - protein, 38 aa, Anaeromyces robustus
  Cellulose docking domain, dockering
CWALKLGSPCCTFNKDVYAIDENGKWSVENGIWCGIID

SEQ ID NO: 5354 - protein, 39 aa, Anaeromyces robustus
  Cellulose docking domain, dockering
DCWAHAYNYPCCKTTKNLVETDSKGNKWGIEDNHWCGLS

SEQ ID NO: 5355 - protein, 39 aa, Anaeromyces robustus
  Cellulose docking domain, dockering
ACFSEKLGYPCCDSSNDIVLYTDSDGKWGVENNNWCGIT

SEQ ID NO: 5356 - protein, 34 aa, Anaeromyces robustus
  Cellulose docking domain, dockering
KGTGYACCIMNNGYIDSTDSDGTWGIEGGRYCLY

SEQ ID NO: 5357 - protein, 35 aa, Anaeromyces robustus
  Cellulose docking domain, dockering
KVEGYKCCKSTCTVSYTDSNKWGVENNEWCIIPYE

SEQ ID NO: 5358 - protein, 42 aa, Anaeromyces robustus
  Cellulose docking domain, dockering
NCWSMKEGYPCCKDENTPVSYISKSTGKEWGMENGEWCGIVD

SEQ ID NO: 5359 - protein, 34 aa, Anaeromyces robustus
  Cellulose docking domain, dockering
ESTGYKCCPDAEVKATYGNSTWGKVNGEWCGIKQ

SEQ ID NO: 5360 - protein, 39 aa, Anaeromyces robustus
  Cellulose docking domain, dockering
ECWSLKQGYPCCVKTEIVVIEDENGKWGVENDDWCGIIV

SEQ ID NO: 5361 - protein, 39 aa, Anaeromyces robustus
  Cellulose docking domain, dockering
KCPFNQYGYPCCKTTKVVVSIDSMGKWGIEDGQWCGIVD

SEQ ID NO: 5362 - protein, 34 aa, Anaeromyces robustus
  Cellulose docking domain, dockering
ERTYPCCSPDNKKIKYVDQHGQWGFENGDWCGMP

SEQ ID NO: 5363 - protein, 40 aa, Anaeromyces robustus
  Cellulose docking domain, dockering
KCLSELVGYPCCAKGIKAVYAKDEYGEWGYDFKKNEWCGL

SEQ ID NO: 5364 - protein, 38 aa, Anaeromyces robustus
  Cellulose docking domain, dockering
TCWSEKYGYPCCNGCYVFETDDDGQWGYENNQWCGIQS

SEQ ID NO: 5365 - protein, 39 aa, Anaeromyces robustus
  Cellulose docking domain, dockering
NCRSALEGYMCCKTPGKVFYRDDFGSWGVENEQWCGFNE

SEQ ID NO: 5366 - protein, 38 aa, Anaeromyces robustus
  Cellulose docking domain, dockering
DCWAEKLGYPCCKGNEPKVEFTDEHGDWSIENGQKCGI

SEQ ID NO: 5367 - protein, 32 aa, Anaeromyces robustus
  Cellulose docking domain, dockering
QLYEICKEQHDVVFKDNEGVWSVENGNWCSIQ

SEQ ID NO: 5368 - protein, 40 aa, Anaeromyces robustus
  Cellulose docking domain, dockering
CPFESIGYKCCSKTCLVLYSDESGDWGVEDDEWCGINPSL

SEQ ID NO: 5369 - protein, 39 aa, Anaeromyces robustus
  Cellulose docking domain, dockering
NCFSEKLGYPCCSGCTVIYSDNDGEWGIENDNWCGIKNN

SEQ ID NO: 5370 - protein, 38 aa, Anaeromyces robustus
  Cellulose docking domain, dockering
CWADELGFSCCENDNGKIVIGDNNGLWGKENGNWCGFK

SEQ ID NO: 5371 - protein, 39 aa, Anaeromyces robustus
  Cellulose docking domain, dockering
ECWSTEYGYPCCSSPDTKSNSTDSKGTWGFENGDWCGLA

SEQ ID NO: 5372 - protein, 38 aa, Anaeromyces robustus
  Cellulose docking domain, dockering
EPDYPCCSNCDVEIIWNDENKGQSWSIENNNWCGILQS

SEQ ID NO: 5373 - protein, 38 aa, Anaeromyces robustus
  Cellulose docking domain, dockering
NCWSLALGYPCCQSSTKVHTTDENGSWGIENNQWCGIP

SEQ ID NO: 5374 - protein, 32 aa, Anaeromyces robustus
  Cellulose docking domain, dockering
YKCCKKSCKVYREEDGDYWNVENNEWCSLPYS

SEQ ID NO: 5375 - protein, 41 aa, Anaeromyces robustus
  Cellulose docking domain, dockering
KCMAEVIGYPCCTSKQTKVYRTDEYGDWSFNFLKLQWCGLT

SEQ ID NO: 5376 - protein, 41 aa, Anaeromyces robustus
  Cellulose docking domain, dockering
CWARKLGYPCCEKCPLLTLYKDSNGSWGLEHLRWCGIIESQ

SEQ ID NO: 5377 - protein, 40 aa, Anaeromyces robustus
  Cellulose docking domain, dockering
KCLSELVGYPCCAKGIKVVYAKDEYGEWGYDFKKNEWCGL

SEQ ID NO: 5378 - protein, 37 aa, Anaeromyces robustus
  Cellulose docking domain, dockering
ECWSEKYGYPCCNGCYVFETDDDGQWGYENNQWCGIQ

SEQ ID NO: 5379 - protein, 38 aa, Anaeromyces robustus
  Cellulose docking domain, dockering
ECWSLNLGFPCCEETKNVIEIDDNGKWGIENNNWCGIT

SEQ ID NO: 5380 - protein, 32 aa, Anaeromyces robustus
  Cellulose docking domain, dockering
GSPCCENNDGEILYYDMDGDWGYENGLWCAYH

SEQ ID NO: 5381 - protein, 30 aa, Anaeromyces robustus
  Cellulose docking domain, dockering
YGYKCCPNATALLEDDYGSWSIVNGEWCGV

SEQ ID NO: 5382 - protein, 39 aa, Anaeromyces robustus
  Cellulose docking domain, dockering
ECWSLNLGFPCCEETQNVIEIDDNGKWGIENNNWCGIIE

SEQ ID NO: 5383 - protein, 36 aa, Anaeromyces robustus; identical to SEQ ID NO: 2846
  Cellulose docking domain, dockering

SEQ ID NO: 5384 - protein, 39 aa, Anaeromyces robustus
  Cellulose docking domain, dockering
QCWSLRLGSPCCTTTDKVIYTDGDGNWGYENNEWCGIIN

SEQ ID NO: 5385 - protein, 40 aa, Anaeromyces robustus
  Cellulose docking domain, dockering
YCWAKAKGYPCCDNDEGYLQSYDMDGKWGYENNAWCGYKS

SEQ ID NO: 5386 - protein, 36 aa, Anaeromyces robustus
  Cellulose docking domain, dockering
KCWSMPLGYPCCVGNDVYKKDVYGLWGIENDNYCGI

SEQ ID NO: 5387 - protein, 33 aa, Anaeromyces robustus
  Cellulose docking domain, dockering
VVGYACCKSSDVKIYETDEYGKWGVEDNKWCLL

SEQ ID NO: 5388 - protein, 39 aa, Anaeromyces robustus
  Cellulose docking domain, dockering
CSSRIQNQGFKCCSNNCMVFYSDGDGNWGYEDGEWCGCN

SEQ ID NO: 5389 - protein, 37 aa, Anaeromyces robustus
  Cellulose docking domain, dockering
ECFSIALGYPCCQGNEIVYTDNDGNWGVENGQWCGIG

SEQ ID NO: 5390 - protein, 38 aa, Anaeromyces robustus
  Cellulose docking domain, dockering
SCFSEALGYPCCTSCNVIFTDSDGKWGVENNSWCGIKD

SEQ ID NO: 5391 - protein, 33 aa, Anaeromyces robustus
  Cellulose docking domain, dockering
GTSYSCCVFRDTAVYSTDETGTWGIEGNRWCLF

SEQ ID NO: 5392 - protein, 44 aa, Anaeromyces robustus
  Cellulose docking domain, dockering
NCWSIAEGYPCCQNPETTVSYTSKSSGKLWGVENNEWCGITEKQ

SEQ ID NO: 5393 - protein, 37 aa, Anaeromyces robustus
  Cellulose docking domain, dockering
QCVKNKNGLKCCSTCEIALTDATGRYGYENGEWCNTP

SEQ ID NO: 5394 - protein, 39 aa, Anaeromyces robustus
  Cellulose docking domain, dockering
CWSRSIGFVCCDKCNVLYVDEQGKWGIEDEYWCGINPDK

SEQ ID NO: 5395 - protein, 29 aa, Anaeromyces robustus
  Cellulose docking domain, dockering
GDYPVCKETTKVMYTDTEKWGVEHGEWCV

SEQ ID NO: 5396 - protein, 35 aa, Anaeromyces robustus
  Cellulose docking domain, dockering
ASSGYPCCTDPHTKVVYHDDEGDWGVENKEWCFIP

SEQ ID NO: 5397 - protein, 36 aa, Anaeromyces robustus
  Cellulose docking domain, dockering
CNSEKYGYSCCKTEQKVVYTDSQGDWGIEDGNWCGI

SEQ ID NO: 5398 - protein, 39 aa, Anaeromyces robustus
  Cellulose docking domain, dockering
SMQRQGYPCCEENNCNIYFKDGDGDWGISSKSNWCGIRF

SEQ ID NO: 5399 - protein, 40 aa, Anaeromyces robustus
  Cellulose docking domain, dockering
CSSKFNQMGYKCCNGCNVILTDETGKWGVENNEWCGIRND

SEQ ID NO: 5400 - protein, 42 aa, Anaeromyces robustus
  Cellulose docking domain, dockering
CSAKFTSLGYSCCSDNNCVVYTVDSTGNWGVENNEWCGISNS

SEQ ID NO: 5401 - protein, 39 aa, Anaeromyces robustus
  Cellulose docking domain, dockering
CSSRILNQGYKCCSDNCKVVYTDEDGTWGYENNQWCGCT

SEQ ID NO: 5402 - protein, 40 aa, Anaeromyces robustus
  Cellulose docking domain, dockering
KCLAELIGYPCCPSIIKTIYAQDEYGDWGFDFKKQEWCGL

SEQ ID NO: 5403 - protein, 38 aa, Anaeromyces robustus
  Cellulose docking domain, dockering
ECWSKIYGYSCCKRCMVYETDENGKWGFESNQWCGIPA

SEQ ID NO: 5404 - protein, 39 aa, Anaeromyces robustus
  Cellulose docking domain, dockering
NCWAYQYGFQCCFYYTKPYLVDERGSWSFERGNWCGIVT

SEQ ID NO: 5405 - protein, 38 aa, Anaeromyces robustus
  Cellulose docking domain, dockering
KCWSKKLGYSCCEESKEVFYEDQDGKWGYEKDNWCGIV

SEQ ID NO: 5406 - protein, 37 aa, Anaeromyces robustus; identical to SEQ ID NO: 2869
  Cellulose docking domain, dockering

SEQ ID NO: 5407 - protein, 32 aa, Anaeromyces robustus
  Cellulose docking domain, dockering
NYEPCCKNDNTPVVYFNMDGRLGMEDGHYCGI

SEQ ID NO: 5408 - protein, 42 aa, Anaeromyces robustus
  Cellulose docking domain, dockering
TCWGEKLGYPCCPPTNCRIFYVNDDGDWGFHNYKWCAIDKKI

SEQ ID NO: 5409 - protein, 42 aa, Anaeromyces robustus
  Cellulose docking domain, dockering
DCWAKKFGYECCPPGVCEVSQKDENGSWGAYDGEWCGIIPSY

SEQ ID NO: 5410 - protein, 37 aa, Anaeromyces robustus
  Cellulose docking domain, dockering
SSLLGYPCCKRCDSFLLTDDDANWGVENSEWCIIKSN

SEQ ID NO: 5411 - protein, 42 aa, Anaeromyces robustus
  Cellulose docking domain, dockering
NCWSESLGYKCCSAGCKAASIFVDSDGSWGVENGEWCGIPSE

SEQ ID NO: 5412 - protein, 40 aa, Anaeromyces robustus
  Cellulose docking domain, dockering
TCWSEEIGYPCCKTCDVFYEEDYEGRWGIENDNWCGIPTS

SEQ ID NO: 5413 - protein, 40 aa, Anaeromyces robustus
  Cellulose docking domain, dockering
NCLAELLGYSCCSPENTNIYLQDENGDWGFDFEKNEWCGL

SEQ ID NO: 5414 - protein, 40 aa, Anaeromyces robustus
  Cellulose docking domain, dockering
SCWSEALGFPCCSTNGCQVVYYTDTDGKWGVENNNWCGIT

SEQ ID NO: 5415 - protein, 38 aa, Anaeromyces robustus
  Cellulose docking domain, dockering
KCWSERLGYPCCKGNVVVTSDADGDWGVENNNWCGIIK

SEQ ID NO: 5416 - protein, 39 aa, Anaeromyces robustus
  Cellulose docking domain, dockering
KCNTYNNKYPCCSHCNVYHTDTDGSRWGIENDNWCSINY

SEQ ID NO: 5417 - protein, 41 aa, Anaeromyces robustus
  Cellulose docking domain, dockering
ACWSETLGYTCCKSSCDIYYTDQDGHWGVENNQWCGIIDSV

SEQ ID NO: 5418 - protein, 38 aa, Anaeromyces robustus
  Cellulose docking domain, dockering
DCWAEKLGYPCCKGNEPKVEFTDEYGDWSTEDGQKCGI

SEQ ID NO: 5419 - protein, 36 aa, Anaeromyces robustus
  Cellulose docking domain, dockering
WSFLLGYDTCKEQHEYIYKDNEGLWSIEGGKWCGIQ

SEQ ID NO: 5420 - protein, 39 aa, Anaeromyces robustus
  Cellulose docking domain, dockering
SCRSALNGYMCCKNTDKVVYRDDFGSWGIENGQWCGFNE

SEQ ID NO: 5421 - protein, 33 aa, Anaeromyces robustus
  Cellulose docking domain, dockering
NYPYCDGCETNYTDKDGGWYYTNKTWCKVNEKK

SEQ ID NO: 5422 - protein, 32 aa, Anaeromyces robustus
  Cellulose docking domain, dockering
KGYQCCKDSSTKVISEDNDGTWGIENKKWCLI

SEQ ID NO: 5423 - protein, 39 aa, Anaeromyces robustus
  Cellulose docking domain, dockering
ECWSEVFGYPCCQSCYVYEEDENGKWGYDFNESTWCGIQ

SEQ ID NO: 5424 - protein, 39 aa, Anaeromyces robustus
  Cellulose docking domain, dockering
NCWVEQFGYPCCQKNAKVYAVDDEGEWGYNFKTQEWCGI

SEQ ID NO: 5425 - protein, 37 aa, Anaeromyces robustus
  Cellulose docking domain, dockering
CPDYATGYSCCYECNIVYNDGHDWGIENGKWCSIPYS

SEQ ID NO: 5426 - protein, 33 aa, Anaeromyces robustus
  Cellulose docking domain, dockering
HAYDECKSCLTYYIEDGVKWGVENNDWCLIPSK

SEQ ID NO: 5427 - protein, 33 aa, Anaeromyces robustus
  Cellulose docking domain, dockering
PQYPCCEGCTVIEETAEGKWGIENSQWCGIKDS

SEQ ID NO: 5428 - protein, 37 aa, Anaeromyces robustus
  Cellulose docking domain, dockering
CWAGQLGYPYCTSTTREVYKDNDGKWGIENNNWCCLS

SEQ ID NO: 5429 - protein, 39 aa, Anaeromyces robustus
  Cellulose docking domain, dockering
DCFSSKLGYPCCSSTKVIVYQDNSGNWGVENNEWCGIDT

SEQ ID NO: 5430 - protein, 36 aa, Anaeromyces robustus
  Cellulose docking domain, dockering
SCFATRLGYECCNYNEILYSDDDGDWGVNDNRWCGI

SEQ ID NO: 5431 - protein, 32 aa, Anaeromyces robustus
  Cellulose docking domain, dockering
DYKCCQKCEIVYEDKEGKWGVENDEWCVIGRN

SEQ ID NO: 5432 - protein, 40 aa, Anaeromyces robustus
  Cellulose docking domain, dockering
CWSLKYGYPCCKENATTIRKDKNGEWGFDFQKFRWCGIQK

SEQ ID NO: 5433 - protein, 39 aa, Anaeromyces robustus
  Cellulose docking domain, dockering
ECFSLSEGYPCCEFCMVEQCIDNNLWGVENGQWCGIADS

SEQ ID NO: 5434 - protein, 38 aa, Anaeromyces robustus
  Cellulose docking domain, dockering
TCFSLEIGFPCCREGEKIVYSDDDGYWGVENGEWCGID

SEQ ID NO: 5435 - protein, 39 aa, Anaeromyces robustus
  Cellulose docking domain, dockering
ECFSIKLGYPCCKKTTEVAHIDKNGKWGIEDNHWCGLKD

SEQ ID NO: 5436 - protein, 37 aa, Anaeromyces robustus
  Cellulose docking domain, dockering
NCWSEQYGYPCCDSNDVFLEDELGKWGVMNGSWCGIP

SEQ ID NO: 5437 - protein, 36 aa, Anaeromyces robustus
  Cellulose docking domain, dockering
FEDLGFKCCSHCVHIYDDKTGLWGVEANEWCGISDE

SEQ ID NO: 5438 - protein, 40 aa, Anaeromyces robustus
  Cellulose docking domain, dockering
SCWSSSLGYPCCSNSNTLVEYTDNDGEWGIENGIWCGIAK

SEQ ID NO: 5439 - protein, 40 aa, Anaeromyces robustus
  Cellulose docking domain, dockering
CSSFAANSNYPVCKYNSIVYFTDEDGQWSVENDNWCLIPS

SEQ ID NO: 5440 - protein, 35 aa, Anaeromyces robustus
  Cellulose docking domain, dockering
CHNSGYSCCVSTTKVLSGDGTGDWGVEFNDWCLFD

SEQ ID NO: 5441 - protein, 39 aa, Anaeromyces robustus
  Cellulose docking domain, dockering
ECWSLSQGYPCCVNKNTKIKSTSSNGDEWGVENNEWCGI

SEQ ID NO: 5442 - protein, 40 aa, Anaeromyces robustus
  Cellulose docking domain, dockering
ECWSIAEGFPCCENKDTIISIIQSGRGWGVENGHWCGIID

SEQ ID NO: 5443 - protein, 33 aa, Anaeromyces robustus
  Cellulose docking domain, dockering
SGDYPCCKGCDVYYTDDVEWGIENGDWCSIPYE

SEQ ID NO: 5444 - protein, 33 aa, Anaeromyces robustus
  Cellulose docking domain, dockering
GNYKCCKSSCSVYYVDTEEWGYEHGEWCLIPYK

SEQ ID NO: 5445 - protein, 40 aa, Anaeromyces robustus
  Cellulose docking domain, dockering
NCWAELIGYPCCPSHNKIVYSHDENGDWGYDYKTNQWCGI

SEQ ID NO: 5446 - protein, 37 aa, Anaeromyces robustus
  Cellulose docking domain, dockering
ECWSEIYGYSCCKGCIIYESDENGKWGYKNGKWCGIP

SEQ ID NO: 5447 - protein, 38 aa, Anaeromyces robustus
  Cellulose docking domain, dockering
CFSIALGYPCCKKCDVLFVDKDGQWGVEDNEWCGIKDN

SEQ ID NO: 5448 - protein, 36 aa, Anaeromyces robustus
  Cellulose docking domain, dockering
QALNPSYPCCKSNKVVYTDKSGDWGVENDQWCGIGN

SEQ ID NO: 5449 - protein, 40 aa, Anaeromyces robustus
  Cellulose docking domain, dockering
KCWSEEQGFPCCKGCVVIYTENNEKWGIENDEWCGINKTT

SEQ ID NO: 5450 - protein, 34 aa, Anaeromyces robustus
  Cellulose docking domain, dockering
KNNEYECCETCTEYFSDNTGRYGYENEKWCLLKD

SEQ ID NO: 5451 - protein, 40 aa, Anaeromyces robustus
  Cellulose docking domain, dockering
CPSHILDQGYNCCIHDCIYITSDENRNWSVENGEWCWCIM

SEQ ID NO: 5452 - protein, 41 aa, Anaeromyces robustus
  Cellulose docking domain, dockering
TCWSIQYGYECCKDPETPVYSKDSTGEWGIENNNWCGIVKN

SEQ ID NO: 5453 - protein, 39 aa, Anaeromyces robustus
  Cellulose docking domain, dockering
KCWSERLGYPCCTTTKKAYTEDSDGKWGVEKGNYCGIIE

SEQ ID NO: 5454 - protein, 38 aa, Anaeromyces robustus
  Cellulose docking domain, dockering
DCWSIPLGYPCCSNSYLPTLFTDDNGEWSVENDNWCGK

SEQ ID NO: 5455 - protein, 34 aa, Anaeromyces robustus
  Cellulose docking domain, dockering
YGVYDCCPKNQPVYEENSLGKWGKINGNYCGIKT

SEQ ID NO: 5456 - protein, 38 aa, Anaeromyces robustus
  Cellulose docking domain, dockering
DCFSVKLGYPCCQYTDEVVYVDDDGDWGVENNDWCGIG

SEQ ID NO: 5457 - protein, 35 aa, Anaeromyces robustus
  Cellulose docking domain, dockering
EVEGYECCEGCTVESEEDNIKWGYENRNWCVIPYS

SEQ ID NO: 5458 - protein, 37 aa, Anaeromyces robustus
  Cellulose docking domain, dockering
ATRFGYPCCDTCKLEYIDDFGDWGFENDNWCGLSQNL

SEQ ID NO: 5459 - protein, 35 aa, Anaeromyces robustus
  Cellulose docking domain, dockering
MKLGYRCCNTCKIEYIDNNIKYGYENGEWCGIPDE

SEQ ID NO: 5460 - protein, 40 aa, Anaeromyces robustus
  Cellulose docking domain, dockering
KCWAEFIGYPCCSEKDTYVYDTDSYGDWSYDFDNNEWCGL

SEQ ID NO: 5461 - protein, 37 aa, Anaeromyces robustus
  Cellulose docking domain, dockering
ECWSEIIGYSCCKGCTVYEEDEFGKWGYEKNHWCGIQ

SEQ ID NO: 5462 - protein, 39 aa, Anaeromyces robustus
  Cellulose docking domain, dockering
NCWSAKLGYPCCKSTTAVEMSDSDGQWGVENGQWCGIQK

SEQ ID NO: 5463 - protein, 39 aa, Anaeromyces robustus
  Cellulose docking domain, dockering
DCWATRLGFPCCEYSAQVFYTDNDGKWSIENGEWCGIIE

SEQ ID NO: 5464 - protein, 40 aa, Anaeromyces robustus
  Cellulose docking domain, dockering
NCWATSIGYGCCNHCNSIYTDGTYRWGVQNNQWCGIIESN

SEQ ID NO: 5465 - protein, 40 aa, Anaeromyces robustus
  Cellulose docking domain, dockering
NCWSVSEGYKCCSLGTKTVLTDSKGKWGIENNEWCGISNE

SEQ ID NO: 5466 - protein, 34 aa, Anaeromyces robustus
  Cellulose docking domain, dockering
ATKLGYSCCKTCMVALTDKDGKWGVENKNWCGID

SEQ ID NO: 5467 - protein, 42 aa, Anaeromyces robustus
  Cellulose docking domain, dockering
ECWAEKYGRPCCKNSSTKNVYTDNEGMWGVENDEWCGITEEQ

SEQ ID NO: 5468 - protein, 42 aa, Anaeromyces robustus
  Cellulose docking domain, dockering
QCWAKKYGRPCCLNNLTEYVYADDEGMWGVENGDWCGINEHQ

SEQ ID NO: 5469 - protein, 39 aa, Anaeromyces robustus
  Cellulose docking domain, dockering
QCWAQKLGFKCCKNPNATVINIDEDGTKWGIENDEWCGI

SEQ ID NO: 5470 - protein, 36 aa, Anaeromyces robustus
  Cellulose docking domain, dockering
KSDKEEDNCCKTNTEILYSDDEGAWGYENDAWCIVR

SEQ ID NO: 5471 - protein, 40 aa, Anaeromyces robustus
  Cellulose docking domain, dockering
ECKSEKLGIECCKDISTENVYTDDEGIKFGVEKDDWCGIK

SEQ ID NO: 5472 - protein, 34 aa, Anaeromyces robustus
  Cellulose docking domain, dockering
PQYPCCNGCDVKYTDNSGKWGVENNNWCKIDNNK

SEQ ID NO: 5473 - protein, 39 aa, Anaeromyces robustus
  Cellulose docking domain, dockering
SCKFEALGYPCCSHCESIYEDNSGKWGVENNNWCGIPDT

SEQ ID NO: 5474 - protein, 41 aa, Anaeromyces robustus
  Cellulose docking domain, dockering
ECWADYFNYKCCSTRNCRSVYLTDANGDWDIEDGQWCGITS

SEQ ID NO: 5475 - protein, 40 aa, Anaeromyces robustus
  Cellulose docking domain, dockering
NCWSLKLGYSCCTSNDIILYSDADGDWSVENNEWCGIIKS

SEQ ID NO: 5476 - protein, 36 aa, Anaeromyces robustus
  Cellulose docking domain, dockering
CWSKELGFPCCKGCLVIDKDEFGSWGFELDHWCGIQ

SEQ ID NO: 5477 - protein, 40 aa, Anaeromyces robustus
  Cellulose docking domain, dockering
QCWAQLVGYGCCPEGTNDVYYEDSYGKWGIDLKKEDWCGI

SEQ ID NO: 5478 - protein, 39 aa, Anaeromyces robustus
  Cellulose docking domain, dockering
KCWASSLGFPCCQSSKVVFRTDSNGSWSLENDEWCGIIE

SEQ ID NO: 5479 - protein, 39 aa, Anaeromyces robustus
  Cellulose docking domain, dockering
TCWAELLGYNCCKSKNPIIIQTDEYGDWAIEKNNWCGIP

SEQ ID NO: 5480 - protein, 40 aa, Anaeromyces robustus
  Cellulose docking domain, dockering
QCWAKKIGYECCKDSKTYAIYTDNNGDWGVENEVWCGIIK

SEQ ID NO: 5481 - protein, 38 aa, Anaeromyces robustus
  Cellulose docking domain, dockering
KCWAKSLGYKCCTSKAIYYASDNDGDWGIENDDWCGII

SEQ ID NO: 5482 - protein, 36 aa, Anaeromyces robustus
  Cellulose docking domain, dockering
TCWAYQLGYKCCKKSETVEVESGYGVLNGNWCGIID

SEQ ID NO: 5483 - protein, 40 aa, Anaeromyces robustus
  Cellulose docking domain, dockering
QCWAKSLGFKCCTGSKPTVVYTDNNGDWSVENDEWCGIIK

SEQ ID NO: 5484 - protein, 39 aa, Anaeromyces robustus
  Cellulose docking domain, dockering
NCWANKFGYDCCKSGAVFVTKDSDGDWGIENGKWCGFKK

SEQ ID NO: 5485 - protein, 37 aa, Anaeromyces robustus
  Cellulose docking domain, dockering
CWSEVFGYPCCESCYVFETDDYGKWGYENNHWCGIQS

SEQ ID NO: 5486 - protein, 40 aa, Anaeromyces robustus
  Cellulose docking domain, dockering
KCWAELAGYPCCSERIKIVYEHDEFGDWGYDYSIKQWCGL

SEQ ID NO: 5487 - protein, 39 aa, Anaeromyces robustus
  Cellulose docking domain, dockering
KCLSELIGYACCSLELTSIYTDEYGDWGYDYNKKEWCGL

SEQ ID NO: 5488 - protein, 39 aa, Anaeromyces robustus
  Cellulose docking domain, dockering
NCWSKKLGYSCCEGCKVIETDEDGSWGYEYDQWCGIPLN

SEQ ID NO: 5489 - protein, 39 aa, Anaeromyces robustus
  Cellulose docking domain, dockering
SCWSLKLGYKCCKKNNMVVLTDTDGQWGVENNEWCGIVH

SEQ ID NO: 5490 - protein, 39 aa, Anaeromyces robustus
  Cellulose docking domain, dockering
SCWSKKLGYNCCTAKCPKEYYIDNDGSWGVENNNWCGIL

SEQ ID NO: 5491 - protein, 39 aa, Anaeromyces robustus
  Cellulose docking domain, dockering
ECPGKKYGYSCCETCDVYLNDDEGKWGVDNGYWCSIKTS

SEQ ID NO: 5492 - protein, 40 aa, Anaeromyces robustus
  Cellulose docking domain, dockering
ECWSEALGYKCCSKGCDAVVLAIDNSGNWGAENGEWCGIQ

SEQ ID NO: 5493 - protein, 40 aa, Anaeromyces robustus
  Cellulose docking domain, dockering
KCWSELIGYPCCSEGNNMVYGHDDYGDWSYDFQKNIWCGL

SEQ ID NO: 5494 - protein, 38 aa, Anaeromyces robustus
  Cellulose docking domain, dockering
ECWSEIFGYPCCKSCVVYEEEEEYGKWGYENNQWCGIQ

SEQ ID NO: 5495 - protein, 38 aa, Anaeromyces robustus
  Cellulose docking domain, dockering
NCWANNLGYPCCSSNTQVIYTDNNGQWGVENNNWCGIV

SEQ ID NO: 5496 - protein, 39 aa, Anaeromyces robustus
  Cellulose docking domain, dockering
DCFSTRLGYPCCTKTTAVVYHDNDGDWGVEDNHWCGLSN

SEQ ID NO: 5497 - protein, 40 aa, Anaeromyces robustus
  Cellulose docking domain, dockering
ECWSESQGYKCCKTCVVVYVDEFGSWGVENDQWCGVKADA

SEQ ID NO: 5498 - protein, 40 aa, Anaeromyces robustus
  Cellulose docking domain, dockering
TCWSSGYGYPCCTTCKVYYEDYSGEWGVENGDWCGIVSQY

SEQ ID NO: 5499 - protein, 38 aa, Anaeromyces robustus
  Cellulose docking domain, dockering
TCWAEKLGYSCCTSTSQVVYTDGDGNWGVENGNWCGIP

SEQ ID NO: 5500 - protein, 41 aa, Anaeromyces robustus
  Cellulose docking domain, dockering
NCFSESLGYPCCRKQNPKVYYTNEDGEWSVENGKWCGVIKS

SEQ ID NO: 5501 - protein, 35 aa, Anaeromyces robustus
  Cellulose docking domain, dockering
CPNLGYPCCNDCRVVYQDEYNWGVLNNQWCVTPYS

SEQ ID NO: 5502 - protein, 41 aa, Anaeromyces robustus
  Cellulose docking domain, dockering
NCWATAHGYNCCSGCKVIFEETETMKWGVENHEWCGIVNSN

SEQ ID NO: 5503 - protein, 38 aa, Anaeromyces robustus
  Cellulose docking domain, dockering
ECFSSKLGYPCCTSTTDIYYSDNDGKWGIENGNWCGIV

SEQ ID NO: 5504 - protein, 39 aa, Anaeromyces robustus
  Cellulose docking domain, dockering
NCWATALGYPCCTTTTDVVFTDNSGDWGVEKGNWCGIVK

SEQ ID NO: 5505 - protein, 41 aa, Anaeromyces robustus
  Cellulose docking domain, dockering
PCWAEVLGFPCCSTDKCRTVYFTDDDGEWDVENNNWCGITA

SEQ ID NO: 5506 - protein, 29 aa, Anaeromyces robustus
  Cellulose docking domain, dockering
EKYKCCKSCDIFYVDNYKWGVENNEWCSI

SEQ ID NO: 5507 - protein, 40 aa, Anaeromyces robustus
  Cellulose docking domain, dockering
ECWSEVHGYPCCELKTTQVEFTDSSTGEQYGIENGRICGI

SEQ ID NO: 5508 - protein, 32 aa, Anaeromyces robustus
  Cellulose docking domain, dockering
GASYPCCENTCAVQYTDADGQWGIENGNWCGM

SEQ ID NO: 5509 - protein, 32 aa, Anaeromyces robustus; identical to SEQ ID NO: 5508
  Cellulose docking domain, dockering

SEQ ID NO: 5510 - protein, 37 aa, Anaeromyces robustus
  Cellulose docking domain, dockering
ACFSENLGYKCCKGNTIYYTDNNGAWGIENGEWCGIE

SEQ ID NO: 5511 - protein, 37 aa, Anaeromyces robustus
  Cellulose docking domain, dockering
CFSVKLGFKCCKGNNIIYTDKDGDWGVEDDEWCGISN

SEQ ID NO: 5512 - protein, 36 aa, Anaeromyces robustus; identical to SEQ ID NO: 2975
  Cellulose docking domain, dockering

SEQ ID NO: 5513 - protein, 37 aa, Anaeromyces robustus
  Cellulose docking domain, dockering
IVEDMGYTICPVGTKITYANTQATWGKNNDDWCVILE

SEQ ID NO: 5514 - protein, 40 aa, Anaeromyces robustus
  Cellulose docking domain, dockering
NCIAELIGYKCCSPNNTKVYAHDENGDWGYDFKKGEWCGL

SEQ ID NO: 5515 - protein, 38 aa, Anaeromyces robustus
  Cellulose docking domain, dockering
TCWSEIFGYSCCKGCTIYEVDNDGSWGYENGEWCGIQS

SEQ ID NO: 5516 - protein, 34 aa, Anaeromyces robustus
  Cellulose docking domain, dockering
NCWSVDLGYPCCKSTNEVYVTDENGKWGLENNNW

SEQ ID NO: 5517 - protein, 38 aa, Anaeromyces robustus
  Cellulose docking domain, dockering
ECFSLALGYSCCQKTTAVIYEDKDGKWGIENNQWCGIK

SEQ ID NO: 5518 - protein, 39 aa, Anaeromyces robustus
  Cellulose docking domain, dockering
SCWSTALGYPCCTNANLDVLFTDDDGDWSIENNNWCGIR

SEQ ID NO: 5519 - protein, 39 aa, Anaeromyces robustus
  Cellulose docking domain, dockering
ECWSLILGYKCCSSCLPIVETDSSGNWSIEDNQWCGLEE

SEQ ID NO: 5520 - protein, 41 aa, Anaeromyces robustus
  Cellulose docking domain, dockering
GCFSERLGFPCCPPGTKVEYSDEEGDWGIINEEWCGISDRG

SEQ ID NO: 5521 - protein, 39 aa, Anaeromyces robustus
  Cellulose docking domain, dockering
GCWAEEFGYPCCSNLNNKIVYYIDEYGNKWGVENDDWCG

SEQ ID NO: 5522 - protein, 38 aa, Anaeromyces robustus
  Cellulose docking domain, dockering
NCWAEKLGYPCCSSSKNVLFEDNDGQWSVENDNWCGIP

SEQ ID NO: 5523 - protein, 39 aa, Anaeromyces robustus
  Cellulose docking domain, dockering
VCWSEALGYPCCSTCSSPVYSDNDGNWGVENGDWCGITK

SEQ ID NO: 5524 - protein, 41 aa, Anaeromyces robustus
  Cellulose docking domain, dockering
DCWAAALGYKCCNHCNVVETDDQDHEWGSLNGEWCGINVTM

SEQ ID NO: 5525 - protein, 26 aa, Anaeromyces robustus
  Cellulose docking domain, dockering
TDYPCCSHCDVLFTDRTARWGIENND

SEQ ID NO: 5526 - protein, 37 aa, Anaeromyces robustus
  Cellulose docking domain, dockering
DCFSERLGYPCCKYTSKVEYVDADGDWGVENGDWCGM

SEQ ID NO: 5527 - protein, 37 aa, Anaeromyces robustus; identical to SEQ ID NO: 5526
  Cellulose docking domain, dockering

SEQ ID NO: 5528 - protein, 37 aa, Anaeromyces robustus
  Cellulose docking domain, dockering
QCWAEAYGYSCCSKCVKVIDTSYNKKWGLENGKWCGL

SEQ ID NO: 5529 - protein, 34 aa, Anaeromyces robustus
  Cellulose docking domain, dockering
NSPAYKCCSSCIVYFEDNYKWGTMNGEWCSLTYD

SEQ ID NO: 5530 - protein, 30 aa, Anaeromyces robustus
  Cellulose docking domain, dockering
YKCCNSCDIVYTDFQYWGYENNEWCSIPYS

SEQ ID NO: 5531 - protein, 38 aa, Anaeromyces robustus
  Cellulose docking domain, dockering
TCFSVAMGYPCCTGNKIVYTDKSGNWGIENNKRCGIGD

SEQ ID NO: 5532 - protein, 35 aa, Anaeromyces robustus
  Cellulose docking domain, dockering
KTLKPSYPCCKGNKVVYTDKNGNWGFENNKWCGIG

SEQ ID NO: 5533 - protein, 37 aa, Anaeromyces robustus
  Cellulose docking domain, dockering
ECWSKAQGYDCCAEGTSVFLEDESGDWSADNGEWCGV

SEQ ID NO: 5534 - protein, 18 aa, Anaeromyces robustus
  Cellulose docking domain, dockering
DESGDWSADNGEWCGVIK

SEQ ID NO: 5535 - protein, 39 aa, Anaeromyces robustus
  Cellulose docking domain, dockering
TCWSETLGYPCCNTNGCQTIYFIDSNGMWSVENDNWCGI

SEQ ID NO: 5536 - protein, 40 aa, Anaeromyces robustus
  Cellulose docking domain, dockering
NCWAHRLGFQCCKNYKIEVAYSDSDGDWGIENGEWCGIDN

SEQ ID NO: 5537 - protein, 35 aa, Anaeromyces robustus
  Cellulose docking domain, dockering
KILDQGYKCCSDNCIIYYNDEDGDWGVENGEWCGC

SEQ ID NO: 5538 - protein, 40 aa, Anaeromyces robustus
  Cellulose docking domain, dockering
CSANILKQGYKCCPDNCVVTYVDADGDWSIDGQEWCGCGN

SEQ ID NO: 5539 - protein, 35 aa, Anaeromyces robustus; identical to SEQ ID NO: 5537
  Cellulose docking domain, dockering

SEQ ID NO: 5540 - protein, 40 aa, Anaeromyces robustus; identical to SEQ ID NO: 5538
  Cellulose docking domain, dockering

SEQ ID NO: 5541 - protein, 34 aa, Anaeromyces robustus
  Cellulose docking domain, dockering
ISSGYKCCPNAKEVQSDDNGSWGYVDGQWCGISP

SEQ ID NO: 5542 - protein, 38 aa, Anaeromyces robustus
  Cellulose docking domain, dockering
KFLGSPYPCCSPDNQKIEFIDHDGLWGRENGKWCGIMN

SEQ ID NO: 5543 - protein, 42 aa, Anaeromyces robustus
  Cellulose docking domain, dockering
SCWSTKLGYPCCSAGNKDVYYNDDDGLWGVENNNWCGIPSNS

SEQ ID NO: 5544 - protein, 32 aa, Anaeromyces robustus
  Cellulose docking domain, dockering
NGYQCCKDSSTQVILTDDDGTWGIENNHWCHI

SEQ ID NO: 5545 - protein, 33 aa, Anaeromyces robustus
  Cellulose docking domain, dockering
DYPYCDGCDANYVDKDGRWNLVDKTWCKVKEKK

SEQ ID NO: 5546 - protein, 39 aa, Anaeromyces robustus; identical to SEQ ID NO: 4975
  Cellulose docking domain, dockering

SEQ ID NO: 5547 - protein, 39 aa, Anaeromyces robustus
  Cellulose docking domain, dockering
ECWSLKHGYPCCQKTKVVTLEDENGKWGVENDDWCGIID

SEQ ID NO: 5548 - protein, 39 aa, Anaeromyces robustus
  Cellulose docking domain, dockering
ECPFEKYGYPCCEITNIVVYTDDMGKWGIENDVWCGIVE

SEQ ID NO: 5549 - protein, 40 aa, Anaeromyces robustus
  Cellulose docking domain, dockering
TCTAQDQGYKCCSTCNVVYTDESGDWGVENNEWCLIKKSK

SEQ ID NO: 5550 - protein, 41 aa, Anaeromyces robustus
  Cellulose docking domain, dockering
KCWSERFGYPCCTSSCHVYETDDNGEWGYENQHWCGILKEN

SEQ ID NO: 5551 - protein, 39 aa, Anaeromyces robustus
  Cellulose docking domain, dockering
ECWSEVFGFPCCTSSCHVYEIDDSGEWGYEDNHWCGIPS

SEQ ID NO: 5552 - protein, 35 aa, Anaeromyces robustus; identical to SEQ ID NO: 3014
  Cellulose docking domain, dockering

SEQ ID NO: 5553 - protein, 42 aa, Anaeromyces robustus
  Cellulose docking domain, dockering
SCWSEKLGYPCCPANRCRVYTTDKDGKWGYTKNSWCGIDEEV

SEQ ID NO: 5554 - protein, 41 aa, Anaeromyces robustus
  Cellulose docking domain, dockering
KCWSELIGYPCCDSSVTTVFVQDDYGDWGYDFNKNEWCGIT

SEQ ID NO: 5555 - protein, 35 aa, Anaeromyces robustus
  Cellulose docking domain, dockering
KGSGYACCKFNTTTVTTTDYTGKWGIEGLRYCLID

SEQ ID NO: 5556 - protein, 36 aa, Anaeromyces robustus
  Cellulose docking domain, dockering
RKGYPCCTKKTSNVNYISKNGDQYGYENNKWCGITT

SEQ ID NO: 5557 - protein, 32 aa, Anaeromyces robustus
  Cellulose docking domain, dockering
EKYKCCNSCKVRYTDDYEWGVEGGEWCSIPYS

SEQ ID NO: 5558 - protein, 32 aa, Anaeromyces robustus
  Cellulose docking domain, dockering
EKYKCCNSCKVRYTDNYEWGVEDGEWCSIPYS

SEQ ID NO: 5559 - protein, 41 aa, Anaeromyces robustus
  Cellulose docking domain, dockering
KCWSELIGYKCCAPNVTAIYASDEYGYWGYDFENNEWCGIT

SEQ ID NO: 5560 - protein, 39 aa, Anaeromyces robustus
  Cellulose docking domain, dockering
NCWSQKYGYPCCQTCIVYHNDNEGSWGYEYNGWCGIPTH

SEQ ID NO: 5561 - protein, 41 aa, Anaeromyces robustus; identical to SEQ ID NO: 5559
  Cellulose docking domain, dockering

SEQ ID NO: 5562 - protein, 39 aa, Anaeromyces robustus
  Cellulose docking domain, dockering
KCWSEKIGYKCCTDAEIYLTDTFGHWSIEDGEWCLVKRS

SEQ ID NO: 5563 - protein, 41 aa, Anaeromyces robustus
  Cellulose docking domain, dockering
ECWSKIIGYECCSSPNPHIYVTDILGHWSIENGDWCYVRRS

SEQ ID NO: 5564 - protein, 39 aa, Anaeromyces robustus
  Cellulose docking domain, dockering
RCFSEKLGFPCCSDPSTVIVFVDESGEWGVENDGWCGFP

SEQ ID NO: 5565 - protein, 39 aa, Anaeromyces robustus
  Cellulose docking domain, dockering
RCFSEKLGFPCCSDPSTVVVFVDESSEWGVENDGWCGFP

SEQ ID NO: 5566 - protein, 40 aa, Anaeromyces robustus
  Cellulose docking domain, dockering
ECWSEKIGYKCCSSPNAVLQLTDIFGYWSVEEDEWCFIRR

SEQ ID NO: 5567 - protein, 39 aa, Anaeromyces robustus
  Cellulose docking domain, dockering
SCFAEKLGYSCCISPSSAVLHEDKDGKWGIEYGKWCGLP

SEQ ID NO: 5568 - protein, 39 aa, Anaeromyces robustus
  Cellulose docking domain, dockering
ECFSLSHGYKCCETCNVVEKGKEGDWGIENHKWCGIKYS

SEQ ID NO: 5569 - protein, 31 aa, Anaeromyces robustus
  Cellulose docking domain, dockering
YFPCCKENKVVLVDEEGEWGIENKKWCGISS

SEQ ID NO: 5570 - protein, 41 aa, Anaeromyces robustus
  Cellulose docking domain, dockering
ECWSEEQGYSCCQGCNILLVEEGQQKWGFENNKWCGIVESV

SEQ ID NO: 5571 - protein, 39 aa, Anaeromyces robustus
  Cellulose docking domain, dockering
CSTSILNQGYSCCSSECIVVLTDSDGTWGYENNKWCGCN

SEQ ID NO: 5572 - protein, 37 aa, Anaeromyces robustus
  Cellulose docking domain, dockering
VLYKGYSCCSENNCKIRYVDEDGNWGAENGQWCGISN

SEQ ID NO: 5573 - protein, 36 aa, Anaeromyces robustus
  Cellulose docking domain, dockering
SILSQGYKCCSDNCLVVYTDDDGTWGYENDKWCGCE

SEQ ID NO: 5574 - protein, 41 aa, Anaeromyces robustus
  Cellulose docking domain, dockering
NCWSELIGYKCCPPNITAVYARDKYGYWGYDFDKKEWCGIT

SEQ ID NO: 5575 - protein, 38 aa, Anaeromyces robustus
  Cellulose docking domain, dockering
YCWSNEYNYPCCKTCIVYEIDDKGSWGYENNEWCGIPS

SEQ ID NO: 5576 - protein, 41 aa, Anaeromyces robustus
  Cellulose docking domain, dockering
CSSKIIAQGYKCCSSICKQPYVDENGEWGVEDGKWCGCIEN

SEQ ID NO: 5577 - protein, 35 aa, Anaeromyces robustus
  Cellulose docking domain, dockering
CPSTITNKGYSCCSTCSKVRYVDEDGKWGVENHQW

SEQ ID NO: 5578 - protein, 40 aa, Anaeromyces robustus
  Cellulose docking domain, dockering
ECWARESGYDCCSEDNQKVIYTDEMGSWGYENDNWCGIIV

SEQ ID NO: 5579 - protein, 39 aa, Anaeromyces robustus
  Cellulose docking domain, dockering
ECWAKEFGYNCCSKDNQNVIYTEEMYSWGYENDNWCGIV

SEQ ID NO: 5580 - protein, 39 aa, Anaeromyces robustus
  Cellulose docking domain, dockering
ECWAKEFGYNCCSKDNQNVIYTEDMYSWGYEKDEWCGIV

SEQ ID NO: 5581 - protein, 35 aa, Anaeromyces robustus
  Cellulose docking domain, dockering
FAITSQGYKCCSKDCFIVFTDDDGTWGIENDQWCG

SEQ ID NO: 5582 - protein, 20 aa, Anaeromyces robustus
  Cellulose docking domain, dockering
VFTDDDGTWGIENDQWCGCD

SEQ ID NO: 5583 - protein, 38 aa, Anaeromyces robustus
  Cellulose docking domain, dockering
CPGIKLGYSCCEKCNSLITNKDGSWSLENFKICSIKYS

SEQ ID NO: 5584 - protein, 39 aa, Anaeromyces robustus
  Cellulose docking domain, dockering
SCWAQNQGYQCCTSCDIVYEDNDGSWGIENGDWCGINTS

SEQ ID NO: 5585 - protein, 25 aa, Anaeromyces robustus
  Cellulose docking domain, dockering
GCFSINFGFPCCSSCVYYYEDDDGK

SEQ ID NO: 5586 - protein, 39 aa, Anaeromyces robustus
  Cellulose docking domain, dockering
SCTGIEDGYPCCKTCNAIYNDEQGPWEMENNKWCGIPDS

SEQ ID NO: 5587 - protein, 38 aa, Anaeromyces robustus
  Cellulose docking domain, dockering
ECFSVKLGYPCCTKTNEVIYTDEQGQWGVEDYHWCGID

SEQ ID NO: 5588 - protein, 37 aa, Anaeromyces robustus
  Cellulose docking domain, dockering
KLQPAYPCCYMRNKEVVSIDSNGKWSTEHGTWCGIIE

SEQ ID NO: 5589 - protein, 39 aa, Anaeromyces robustus
  Cellulose docking domain, dockering
TCWSTRLGYPCCEDSNVVYAVDENGIWGYENKHWCGIIE

SEQ ID NO: 5590 - protein, 24 aa, Anaeromyces robustus
  Cellulose docking domain, dockering
TCWSTRLGYPCCEDSNVVYAVDEN

SEQ ID NO: 5591 - protein, 40 aa, Anaeromyces robustus
  Cellulose docking domain, dockering
SCFSIELGYPCCQTSCEVYYIDEDGDWGIEDNHWCGIGEN

SEQ ID NO: 5592 - protein, 35 aa, Anaeromyces robustus; identical to SEQ ID NO: 2465
  Cellulose docking domain, dockering

SEQ ID NO: 5593 - protein, 21 aa, Anaeromyces robustus
  Cellulose docking domain, dockering
CNVYYTDNDGEWGVENGNWCG

SEQ ID NO: 5594 - protein, 43 aa, Anaeromyces robustus
  Cellulose docking domain, dockering
SCWATKLGYKCCTAKCPEVSYVDQDGAWGIENGNWCGIIESSC

SEQ ID NO: 5595 - protein, 34 aa, Anaeromyces robustus
  Cellulose docking domain, dockering
SEKLGYPCCSETTDVVSVDANGKWGLENGTICGI

SEQ ID NO: 5596 - protein, 37 aa, Anaeromyces robustus
  Cellulose docking domain, dockering
VANAYNNCTHTCRVLVTEDGVEWGAENNDWCIIDQSL

SEQ ID NO: 5597 - protein, 32 aa, Anaeromyces robustus
  Cellulose docking domain, dockering
NYLCCNECNVVLEDEEGKWGYENNRWCGIKDT

SEQ ID NO: 5598 - protein, 32 aa, Anaeromyces robustus; identical to SEQ ID NO: 5597
  Cellulose docking domain, dockering

SEQ ID NO: 5599 - protein, 37 aa, Anaeromyces robustus; identical to SEQ ID NO: 5596
  Cellulose docking domain, dockering

SEQ ID NO: 5600 - protein, 36 aa, Anaeromyces robustus
  Cellulose docking domain, dockering
YCWSKVLGYPCCTVNTYVYYIDDNGMWGIENDNWCG

SEQ ID NO: 5601 - protein, 34 aa, Anaeromyces robustus
  Cellulose docking domain, dockering
FLYNCCKNTCKLVAIQDKIQLGIENGEYCSIPYS

SEQ ID NO: 5602 - protein, 22 aa, Anaeromyces robustus
  Cellulose docking domain, dockering
ECFSVKLGYPCCTKTNEVIYTD

SEQ ID NO: 5603 - protein, 37 aa, Anaeromyces robustus
  Cellulose docking domain, dockering
TCWSKDYGYPCCKSCFVFEETEEGKWGYEDNHWCGIQ

SEQ ID NO: 5604 - protein, 41 aa, Anaeromyces robustus
  Cellulose docking domain, dockering
NCIGEVAGYPCCSEGVNKVYEHDINGEWGYDFSKKQWCSLT

SEQ ID NO: 5605 - protein, 33 aa, Anaeromyces robustus
  Cellulose docking domain, dockering
EYPCCTSTKTVMYTDEKGPWGIENGNWCGIKDS

SEQ ID NO: 5606 - protein, 31 aa, Anaeromyces robustus
  Cellulose docking domain, dockering
NCWAKSLGYNCCSTSSCRTAQFSDADGQWDV

SEQ ID NO: 5607 - protein, 22 aa, Anaeromyces robustus
  Cellulose docking domain, dockering
TVIFTDSNGQWGIENGNWCGKP

SEQ ID NO: 5608 - protein, 35 aa, Anaeromyces robustus; identical to SEQ ID NO: 2465
  Cellulose docking domain, dockering

SEQ ID NO: 5609 - protein, 30 aa, Anaeromyces robustus; identical to SEQ ID NO: 3077
  Cellulose docking domain, dockering

SEQ ID NO: 5610 - protein, 33 aa, Anaeromyces robustus
  Cellulose docking domain, dockering
FAITSQGYKCCKEDNCSVFETDDDGTWGIENDQ

SEQ ID NO: 5611 - protein, 26 aa, Anaeromyces robustus
  Cellulose docking domain, dockering
QAVIYHDNDGDWGVENNQWCLIKSSK

SEQ ID NO: 5612 - protein, 33 aa, Piromyces finnis
  Cellulose docking domain, dockering
GCWAEALGYKCCSAGNYMVLLTDESGAWGAENG

SEQ ID NO: 5613 - protein, 27 aa, Piromyces finnis
  Cellulose docking domain, dockering
CFAENLGYQCCSDPETIVITTDEYGEW

SEQ ID NO: 5614 - protein, 35 aa, Piromyces finnis
  Cellulose docking domain, dockering
LNNNCCTKTDTHVSFIDDEKSLWGIESGSWCKINI

SEQ ID NO: 5615 - protein, 36 aa, Piromyces finnis
  Cellulose docking domain, dockering
NCWSSKYGYGCCFNDNDDVIYRDEKGSWGIENNQWC

SEQ ID NO: 5616 - protein, 39 aa, Piromyces finnis
  Cellulose docking domain, dockering
KCWSEKLGFKCCRIDIQPIFSDYEGIWGVEDDQWCGIIN

SEQ ID NO: 5617 - protein, 38 aa, Piromyces finnis
  Cellulose docking domain, dockering
RCSFEVLGYHCCSSINPKVVKEDSYGKWGEEDGELCGI

SEQ ID NO: 5618 - protein, 30 aa, Piromyces finnis; identical to SEQ ID NO: 3084
  Cellulose docking domain, dockering

SEQ ID NO: 5619 - protein, 37 aa, Piromyces finnis
  Cellulose docking domain, dockering
CWSEPEYPCCKESCTVYYVDDHQWGIENGEWCGIPDS

SEQ ID NO: 5620 - protein, 40 aa, Piromyces finnis
  Cellulose docking domain, dockering
SCWSEELGYSCCSHCTVLLKDESGLWGAEDGKWCGIPNES

SEQ ID NO: 5621 - protein, 40 aa, Piromyces finnis
  Cellulose docking domain, dockering
DCWSSYYGYSCCSHCNIFLTDELGDWGVENKKWCGINSNK

SEQ ID NO: 5622 - protein, 40 aa, Piromyces finnis
  Cellulose docking domain, dockering
CSSGVKAQGYPCCKSCGQVVYVDEDGKWGVENNDWCGIPT

SEQ ID NO: 5623 - protein, 37 aa, Piromyces finnis
  Cellulose docking domain, dockering
SEKIINQGYPCCSKETQVYYTDESGEWGVENNNWCGI

SEQ ID NO: 5624 - protein, 40 aa, Piromyces finnis
  Cellulose docking domain, dockering
KCWATSLGYPCCKEANPIIFYKDEDGDWGIENNSWCGIIK

SEQ ID NO: 5625 - protein, 36 aa, Piromyces finnis
  Cellulose docking domain, dockering
YGYPCCENKNTVVEINDSEYNLQFGIENGKLCGISS

SEQ ID NO: 5626 - protein, 25 aa, Piromyces finnis
  Cellulose docking domain, dockering
QYKCCKKCNIYVNELGQDWGIENND

SEQ ID NO: 5627 - protein, 35 aa, Piromyces finnis
  Cellulose docking domain, dockering
MKLGYRCCDSCEIKFIDENIKYGYENGEWCGIPDE

SEQ ID NO: 5628 - protein, 37 aa, Piromyces finnis
  Cellulose docking domain, dockering
STRFGFPCCNTCELQYIDDFGNWGFENDNWCGISPNI

SEQ ID NO: 5629 - protein, 34 aa, Piromyces finnis
  Cellulose docking domain, dockering
VEGYDCCEGCTIETEEDGIKWGYENRNWCVIPYT

SEQ ID NO: 5630 - protein, 36 aa, Piromyces finnis
  Cellulose docking domain, dockering
CFSVKMGYPCCTQNSEIVYTDSTGSWGLQNGDWCGV

SEQ ID NO: 5631 - protein, 35 aa, Piromyces finnis; identical to SEQ ID NO: 3098
  Cellulose docking domain, dockering

SEQ ID NO: 5632 - protein, 39 aa, Piromyces finnis
  Cellulose docking domain, dockering
SCFSKALGYPCCSVGNSDVAFIDNNGKWGIENGNWCGIT

SEQ ID NO: 5633 - protein, 40 aa, Piromyces finnis
  Cellulose docking domain, dockering
WANYIDQGYGCCLNDNGKREIINMDGEWGLENDNWCGFRN

SEQ ID NO: 5634 - protein, 39 aa, Piromyces finnis
  Cellulose docking domain, dockering
ECWSEQYNFPCCSPGVKIDFTDNRGSWGLENYSWCGIIS

SEQ ID NO: 5635 - protein, 38 aa, Piromyces finnis
  Cellulose docking domain, dockering
CAKNKNNLPCCSTCEIALIDGSGRYGYENGQWCNIPFN

SEQ ID NO: 5636 - protein, 39 aa, Piromyces finnis
  Cellulose docking domain, dockering
CWSRAIGFVCCDKCNVLFVDEQGKWSVEDGYWCGINPSK

SEQ ID NO: 5637 - protein, 32 aa, Piromyces finnis; identical to SEQ ID NO: 3103
  Cellulose docking domain, dockering

SEQ ID NO: 5638 - protein, 40 aa, Piromyces finnis
  Cellulose docking domain, dockering
KCFSEVLGYPCCNECSIIYSDADGDWGYENGMWCGINTSQ

SEQ ID NO: 5639 - protein, 38 aa, Piromyces finnis
  Cellulose docking domain, dockering
ECWSEKFGIPCCKEALMPLRTTYDGGWSQENGEWCGLG

SEQ ID NO: 5640 - protein, 34 aa, Piromyces finnis
  Cellulose docking domain, dockering
TSYSCCIFDDTLIITSDSTGNWGFEGDRWCLIKN

SEQ ID NO: 5641 - protein, 40 aa, Piromyces finnis
  Cellulose docking domain, dockering
ECWAKAQGYNCCEKRTTAVTYVDKKTGEEWGYEGGKWCGI

SEQ ID NO: 5642 - protein, 38 aa, Piromyces finnis
  Cellulose docking domain, dockering
DFSDEYACCKGCDVVSVTSNGNSKWGVENKKWCSIPYS

SEQ ID NO: 5643 - protein, 39 aa, Piromyces finnis
  Cellulose docking domain, dockering
DCFSLKLGYPCCSTTTTVVTSDSDGDWGIENNSWCGIEK

SEQ ID NO: 5644 - protein, 39 aa, Piromyces finnis
  Cellulose docking domain, dockering
ECWSLKQGYSCCRGCKVQTKDEYGKWGIENNEWSGIPTS

SEQ ID NO: 5645 - protein, 32 aa, Piromyces finnis
  Cellulose docking domain, dockering
FSCCDSGNTDVYFYDGDGEWGFNFETQEWCGL

SEQ ID NO: 5646 - protein, 32 aa, Piromyces finnis
  Cellulose docking domain, dockering
EYMCCEGCEVVEETAEGKWGIEKNNWCGIKDS

SEQ ID NO: 5647 - protein, 39 aa, Piromyces finnis
  Cellulose docking domain, dockering
CWSEPLGFPCCSECVEPERVDDNGEWGIENNEWCGIYKS

SEQ ID NO: 5648 - protein, 42 aa, Piromyces finnis
  Cellulose docking domain, dockering
CSASIISQGYKCCKSGCQVVYQDADGDWGVNSQGYWCGIPTS

SEQ ID NO: 5649 - protein, 41 aa, Piromyces finnis
  Cellulose docking domain, dockering
CWSEELGYRCCNNGESIVEYIDESGWWGVTKDTKEWCGIIK

SEQ ID NO: 5650 - protein, 39 aa, Piromyces finnis
  Cellulose docking domain, dockering
TCGAQGYSCCKSSCTVYFEDSDGKWSIENDDWCLINSSK

SEQ ID NO: 5651 - protein, 20 aa, Piromyces finnis
  Cellulose docking domain, dockering
TDESGNWGIEKDDWCGIPKS

SEQ ID NO: 5652 - protein, 32 aa, Piromyces finnis
  Cellulose docking domain, dockering
DYSCCEGCEVIEETEEGKWGIENYAWCGIKDS

SEQ ID NO: 5653 - protein, 31 aa, Piromyces finnis; identical to SEQ ID NO: 3119
  Cellulose docking domain, dockering

SEQ ID NO: 5654 - protein, 28 aa, Piromyces finnis
  Cellulose docking domain, dockering
ACWADAIGYPCCKGCDVITTDDDGDWGV

SEQ ID NO: 5655 - protein, 35 aa, Piromyces finnis
  Cellulose docking domain, dockering
HDYYECCTGCKPIVADDEGRWGAQNGEWCLIDEER

SEQ ID NO: 5656 - protein, 34 aa, Piromyces finnis
  Cellulose docking domain, dockering
PDYDVCEGCEVLVTDLEGKWGAQDGKWCHIDEVK

SEQ ID NO: 5657 - protein, 33 aa, Piromyces finnis
  Cellulose docking domain, dockering
CSASIIKSGYKCCSASCEVIYTDSDGTWGVENN

SEQ ID NO: 5658 - protein, 36 aa, Piromyces finnis
  Cellulose docking domain, dockering
EEKKLGYPCCKYCTIIESDSYGDYGVENNAWCSISY

SEQ ID NO: 5659 - protein, 37 aa, Piromyces finnis
  Cellulose docking domain, dockering
CSCWSESLGYPCCHHQDIIYTDESGPWGLENNQWCGI

SEQ ID NO: 5660 - protein, 37 aa, Piromyces finnis
  Cellulose docking domain, dockering
CSSKITQQGYKCCSKNCVVYYTDSDGNWGYENDWCGC

SEQ ID NO: 5661 - protein, 30 aa, Piromyces finnis
  Cellulose docking domain, dockering
NGYPCCKTNKTVVFTDEYGKWSVENNDWCL

SEQ ID NO: 5662 - protein, 37 aa, Piromyces finnis; identical to SEQ ID NO: 5660
  Cellulose docking domain, dockering

SEQ ID NO: 5663 - protein, 30 aa, Piromyces finnis; identical to SEQ ID NO: 5661
  Cellulose docking domain, dockering

SEQ ID NO: 5664 - protein, 39 aa, Piromyces finnis
  Cellulose docking domain, dockering
KCWSEALGYKCCKKCNALYRDSNGLWGIENFKRCGIPSS

SEQ ID NO: 5665 - protein, 40 aa, Piromyces finnis
  Cellulose docking domain, dockering
KCMSELKGYPCCSKEISIVLKHDQYGDWGYDFKKGKWCGL

SEQ ID NO: 5666 - protein, 39 aa, Piromyces finnis; identical to SEQ ID NO: 5664
  Cellulose docking domain, dockering

SEQ ID NO: 5667 - protein, 40 aa, Piromyces finnis; identical to SEQ ID NO: 5665
  Cellulose docking domain, dockering

SEQ ID NO: 5668 - protein, 41 aa, Piromyces finnis
  Cellulose docking domain, dockering
TCWVSVHGYPCCEGESLEKVYAEDVDGKWGYDFVKKTWCGI

SEQ ID NO: 5669 - protein, 38 aa, Piromyces finnis
  Cellulose docking domain, dockering
GCWSLKEGYNCCIGCAVYAITDEGSWGVENGKWCGIPS

SEQ ID NO: 5670 - protein, 43 aa, Piromyces finnis
  Cellulose docking domain, dockering
KCWSLSQGYPCCDPDAETIYSDESGDWGLALNSNNELDWCGII

SEQ ID NO: 5671 - protein, 45 aa, Piromyces finnis
  Cellulose docking domain, dockering
KCWSESLGFPCCSDENTIIVESDGDGDWGIELNSNNEWEWCGIKK

SEQ ID NO: 5672 - protein, 36 aa, Piromyces finnis
  Cellulose docking domain, dockering
CYSKGSGFPCCKKNTKIIYMDGEGDWGVNNGEWCIV

SEQ ID NO: 5673 - protein, 30 aa, Piromyces finnis
  Cellulose docking domain, dockering
WATLINLSYKCCSPNASYYSVDQDGEWGVE

SEQ ID NO: 5674 - protein, 24 aa, Piromyces finnis
  Cellulose docking domain, dockering
ASCFSEALGYECCKGCTVITTDES

SEQ ID NO: 5675 - protein, 36 aa, Piromyces finnis
  Cellulose docking domain, dockering
SCFATKLGYPCCKNNQIVYTDSDGDWGFENNEWCGI

SEQ ID NO: 5676 - protein, 36 aa, Piromyces finnis; identical to SEQ ID NO: 5675
  Cellulose docking domain, dockering

SEQ ID NO: 5677 - protein, 36 aa, Piromyces finnis; identical to SEQ ID NO: 5675
  Cellulose docking domain, dockering

SEQ ID NO: 5678 - protein, 39 aa, Piromyces finnis
  Cellulose docking domain, dockering
NCWAESLGYPCCKEKTPNVEYVDESGSWGIENDIWCGII

SEQ ID NO: 5679 - protein, 38 aa, Piromyces finnis
  Cellulose docking domain, dockering
KCWAEAQGYPCCEITKEVVYVDDYLWGIENEEWCGIIE

SEQ ID NO: 5680 - protein, 34 aa, Piromyces finnis; identical to SEQ ID NO: 3157
  Cellulose docking domain, dockering

SEQ ID NO: 5681 - protein, 35 aa, Piromyces finnis; identical to SEQ ID NO: 3158
  Cellulose docking domain, dockering

SEQ ID NO: 5682 - protein, 36 aa, Piromyces finnis; identical to SEQ ID NO: 3159
  Cellulose docking domain, dockering

SEQ ID NO: 5683 - protein, 24 aa, Piromyces finnis
  Cellulose docking domain, dockering
GDVIRLGYLCCSLPCTVIYTDDDG

SEQ ID NO: 5684 - protein, 26 aa, Piromyces finnis
  Cellulose docking domain, dockering
KCWSTEFGFPCCKGNTIVFTDENGDW

SEQ ID NO: 5685 - protein, 38 aa, Piromyces finnis
  Cellulose docking domain, dockering
ECFSINLGYPCCSTCTLYFENSIGRWGIENNEWCGLKS

SEQ ID NO: 5686 - protein, 38 aa, Piromyces finnis
  Cellulose docking domain, dockering
SCWAEEQGYQCCSDCDVIYEDNNGLWGIENGTWCGINS

SEQ ID NO: 5687 - protein, 37 aa, Piromyces finnis
  Cellulose docking domain, dockering
SCFAKSMGYACCSVGTEVVYTDNDGQWGIENGQWCGI

SEQ ID NO: 5688 - protein, 21 aa, Piromyces finnis
  Cellulose docking domain, dockering
DYACCSGCESVYVDNDGKWGV

SEQ ID NO: 5689 - protein, 32 aa, Piromyces finnis; identical to SEQ ID NO: 3167
  Cellulose docking domain, dockering

SEQ ID NO: 5690 - protein, 40 aa, Piromyces finnis
  Cellulose docking domain, dockering
KCWSELLGSPCCPPKVTIVYSHDEYGDWGYDFKRKEWCGL

SEQ ID NO: 5691 - protein, 38 aa, Piromyces finnis
  Cellulose docking domain, dockering
QTNIVELGYKCCSSFIKIDHTDKIGTWGYENGELCGIP

SEQ ID NO: 5692 - protein, 32 aa, Piromyces finnis
  Cellulose docking domain, dockering
EYLCCDGCNVVEETAEGKWGVENNKWCGIPSN

SEQ ID NO: 5693 - protein, 25 aa, Piromyces finnis
  Cellulose docking domain, dockering
CGVVLEEDGIKWGVENNDWCIIPSK

SEQ ID NO: 5694 - protein, 40 aa, Piromyces finnis
  Cellulose docking domain, dockering
QCWSENIGYPCCQNKDTKVTYHSKSLNKDYGTENGEWCGI

SEQ ID NO: 5695 - protein, 32 aa, Piromyces finnis
  Cellulose docking domain, dockering
TSYNCCKIPANVDTVDDVGYWAIQNGQWCFID

SEQ ID NO: 5696 - protein, 30 aa, Piromyces finnis
  Cellulose docking domain, dockering
SKYKCCETCKVSYTDSTKWGVEHGKWCSIP

SEQ ID NO: 5697 - protein, 28 aa, Piromyces finnis
  Cellulose docking domain, dockering
SSGYDCCLSTKAIVTSDVVGDWGIENND

SEQ ID NO: 5698 - protein, 30 aa, Piromyces finnis
  Cellulose docking domain, dockering
YQCCQSCDIVFTDTEDWGFENGNWCSIPHS

SEQ ID NO: 5699 - protein, 39 aa, Piromyces finnis
  Cellulose docking domain, dockering
SLSYGTGYPCCKDKNTKVNYVSKSTGKEWGVENGNWCGI

SEQ ID NO: 5700 - protein, 31 aa, Piromyces finnis
  Cellulose docking domain, dockering
SQSILNQGYSCCSSGCEVIYTDSDGTWGVEN

SEQ ID NO: 5701 - protein, 40 aa, Piromyces finnis
  Cellulose docking domain, dockering
ACWSERLGYRCCSFTNDVILEDSDGKWGVENNDWCGIQNN

SEQ ID NO: 5702 - protein, 39 aa, Piromyces finnis
  Cellulose docking domain, dockering
TCWSSSLGYPCCTNTNEVIYEDSDGKWGIENNNWCGIIN

SEQ ID NO: 5703 - protein, 29 aa, Piromyces finnis
  Cellulose docking domain, dockering
DCVALYLGYPCCSPDNTYVVYQDESGDWG

SEQ ID NO: 5704 - protein, 29 aa, Piromyces finnis
  Cellulose docking domain, dockering
TCFSIKFGYNCCNECNVYYTDNDGKWGVE

SEQ ID NO: 5705 - protein, 44 aa, Piromyces finnis
  Cellulose docking domain, dockering
DCWASSLGYKCCTKTTKVEYVDANGEWGAERDEFGVRNWCGIIK

SEQ ID NO: 5706 - protein, 36 aa, Piromyces finnis
  Cellulose docking domain, dockering
PDPYPCCSSDQVQRIDSTYDGDWGKENGKKCGIVYE

SEQ ID NO: 5707 - protein, 39 aa, Piromyces finnis
  Cellulose docking domain, dockering
ACWSEKFNIPCCQTTKEVVRTTYDGIWGMENGEWCGLGT

SEQ ID NO: 5708 - protein, 26 aa, Piromyces finnis
  Cellulose docking domain, dockering
PDYPCCQPGAEVVYVDETGNWGVENG

SEQ ID NO: 5709 - protein, 30 aa, Piromyces finnis
  Cellulose docking domain, dockering
YSSKDGYPVCKTTTTVVYTDSEKWGVENGN

SEQ ID NO: 5710 - protein, 38 aa, Piromyces finnis
  Cellulose docking domain, dockering
SCFSVALGYPCCSGNNVVYSDSDGKWGFENNSWCGIAE

SEQ ID NO: 5711 - protein, 38 aa, Piromyces finnis
  Cellulose docking domain, dockering
SCFSIKLGYPCCNSNIVYYVDNDGQWGFENNNWCGIIS

SEQ ID NO: 5712 - protein, 39 aa, Piromyces finnis
  Cellulose docking domain, dockering
TCTGKDQGYQCCNSCSVYYVDNDGRWGIENGEWCGIKNT

SEQ ID NO: 5713 - protein, 32 aa, Piromyces finnis
  Cellulose docking domain, dockering
GKYPCCQGCIVVTTDKNGRWGVENNAWCSISY

SEQ ID NO: 5714 - protein, 39 aa, Piromyces finnis
  Cellulose docking domain, dockering
ECWSEKLGYTCCQGCKVYEKDSDGSWGYELNQWCGIPSK

SEQ ID NO: 5715 - protein, 39 aa, Piromyces finnis
  Cellulose docking domain, dockering
ECFSLALGHPCCDSCDVVSTDENGLWGVKDNDWCGIKSS

SEQ ID NO: 5716 - protein, 33 aa, Piromyces finnis
  Cellulose docking domain, dockering
LDETFDCCPDGTEVAYVDEYGEWGIINGEWCGF

SEQ ID NO: 5717 - protein, 33 aa, Piromyces finnis
  Cellulose docking domain, dockering
SEYSCCSSCIDIVEQDDDSSWGIENGQWCSIPF

SEQ ID NO: 5718 - protein, 32 aa, Piromyces finnis
  Cellulose docking domain, dockering
SCVGLNLGYPCCSSCNIAYSDETGNWGIENNE

SEQ ID NO: 5719 - protein, 38 aa, Piromyces finnis
  Cellulose docking domain, dockering
SCFSMALGFSCCEGNKIVYTDDDGDWGYENGEWCGIIK

SEQ ID NO: 5720 - protein, 40 aa, Piromyces finnis
  Cellulose docking domain, dockering
ECFSTKLGYKCCSSCTDVIYIDNDGQWGLENDNWCGIADK

SEQ ID NO: 5721 - protein, 31 aa, Piromyces finnis
  Cellulose docking domain, dockering
DCFSIALGFPCCKGNDIVYTDNDGPWGVENG

SEQ ID NO: 5722 - protein, 36 aa, Piromyces finnis; identical to SEQ ID NO: 3200
  Cellulose docking domain, dockering

SEQ ID NO: 5723 - protein, 31 aa, Piromyces finnis
  Cellulose docking domain, dockering
GYECCFDNEVVYEDESGKWGINEKGEWCGVE

SEQ ID NO: 5724 - protein, 33 aa, Piromyces finnis
  Cellulose docking domain, dockering
DYPCCQNTNFSYYTDSAGNEWGIENNNWCGIKP

SEQ ID NO: 5725 - protein, 39 aa, Piromyces finnis
  Cellulose docking domain, dockering
CSSKITKQGYKCCSKGCEIYYVDADGDWGFESGDWCGCG

SEQ ID NO: 5726 - protein, 30 aa, Piromyces finnis
  Cellulose docking domain, dockering
CPSKITSQGYKCCKDNCIIYYTDADGDWGV

SEQ ID NO: 5727 - protein, 36 aa, Piromyces finnis
  Cellulose docking domain, dockering
SKAGYPCCSPEITEVIYTDDEGNWGSENNNWCLMAE

SEQ ID NO: 5728 - protein, 43 aa, Piromyces finnis
  Cellulose docking domain, dockering
CSSIFSELGYKCCYDQNTKVEYIDEFGNWGIENGKLCGIGYDR

SEQ ID NO: 5729 - protein, 37 aa, Piromyces finnis
  Cellulose docking domain, dockering
ILDDGYPCCSSVNPEVQYTDDNGNKWGVEDGEWCGIG

SEQ ID NO: 5730 - protein, 39 aa, Piromyces finnis
  Cellulose docking domain, dockering
CFSEVLGYPCCSDPNADVVTTDEYGQWGIENNLWCGILG

SEQ ID NO: 5731 - protein, 39 aa, Piromyces finnis; identical to SEQ ID NO: 5730
  Cellulose docking domain, dockering

SEQ ID NO: 5732 - protein, 43 aa, Piromyces finnis; identical to SEQ ID NO: 5728
  Cellulose docking domain, dockering

SEQ ID NO: 5733 - protein, 37 aa, Piromyces finnis; identical to SEQ ID NO: 5729
  Cellulose docking domain, dockering

SEQ ID NO: 5734 - protein, 36 aa, Piromyces finnis; identical to SEQ ID NO: 5727
  Cellulose docking domain, dockering

SEQ ID NO: 5735 - protein, 35 aa, Piromyces finnis
  Cellulose docking domain, dockering
NCWAKSLGYKCCASKCAEVYSTDASGKWSIENNEW

SEQ ID NO: 5736 - protein, 37 aa, Piromyces finnis
  Cellulose docking domain, dockering
TCFSTSMGYPCCKDTSRVVTTDCDGKWGVENGEWCGI

SEQ ID NO: 5737 - protein, 37 aa, Piromyces finnis; identical to SEQ ID NO: 5736
  Cellulose docking domain, dockering

SEQ ID NO: 5738 - protein, 35 aa, Piromyces finnis; identical to SEQ ID NO: 5735
  Cellulose docking domain, dockering

SEQ ID NO: 5739 - protein, 43 aa, Piromyces finnis
  Cellulose docking domain, dockering
SQTILDQGYSCCSYNCKVVHEENKGESKYYWGVEKDNWCGCPL

SEQ ID NO: 5740 - protein, 39 aa, Piromyces finnis
  Cellulose docking domain, dockering
SITEKGYKCCSNNHCRSKYEDEDGIWSIENGEWCGVSLE

SEQ ID NO: 5741 - protein, 29 aa, Piromyces finnis
  Cellulose docking domain, dockering
SKFILERGYKCCSDNCEVTHSDENGDWGY

SEQ ID NO: 5742 - protein, 29 aa, Piromyces finnis
  Cellulose docking domain, dockering
DCWSDVLGYSCCSKCLEAVYEDQDGKWGV

SEQ ID NO: 5743 - protein, 35 aa, Piromyces finnis
  Cellulose docking domain, dockering
NGGLDYECCSSLNVKLQSIDADAKWGFENGKWCII

SEQ ID NO: 5744 - protein, 40 aa, Piromyces finnis
  Cellulose docking domain, dockering
ECWSKKFGYDCCVLPETRAIYSDANGKYGVEFKQKCGIVD

SEQ ID NO: 5745 - protein, 33 aa, Piromyces finnis
  Cellulose docking domain, dockering
FNYPCCVKTEKGTYSDGDGDWAQENGDWCTIRH

SEQ ID NO: 5746 - protein, 30 aa, Piromyces finnis; identical to SEQ ID NO: 3223
  Cellulose docking domain, dockering

SEQ ID NO: 5747 - protein, 18 aa, Piromyces finnis
  Cellulose docking domain, dockering
DGKWSVENGDWCLIDESK

SEQ ID NO: 5748 - protein, 29 aa, Piromyces finnis
  Cellulose docking domain, dockering
SCKFEALGYSCCSNCGPVYFTDSDGKWGV

SEQ ID NO: 5749 - protein, 36 aa, Piromyces finnis
  Cellulose docking domain, dockering
CHPSYPCCNGCDVTYVDNEGEWGVQNNNWCFIDSGK

SEQ ID NO: 5750 - protein, 30 aa, Piromyces finnis
  Cellulose docking domain, dockering
NCFSETLGYSCCENTTEVVHVDENGEWGIE

SEQ ID NO: 5751 - protein, 38 aa, Piromyces finnis
  Cellulose docking domain, dockering
ECFSLKFGVPCCKQTKDVVYVDSNGEWGVENNNWCGMK

SEQ ID NO: 5752 - protein, 39 aa, Piromyces finnis
  Cellulose docking domain, dockering
KCWSEDFGYPCCKGCIVYEEDEHGQWGYDFTEATWCGIQ

SEQ ID NO: 5753 - protein, 40 aa, Piromyces finnis
  Cellulose docking domain, dockering
ECWVAQFGYPCCAKNNKIVYDVDADGEWGYNFKTKEWCGI

SEQ ID NO: 5754 - protein, 31 aa, Piromyces finnis
  Cellulose docking domain, dockering
PNYECCNGCDVVYTDAEGKWGVENNNWCIIN

SEQ ID NO: 5755 - protein, 34 aa, Piromyces finnis
  Cellulose docking domain, dockering
PTQYPWCNGCKVYYTDAEGNWGVENNDWCLIKSS

SEQ ID NO: 5756 - protein, 34 aa, Piromyces finnis; identical to SEQ ID NO: 5755
  Cellulose docking domain, dockering

SEQ ID NO: 5757 - protein, 31 aa, Piromyces finnis; identical to SEQ ID NO: 5754
  Cellulose docking domain, dockering

SEQ ID NO: 5758 - protein, 34 aa, Piromyces finnis; identical to SEQ ID NO: 3236
  Cellulose docking domain, dockering

SEQ ID NO: 5759 - protein, 34 aa, Piromyces finnis
  Cellulose docking domain, dockering
KQSGFPCCLDLNGGIISVDGAGEWNIEGSIWCLY

SEQ ID NO: 5760 - protein, 38 aa, Piromyces finnis
  Cellulose docking domain, dockering
CPGIKYGYECCEKCDVVETDELGQWGAINGEWCSIKKS

SEQ ID NO: 5761 - protein, 39 aa, Piromyces finnis
  Cellulose docking domain, dockering
ECPGKKYGYPCCEKCDVFLTDKDGAWGVQNSNWCSVKDS

SEQ ID NO: 5762 - protein, 37 aa, Piromyces finnis
  Cellulose docking domain, dockering
SCWSQGLGFQCCSGCNVEYVDSDGEWGLENGEWCGIP

SEQ ID NO: 5763 - protein, 37 aa, Piromyces finnis; identical to SEQ ID NO: 5762
  Cellulose docking domain, dockering

SEQ ID NO: 5764 - protein, 39 aa, Piromyces finnis; identical to SEQ ID NO: 5761
  Cellulose docking domain, dockering

SEQ ID NO: 5765 - protein, 37 aa, Piromyces finnis; identical to SEQ ID NO: 3242
  Cellulose docking domain, dockering

SEQ ID NO: 5766 - protein, 39 aa, Piromyces finnis
  Cellulose docking domain, dockering
TCWSLSLGYNCCSAGAEVILVDENGEWGFEMNEWCGIIK

SEQ ID NO: 5767 - protein, 30 aa, Piromyces finnis; identical to SEQ ID NO: 3244
  Cellulose docking domain, dockering

SEQ ID NO: 5768 - protein, 37 aa, Piromyces finnis
  Cellulose docking domain, dockering
CKSGGGEYKCCKGCQIIYTDNEDWGVENDNWCSIPYS

SEQ ID NO: 5769 - protein, 39 aa, Piromyces finnis
  Cellulose docking domain, dockering
DCWSTNLGFPCCQLKTTKVQYGDNTNSQFGIENGQLCGI

SEQ ID NO: 5770 - protein, 37 aa, Piromyces finnis
  Cellulose docking domain, dockering
CWSRKLGYPCCSEGALVVNVDENGKWGIDKDNWCGIL

SEQ ID NO: 5771 - protein, 33 aa, Piromyces finnis
  Cellulose docking domain, dockering
RNTGYPCCSDPKASIITNDISGDWGIEGNTWCL

SEQ ID NO: 5772 - protein, 39 aa, Piromyces finnis
  Cellulose docking domain, dockering
ECWSLERGYPCCETNTEVFYTSSNGKTWSIENNDWCGIN

SEQ ID NO: 5773 - protein, 34 aa, Piromyces finnis
  Cellulose docking domain, dockering
HAYSDCKNCRVVTVEDGVSWGVENNDWCVIKSSI

SEQ ID NO: 5774 - protein, 22 aa, Piromyces finnis
  Cellulose docking domain, dockering
PDYPCCSGCDAIYEDDDGKWGV

SEQ ID NO: 5775 - protein, 41 aa, Piromyces finnis
  Cellulose docking domain, dockering
SCWASSEGYKCCQNTCDAIYSEGSKKWGFENGDWCGIVDNR

SEQ ID NO: 5776 - protein, 31 aa, Piromyces finnis; identical to SEQ ID NO: 3255
  Cellulose docking domain, dockering

SEQ ID NO: 5777 - protein, 41 aa, Piromyces finnis
  Cellulose docking domain, dockering
CSSSFKNQGYSCCKGCSVVDTDATGDWGVENGQWCGIDTQA

SEQ ID NO: 5778 - protein, 37 aa, Piromyces finnis
  Cellulose docking domain, dockering
CSSSFKNQGYSCCKGCSVVDTDATGDWGVENGQWCGC

SEQ ID NO: 5779 - protein, 38 aa, Piromyces finnis
  Cellulose docking domain, dockering
AITNQGYKCCSGCSYVYYEDQDGKWGVENNDWCGIKDS

SEQ ID NO: 5780 - protein, 32 aa, Piromyces finnis; identical to SEQ ID NO: 3260
  Cellulose docking domain, dockering

SEQ ID NO: 5781 - protein, 39 aa, Piromyces finnis
  Cellulose docking domain, dockering
DCWSLAEGYKCCSEGTPVVLTDSKGKWGIENNDWCGIVT

SEQ ID NO: 5782 - protein, 30 aa, Piromyces finnis; identical to SEQ ID NO: 3261
  Cellulose docking domain, dockering

SEQ ID NO: 5783 - protein, 35 aa, Piromyces finnis
  Cellulose docking domain, dockering
NCWANAEGYNCCKSTTQVVLTDSKGKWGIENNQWC

SEQ ID NO: 5784 - protein, 31 aa, Piromyces finnis
  Cellulose docking domain, dockering
YKCCKNCNVVLDDNTGKWGVENNQWCGIDTS

SEQ ID NO: 5785 - protein, 27 aa, Piromyces finnis
  Cellulose docking domain, dockering
TCWSRPLGYECCETCSYIVLSDADGDW

SEQ ID NO: 5786 - protein, 40 aa, Piromyces finnis
  Cellulose docking domain, dockering
GCWAEALGYKCCSAGNYMVLLTDESGAWGAENGEWCGIVK

SEQ ID NO: 5787 - protein, 38 aa, Piromyces finnis
  Cellulose docking domain, dockering
YCFAKSDGYECCFDNEVVYEDESGKWGINEKGEWCGVE

SEQ ID NO: 5788 - protein, 40 aa, Piromyces finnis; identical to SEQ ID NO: 5786
  Cellulose docking domain, dockering

SEQ ID NO: 5789 - protein, 27 aa, Piromyces finnis
  Cellulose docking domain, dockering
TCWSRPLGYECCETCSYIVLSDADGDW

SEQ ID NO: 5790 - protein, 38 aa, Piromyces finnis; identical to SEQ ID NO: 5787
  Cellulose docking domain, dockering

SEQ ID NO: 5791 - protein, 34 aa, Piromyces finnis; identical to SEQ ID NO: 3270
  Cellulose docking domain, dockering

SEQ ID NO: 5792 - protein, 31 aa, Piromyces finnis
  Cellulose docking domain, dockering
DYQCCADGTEVIYTDESGDWGVINDEWCGIK

SEQ ID NO: 5793 - protein, 40 aa, Piromyces finnis
  Cellulose docking domain, dockering
DCFSTSMGYPCCSGCEDIYEDDDGKWGVENDDWCGIDEAK

SEQ ID NO: 5794 - protein, 33 aa, Piromyces finnis
  Cellulose docking domain, dockering
PDYPCCEGDTVIYSDESGDWGVENDEWCGIVKS

SEQ ID NO: 5795 - protein, 35 aa, Piromyces finnis
  Cellulose docking domain, dockering
GCWAEALGYECCSTCQPSQYKDESGEWGVENGEWC

SEQ ID NO: 5796 - protein, 39 aa, Piromyces finnis
  Cellulose docking domain, dockering
SCWANALNYPCCKTTTEVVLTDNDGKWGIENNEWCGINS

SEQ ID NO: 5797 - protein, 23 aa, Piromyces finnis
  Cellulose docking domain, dockering
EAIFTDGEKKWGVENGQWCGMPN

SEQ ID NO: 5798 - protein, 25 aa, Piromyces finnis
  Cellulose docking domain, dockering
EAIFTDGEKKWGVENGQWCGIIESQ

SEQ ID NO: 5799 - protein, 33 aa, Piromyces finnis
  Cellulose docking domain, dockering
ALGYPCCQSTSSVVFTDNTGKWGIENNDWCEIK

SEQ ID NO: 5800 - protein, 39 aa, Piromyces finnis; identical to SEQ ID NO: 5796
  Cellulose docking domain, dockering

SEQ ID NO: 5801 - protein, 37 aa, Piromyces finnis; identical to SEQ ID NO: 5619
  Cellulose docking domain, dockering

SEQ ID NO: 5802 - protein, 35 aa, Piromyces finnis
  Cellulose docking domain, dockering
SAADYPCCEQCNIVSEEEGDFWGVENNEWCSIKFK

SEQ ID NO: 5803 - protein, 35 aa, Piromyces finnis; identical to SEQ ID NO: 5802
  Cellulose docking domain, dockering

SEQ ID NO: 5804 - protein, 38 aa, Piromyces finnis
  Cellulose docking domain, dockering
DCWANKLGYDCCKTSKEVYEDVEGKWGVENGNWCGIVE

SEQ ID NO: 5805 - protein, 37 aa, Piromyces finnis; identical to SEQ ID NO: 5619
  Cellulose docking domain, dockering

SEQ ID NO: 5806 - protein, 40 aa, Piromyces finnis
  Cellulose docking domain, dockering
ECWSLKYGYECCSPNNTRVVVTDESGKWGVENSDWCGIVD

SEQ ID NO: 5807 - protein, 38 aa, Piromyces finnis; identical to SEQ ID NO: 5804
  Cellulose docking domain, dockering

SEQ ID NO: 5808 - protein, 40 aa, Piromyces finnis
  Cellulose docking domain, dockering
KCWSIPFGYKCCDHCKVLLTDESGKWGELNGEWCGIDTTK

SEQ ID NO: 5809 - protein, 40 aa, Piromyces finnis; identical to SEQ ID NO: 5808
  Cellulose docking domain, dockering

SEQ ID NO: 5810 - protein, 40 aa, Piromyces finnis; identical to SEQ ID NO: 5806
  Cellulose docking domain, dockering

SEQ ID NO: 5811 - protein, 35 aa, Piromyces finnis; identical to SEQ ID NO: 5802
  Cellulose docking domain, dockering

SEQ ID NO: 5812 - protein, 37 aa, Piromyces finnis; identical to SEQ ID NO: 5619
  Cellulose docking domain, dockering

SEQ ID NO: 5813 - protein, 33 aa, Piromyces finnis; identical to SEQ ID NO: 3292
  Cellulose docking domain, dockering

SEQ ID NO: 5814 - protein, 33 aa, Piromyces finnis; identical to SEQ ID NO: 3292
  Cellulose docking domain, dockering

SEQ ID NO: 5815 - protein, 40 aa, Piromyces finnis
  Cellulose docking domain, dockering
CSANILKQGYKCCSSTNCTIVFTDNDGTWGVENNQWCGCA

SEQ ID NO: 5816 - protein, 39 aa, Piromyces finnis
  Cellulose docking domain, dockering
ISITSQGYSCCAGNNCSVVLTDESGRWGVENNQWCGISN

SEQ ID NO: 5817 - protein, 32 aa, Piromyces finnis
  Cellulose docking domain, dockering
EYLCCDGCNVVEETAEGKWGIENNYWCGIKNS

SEQ ID NO: 5818 - protein, 33 aa, Piromyces finnis
  Cellulose docking domain, dockering
KAYDYCNACGVVLEEDGVKWGVENNDWCIIPSK

SEQ ID NO: 5819 - protein, 40 aa, Piromyces finnis
  Cellulose docking domain, dockering
KCEAEEYGYICCPNYLTEVLYQDEEGDWAYDYVMEDWCII

SEQ ID NO: 5820 - protein, 39 aa, Piromyces finnis
  Cellulose docking domain, dockering
ECWTSPLGYECCDSCDVIYEDNNGQWGVKNNKWCGILPN

SEQ ID NO: 5821 - protein, 40 aa, Piromyces finnis
  Cellulose docking domain, dockering
KCWAEFIGYQCCSAENTDVYLHDSNGDWGYDFDTNEWCGI

SEQ ID NO: 5822 - protein, 39 aa, Piromyces finnis
  Cellulose docking domain, dockering
ECWSEELGYPCCKDCTVYETDESGEWGYDFKNMQWCGIQ

SEQ ID NO: 5823 - protein, 36 aa, Piromyces finnis
  Cellulose docking domain, dockering
ASCWAQSQGYSCCSNPGSTKVEFTDASGNWGIENGN

SEQ ID NO: 5824 - protein, 36 aa, Piromyces finnis; identical to SEQ ID NO: 5823
  Cellulose docking domain, dockering

SEQ ID NO: 5825 - protein, 22 aa, Piromyces finnis
  Cellulose docking domain, dockering
YPAYPCCKGNTVVYTDNEGSWG

SEQ ID NO: 5826 - protein, 22 aa, Piromyces finnis
  Cellulose docking domain, dockering
YPAYPCCKGNTVVYTDNEGSWG

SEQ ID NO: 5827 - protein, 42 aa, Piromyces finnis
  Cellulose docking domain, dockering
ECWAEKLGYKCCPDDVCTTLHSDANGEWSIVNDEWCGIISSL

SEQ ID NO: 5828 - protein, 42 aa, Piromyces finnis
  Cellulose docking domain, dockering
ECWAKKLNYPCCKKDNCMKFYVNDDGAWGFENWKWCGIDTEY

SEQ ID NO: 5829 - protein, 38 aa, Piromyces finnis
  Cellulose docking domain, dockering
ECWAEKLGYKCCPDDVCTTLHSDANGEWSIVNDEWCGI

SEQ ID NO: 5830 - protein, 42 aa, Piromyces finnis; identical to SEQ ID NO: 5828
  Cellulose docking domain, dockering

SEQ ID NO: 5831 - protein, 42 aa, Piromyces finnis
  Cellulose docking domain, dockering
QCWSKPLGYDCCVDPYIQIAYSDDDGDWGYENDEWCGIISSL

SEQ ID NO: 5832 - protein, 40 aa, Piromyces finnis
  Cellulose docking domain, dockering
QCWSKPLGYDCCVDPYIQIAYSDDDGDWGYENDEWCGIIE

SEQ ID NO: 5833 - protein, 35 aa, Piromyces finnis
  Cellulose docking domain, dockering
GGYPCCKRSCIVVEENASGKWSLEKHDWCLIDLEV

SEQ ID NO: 5834 - protein, 39 aa, Piromyces finnis
  Cellulose docking domain, dockering
SCWSEKLGYKCCKSCDIILKDASGKWGVEDGKWCGIPST

SEQ ID NO: 5835 - protein, 42 aa, Piromyces finnis; identical to SEQ ID NO: 5828
  Cellulose docking domain, dockering

SEQ ID NO: 5836 - protein, 40 aa, Piromyces finnis
  Cellulose docking domain, dockering
ECWAEKLGYKCCPDDVCTTLHSDANGEWSIVNDEWCGIIE

SEQ ID NO: 5837 - protein, 29 aa, Piromyces finnis
  Cellulose docking domain, dockering
ECWSEVQGYPCCTQTTEVAYTDSDGDWGV

SEQ ID NO: 5838 - protein, 39 aa, Piromyces finnis
  Cellulose docking domain, dockering
NCWSIKLGYPCCPEDTTIITTDDDGDWGIYNENWCGILK

SEQ ID NO: 5839 - protein, 44 aa, Piromyces finnis
  Cellulose docking domain, dockering
ECWSLALSIPCCNKNKEIYSKDQDGNWGITTDENGNSIWCGIRK

SEQ ID NO: 5840 - protein, 39 aa, Piromyces finnis
  Cellulose docking domain, dockering
RCWSRAGGYPCCEGGESIALIDQDGIWGQNANGNWCGFR

SEQ ID NO: 5841 - protein, 43 aa, Piromyces finnis
  Cellulose docking domain, dockering
YCWSEKLGYPCCPEEITQPNYKDSEGDWVFNSNGEWCGIRNGR

SEQ ID NO: 5842 - protein, 29 aa, Piromyces finnis
  Cellulose docking domain, dockering
KCWASLLGYKCCVGTNPAVVFVDDDGKWG

SEQ ID NO: 5843 - protein, 43 aa, Piromyces finnis; identical to SEQ ID NO: 5841
  Cellulose docking domain, dockering

SEQ ID NO: 5844 - protein, 39 aa, Piromyces finnis; identical to SEQ ID NO: 5840
  Cellulose docking domain, dockering

SEQ ID NO: 5845 - protein, 31 aa, Piromyces finnis
  Cellulose docking domain, dockering
HYQCCKGNVVVQSDSNGDWGYEDGQWCGIIK

SEQ ID NO: 5846 - protein, 40 aa, Piromyces finnis
  Cellulose docking domain, dockering
DCWSSALGYQCCKGCSVISEDADGKWGFEDKHWCGIVDDV

SEQ ID NO: 5847 - protein, 33 aa, Piromyces finnis
  Cellulose docking domain, dockering
PDYPCCKTTSLVVSSDAEGDWGYEDNQWCGIVK

SEQ ID NO: 5848 - protein, 40 aa, Piromyces finnis
  Cellulose docking domain, dockering
DCWSSTMGYQCCKSCSVIAEDSDGKWGFEDKHWCGIVDDV

SEQ ID NO: 5849 - protein, 31 aa, Piromyces finnis; identical to SEQ ID NO: 5845
  Cellulose docking domain, dockering

SEQ ID NO: 5850 - protein, 33 aa, Piromyces finnis; identical to SEQ ID NO: 5847
  Cellulose docking domain, dockering

SEQ ID NO: 5851 - protein, 31 aa, Piromyces finnis
  Cellulose docking domain, dockering
HYQCCKGNEVVFTDHNGDWGFENNQWCGIVK

SEQ ID NO: 5852 - protein, 32 aa, Piromyces finnis
  Cellulose docking domain, dockering
DYPCCKNTSLVVASDAQGDWGYEDNQWCGIVK

SEQ ID NO: 5853 - protein, 33 aa, Piromyces finnis
  Cellulose docking domain, dockering
PDYPCCPTCDVFLTEEDGNRWGVLYDNWCSIKN

SEQ ID NO: 5854 - protein, 40 aa, Piromyces finnis
  Cellulose docking domain, dockering
CPSSITSQGYACCRGCDVVYTDENGDWGIENDYWCGISQS

SEQ ID NO: 5855 - protein, 35 aa, Piromyces finnis
  Cellulose docking domain, dockering
IKKQGYPCCSSCIVYFSDKDGQWGVENGKWCGIQD

SEQ ID NO: 5856 - protein, 39 aa, Piromyces finnis
  Cellulose docking domain, dockering
DCFSTKLGYPCCTSTTQVVFTDNDGNWGVENNDWCGLTN

SEQ ID NO: 5857 - protein, 39 aa, Piromyces finnis; identical to SEQ ID NO: 5856
  Cellulose docking domain, dockering

SEQ ID NO: 5858 - protein, 41 aa, Piromyces finnis
  Cellulose docking domain, dockering
SCWSEIYGYPCCSGCDVIYEESETMRWGVENNDWCGIINSN

SEQ ID NO: 5859 - protein, 41 aa, Piromyces finnis
  Cellulose docking domain, dockering
QCWSEKLGFPCCSKCGQVVYTDEDGNWSVENNDWCGIINSN

SEQ ID NO: 5860 - protein, 39 aa, Piromyces finnis
  Cellulose docking domain, dockering
DCAAASQGYPCCKNQNAEVYYQDETGDWGIENGEWCGIT

SEQ ID NO: 5861 - protein, 32 aa, Piromyces finnis
  Cellulose docking domain, dockering
SEYPCCEDCVVVYEDNQKWGILNNDWCSTPYS

SEQ ID NO: 5862 - protein, 33 aa, Piromyces finnis; identical to SEQ ID NO: 3345
  Cellulose docking domain, dockering

SEQ ID NO: 5863 - protein, 34 aa, Piromyces finnis; identical to SEQ ID NO: 3347
  Cellulose docking domain, dockering

SEQ ID NO: 5864 - protein, 39 aa, Piromyces finnis
  Cellulose docking domain, dockering
ECWSEALGYKCCSHCVAILEDQDGAWGSENGEWCGIQNE

SEQ ID NO: 5865 - protein, 39 aa, Piromyces finnis
  Cellulose docking domain, dockering
QCWSMKYGYPCCEDCQLYLEDESGAWGVLNYDWCGIPSS

SEQ ID NO: 5866 - protein, 39 aa, Piromyces finnis
  Cellulose docking domain, dockering
ECWSEALGYKCCSHCVAILEDQDGAWGSENGEWCGIPDT

SEQ ID NO: 5867 - protein, 40 aa, Piromyces finnis
  Cellulose docking domain, dockering
QCWSKRLGYECCKQKFEVVETDENGSWSIENNEWCGIPEN

SEQ ID NO: 5868 - protein, 34 aa, Piromyces finnis
  Cellulose docking domain, dockering
SGNYPCCPEGTPIQYSDDEGDWGVYMDNWCGIVK

SEQ ID NO: 5869 - protein, 40 aa, Piromyces finnis
  Cellulose docking domain, dockering
CWSMAGGFPCCSPENTNVVYRDQDGKWGLDEDGNWCGMKN

SEQ ID NO: 5870 - protein, 32 aa, Piromyces finnis
  Cellulose docking domain, dockering
DYPCCDSCDVVFSDTLGDWGVQNDQWCGIKAS

SEQ ID NO: 5871 - protein, 29 aa, Piromyces finnis
  Cellulose docking domain, dockering
FSEPDYPCCKSTCNVVDTDANGKWGVENG

SEQ ID NO: 5872 - protein, 38 aa, Piromyces finnis
  Cellulose docking domain, dockering
QCWSKRLGYECCKQKFEVVETDENGSWSIENNEWCGIP

SEQ ID NO: 5873 - protein, 40 aa, Piromyces finnis; identical to SEQ ID NO: 5869
  Cellulose docking domain, dockering

SEQ ID NO: 5874 - protein, 34 aa, Piromyces finnis; identical to SEQ ID NO: 5868
  Cellulose docking domain, dockering

SEQ ID NO: 5875 - protein, 38 aa, Piromyces finnis
  Cellulose docking domain, dockering
SCWAGALGYPCCEGCDVVYTDNDGKWGYEDDWCGIKES

SEQ ID NO: 5876 - protein, 34 aa, Piromyces finnis
  Cellulose docking domain, dockering
SNYPCCSSFNTVVTYTDQDGNWGFENDDWCGMRD

SEQ ID NO: 5877 - protein, 37 aa, Piromyces finnis
  Cellulose docking domain, dockering
CWSEPKYPCCSEGVKVYSKTSSGEWGIENGNWCGIPR

SEQ ID NO: 5878 - protein, 40 aa, Piromyces finnis
  Cellulose docking domain, dockering
PCWAKPLGYNCCHGETQVIYTDNDGQWGSEDGKWCGIISN

SEQ ID NO: 5879 - protein, 34 aa, Piromyces finnis; identical to SEQ ID NO: 5876
  Cellulose docking domain, dockering

SEQ ID NO: 5880 - protein, 37 aa, Piromyces finnis
  Cellulose docking domain, dockering
TCWASSLGYDCCEGCDIITTDEYGEWGIENGNWCGIP

SEQ ID NO: 5881 - protein, 34 aa, Piromyces finnis; identical to SEQ ID NO: 5876
  Cellulose docking domain, dockering

SEQ ID NO: 5882 - protein, 37 aa, Piromyces finnis; identical to SEQ ID NO: 5880
  Cellulose docking domain, dockering

SEQ ID NO: 5883 - protein, 40 aa, Piromyces finnis; identical to SEQ ID NO: 5878
  Cellulose docking domain, dockering

SEQ ID NO: 5884 - protein, 39 aa, Piromyces finnis
  Cellulose docking domain, dockering
CPVESKGYKCCNDPNLQSMFEDEDGQWYYENDEWCLIVS

SEQ ID NO: 5885 - protein, 40 aa, Piromyces finnis; identical to SEQ ID NO: 5878
  Cellulose docking domain, dockering

SEQ ID NO: 5886 - protein, 34 aa, Piromyces finnis; identical to SEQ ID NO: 5876
  Cellulose docking domain, dockering

SEQ ID NO: 5887 - protein, 36 aa, Piromyces finnis
  Cellulose docking domain, dockering
CWSEPKYPCCSEGVKVYSKTSSGEWGIENGNWCGIP

SEQ ID NO: 5888 - protein, 40 aa, Piromyces finnis; identical to SEQ ID NO: 5878
  Cellulose docking domain, dockering

SEQ ID NO: 5889 - protein, 36 aa, Piromyces finnis; identical to SEQ ID NO: 5887
  Cellulose docking domain, dockering

SEQ ID NO: 5890 - protein, 34 aa, Piromyces finnis; identical to SEQ ID NO: 5876
  Cellulose docking domain, dockering

SEQ ID NO: 5891 - protein, 39 aa, Piromyces finnis; identical to SEQ ID NO: 5884
  Cellulose docking domain, dockering

SEQ ID NO: 5892 - protein, 37 aa, Piromyces finnis
  Cellulose docking domain, dockering
CPVESKGYKCCNDPNLQSMFEDEDGQWYYENDEWCLI

SEQ ID NO: 5893 - protein, 36 aa, Piromyces finnis
  Cellulose docking domain, dockering
MNTGYSCCSNPNAYVYTTDITGNWSIEGNYWCLIVK

SEQ ID NO: 5894 - protein, 40 aa, Piromyces finnis
  Cellulose docking domain, dockering
ECWSTSFGYPCCQSKDTTISLTEFGTGNQYGIENGRFCGI

SEQ ID NO: 5895 - protein, 31 aa, Piromyces finnis
  Cellulose docking domain, dockering
KYKCCKKCKVVYTDNYLWGAEHNEWCSIPYS

SEQ ID NO: 5896 - protein, 32 aa, Piromyces finnis
  Cellulose docking domain, dockering
GYKCCSHCDVYLTDEVGQWGVENNYWCGIPES

SEQ ID NO: 5897 - protein, 40 aa, Piromyces finnis
  Cellulose docking domain, dockering
CNAEFIKQGYKCCSGCRTVYYTDDLGDWGVEDGDWCGIPT

SEQ ID NO: 5898 - protein, 33 aa, Piromyces finnis
  Cellulose docking domain, dockering
NYECCNNCQVIETDDEGRWGSLNGEWCFIDESK

SEQ ID NO: 5899 - protein, 39 aa, Piromyces finnis
  Cellulose docking domain, dockering
NCKFEQYGYKCCSHCDVYLTDEMGQWGVENNYWCGIPES

SEQ ID NO: 5900 - protein, 40 aa, Piromyces finnis; identical to SEQ ID NO: 5897
  Cellulose docking domain, dockering

SEQ ID NO: 5901 - protein, 33 aa, Piromyces finnis; identical to SEQ ID NO: 5898
  Cellulose docking domain, dockering

SEQ ID NO: 5902 - protein, 39 aa, Piromyces finnis; identical to SEQ ID NO: 5899
  Cellulose docking domain, dockering

SEQ ID NO: 5903 - protein, 40 aa, Piromyces finnis; identical to SEQ ID NO: 5897
  Cellulose docking domain, dockering

SEQ ID NO: 5904 - protein, 36 aa, Piromyces finnis
  Cellulose docking domain, dockering
NNSGYPCCVFTTTVIMSDRSGNWGIEYGQWCYIKEE

SEQ ID NO: 5905 - protein, 38 aa, Piromyces finnis
  Cellulose docking domain, dockering
ECWSLKEGYQCCQDEKTTIIPTKDGKEWGIENNEWCGI

SEQ ID NO: 5906 - protein, 31 aa, Piromyces finnis
  Cellulose docking domain, dockering
EYKCCEKCKVVYSDGEDWGVEHGNWCSIPYS

SEQ ID NO: 5907 - protein, 38 aa, Piromyces finnis
  Cellulose docking domain, dockering
ECWSEVLGYSCCKDKKTKVSYVDASGEWGAEHGQWCGI

SEQ ID NO: 5908 - protein, 33 aa, Piromyces finnis
  Cellulose docking domain, dockering
KNSGYPCCVKTKTLVSSDAVGDWGIENNDWCLF

SEQ ID NO: 5909 - protein, 34 aa, Piromyces finnis
  Cellulose docking domain, dockering
YNTGYNCCLSDKTPSSTTDNIGKWGIEGGDWCLI

SEQ ID NO: 5910 - protein, 21 aa, Piromyces finnis
  Cellulose docking domain, dockering
QYKCCKKCEVIMTDDDGDWGI

SEQ ID NO: 5911 - protein, 39 aa, Piromyces finnis
  Cellulose docking domain, dockering
NCWSIKYGYSCCTNKNTKVSFVEPTGEKYGIEHDQWCGI

SEQ ID NO: 5912 - protein, 34 aa, Piromyces finnis; identical to SEQ ID NO: 5909
  Cellulose docking domain, dockering

SEQ ID NO: 5913 - protein, 39 aa, Piromyces finnis; identical to SEQ ID NO: 5911
  Cellulose docking domain, dockering

SEQ ID NO: 5914 - protein, 21 aa, Piromyces finnis
  Cellulose docking domain, dockering
QYKCCKKCEVIMTDDDGDWGI

SEQ ID NO: 5915 - protein, 31 aa, Piromyces finnis; identical to SEQ ID NO: 5906
  Cellulose docking domain, dockering

SEQ ID NO: 5916 - protein, 33 aa, Piromyces finnis; identical to SEQ ID NO: 5908
  Cellulose docking domain, dockering

SEQ ID NO: 5917 - protein, 38 aa, Piromyces finnis; identical to SEQ ID NO: 5907
  Cellulose docking domain, dockering

SEQ ID NO: 5918 - protein, 33 aa, Piromyces finnis; identical to SEQ ID NO: 5908
  Cellulose docking domain, dockering

SEQ ID NO: 5919 - protein, 38 aa, Piromyces finnis; identical to SEQ ID NO: 5907
  Cellulose docking domain, dockering

SEQ ID NO: 5920 - protein, 31 aa, Piromyces finnis; identical to SEQ ID NO: 5906
  Cellulose docking domain, dockering

SEQ ID NO: 5921 - protein, 34 aa, Piromyces finnis; identical to SEQ ID NO: 5909
  Cellulose docking domain, dockering

SEQ ID NO: 5922 - protein, 39 aa, Piromyces finnis; identical to SEQ ID NO: 5911
  Cellulose docking domain, dockering

SEQ ID NO: 5923 - protein, 21 aa, Piromyces finnis
  Cellulose docking domain, dockering
QYKCCKKCEVIMTDDDGDWGI

SEQ ID NO: 5924 - protein, 21 aa, Piromyces finnis
  Cellulose docking domain, dockering
QYKCCKKCEVIMTDDDGDWGI

SEQ ID NO: 5925 - protein, 34 aa, Piromyces finnis; identical to SEQ ID NO: 5909
  Cellulose docking domain, dockering

SEQ ID NO: 5926 - protein, 39 aa, Piromyces finnis; identical to SEQ ID NO: 5911
  Cellulose docking domain, dockering

SEQ ID NO: 5927 - protein, 42 aa, Piromyces finnis
  Cellulose docking domain, dockering
KCWSEKLGYSCCKNKNTKISYISRSTGKELYYGVEHGQWCGI

SEQ ID NO: 5928 - protein, 36 aa, Piromyces finnis
  Cellulose docking domain, dockering
HNSGYSCCSLSNTEVRTTDAVGKWGIEGEEWCLIDE

SEQ ID NO: 5929 - protein, 21 aa, Piromyces finnis
  Cellulose docking domain, dockering
QYKCCKKCEVIMTDDDGDWGI

SEQ ID NO: 5930 - protein, 34 aa, Piromyces finnis; identical to SEQ ID NO: 5909
  Cellulose docking domain, dockering

SEQ ID NO: 5931 - protein, 39 aa, Piromyces finnis; identical to SEQ ID NO: 5911
  Cellulose docking domain, dockering

SEQ ID NO: 5932 - protein, 38 aa, Piromyces finnis; identical to SEQ ID NO: 5907
  Cellulose docking domain, dockering

SEQ ID NO: 5933 - protein, 33 aa, Piromyces finnis; identical to SEQ ID NO: 5908
  Cellulose docking domain, dockering

SEQ ID NO: 5934 - protein, 31 aa, Piromyces finnis; identical to SEQ ID NO: 5906
  Cellulose docking domain, dockering

SEQ ID NO: 5935 - protein, 38 aa, Piromyces finnis; identical to SEQ ID NO: 5907
  Cellulose docking domain, dockering

SEQ ID NO: 5936 - protein, 31 aa, Piromyces finnis; identical to SEQ ID NO: 5906
  Cellulose docking domain, dockering

SEQ ID NO: 5937 - protein, 33 aa, Piromyces finnis; identical to SEQ ID NO: 5908
  Cellulose docking domain, dockering

SEQ ID NO: 5938 - protein, 42 aa, Piromyces finnis
  Cellulose docking domain, dockering
ECWSLAEGYPCCKNQNTPVKYESKSRGVKYGIENGDWCGLIE

SEQ ID NO: 5939 - protein, 37 aa, Piromyces finnis
  Cellulose docking domain, dockering
TCWSSKIGYPCCKENNVIYAIDSQGSWGYENDSWCGI

SEQ ID NO: 5940 - protein, 39 aa, Piromyces finnis
  Cellulose docking domain, dockering
NCWASALGFTCCKATKTVVMEDADGAWGVEDGFWCGIVE

SEQ ID NO: 5941 - protein, 34 aa, Piromyces finnis; identical to SEQ ID NO: 3426
  Cellulose docking domain, dockering

SEQ ID NO: 5942 - protein, 39 aa, Piromyces finnis
  Cellulose docking domain, dockering
ACWSSALGYPCCKSCDAIYQDNDGKWGFENNDWCGIASS

SEQ ID NO: 5943 - protein, 40 aa, Piromyces finnis
  Cellulose docking domain, dockering
SCSGALGYPCCKSACTVYDTDSNGKWSIENNDWCLIDNSK

SEQ ID NO: 5944 - protein, 32 aa, Piromyces finnis; identical to SEQ ID NO: 3430
  Cellulose docking domain, dockering

SEQ ID NO: 5945 - protein, 30 aa, Piromyces finnis
  Cellulose docking domain, dockering
AYPCCNECEVIYTDNDGDWGVENNEWCLIN

SEQ ID NO: 5946 - protein, 36 aa, Piromyces finnis
  Cellulose docking domain, dockering
DCFAIAQGYECCNDNEVVYTDESGQWGIKDGQWCGI

SEQ ID NO: 5947 - protein, 38 aa, Piromyces finnis
  Cellulose docking domain, dockering
TCTGMNSGYQCCDTCNVVYTDNDGKWGIMNGEWCGIKS

SEQ ID NO: 5948 - protein, 41 aa, Piromyces finnis
  Cellulose docking domain, dockering
ACWSTGLGYNCCKSCVDVAYIDNDGKWGVENGNWCLIKESK

SEQ ID NO: 5949 - protein, 38 aa, Piromyces finnis; identical to SEQ ID NO: 5947
  Cellulose docking domain, dockering

SEQ ID NO: 5950 - protein, 37 aa, Piromyces finnis; identical to SEQ ID NO: 5687
  Cellulose docking domain, dockering

SEQ ID NO: 5951 - protein, 33 aa, Piromyces finnis
  Cellulose docking domain, dockering
DYACCSGCESVYVDNDGKWGVENGNWCLIKESK

SEQ ID NO: 5952 - protein, 32 aa, Piromyces finnis; identical to SEQ ID NO: 3430
  Cellulose docking domain, dockering

SEQ ID NO: 5953 - protein, 30 aa, Piromyces finnis; identical to SEQ ID NO: 5945
  Cellulose docking domain, dockering

SEQ ID NO: 5954 - protein, 36 aa, Piromyces finnis; identical to SEQ ID NO: 5946
  Cellulose docking domain, dockering

SEQ ID NO: 5955 - protein, 37 aa, Piromyces finnis; identical to SEQ ID NO: 5687
  Cellulose docking domain, dockering

SEQ ID NO: 5956 - protein, 33 aa, Piromyces finnis; identical to SEQ ID NO: 5951
  Cellulose docking domain, dockering

SEQ ID NO: 5957 - protein, 38 aa, Piromyces finnis; identical to SEQ ID NO: 5947
  Cellulose docking domain, dockering

SEQ ID NO: 5958 - protein, 36 aa, Piromyces finnis; identical to SEQ ID NO: 5946
  Cellulose docking domain, dockering

SEQ ID NO: 5959 - protein, 30 aa, Piromyces finnis; identical to SEQ ID NO: 5945
  Cellulose docking domain, dockering

SEQ ID NO: 5960 - protein, 32 aa, Piromyces finnis; identical to SEQ ID NO: 3430
  Cellulose docking domain, dockering

SEQ ID NO: 5961 - protein, 37 aa, Piromyces finnis; identical to SEQ ID NO: 5687
  Cellulose docking domain, dockering

SEQ ID NO: 5962 - protein, 38 aa, Piromyces finnis; identical to SEQ ID NO: 5947
  Cellulose docking domain, dockering

SEQ ID NO: 5963 - protein, 33 aa, Piromyces finnis; identical to SEQ ID NO: 5951
  Cellulose docking domain, dockering

SEQ ID NO: 5964 - protein, 40 aa, Piromyces finnis; identical to SEQ ID NO: 5943
  Cellulose docking domain, dockering

SEQ ID NO: 5965 - protein, 39 aa, Piromyces finnis
  Cellulose docking domain, dockering
YCFSEKLGYKCCKACDTIYTDESGDWGFENNDWCGIASS

SEQ ID NO: 5966 - protein, 36 aa, Piromyces finnis
  Cellulose docking domain, dockering
HESGYPYCKTTTDVVYTDSVKWGIENNDWCGIVDSS

SEQ ID NO: 5967 - protein, 40 aa, Piromyces finnis
  Cellulose docking domain, dockering
SCWASKLGFKCCTSQCPQEVYVDTDGSWGVENNNWCGIVS

SEQ ID NO: 5968 - protein, 40 aa, Piromyces finnis
  Cellulose docking domain, dockering
ACWAELLGYSCCSTKTCRNAVYTDDDGQWDVENGNWCGIT

SEQ ID NO: 5969 - protein, 40 aa, Piromyces finnis
  Cellulose docking domain, dockering
ACWAELLGYSCCSTKTCRNAVYTDDDGQWDVENGNWCGIG

SEQ ID NO: 5970 - protein, 39 aa, Piromyces finnis
  Cellulose docking domain, dockering
SCWSEELGYPCCTSTTKVVYTDESGNWGVENNNWCGIVS

SEQ ID NO: 5971 - protein, 40 aa, Piromyces finnis; identical to SEQ ID NO: 5969
  Cellulose docking domain, dockering

SEQ ID NO: 5972 - protein, 20 aa, Piromyces finnis
  Cellulose docking domain, dockering
DASGRWGIENNDWCGIVDSS

SEQ ID NO: 5973 - protein, 40 aa, Piromyces finnis; identical to SEQ ID NO: 5967
  Cellulose docking domain, dockering

SEQ ID NO: 5974 - protein, 40 aa, Piromyces finnis; identical to SEQ ID NO: 5967
  Cellulose docking domain, dockering

SEQ ID NO: 5975 - protein, 40 aa, Piromyces finnis; identical to SEQ ID NO: 5969
  Cellulose docking domain, dockering

SEQ ID NO: 5976 - protein, 36 aa, Piromyces finnis; identical to SEQ ID NO: 5966
  Cellulose docking domain, dockering

SEQ ID NO: 5977 - protein, 40 aa, Piromyces finnis; identical to SEQ ID NO: 5968
  Cellulose docking domain, dockering

SEQ ID NO: 5978 - protein, 40 aa, Piromyces finnis; identical to SEQ ID NO: 5967
  Cellulose docking domain, dockering

SEQ ID NO: 5979 - protein, 20 aa, Piromyces finnis
  Cellulose docking domain, dockering
DASGRWGIENNDWCGIVDSS

SEQ ID NO: 5980 - protein, 37 aa, Piromyces finnis
  Cellulose docking domain, dockering
SCWSEELGYPCCTSTTKVVYTDESGSWGIENGDWCGI

SEQ ID NO: 5981 - protein, 40 aa, Piromyces finnis; identical to SEQ ID NO: 5968
  Cellulose docking domain, dockering

SEQ ID NO: 5982 - protein, 39 aa, Piromyces finnis; identical to SEQ ID NO: 5970
  Cellulose docking domain, dockering

SEQ ID NO: 5983 - protein, 39 aa, Piromyces finnis
  Cellulose docking domain, dockering
CKGAQGYPCCQFSCDVYSTDSDGKWSVENNNWCLIDNSK

SEQ ID NO: 5984 - protein, 39 aa, Piromyces finnis
  Cellulose docking domain, dockering
DCFALKLGFPCCNNNEIYYTDENGNWGLTNTTPVNWCGI

SEQ ID NO: 5985 - protein, 33 aa, Piromyces finnis
  Cellulose docking domain, dockering
VMGYPCCTNPSTTVFYVDEDGNWGLENDNWCIM

SEQ ID NO: 5986 - protein, 32 aa, Piromyces finnis
  Cellulose docking domain, dockering
YPYCSGCESNYQDADGEWYFVDNKWCKVNEKK

SEQ ID NO: 5987 - protein, 30 aa, Piromyces finnis
  Cellulose docking domain, dockering
QCWSKELGFECCKSCVTQYTDEDGQWGYED

SEQ ID NO: 5988 - protein, 39 aa, Piromyces finnis
  Cellulose docking domain, dockering
QCFSEKQGYPCCSGCDVAYIDSDGDWGYENDSWCGIKST

SEQ ID NO: 5989 - protein, 38 aa, Piromyces finnis
  Cellulose docking domain, dockering
NCFATKLGYKCCSECDVTYTDSDGDWGFEGDWCGIKDS

SEQ ID NO: 5990 - protein, 26 aa, Piromyces finnis
  Cellulose docking domain, dockering
DYPCCSSGTSVVYTDASGSWGVENNE

SEQ ID NO: 5991 - protein, 39 aa, Piromyces finnis; identical to SEQ ID NO: 5988
  Cellulose docking domain, dockering

SEQ ID NO: 5992 - protein, 26 aa, Piromyces finnis
  Cellulose docking domain, dockering
DYPCCSSGTSVAYTDASGSWGVENNE

SEQ ID NO: 5993 - protein, 38 aa, Piromyces finnis
  Cellulose docking domain, dockering
SCFATKLGYKCCSGCDVTYTDSDGDWGFEGDWCGIKDS

SEQ ID NO: 5994 - protein, 32 aa, Piromyces finnis
  Cellulose docking domain, dockering
IYPCCSKCNIVFTDEEGDWGYEKGDWCGIRDN

SEQ ID NO: 5995 - protein, 40 aa, Piromyces finnis
  Cellulose docking domain, dockering
SCWAEEFGYNCCKHCTVTYSDENGDWGREEDDAWCGIIKN

SEQ ID NO: 5996 - protein, 39 aa, Piromyces finnis
  Cellulose docking domain, dockering
TCWAEKLGYKCCNECTVTYNDENGDWGFENGEWCGILRT

SEQ ID NO: 5997 - protein, 32 aa, Piromyces finnis; identical to SEQ ID NO: 3483
  Cellulose docking domain, dockering

SEQ ID NO: 5998 - protein, 32 aa, Piromyces finnis; identical to SEQ ID NO: 3484
  Cellulose docking domain, dockering

SEQ ID NO: 5999 - protein, 38 aa, Piromyces finnis
  Cellulose docking domain, dockering
ACWSQSLGYPCCSSASAKVEYTDADGKWGIENGNWCGI

SEQ ID NO: 6000 - protein, 38 aa, Piromyces finnis
  Cellulose docking domain, dockering
SCWAKPLGYNCCTSTTQAVYTDSDGKWGVENGDWCGIV

SEQ ID NO: 6001 - protein, 39 aa, Piromyces finnis
  Cellulose docking domain, dockering
ACWSQKLGYPCCSSSSAQVWFTDNDGEWGVENGDWCGIV

SEQ ID NO: 6002 - protein, 39 aa, Piromyces finnis; identical to SEQ ID NO: 6001
  Cellulose docking domain, dockering

SEQ ID NO: 6003 - protein, 39 aa, Piromyces finnis
  Cellulose docking domain, dockering
SCWSQPLGYPCCTSTSTAVYTDGDGAWGIENGDWCGING

SEQ ID NO: 6004 - protein, 38 aa, Piromyces finnis; identical to SEQ ID NO: 5999
  Cellulose docking domain, dockering

SEQ ID NO: 6005 - protein, 38 aa, Piromyces finnis
  Cellulose docking domain, dockering
SCWAKPLGYNCCTSTTQAVYTDSDGKWGVENGDWCGIP

SEQ ID NO: 6006 - protein, 39 aa, Piromyces finnis; identical to SEQ ID NO: 6003
  Cellulose docking domain, dockering

SEQ ID NO: 6007 - protein, 39 aa, Piromyces finnis
  Cellulose docking domain, dockering
ACWSQKLGYPCCSSSSAQVWFTDNDGEWGVENGDWCGIP

SEQ ID NO: 6008 - protein, 38 aa, Piromyces finnis; identical to SEQ ID NO: 5999
  Cellulose docking domain, dockering

SEQ ID NO: 6009 - protein, 38 aa, Piromyces finnis; identical to SEQ ID NO: 6000
  Cellulose docking domain, dockering

SEQ ID NO: 6010 - protein, 39 aa, Piromyces finnis; identical to SEQ ID NO: 6007
  Cellulose docking domain, dockering

SEQ ID NO: 6011 - protein, 39 aa, Piromyces finnis; identical to SEQ ID NO: 6003
  Cellulose docking domain, dockering

SEQ ID NO: 6012 - protein, 39 aa, Piromyces finnis; identical to SEQ ID NO: 6001
  Cellulose docking domain, dockering

SEQ ID NO: 6013 - protein, 38 aa, Piromyces finnis; identical to SEQ ID NO: 6000
  Cellulose docking domain, dockering

SEQ ID NO: 6014 - protein, 38 aa, Piromyces finnis; identical to SEQ ID NO: 5999
  Cellulose docking domain, dockering

SEQ ID NO: 6015 - protein, 39 aa, Piromyces finnis; identical to SEQ ID NO: 6001
  Cellulose docking domain, dockering

SEQ ID NO: 6016 - protein, 38 aa, Piromyces finnis; identical to SEQ ID NO: 5999
  Cellulose docking domain, dockering

SEQ ID NO: 6017 - protein, 38 aa, Piromyces finnis; identical to SEQ ID NO: 6000
  Cellulose docking domain, dockering

SEQ ID NO: 6018 - protein, 38 aa, Piromyces finnis; identical to SEQ ID NO: 6000
  Cellulose docking domain, dockering

SEQ ID NO: 6019 - protein, 38 aa, Piromyces finnis; identical to SEQ ID NO: 5999
  Cellulose docking domain, dockering

SEQ ID NO: 6020 - protein, 38 aa, Piromyces finnis; identical to SEQ ID NO: 6005
  Cellulose docking domain, dockering

SEQ ID NO: 6021 - protein, 39 aa, Piromyces finnis; identical to SEQ ID NO: 6003
  Cellulose docking domain, dockering

SEQ ID NO: 6022 - protein, 38 aa, Piromyces finnis; identical to SEQ ID NO: 5999
  Cellulose docking domain, dockering

SEQ ID NO: 6023 - protein, 39 aa, Piromyces finnis; identical to SEQ ID NO: 6001
  Cellulose docking domain, dockering

SEQ ID NO: 6024 - protein, 39 aa, Piromyces finnis; identical to SEQ ID NO: 6003
  Cellulose docking domain, dockering

SEQ ID NO: 6025 - protein, 38 aa, Piromyces finnis; identical to SEQ ID NO: 6005
  Cellulose docking domain, dockering

SEQ ID NO: 6026 - protein, 38 aa, Piromyces finnis; identical to SEQ ID NO: 5999
  Cellulose docking domain, dockering

SEQ ID NO: 6027 - protein, 38 aa, Piromyces finnis; identical to SEQ ID NO: 6000
  Cellulose docking domain, dockering

SEQ ID NO: 6028 - protein, 38 aa, Piromyces finnis; identical to SEQ ID NO: 5999
  Cellulose docking domain, dockering

SEQ ID NO: 6029 - protein, 39 aa, Piromyces finnis; identical to SEQ ID NO: 6001
  Cellulose docking domain, dockering

SEQ ID NO: 6030 - protein, 39 aa, Piromyces finnis; identical to SEQ ID NO: 6007
  Cellulose docking domain, dockering

SEQ ID NO: 6031 - protein, 39 aa, Piromyces finnis; identical to SEQ ID NO: 6003
  Cellulose docking domain, dockering

SEQ ID NO: 6032 - protein, 40 aa, Piromyces finnis
  Cellulose docking domain, dockering
GCWSTAFGYSCCKSCGPVYFTDESGNWGIENGDWCGLLSS

SEQ ID NO: 6033 - protein, 39 aa, Piromyces finnis; identical to SEQ ID NO: 5647
  Cellulose docking domain, dockering

SEQ ID NO: 6034 - protein, 40 aa, Piromyces finnis; identical to SEQ ID NO: 6032
  Cellulose docking domain, dockering

SEQ ID NO: 6035 - protein, 28 aa, Piromyces finnis
  Cellulose docking domain, dockering
CWSEPLGYPCCTGCAYSWYSDDDGEWGV

SEQ ID NO: 6036 - protein, 40 aa, Piromyces finnis; identical to SEQ ID NO: 6032
  Cellulose docking domain, dockering

SEQ ID NO: 6037 - protein, 28 aa, Piromyces finnis
  Cellulose docking domain, dockering
CWSEPLGYPCCTGCAYSWYSDDDGEWGV

SEQ ID NO: 6038 - protein, 28 aa, Piromyces finnis
  Cellulose docking domain, dockering
CWSEPLGYPCCTGCAYSWYSDDDGEWGV

SEQ ID NO: 6039 - protein, 40 aa, Piromyces finnis; identical to SEQ ID NO: 6032
  Cellulose docking domain, dockering

SEQ ID NO: 6040 - protein, 40 aa, Piromyces finnis
  Cellulose docking domain, dockering
SCWAKALGYSCCDSCAPVYYFDNDGEWGIVDGQWCGIPKN

SEQ ID NO: 6041 - protein, 35 aa, Piromyces finnis
  Cellulose docking domain, dockering
EGYPCCKSSCIVYTKENGVNWGVENNNWCVINDSL

SEQ ID NO: 6042 - protein, 28 aa, Piromyces finnis
  Cellulose docking domain, dockering
CWSEPLGYPCCTGCAYSWYSDDDGEWGV

SEQ ID NO: 6043 - protein, 39 aa, Piromyces finnis; identical to SEQ ID NO: 5647
  Cellulose docking domain, dockering

SEQ ID NO: 6044 - protein, 39 aa, Piromyces finnis; identical to SEQ ID NO: 5647
  Cellulose docking domain, dockering

SEQ ID NO: 6045 - protein, 35 aa, Piromyces finnis; identical to SEQ ID NO: 6041
  Cellulose docking domain, dockering

SEQ ID NO: 6046 - protein, 40 aa, Piromyces finnis; identical to SEQ ID NO: 6040
  Cellulose docking domain, dockering

SEQ ID NO: 6047 - protein, 29 aa, Piromyces finnis
  Cellulose docking domain, dockering
CPATFTSLGYSCCKSENCMVYYQDESGDW

SEQ ID NO: 6048 - protein, 36 aa, Piromyces finnis; identical to SEQ ID NO: 3534
  Cellulose docking domain, dockering

SEQ ID NO: 6049 - protein, 36 aa, Piromyces finnis; identical to SEQ ID NO: 3535
  Cellulose docking domain, dockering

SEQ ID NO: 6050 - protein, 37 aa, Piromyces finnis
  Cellulose docking domain, dockering
QCWSEKLGFPCCSKCGQVVYTDEDGNWSVENNDWCII

SEQ ID NO: 6051 - protein, 39 aa, Piromyces finnis
  Cellulose docking domain, dockering
CSAKITSQGYKCCSSSCVPSYTDGDGDWAIENGEWCGIT

SEQ ID NO: 6052 - protein, 39 aa, Piromyces finnis
  Cellulose docking domain, dockering
CSSKITSQGYKCCSSSCVPSYTDGDGDWAIENGEWCGIT

SEQ ID NO: 6053 - protein, 37 aa, Piromyces finnis; identical to SEQ ID NO: 6050
  Cellulose docking domain, dockering

SEQ ID NO: 6054 - protein, 39 aa, Piromyces finnis
  Cellulose docking domain, dockering
DCAAASQGYPCCKNQNAEVYYQDETGDWGIENGEWCGCG

SEQ ID NO: 6055 - protein, 40 aa, Piromyces finnis
  Cellulose docking domain, dockering
CSANILAQGYKCCSAGCQVIYTDNDGTWGAENGEWCGCGS

SEQ ID NO: 6056 - protein, 37 aa, Piromyces finnis; identical to SEQ ID NO: 6050
  Cellulose docking domain, dockering

SEQ ID NO: 6057 - protein, 39 aa, Piromyces finnis; identical to SEQ ID NO: 5860
  Cellulose docking domain, dockering

SEQ ID NO: 6058 - protein, 40 aa, Piromyces finnis; identical to SEQ ID NO: 6055
  Cellulose docking domain, dockering

SEQ ID NO: 6059 - protein, 39 aa, Piromyces finnis
  Cellulose docking domain, dockering
CSAKITSQGYKCCSSSCVPSYTDGDGDWAIENGEWCGCG

SEQ ID NO: 6060 - protein, 41 aa, Piromyces finnis
  Cellulose docking domain, dockering
CSANILAQGYKCCSAGCQVVYTDNDGTWGVENNEWCGCNAN

SEQ ID NO: 6061 - protein, 39 aa, Piromyces finnis
  Cellulose docking domain, dockering
CSSKITSQGYKCCSSSCVPSYTDGDGDWAIENGEWCGCG

SEQ ID NO: 6062 - protein, 40 aa, Piromyces finnis; identical to SEQ ID NO: 6055
  Cellulose docking domain, dockering

SEQ ID NO: 6063 - protein, 38 aa, Piromyces finnis
  Cellulose docking domain, dockering
SVLALGYPCCSKTNCVAVYTDETGDWDVENNDWCWCRG

SEQ ID NO: 6064 - protein, 39 aa, Piromyces finnis
  Cellulose docking domain, dockering
PTSITNQGYKCCSAEKCEVVYTDESGDWGVEDGDWCGCT

SEQ ID NO: 6065 - protein, 38 aa, Piromyces finnis; identical to SEQ ID NO: 6063
  Cellulose docking domain, dockering

SEQ ID NO: 6066 - protein, 39 aa, Piromyces finnis; identical to SEQ ID NO: 6064
  Cellulose docking domain, dockering

SEQ ID NO: 6067 - protein, 31 aa, Piromyces finnis; identical to SEQ ID NO: 3119
  Cellulose docking domain, dockering

SEQ ID NO: 6068 - protein, 31 aa, Piromyces finnis; identical to SEQ ID NO: 3119
  Cellulose docking domain, dockering

SEQ ID NO: 6069 - protein, 31 aa, Piromyces finnis; identical to SEQ ID NO: 3119
  Cellulose docking domain, dockering

SEQ ID NO: 6070 - protein, 31 aa, Piromyces finnis; identical to SEQ ID NO: 3119
  Cellulose docking domain, dockering

SEQ ID NO: 6071 - protein, 34 aa, Piromyces finnis
  Cellulose docking domain, dockering
PYYNCCNNCDVYYTDNEGKWGVQNNDWCFIDNNR

SEQ ID NO: 6072 - protein, 39 aa, Piromyces finnis
  Cellulose docking domain, dockering
YCKFESLGYRCCNGCDVVYTDSDGNWGVENGNWCGIRDN

SEQ ID NO: 6073 - protein, 38 aa, Piromyces finnis
  Cellulose docking domain, dockering
CSASIMSQGYKCCSKNCQVVYTDADGDWGVENGQWCGC

SEQ ID NO: 6074 - protein, 37 aa, Piromyces finnis
  Cellulose docking domain, dockering
YCKFESLGYRCCNGCDVVYTDSDGNWGVENGNWCGIQ

SEQ ID NO: 6075 - protein, 35 aa, Piromyces finnis
  Cellulose docking domain, dockering
HPYYNCCNNCDVYYTDNEGKWGVQNNDWCFIDNNR

SEQ ID NO: 6076 - protein, 38 aa, Piromyces finnis; identical to SEQ ID NO: 6073
  Cellulose docking domain, dockering

SEQ ID NO: 6077 - protein, 39 aa, Piromyces finnis
  Cellulose docking domain, dockering
PVAITNQGYPCCKSCGTVYYTDADGEWGVENGDWCGMPT

SEQ ID NO: 6078 - protein, 38 aa, Piromyces finnis
  Cellulose docking domain, dockering
CSASITNQGYKCCKVGCQTIYTDADGNWGVENNQWCGC

SEQ ID NO: 6079 - protein, 39 aa, Piromyces finnis; identical to SEQ ID NO: 6077
  Cellulose docking domain, dockering

SEQ ID NO: 6080 - protein, 38 aa, Piromyces finnis; identical to SEQ ID NO: 6078
  Cellulose docking domain, dockering

SEQ ID NO: 6081 - protein, 39 aa, Piromyces finnis
  Cellulose docking domain, dockering
CSSKITSQGYQCCSDNCEVIYTDADGNWGVENGNWCGIQ

SEQ ID NO: 6082 - protein, 38 aa, Piromyces finnis
  Cellulose docking domain, dockering
CSAAITRQGYKCCSKNCQVVYTDGDGDWGVENGQWCGC

SEQ ID NO: 6083 - protein, 38 aa, Piromyces finnis; identical to SEQ ID NO: 6082
  Cellulose docking domain, dockering

SEQ ID NO: 6084 - protein, 38 aa, Piromyces finnis
  Cellulose docking domain, dockering
CPSSITSQGYPCCSSCGTVYYQDADGDWGVENGQWCGC

SEQ ID NO: 6085 - protein, 33 aa, Piromyces finnis
  Cellulose docking domain, dockering
AQGFPCCQNTCEVYTTDSDGDWGLENGNWCGIQ

SEQ ID NO: 6086 - protein, 40 aa, Piromyces finnis
  Cellulose docking domain, dockering
SCWSTSLGYSCCKSCINVAYKDNDGEWGIENNNWCGIPKT

SEQ ID NO: 6087 - protein, 39 aa, Piromyces finnis
  Cellulose docking domain, dockering
YCKFESLGYRCCNGCDVVYTDSDGNWGVENGNWCGIKPS

SEQ ID NO: 6088 - protein, 35 aa, Piromyces finnis; identical to SEQ ID NO: 6075
  Cellulose docking domain, dockering

SEQ ID NO: 6089 - protein, 38 aa, Piromyces finnis; identical to SEQ ID NO: 6078
  Cellulose docking domain, dockering

SEQ ID NO: 6090 - protein, 39 aa, Piromyces finnis; identical to SEQ ID NO: 6077
  Cellulose docking domain, dockering

SEQ ID NO: 6091 - protein, 38 aa, Piromyces finnis; identical to SEQ ID NO: 6078
  Cellulose docking domain, dockering

SEQ ID NO: 6092 - protein, 39 aa, Piromyces finnis; identical to SEQ ID NO: 6077
  Cellulose docking domain, dockering

SEQ ID NO: 6093 - protein, 33 aa, Piromyces finnis
  Cellulose docking domain, dockering
CSAKITSQGYKCCSAGCVIYYTDADGDWGVENN

SEQ ID NO: 6094 - protein, 39 aa, Piromyces finnis
  Cellulose docking domain, dockering
CSAKITSQGYKCCSAGCVIYYTDADGDWGVENNEWCGCG

SEQ ID NO: 6095 - protein, 39 aa, Piromyces finnis
  Cellulose docking domain, dockering
DCFSTKLGYPCCKAGTQAVYTDADGDWGVENGDWCGIKD

SEQ ID NO: 6096 - protein, 36 aa, Piromyces finnis
  Cellulose docking domain, dockering
GCWAKSSGYSCCSTNKCREVVYFDKEGQWDVENGQW

SEQ ID NO: 6097 - protein, 38 aa, Piromyces finnis
  Cellulose docking domain, dockering
SCWSKSLGFECCTGSAYVLYTDENGQWGVENGDWCGIG

SEQ ID NO: 6098 - protein, 32 aa, Piromyces finnis; identical to SEQ ID NO: 3584
  Cellulose docking domain, dockering

SEQ ID NO: 6099 - protein, 37 aa, Piromyces finnis
  Cellulose docking domain, dockering
DCFSTKLGYPCCKAGTQAVYTDADGDWGVENGDWCGI

SEQ ID NO: 6100 - protein, 34 aa, Piromyces finnis
  Cellulose docking domain, dockering
VLLGYPLCKEKHEDDLVRDEDGYWAIEDGNWCGV

SEQ ID NO: 6101 - protein, 32 aa, Piromyces finnis; identical to SEQ ID NO: 3586
  Cellulose docking domain, dockering

SEQ ID NO: 6102 - protein, 33 aa, Piromyces finnis
  Cellulose docking domain, dockering
ASCWAQALGYPCCKNTKDVVTTDSDGDWGIENG

SEQ ID NO: 6103 - protein, 38 aa, Piromyces finnis
  Cellulose docking domain, dockering
DCFSTKLGYPCCKAGTQAVYTDADGDWGVENGDWCGIG

SEQ ID NO: 6104 - protein, 36 aa, Piromyces finnis; identical to SEQ ID NO: 6096
  Cellulose docking domain, dockering

SEQ ID NO: 6105 - protein, 39 aa, Piromyces finnis
  Cellulose docking domain, dockering
SCWSKSLGFECCTGSAYVLYTDENGQWGVENGDWCGIKD

SEQ ID NO: 6106 - protein, 39 aa, Piromyces finnis
  Cellulose docking domain, dockering
ASCWAKPLGYNCCTSTTQAVYTDSDGKWGVENGDWCGIV

SEQ ID NO: 6107 - protein, 38 aa, Piromyces finnis
  Cellulose docking domain, dockering
SCWAKALGYNCCTSTTQAIYTDSDGKWGVENGDWCGIV

SEQ ID NO: 6108 - protein, 39 aa, Piromyces finnis
  Cellulose docking domain, dockering
ASCWAKALGYNCCTSTTQAIYTDSDGKWGVENGDWCGIV

SEQ ID NO: 6109 - protein, 38 aa, Piromyces finnis; identical to SEQ ID NO: 6107
  Cellulose docking domain, dockering

SEQ ID NO: 6110 - protein, 38 aa, Piromyces finnis; identical to SEQ ID NO: 6107
  Cellulose docking domain, dockering

SEQ ID NO: 6111 - protein, 38 aa, Piromyces finnis; identical to SEQ ID NO: 6107
  Cellulose docking domain, dockering

SEQ ID NO: 6112 - protein, 39 aa, Piromyces finnis
  Cellulose docking domain, dockering
TCFAEKLGYSCCPDGTTVSYTDGDGKWGVVNGDWCGIAE

SEQ ID NO: 6113 - protein, 38 aa, Piromyces finnis
  Cellulose docking domain, dockering
TCWAEALGYKCCQTTSNVEFIDTDGKWGFENGDWCGIN

SEQ ID NO: 6114 - protein, 38 aa, Piromyces finnis; identical to SEQ ID NO: 6000
  Cellulose docking domain, dockering

SEQ ID NO: 6115 - protein, 42 aa, Piromyces finnis
  Cellulose docking domain, dockering
ASCWAQALGYPCCKNTKDVVTTDSDGDWGIENGDWCGIVDNR

SEQ ID NO: 6116 - protein, 38 aa, Piromyces finnis; identical to SEQ ID NO: 6000
  Cellulose docking domain, dockering

SEQ ID NO: 6117 - protein, 38 aa, Piromyces finnis; identical to SEQ ID NO: 6107
  Cellulose docking domain, dockering

SEQ ID NO: 6118 - protein, 38 aa, Piromyces finnis; identical to SEQ ID NO: 6000
  Cellulose docking domain, dockering

SEQ ID NO: 6119 - protein, 38 aa, Piromyces finnis; identical to SEQ ID NO: 6000
  Cellulose docking domain, dockering

SEQ ID NO: 6120 - protein, 39 aa, Piromyces finnis; identical to SEQ ID NO: 6003
  Cellulose docking domain, dockering

SEQ ID NO: 6121 - protein, 39 aa, Piromyces finnis; identical to SEQ ID NO: 6106
  Cellulose docking domain, dockering

SEQ ID NO: 6122 - protein, 38 aa, Piromyces finnis; identical to SEQ ID NO: 6000
  Cellulose docking domain, dockering

SEQ ID NO: 6123 - protein, 38 aa, Piromyces finnis; identical to SEQ ID NO: 6000
  Cellulose docking domain, dockering

SEQ ID NO: 6124 - protein, 39 aa, Piromyces finnis; identical to SEQ ID NO: 6108
  Cellulose docking domain, dockering

SEQ ID NO: 6125 - protein, 38 aa, Piromyces finnis; identical to SEQ ID NO: 6107
  Cellulose docking domain, dockering

SEQ ID NO: 6126 - protein, 31 aa, Piromyces finnis; identical to SEQ ID NO: 3612
  Cellulose docking domain, dockering

SEQ ID NO: 6127 - protein, 39 aa, Piromyces finnis
  Cellulose docking domain, dockering
CSSKITSQGYKCCASNCDVVYVDNDGNWGVENDEWCGCG

SEQ ID NO: 6128 - protein, 32 aa, Piromyces finnis
  Cellulose docking domain, dockering
PKGYKCCKTTSQVYEVDSDGKWGIENNDWCFI

SEQ ID NO: 6129 - protein, 33 aa, Piromyces finnis
  Cellulose docking domain, dockering
KLLGYNCCRNTCDIQYKDDDGNWGVENNDWCGL

SEQ ID NO: 6130 - protein, 38 aa, Piromyces finnis
  Cellulose docking domain, dockering
CSSKITSQGYKCCASNCDVVYVDNDGNWGVENNDWCGL

SEQ ID NO: 6131 - protein, 40 aa, Piromyces finnis
  Cellulose docking domain, dockering
CSSKITSQGYKCCASNCDVVYVDNDGNWGVENNDWCGLTN

SEQ ID NO: 6132 - protein, 35 aa, Piromyces finnis
  Cellulose docking domain, dockering
KLLGYNCCRNTCDIQYKDDDGNWGVENNDWCGLTN

SEQ ID NO: 6133 - protein, 37 aa, Piromyces finnis
  Cellulose docking domain, dockering
SCWSEALGYPCCEGNVVITSDENGDWGVENNEWCGCG

SEQ ID NO: 6134 - protein, 39 aa, Piromyces finnis; identical to SEQ ID NO: 6094
  Cellulose docking domain, dockering

SEQ ID NO: 6135 - protein, 20 aa, Piromyces finnis
  Cellulose docking domain, dockering
TIYTDADGNWGVENNQWCGC

SEQ ID NO: 6136 - protein, 41 aa, Piromyces finnis
  Cellulose docking domain, dockering
CSSKITSQGYQCCSDNCEVIYTDADGNWGVENGNWCGIRDN

SEQ ID NO: 6137 - protein, 41 aa, Piromyces finnis; identical to SEQ ID NO: 6136
  Cellulose docking domain, dockering

SEQ ID NO: 6138 - protein, 41 aa, Piromyces finnis
  Cellulose docking domain, dockering
CSASITNQGYKCCKVGCQTVYTDADGNWGVENGNWCGIRDN

SEQ ID NO: 6139 - protein, 41 aa, Piromyces finnis; identical to SEQ ID NO: 6138
  Cellulose docking domain, dockering

SEQ ID NO: 6140 - protein, 35 aa, Piromyces finnis
  Cellulose docking domain, dockering
QEGYECCSSCNVIYTDDDGNWGVENDQWCGIDEEK

SEQ ID NO: 6141 - protein, 31 aa, Piromyces finnis
  Cellulose docking domain, dockering
YGCCAHCNAIYEDEDGLWGVSNGEWCKIKKN

SEQ ID NO: 6142 - protein, 39 aa, Piromyces finnis
  Cellulose docking domain, dockering
KCFSSKLGYPCCTSTTDVITEDEDGKWGLENGDWCGIQE

SEQ ID NO: 6143 - protein, 29 aa, Piromyces finnis
  Cellulose docking domain, dockering
TCWAEALGYKCCQTTSNVEFIDTDGKWGF

SEQ ID NO: 6144 - protein, 39 aa, Piromyces finnis; identical to SEQ ID NO: 6112
  Cellulose docking domain, dockering

SEQ ID NO: 6145 - protein, 27 aa, Piromyces finnis
  Cellulose docking domain, dockering
SCWASSLGYPCCKSTKVVIDTDASGRW

SEQ ID NO: 6146 - protein, 31 aa, Piromyces finnis; identical to SEQ ID NO: 3633
  Cellulose docking domain, dockering

SEQ ID NO: 6147 - protein, 38 aa, Piromyces finnis
  Cellulose docking domain, dockering
SCWSTKLGYKCCKGCDVSYTDSDGDWGYESDWCGIPTS

SEQ ID NO: 6148 - protein, 31 aa, Piromyces finnis
  Cellulose docking domain, dockering
EYECCNGCNVVDQSDGLKWGVENNNWCIIKS

SEQ ID NO: 6149 - protein, 35 aa, Piromyces finnis
  Cellulose docking domain, dockering
TTSGYPCCKDCNVVYTDETGKWGIANNEWCAISDT

SEQ ID NO: 6150 - protein, 34 aa, Piromyces finnis
  Cellulose docking domain, dockering
CSSKITAQGYSCCSSSNCSIIYTDEDGTWGVENG

SEQ ID NO: 6151 - protein, 39 aa, Piromyces finnis; identical to SEQ ID NO: 5984
  Cellulose docking domain, dockering

SEQ ID NO: 6152 - protein, 33 aa, Piromyces finnis; identical to SEQ ID NO: 5985
  Cellulose docking domain, dockering

SEQ ID NO: 6153 - protein, 32 aa, Piromyces finnis; identical to SEQ ID NO: 5986
  Cellulose docking domain, dockering

SEQ ID NO: 6154 - protein, 32 aa, Piromyces finnis; identical to SEQ ID NO: 3641
  Cellulose docking domain, dockering

SEQ ID NO: 6155 - protein, 33 aa, Piromyces finnis
  Cellulose docking domain, dockering
EYPCCSSENAEIVYTDSEGDWGLEKGDWCLIKK

SEQ ID NO: 6156 - protein, 31 aa, Piromyces finnis
  Cellulose docking domain, dockering
DCFSLKLGYRCCERSKVVYSDADGLWGVENG

SEQ ID NO: 6157 - protein, 26 aa, Piromyces finnis
  Cellulose docking domain, dockering
KCWSTEFGFPCCKGNTIVFTDENGDW

SEQ ID NO: 6158 - protein, 34 aa, Piromyces finnis; identical to SEQ ID NO: 5656
  Cellulose docking domain, dockering

SEQ ID NO: 6159 - protein, 36 aa, Piromyces finnis
  Cellulose docking domain, dockering
HHDYYECCTGCKPIVADDEGRWGAQNGEWCLIDEER

SEQ ID NO: 6160 - protein, 34 aa, Piromyces finnis; identical to SEQ ID NO: 5656
  Cellulose docking domain, dockering

SEQ ID NO: 6161 - protein, 36 aa, Piromyces finnis; identical to SEQ ID NO: 6159
  Cellulose docking domain, dockering

SEQ ID NO: 6162 - protein, 31 aa, Piromyces finnis
  Cellulose docking domain, dockering
AQGYSCCNKECTVYYDDEDGDWSIENGEWCL

SEQ ID NO: 6163 - protein, 40 aa, Piromyces finnis
  Cellulose docking domain, dockering
SCWSESLGYPCCETTCDIVEKDSDGSWGVEYNEWCGIPKS

SEQ ID NO: 6164 - protein, 29 aa, Piromyces finnis
  Cellulose docking domain, dockering
NCIAKSLGYQCCPKNISEVYYHDENGDWG

SEQ ID NO: 6165 - protein, 40 aa, Piromyces finnis
  Cellulose docking domain, dockering
SILRQGYSCCEQNNCNIYYKDDDGDWGLTSSLKWCGIRYS

SEQ ID NO: 6166 - protein, 39 aa, Piromyces finnis
  Cellulose docking domain, dockering
ASVFNQMGYKCCRSCNVVLTDSTGKWGVEDNEWCGIRKD

SEQ ID NO: 6167 - protein, 38 aa, Piromyces finnis
  Cellulose docking domain, dockering
SIIRIGYVCCDHCQSNYEDEFGKWYHTNNHDWCALKPS

SEQ ID NO: 6168 - protein, 35 aa, Piromyces finnis
  Cellulose docking domain, dockering
RVKDLGYKCCKEPCDVIYTDVDGDWGAENNEWCGC

SEQ ID NO: 6169 - protein, 39 aa, Piromyces finnis
  Cellulose docking domain, dockering
ECWSEEFGYKCCKKSCTVFEIDNDGKWGYEDGNWCGIPS

SEQ ID NO: 6170 - protein, 40 aa, Piromyces finnis
  Cellulose docking domain, dockering
KCIAETIGYRCCSSKNKTVYYTDSYGDWGYDFKLNDWCGI

SEQ ID NO: 6171 - protein, 33 aa, Piromyces finnis; identical to SEQ ID NO: 3658
  Cellulose docking domain, dockering

SEQ ID NO: 6172 - protein, 41 aa, Piromyces finnis
  Cellulose docking domain, dockering
YCWSHKYGYPCCSEGTCHIFTSDENGDWGYENGRWCGILPS

SEQ ID NO: 6173 - protein, 34 aa, Piromyces finnis; identical to SEQ ID NO: 3659
  Cellulose docking domain, dockering

SEQ ID NO: 6174 - protein, 31 aa, Piromyces finnis; identical to SEQ ID NO: 3662
  Cellulose docking domain, dockering

SEQ ID NO: 6175 - protein, 39 aa, Piromyces finnis
  Cellulose docking domain, dockering
DCFSRNLGFNCCENESTSVFFVDDNGSWGVENDEWCGLS

SEQ ID NO: 6176 - protein, 35 aa, Piromyces finnis
  Cellulose docking domain, dockering
YCWSEPLGYPCCSIEAKPSDEASIWGWENEEWCGM

SEQ ID NO: 6177 - protein, 37 aa, Piromyces finnis
  Cellulose docking domain, dockering
ECFAEKLGKPCCTETLDVVRVDENGQWGMENGQFCGL

SEQ ID NO: 6178 - protein, 20 aa, Piromyces finnis
  Cellulose docking domain, dockering
QDESGKWGIENNQWCGIKYS

SEQ ID NO: 6179 - protein, 39 aa, Piromyces finnis
  Cellulose docking domain, dockering
DCWSEELGYACCKKTCTIFEIDENGEWGFEDDKWCGIPS

SEQ ID NO: 6180 - protein, 36 aa, Piromyces finnis
  Cellulose docking domain, dockering
ETIGYNCCPLEVSTVFYTDSYGNWSYNYKLKEWCGL

SEQ ID NO: 6181 - protein, 40 aa, Piromyces finnis
  Cellulose docking domain, dockering
KCFSENLGYSCCEECNVVYTDNDGKWGYENNEWCGIIKSI

SEQ ID NO: 6182 - protein, 40 aa, Piromyces finnis; identical to SEQ ID NO: 6181
  Cellulose docking domain, dockering

SEQ ID NO: 6183 - protein, 40 aa, Piromyces finnis; identical to SEQ ID NO: 5638
  Cellulose docking domain, dockering

SEQ ID NO: 6184 - protein, 35 aa, Piromyces finnis; identical to SEQ ID NO: 6176
  Cellulose docking domain, dockering

SEQ ID NO: 6185 - protein, 37 aa, Piromyces finnis
  Cellulose docking domain, dockering
SCWSEVYGYSCCRETTTVITSDSKGNWGAENGEWCGL

SEQ ID NO: 6186 - protein, 36 aa, Piromyces finnis
  Cellulose docking domain, dockering
CWSEVYDYSCCKKTTQVMYIDSKGTWGIENGEWCGL

SEQ ID NO: 6187 - protein, 39 aa, Piromyces finnis; identical to SEQ ID NO: 6175
  Cellulose docking domain, dockering

SEQ ID NO: 6188 - protein, 39 aa, Piromyces finnis; identical to SEQ ID NO: 5714
  Cellulose docking domain, dockering

SEQ ID NO: 6189 - protein, 40 aa, Piromyces finnis; identical to SEQ ID NO: 5690
  Cellulose docking domain, dockering

SEQ ID NO: 6190 - protein, 31 aa, Piromyces finnis; identical to SEQ ID NO: 6141
  Cellulose docking domain, dockering

SEQ ID NO: 6191 - protein, 23 aa, Piromyces finnis
  Cellulose docking domain, dockering
IYTEDDGNWGLENDQWCGIDEEK

SEQ ID NO: 6192 - protein, 39 aa, Piromyces finnis; identical to SEQ ID NO: 6142
  Cellulose docking domain, dockering

SEQ ID NO: 6193 - protein, 39 aa, Piromyces finnis
  Cellulose docking domain, dockering
SCWSSSLGFPCCSGKVVVEYTDASGRWGIQNNNWCGIVN

SEQ ID NO: 6194 - protein, 40 aa, Piromyces finnis
  Cellulose docking domain, dockering
TCWAKALGYNCCSTNTCRNAVYNDTDGQWDIENNQWCGIS

SEQ ID NO: 6195 - protein, 29 aa, Piromyces finnis
  Cellulose docking domain, dockering
DCWSDVLGYSCCSKCLEAVYEDQDGKWGV

SEQ ID NO: 6196 - protein, 37 aa, Piromyces finnis
  Cellulose docking domain, dockering
YCWALAYGYPCCKETTTVLSTDESGTWGYENNTWCGI

SEQ ID NO: 6197 - protein, 38 aa, Piromyces finnis
  Cellulose docking domain, dockering
DCWASLLGYPCCESNIVYEVDEYGTWGYEFGHWCGIKT

SEQ ID NO: 6198 - protein, 37 aa, Piromyces finnis
  Cellulose docking domain, dockering
DCWSVEYGFPCCFGSKVIATDYNGDWGYENNQWCGMP

SEQ ID NO: 6199 - protein, 26 aa, Piromyces finnis
  Cellulose docking domain, dockering
SCWASSLGYPCCKSTKVVIDTDASGR

SEQ ID NO: 6200 - protein, 33 aa, Piromyces finnis; identical to SEQ ID NO: 5794
  Cellulose docking domain, dockering

SEQ ID NO: 6201 - protein, 30 aa, Piromyces finnis; identical to SEQ ID NO: 3244
  Cellulose docking domain, dockering

SEQ ID NO: 6202 - protein, 30 aa, Piromyces finnis; identical to SEQ ID NO: 3690
  Cellulose docking domain, dockering

SEQ ID NO: 6203 - protein, 33 aa, Piromyces finnis; identical to SEQ ID NO: 5908
  Cellulose docking domain, dockering

SEQ ID NO: 6204 - protein, 37 aa, Piromyces finnis; identical to SEQ ID NO: 3391
  Cellulose docking domain, dockering

SEQ ID NO: 6205 - protein, 38 aa, Piromyces finnis; identical to SEQ ID NO: 6197
  Cellulose docking domain, dockering

SEQ ID NO: 6206 - protein, 37 aa, Piromyces finnis; identical to SEQ ID NO: 6196
  Cellulose docking domain, dockering

SEQ ID NO: 6207 - protein, 32 aa, Piromyces finnis
  Cellulose docking domain, dockering
NFPCCSDNTEIIYTDEEGNWGLENDEWCFINK

SEQ ID NO: 6208 - protein, 38 aa, Piromyces finnis; identical to SEQ ID NO: 3696
  Cellulose docking domain, dockering

SEQ ID NO: 6209 - protein, 41 aa, Piromyces finnis
  Cellulose docking domain, dockering
ECYFETLGYSCCPSEITEVAYTDEDGNKWGIINNEWCGIVD

SEQ ID NO: 6210 - protein, 32 aa, Piromyces finnis; identical to SEQ ID NO: 6207
  Cellulose docking domain, dockering

SEQ ID NO: 6211 - protein, 40 aa, Piromyces finnis
  Cellulose docking domain, dockering
RCWSRSYGFPCCNGCKVYYIDKSGEWGIENGNWCGIVDDN

SEQ ID NO: 6212 - protein, 23 aa, Piromyces finnis
  Cellulose docking domain, dockering
AYPCCNECEVIYTDNDGDWGVEN

SEQ ID NO: 6213 - protein, 36 aa, Piromyces finnis; identical to SEQ ID NO: 5946
  Cellulose docking domain, dockering

SEQ ID NO: 6214 - protein, 40 aa, Piromyces finnis; identical to SEQ ID NO: 5808
  Cellulose docking domain, dockering

SEQ ID NO: 6215 - protein, 15 aa, Piromyces finnis
  Cellulose docking domain, dockering
GKWGVENSDWCGIVD

SEQ ID NO: 6216 - protein, 40 aa, Piromyces finnis
  Cellulose docking domain, dockering
QCWSELIGYPCCDPKNNVVYSHDSYGEWGYNFKTQMWCGL

SEQ ID NO: 6217 - protein, 33 aa, Piromyces finnis
  Cellulose docking domain, dockering
PDYSCCEGCEVIEETEEGKWGIENYAWCGIKDS

SEQ ID NO: 6218 - protein, 32 aa, Neocallimastix californiae
  Cellulose-binding domain
SIWQQCGGQNYNGPTCCEAGTTCVKLSDYYYQ

SEQ ID NO: 6219 - protein, 32 aa, Neocallimastix californiae
  Cellulose-binding domain
VALYDQCGGEGYFGPTKCCKGKCISQGPYYSQ

SEQ ID NO: 6220 - protein, 32 aa, Neocallimastix californiae
  Cellulose-binding domain
KAYAQCGGLGYEGSTCCQAGTICTVVNEHYSH

SEQ ID NO: 6221 - protein, 32 aa, Neocallimastix californiae
  Cellulose-binding domain
VALYDQCGGDGYFGPTECCKGKCISQGPYYSQ

SEQ ID NO: 6222 - protein, 32 aa, Neocallimastix californiae
  Cellulose-binding domain
KAYGKCGGNDWTGSTCCMVGTSCQKINEWVSL

SEQ ID NO: 6223 - protein, 32 aa, Neocallimastix californiae
  Cellulose-binding domain
FDQCGGVGYNGPTNCCNPDYKCKEYGTYYFQC

SEQ ID NO: 6224 - protein, 32 aa, Neocallimastix californiae
  Cellulose-binding domain
KAYAQCGGIGYEGPNCCQAGTVCTEINEHYSH

SEQ ID NO: 6225 - protein, 33 aa, Neocallimastix californiae
  Cellulose-binding domain
ANVWGQCGGEGWNGPTCCNSGSVCVVTNQYYHQ

SEQ ID NO: 6226 - protein, 34 aa, Neocallimastix californiae
  Cellulose-binding domain
NNWAQCGGIDFNGPTTCCDPSAVCKYLNDYYYQC

SEQ ID NO: 6227 - protein, 33 aa, Neocallimastix californiae
  Cellulose-binding domain
NKWDQCGGMNWAGPNCCVEGTYCTFVNPYYSQC

SEQ ID NO: 6228 - protein, 33 aa, Neocallimastix californiae
  Cellulose-binding domain
EKWTQCGGQGYTGPTCCKSGSTCHEINKYYSQC

SEQ ID NO: 6229 - protein, 34 aa, Neocallimastix californiae
  Cellulose-binding domain
KAYQPCGGNDYPNAPTCCEAGFACLMKNPNYHQC

SEQ ID NO: 6230 - protein, 33 aa, Neocallimastix californiae
  Cellulose-binding domain
VARYAQCGGVNYHGSTKCCGNLTCVYRGEYYSQ

SEQ ID NO: 6231 - protein, 32 aa, Neocallimastix californiae
  Cellulose-binding domain
TPYGQCGGINYNGPTCCPSGYTCKFISDYYYQ

SEQ ID NO: 6232 - protein, 31 aa, Neocallimastix californiae
  Cellulose-binding domain
KEFDQCDGINYNGPKCCSVGKCVRLNDYYYQ

SEQ ID NO: 6233 - protein, 31 aa, Neocallimastix californiae
  Cellulose-binding domain
SQWAQCGGIGFNGPTCCSSGKCVKLNDWYSQ

SEQ ID NO: 6234 - protein, 34 aa, Neocallimastix californiae
  Cellulose-binding domain
AKHWDQCGGVNHRGPFCCESGLTCVFVNDYYSQC

SEQ ID NO: 6235 - protein, 30 aa, Neocallimastix californiae
  Cellulose-binding domain
VPAFGQCGGTDYRGSTKCCENLRCVYLNDY

SEQ ID NO: 6236 - protein, 34 aa, Neocallimastix californiae
  Cellulose-binding domain
NVYEYCGGINYPKAPKCCKPGSKCVKFNEYHHQC

SEQ ID NO: 6237 - protein, 32 aa, Anaeromyces robustus
  Cellulose-binding domain
KAYAQCGGKEYTGPNCCQAGTICTEINEHYSH

SEQ ID NO: 6238 - protein, 32 aa, Anaeromyces robustus
  Cellulose-binding domain
VALYDQCGGEGYFGPTECCKGKCTSQGPYYSQ

SEQ ID NO: 6239 - protein, 33 aa, Anaeromyces robustus
  Cellulose-binding domain
TLWNQCDENGILGPSCCEKGSICKKYSDYYSQC

SEQ ID NO: 6240 - protein, 32 aa, Anaeromyces robustus
  Cellulose-binding domain
KVWDQCGGATYYGPTCCESNSRCIVHNEYYSQ

SEQ ID NO: 6241 - protein, 32 aa, Anaeromyces robustus
  Cellulose-binding domain
GNWNQCGGKEYTGPTCCNENYHCIYVNEYYSQ

SEQ ID NO: 6242 - protein, 33 aa, Anaeromyces robustus
  Cellulose-binding domain
KVYDQCGGIGFRGPTCCEPGTTCEFVVDYYSQC

SEQ ID NO: 6243 - protein, 31 aa, Anaeromyces robustus
  Cellulose-binding domain
GYGQCGGINYTGPTCCPSGYSCKKHNDYYSQ

SEQ ID NO: 6244 - protein, 33 aa, Anaeromyces robustus
  Cellulose-binding domain
PDYEKCGGIGYNGPTCCENPNFKCEVINEYFHQ

SEQ ID NO: 6245 - protein, 33 aa, Anaeromyces robustus
  Cellulose-binding domain
DVWQQCGGVGYNGPTCCKGDYYCKSYSDYYSQC

SEQ ID NO: 6246 - protein, 37 aa, Anaeromyces robustus
  Cellulose-binding domain
EAWGQCGGTVNGKKYNGSTCCVSGYKCKEYNTNYAQC

SEQ ID NO: 6247 - protein, 34 aa, Anaeromyces robustus
  Cellulose-binding domain
KAYQQCGGLNYKGTISCCEEGYFCHKNDEHYHQC

SEQ ID NO: 6248 - protein, 30 aa, Anaeromyces robustus
  Cellulose-binding domain
SLFAQCDGDGYNGPKCCQSGQCVKVNNWYS

SEQ ID NO: 6249 - protein, 33 aa, Anaeromyces robustus
  Cellulose-binding domain
KIYEQCGGFYFSGPNCCEEGSRCIYQNDYYSQC

SEQ ID NO: 6250 - protein, 34 aa, Piromyces finnis
  Cellulose-binding domain
AKKWQQCGGIGYSGPTQCESGSECVATNEFYSQC

SEQ ID NO: 6251 - protein, 32 aa, Piromyces finnis; identical to SEQ ID NO: 6220
  Cellulose-binding domain

SEQ ID NO: 6252 - protein, 32 aa, Piromyces finnis
  Cellulose-binding domain
EAYGKCGGKDWTGSTCCMVGTSCKEVNEWVSL

SEQ ID NO: 6253 - protein, 32 aa, Piromyces finnis; identical to SEQ ID NO: 6221
  Cellulose-binding domain

SEQ ID NO: 6254 - protein, 32 aa, Piromyces finnis; identical to SEQ ID NO: 6252
  Cellulose-binding domain

SEQ ID NO: 6255 - protein, 112 aa, Neocallimastix californiae
  CHB_HEX_C
APKFSMESGYYEATEDLKLAISSSSSSGTIYYTLDSSDPTTSSTAKVYSDEIKMYDKSIDENVYSMYQHEDNSPYSINLQTNYKASTLKHDKVTVVRAATKLEDGSFSPVVT

SEQ ID NO: 6256 - protein, 112 aa, Neocallimastix californiae; identical to SEQ ID NO: 6255
  CHB_HEX_C

SEQ ID NO: 6257 - protein, 77 aa, Neocallimastix californiae
  CHB_HEX_C
VPIFSMESGYYEASDNLNLTLSSSGTIYYTLDSSDPTTSSTAKVYEGEIKMYDKSVDNNVYSMYQHEENSPYSITIH

SEQ ID NO: 6258 - protein, 50 aa, Neocallimastix californiae
  CHB_HEX_C
PKFSMEAGFYEAKDGLSLTLSSSEGTVYYTLDSSDPTTSSTAKAYNGAIR

SEQ ID NO: 6259 - protein, 50 aa, Anaeromyces robustus; identical to SEQ ID NO: 6258
  CHB_HEX_C

SEQ ID NO: 6260 - protein, 49 aa, Piromyces finnis
  CHB_HEX_C
PQFSMESGFYENVEGLNLTLNSEGTILYTLDSTDPTTSSTAKVYEGPIK

SEQ ID NO: 6261 - protein, 49 aa, Piromyces finnis; identical to SEQ ID NO: 6260
  CHB_HEX_C

SEQ ID NO: 6262 - protein, 110 aa, Piromyces finnis
  CHB_HEX_C
VPQFSMESGYYENVDGLSLTLNTEEGTVLYTLDGTDPTTSSTAKVFGDPIKMYDRTIDENVLSKYQHEDKSPYTIQLKNQYKANKLNNDKATIVRAVTKLADGSFSPVVS

SEQ ID NO: 6263 - protein, 19 aa, Neocallimastix californiae
  CHIT_BIND_I_1
CPDGLCCSQYGWCGVTSDY

SEQ ID NO: 6264 - protein, 19 aa, Neocallimastix californiae
  CHIT_BIND_I_1
CPDDECCSRYGWCGTTSEY

SEQ ID NO: 6265 - protein, 19 aa, Neocallimastix californiae
  CHIT_BIND_I_1
CPNNECCSQYGWCGTTSEY

SEQ ID NO: 6266 - protein, 42 aa, Neocallimastix californiae
  CHIT_BIND_I_2
AQLCGRDYGKCPDGLCCSQYGWCGVTSDYCDNNCQPEFGRCN

SEQ ID NO: 6267 - protein, 45 aa, Neocallimastix californiae
  CHIT_BIND_I_2
YKGCGIFSGKRSCSNNECCSSSTGYCGRNDDYCGSDCQSEFGYCT

SEQ ID NO: 6268 - protein, 42 aa, Neocallimastix californiae
  CHIT_BIND_I_2
ANKCGKGYGTCPDDECCSRYGWCGTTSEYCGYKCQSDYGRCD

SEQ ID NO: 6269 - protein, 42 aa, Neocallimastix californiae
  CHIT_BIND_I_2
ANKCGKGYGSCPNNECCSQYGWCGTTSEYCDYKCQLDYGRCN

SEQ ID NO: 6270 - protein, 42 aa, Anaeromyces robustus
  CHIT_BIND_I_2
ANRCGKGYGSCPDNACCSQWGWCGFTSDHCGAGCNKEYGRCD

SEQ ID NO: 6271 - protein, 167 aa, Anaeromyces robustus
  CHITIN DEACETYLASE 1-RELATED
YTQCNNPKHWAMTYDDGPTEFADAILDLLKEKGIKATFFIVGHMYMDNNSSDWSRIIKRMDSEGHIVGNHTYDHQDLTGLSSDQIISQMKQVEDRIFKIIGKRPAFMRPPYGSGNGNQNVMNALQQAGYTAAINWNVDPQDYSNGGDANYARQVINQAKGQPIITLN

SEQ ID NO: 6272 - protein, 34 aa, Neocallimastix californiae
  Chitin_bind_1
AQLCGRDYGKCPDGLCCSQYGWCGVTSDYCDNNC

SEQ ID NO: 6273 - protein, 35 aa, Neocallimastix californiae
  Chitin_bind_1
ANKCGKGYGTCPDDECCSRYGWCGTTSEYCGYKCQ

SEQ ID NO: 6274 - protein, 34 aa, Neocallimastix californiae
  Chitin_bind_1
ANKCGKGYGSCPNNECCSQYGWCGTTSEYCDYKC

SEQ ID NO: 6275 - protein, 34 aa, Anaeromyces robustus
  Chitin_bind_1
ANRCGKGYGSCPDNACCSQWGWCGFTSDHCGAGC

SEQ ID NO: 6276 - protein, 45 aa, Neocallimastix californiae
  Chitin-bd_1
CGILSGKRTCPGDNCCSASTGYCGRNFCDIDCQSEFGYCNNKNNN

SEQ ID NO: 6277 - protein, 45 aa, Neocallimastix californiae; identical to SEQ ID NO: 6276
  Chitin-bd_1

SEQ ID NO: 6278 - protein, 46 aa, Neocallimastix californiae
  Chitin-bd_1
QLCGRDYGKCPDGLCCSQYGWCGVTSDYCDNNCQPEFGRCNNMAAP

SEQ ID NO: 6279 - protein, 46 aa, Neocallimastix californiae
  Chitin-bd_1
CGIFSGKRSCSNNECCSSSTGYCGRNDDYCGSDCQSEFGYCTSSNS

SEQ ID NO: 6280 - protein, 44 aa, Neocallimastix californiae
  Chitin-bd_1
NKCGKGYGTCPDDECCSRYGWCGTTSEYCGYKCQSDYGRCDNIS

SEQ ID NO: 6281 - protein, 46 aa, Neocallimastix californiae
  Chitin-bd_1
NKCGKGYGSCPNNECCSQYGWCGTTSEYCDYKCQLDYGRCNNISFD

SEQ ID NO: 6282 - protein, 45 aa, Anaeromyces robustus
  Chitin-bd_1
NRCGKGYGSCPDNACCSQWGWCGFTSDHCGAGCNKEYGRCDNVET

SEQ ID NO: 6283 - protein, 451 aa, Neocallimastix californiae
  CHITINASE
KIIVGYFSEWKNANYPISRVDLSKITHLNYAFGVIDPNSYAVTGYDSNILSQVVTAAHSQGVKVLMSVGGWYGSRYFTQMTSSKSNIEKFVDSCQSLISNYGVDGIDIDWEYPGREGACNSPDMANDAENYLTLLKILREKIGNALISAAVSVIPFEKNGQPISDLSEYEKYFDYINVMAYDFAGSWTPTVSHHSALYDPEAGEKLSLSSGVKNWLSRGFPANKIVVGVPAYGKSWIAASSNRNGLYQSVANGNPKGDHEDSNSPWTNYCGVLESAYSGNWKYKNIRSEILKSDYTTASGSWVRSWDDKVKGPYLFNKETKQIITYDDPETIQYKAKYIIDNNFGGMMIWELENDTDDFEILTAINDNLGCKDSNKSSNSSPKTKTIIKSTTIVKQTTTIAEIPTVSNNDNPVSNNVTPVSSNNDSLNAEYPYCNNCVTVYEDDQKWGILN

SEQ ID NO: 6284 - protein, 370 aa, Neocallimastix californiae
  CHITINASE
IIIYYPEWKYYNYPPRNLPFNKLTHINYAFGEIDPTNYSLKYDSTKFLELIETARSRNKNVKIIMSVGGWTGSRYFSVMSSNPANRSKFISSVKSMLESTGADGIDIDWEHPGVPGAFYDSFDAQNDTYNLLKLMQELREAIGKSKIISTAVTFNLFVVNYQPLQDLSKFAEILDYINLMCYDFNGSWSNIISHQSSLYPTGGNDSGFSVEGAVKNWMNAKFPSNKIVIGIPSYGISWISSTSNNNGLLQIPSNSFPKGDEEDVMNAESGRYSGIWKYKNLRKQILQSSFKDATGDWIRVWDSKSSVPYLYNKVSRQFITYDDPESVKIKADYVIERNLGGMMMWEIEEDTKDGELISTVYDNFIGLTCD

SEQ ID NO: 6285 - protein, 437 aa, Neocallimastix californiae
  CHITINASE
CPDDECCSRYGWCGTTSEYCGYKCQSDYGRCDNISLNTSNLGKNMVEISTSQSGIEGLCKNSKLSKSIIVYYPEWKYYDFPPKNIPFNKLTHINYAFAEIDSNDYSLDYDSSRFLELVETAHEKNKNIKVLMSIGGWTGSKYYSKMASSSSRRSKFVKSVKRMLEASDADGIDIDWEYPGTSGAYDDNFDAENDTNNLLKLLKELREAIGSSKIISAAVPFNTFEVDSRPLKDMSEFAELFDYVNIMAYDFAGSWSTVTSHQSSLYSISEDDNGYSLSGAVSNWINANFPSSKIVVGIPAYGRSWISGSSSNNGYLQRPSNSHPKGDEEDYIDSSSKRYSSTWKYKNIRKAIVKSTYKNSSGDWIRIWDSKSSVPFLFNTNTRQFITYDDPESVSLKADYVINKNLGGMMMWEIEEDTQDSELISTIYEKFISLTCN

SEQ ID NO: 6286 - protein, 454 aa, Neocallimastix californiae
  CHITINASE
IIVYYPEWKYYNFPPKNIPFNKLTHINYAFAEINSSDYSLEYDSSKFLELVETAHEYNKNIKVLMSIGGWTGSRYYSKMASSSSNRSKFVKSVKRMLEASGADGIDIDWEYPGTSGAYDDNFDAKNDTNNLLKLLQELRASIGYSKIISAAVPYNTFEVNYKPLEDMSEFAELFDYINIMAYDFAGSWSSVTSHHSSLYSTVEDDSGYSLAGAVKNWMNARFPATKIVVGIPAYGRSWISGSSSNNGYLQRPSNSHPKGDEEDYIDPNSKRYSSTWKYKNIRKAIMKSTYKDSTGNWIRVWDSKSSVPFLFNKNTRQFITYDDPESVSIKADYVIKYNLGGMMMWEIEEDTKDSELISTIHKKFKSFSCTNLKNNLTGNKNIVNPGLNIDLNGESSESSKYSSSTRKITSIRTSTRTTLRSTSTYTLCPNSSKYKCCESCNVSYDDGNKWGVLN

SEQ ID NO: 6287 - protein, 422 aa, Anaeromyces robustus
  CHITINASE
KKIVGYFSEWRNSNYPISRVDLSKITHLNYAFGLIDPSTYAVTGYESWILTQVVEAAHKQGVKVLMSIGGWYGSRYFTKMTSSKSNMERFADSCKNLIDTYKIDGIDIDWEYPGREGACNTPDLANDTDNYLTLLEILRKKIGNDSLITAAVSAIPFEKNGQPVSNLSAYAKYFDFINLMAYDFAGSWSSVTSHHSGLYDPEAGDKLSVSTGVKNWLNAQFPASKIVVGVPAYGKSWIAASSDKNGLYQSIANKSPKGDQDDSNDAWTNYCGVVESTYSSNWKYKNLRKEILTSDYTSASGSWVRTWDDTVMAPYLFNKDTKQIISYDDPKAIENKAKYVLSNNFAGMMVWELENDTEDFEILSAINKHLGCDGSFNGDSNKPTTTTTKKTTTVTKKSTTTTTKKSTPTDTNCPNLGYPCCN

SEQ ID NO: 6288 - protein, 453 aa, Anaeromyces robustus
  CHITINASE
IIVYYPEWKYYDFPPKDIPFSKLTHINYAFAEINPDDFSLEYDSNKFLELIDTAHKKNKSIKVLMSIGGWTGSRYFSKMASSSSNRTKFVKSVKRMIDASNADGIDIDWEYPGSSGAYDDNYDSENDTNNLLKLLKELRETIGTSKLITAAVPFNTFEVDHKPLSDMTEFAKLFDFINIMAYDFSGSWSSVTAHQSALYSTHEDDSGYSLSGAVKNWMNANFPAKKIVVGIPAYGRSWIAGSSTNHGYLQRPSNSYPKGDEEDYIDSDSKRYSSTWKYKNIRKQVLKSDYSKSTGSWERIWDSKSSAPFLFNKDTKQFITYDDPKSVGLKADYVIENNLGGMMMWEIEEDSKDSELISSMYQKFISLTCSGAKGMVGSIDFNLDGISNDSSSPSKTTTIRRTTTTSKRISTITTSSKKSTSTSCPNSPAYKCCSSCIVYFEDNYKWGTMNGEW

SEQ ID NO: 6289 - protein, 132 aa, Piromyces finnis
  CHITINASE
FYYRSWIVSSTSRNGLYQSIVNGNPRGDHEDSSDSWTNYCGIVESGFSGSWKYKNIRNEILLSSYNTSSGSWIRTWDDNVKCPYLFNKDTKQIISYDDPESIGYKAKFVLENGFAGMMVWELENDTDDFEIL

SEQ ID NO: 6290 - protein, 132 aa, Piromyces finnis; identical to SEQ ID NO: 6289
  CHITINASE

SEQ ID NO: 6291 - protein, 382 aa, Piromyces finnis
  CHITINASE
YFSEWRYSSYPVSRIDFSKFTHLNYAFAVIDPNTYALTGYEGWILNEVVTAAHNQDVKVLMSVGGWYGSRYFTKMTSSENNMKKFAESCKNLIDTYHIDGIDIDWEYPGREGACNNPDYANDTDNYLKLLKILREYIGNENIISAAVSITPFEKNGQPITNLAPYAEYFDFINIMGYDFAGSWSSVTSHHAALYDPEAGDILSISSGVNNWLNGQFPADKIVIGVPTYGKSWIVSSTSRNGLYQSIVNGNPRGDHEDSSDSWTNYCGIVESGFSGSWKYKNIRNEILLSSYNTSSGSWIRTWDDNVKCPYLFNKDTKQIISYDDPESIGYKAKFVLENGFAGMMVWELENDTDDFEILTAINNQLGCDGSSINDNTCPKSEY

SEQ ID NO: 6292 - protein, 94 aa, Neocallimastix californiae
  Chitinase insertion domain
YGKSWIAASSNRNGLYQSVANGNPKGDHEDSNSPWTNYCGVLESAYSGNWKYKNIRSEILKSDYTTASGSWVRSWDDKVKGPYLFNKETKQIIT

SEQ ID NO: 6293 - protein, 87 aa, Neocallimastix californiae
  Chitinase insertion domain
YGISWISSTSNNNGLLQIPSNSFPKGDEEDVMNAESGRYSGIWKYKNLRKQILQSSFKDATGDWIRVWDSKSSVPYLYNKVSRQFIT

SEQ ID NO: 6294 - protein, 87 aa, Neocallimastix californiae
  Chitinase insertion domain
YGRSWISGSSSNNGYLQRPSNSHPKGDEEDYIDSSSKRYSSTWKYKNIRKAIVKSTYKNSSGDWIRIWDSKSSVPFLFNTNTRQFIT

SEQ ID NO: 6295 - protein, 87 aa, Neocallimastix californiae
  Chitinase insertion domain
YGRSWISGSSSNNGYLQRPSNSHPKGDEEDYIDPNSKRYSSTWKYKNIRKAIMKSTYKDSTGNWIRVWDSKSSVPFLFNKNTRQFIT

SEQ ID NO: 6296 - protein, 94 aa, Anaeromyces robustus
  Chitinase insertion domain
YGKSWIAASSDKNGLYQSIANKSPKGDQDDSNDAWTNYCGVVESTYSSNWKYKNLRKEILTSDYTSASGSWVRTWDDTVMAPYLFNKDTKQIIS

SEQ ID NO: 6297 - protein, 87 aa, Anaeromyces robustus
  Chitinase insertion domain
YGRSWIAGSSTNHGYLQRPSNSYPKGDEEDYIDSDSKRYSSTWKYKNIRKQVLKSDYSKSTGSWERIWDSKSSAPFLFNKDTKQFIT

SEQ ID NO: 6298 - protein, 94 aa, Piromyces finnis
  Chitinase insertion domain
YYRSWIVSSTSRNGLYQSIVNGNPRGDHEDSSDSWTNYCGIVESGFSGSWKYKNIRNEILLSSYNTSSGSWIRTWDDNVKCPYLFNKDTKQIIS

SEQ ID NO: 6299 - protein, 94 aa, Piromyces finnis; identical to SEQ ID NO: 6298
  Chitinase insertion domain

SEQ ID NO: 6300 - protein, 94 aa, Piromyces finnis
  Chitinase insertion domain
YGKSWIVSSTSRNGLYQSIVNGNPRGDHEDSSDSWTNYCGIVESGFSGSWKYKNIRNEILLSSYNTSSGSWIRTWDDNVKCPYLFNKDTKQIIS

SEQ ID NO: 6301 - protein, 8 aa, Neocallimastix californiae
  CHITINASE_18
VDGIDIDW

SEQ ID NO: 6302 - protein, 8 aa, Anaeromyces robustus
  CHITINASE_18
IDGIDIDW

SEQ ID NO: 6303 - protein, 8 aa, Piromyces finnis
  CHITINASE_18
IDGIDIDW

SEQ ID NO: 6304 - protein, 91 aa, Neocallimastix californiae
  Chitinase_insertion
SWIAASSNRNGLYQSVANGNPKGDHEDSNSPWTNYCGVLESAYSGNWKYKNIRSEILKSDYTTASGSWVRSWDDKVKGPYLFNKETKQIIT

SEQ ID NO: 6305 - protein, 87 aa, Neocallimastix californiae
  Chitinase_insertion
SWISSTSNNNGLLQIPSNSFPKGDEEDVMNAESGRYSGIWKYKNLRKQILQSSFKDATGDWIRVWDSKSSVPYLYNKVSRQFITYDD

SEQ ID NO: 6306 - protein, 87 aa, Neocallimastix californiae
  Chitinase_insertion
SWISGSSSNNGYLQRPSNSHPKGDEEDYIDSSSKRYSSTWKYKNIRKAIVKSTYKNSSGDWIRIWDSKSSVPFLFNTNTRQFITYDD

SEQ ID NO: 6307 - protein, 87 aa, Neocallimastix californiae
  Chitinase_insertion
SWISGSSSNNGYLQRPSNSHPKGDEEDYIDPNSKRYSSTWKYKNIRKAIMKSTYKDSTGNWIRVWDSKSSVPFLFNKNTRQFITYDD

SEQ ID NO: 6308 - protein, 81 aa, Anaeromyces robustus
  Chitinase_insertion
SSDKNGLYQSIANKSPKGDQDDSNDAWTNYCGVVESTYSSNWKYKNLRKEILTSDYTSASGSWVRTWDDTVMAPYLFNKDT

SEQ ID NO: 6309 - protein, 84 aa, Anaeromyces robustus
  Chitinase_insertion
SWIAGSSTNHGYLQRPSNSYPKGDEEDYIDSDSKRYSSTWKYKNIRKQVLKSDYSKSTGSWERIWDSKSSAPFLFNKDTKQFIT

SEQ ID NO: 6310 - protein, 98 aa, Piromyces finnis
  Chitinase_insertion
FYYRSWIVSSTSRNGLYQSIVNGNPRGDHEDSSDSWTNYCGIVESGFSGSWKYKNIRNEILLSSYNTSSGSWIRTWDDNVKCPYLFNKDTKQIISYDD

SEQ ID NO: 6311 - protein, 98 aa, Piromyces finnis; identical to SEQ ID NO: 6310
  Chitinase_insertion

SEQ ID NO: 6312 - protein, 92 aa, Piromyces finnis
  Chitinase_insertion
KSWIVSSTSRNGLYQSIVNGNPRGDHEDSSDSWTNYCGIVESGFSGSWKYKNIRNEILLSSYNTSSGSWIRTWDDNVKCPYLFNKDTKQIIS

SEQ ID NO: 6313 - protein, 109 aa, Neocallimastix californiae
  Chitobiase/Hex_dom_2-like
DEEFSGVKKIADMVRNDVKLVTGALPEFNYSLNTTIGEEAAVIFGTVGKSNLFEGVDVSAIKDKYESYVFNVQGNRIYIAGSDKRGTIYGLFHLSELMGVSPFVDWLDL

SEQ ID NO: 6314 - protein, 133 aa, Neocallimastix californiae
  Chitobiase/Hex_dom_2-like
EYDGISIIAEALKADIARVTGESVDKEGKASNSSNGLKIITNSSQLSGKMIIAGTFGAKGNDVINQLIDNGKIDVSNLKGRWESYQMQVIKNPINGVSEALVIVGSDKRGTLYGMFHISEMMGVSPWVWWSDV

SEQ ID NO: 6315 - protein, 34 aa, Neocallimastix californiae
  ChtBD1
LCGRDYGKCPDGLCCSQYGWCGVTSDYCDNNCQP

SEQ ID NO: 6316 - protein, 38 aa, Neocallimastix californiae
  ChtBD1
KCGKGYGTCPDDECCSRYGWCGTTSEYCGYKCQSDYGR

SEQ ID NO: 6317 - protein, 38 aa, Neocallimastix californiae
  ChtBD1
KCGKGYGSCPNNECCSQYGWCGTTSEYCDYKCQLDYGR

SEQ ID NO: 6318 - protein, 34 aa, Anaeromyces robustus
  ChtBD1
RCGKGYGSCPDNACCSQWGWCGFTSDHCGAGCNK

SEQ ID NO: 6319 - protein, 337 aa, Neocallimastix californiae; identical to SEQ ID NO: 852
  CINNAMYL ALCOHOL DEHYDROGENASE 2-RELATED

SEQ ID NO: 6320 - protein, 342 aa, Neocallimastix californiae; identical to SEQ ID NO: 856
  CINNAMYL ALCOHOL DEHYDROGENASE 2-RELATED

SEQ ID NO: 6321 - protein, 329 aa, Neocallimastix californiae; identical to SEQ ID NO: 857
  CINNAMYL ALCOHOL DEHYDROGENASE 2-RELATED

SEQ ID NO: 6322 - protein, 240 aa, Neocallimastix californiae
  ClpP/crotonase
MYDLEEGIAVIEMCSPQNFNGMNLDISRQLHAHVNTLKMRKDVKCVIVRGYRRHFCTGADPSWVANIEGKTHLRMALEVYEIYRDYASILELNVPVIGMLNGRIVGGGLALSLNCDWRVALKTSTIDFGNLPRGVCPGMMLSVNMESYVKRGRSFNMYLQPGSYGMTMEEALSIGIIQEIADSFEDLQEKAIRKAREIVQASKQFQGIDRSILLMRTPLNKELIMKEAYLLAECAVYTDM

SEQ ID NO: 6323 - protein, 185 aa, Neocallimastix californiae
  ClpP/crotonase
NIVIESTDRLVHVIFNRPEANNSFTEDMLIRLMEAYDPNKILFIESKGKNFSTGWDLNGGDFGSEAFEQSIEKYSQFVKQLEGAIQPIVVVCQGSCRGGSMLFPLMADYVIAYEDANFGFPEVRRGGIPALVSVAALKKFSRTIAKRMMLLGEPIQVEEAKKCNLVDYICHTKEQCNELIKKLFQ

SEQ ID NO: 6324 - protein, 203 aa, Neocallimastix californiae
  ClpP/crotonase
DDVIVKSTDKIVILTLNRPESMNDLHTGMIKKIIQAIDVQKSLIIENAGDNFCMGWSSLNAETETIESVYHYYSELINKMNSVTQPIISICKGIVFGGGMIFPCMSDIVIADNNTTFSFYESTFKQMPFILTKAAQNRIKSSHIKKMFLIEKEANIEEAINMELVDIAVASNKLEMEKKSVIRRINTLDPSVLKITKENINDT

SEQ ID NO: 6325 - protein, 222 aa, Neocallimastix californiae
  ClpP/crotonase
MDLVSLKLVEPKIYLLEIKTNIINLEVASQIGNSFEQMKEKNDAHVLIIKNASNDFCQGFDAEFLNSISGKSKSQLANEIYHIYKNYSKTYELTIPVLCCLSGSVMNAGLNLALTSDWRVASRESCLSFINKSNTVDSSVMMSHSLQDFVGRGKSFNILFNYDNKTSNAVEAYKQGIVQELVANPNQLMDIALTKARVIASAPLKGINHSLNLMRIPYENSL

SEQ ID NO: 6326 - protein, 189 aa, Neocallimastix californiae
  ClpP/crotonase
IEDGIYSLTMTNDYMTLEYAEEFGQAITKLSQLKKMKALIIEYEDQLSKGLEPSLKEELNKTKPSKTKINEIYKIYFHCMKLANVNVPVICCLNGEITDLNILLAILSNWRLITRRSYLSSHNNPININWITELVNAKNDTQSLNLIEKIEKEKISAIQAYKLKYVNDIASNAENMKKMALEMAKSIIQ

SEQ ID NO: 6327 - protein, 194 aa, Neocallimastix californiae
  ClpP/crotonase
SHVYYQPLEDGIYCLTLKNDYMTLEYAEELGQAITELSQLKKMKILIIEFEKNFSKGLEPSLKEELCKEKPSKSKINEIFKIYFHCMKLANINIPVICCLNGEITDLSILIGHLSNWRLITRQSVYYSHNNPINIKWMTDIAISNDETHYLKLIKQLEEENISAIYAYKLKYINDIAFNVEKMKIMALKMAKIL

SEQ ID NO: 6328 - protein, 193 aa, Anaeromyces robustus
  ClpP/crotonase
SDIIIESTDRLVHVVFNRPEANNSFNGDMLIKLMDAYDPNKILLIESQGKNFSTGWDLNNGGFNSQAFEDSINKYSEFVERLENAVQPIVVICQGSCRGGSMLFPLMADYVIAYKDASFGFPEVRRGGIPALVSVAAMKKLSRTMAKRMMLLGEPIQVEEAKNTNLVDYICNTKEECNQIVKNLFNQFITNHI

SEQ ID NO: 6329 - protein, 240 aa, Anaeromyces robustus
  ClpP/crotonase
LYDLEEGIAVLEMCSLKNFNGMNLDISRQLHAHVNTLKTRKDIKCVILRGYKRHFCTGADPSWVANIEGKSHLRMALEVYEIYRDYASILELNVPVIGMLNGRIVGGGLALSLNCDWRVALKTSTIDFGNLPRGVCPGMMLSANMESFVKRGYSFNMYLQPGSYGMSMEEALELGIIQEIAESFEDLQEKALLKAREIVKASKQYQGIDRSILLMRTPLNTELIMKEAYLLAECAVYTDM

SEQ ID NO: 6330 - protein, 227 aa, Anaeromyces robustus
  ClpP/crotonase
MDLVSLQLVEPKIYVLEMNTNIINLEVAAQIGHAIDIMKQKNDAHVLIIKSAAPDFCQGFDAEYLNSISGKSKSQLANEIYNIYKNYNKNSELTIPVLCCLSGSVMNAGLNLALSSDWRVASRESCLSFINKNNTVDSSVMMSHSLQEFIGRGKSFNMIFNYDNKKSNVLEAYKQGIVQELVANPGQLMDIALAKARIIASAPLKGINHSLNLMRIPYDNSTLMKEA

SEQ ID NO: 6331 - protein, 199 aa, Anaeromyces robustus
  ClpP/crotonase
DVIIRNTDKIVFITLNRSESMNDLNNKMIEKIIEAIDPQKSLIIDSTGDHLSMGWTSNESKSDTIENVYHIYGKLMDKMSEVTQPIVTICKGAVFGGGMIFPCMSDIVIADNNATFSFYETNFKQIPFILTKAAQNRIKNSQIMKMFLIEKEAEVNEARNMELVDIIVNSDKLDNEKKSVIRRINTLDSSVLKITKENI

SEQ ID NO: 6332 - protein, 203 aa, Piromyces finnis
  ClpP/crotonase
DIIIRPTEKVVFLTLNRPGSMNDLHANMMRKIISAIDTQKALVIEGSGDNFCMGWTSSSMNKHETTENIYQLYGELIKKMNKVTQPIVTICKGVVFGGGMIFPCMSDIVIAENNAVFSFYENRLKQIPFILSKAAQNRIKHSQIKKMFLIEKEADIEEAINMELVDISVPADKLEMEKKSVLRRINTLDPTVLKITKENIKDA

SEQ ID NO: 6333 - protein, 221 aa, Piromyces finnis
  ClpP/crotonase
MDLVSLELLEPKIYLLEIKTNIINPEIAAQIGNAFEQMKEKDDAHVLIVKCNGDDFCQGFDAEFLNSISNKTKGQLANEIYNIYKNYSKSSELTIPVLCCLNGSVMNAGLNFALTSDWRVATRETCLSFINKTKTVDSSVMMSHSLQDFIGRGKSFNMIFNYDNTTNNAIEAHKQGIIQELVANQSQLLDAALVKARIIASAPLKGINHSLNLMRIPYDNS

SEQ ID NO: 6334 - protein, 186 aa, Neocallimastix californiae
  ClpP/crotonase-like_dom
NNIVIESTDRLVHVIFNRPEANNSFTEDMLIRLMEAYDPNKILFIESKGKNFSTGWDLNGGDFGSEAFEQSIEKYSQFVKQLEGAIQPIVVVCQGSCRGGSMLFPLMADYVIAYEDANFGFPEVRRGGIPALVSVAALKKFSRTIAKRMMLLGEPIQVEEAKKCNLVDYICHTKEQCNELIKKLFQ

SEQ ID NO: 6335 - protein, 202 aa, Neocallimastix californiae
  ClpP/crotonase-like_dom
YDLEEGIAVIEMCSPQNFNGMNLDISRQLHAHVNTLKMRKDVKCVIVRGYRRHFCTGADPSWVANIEGKTHLRMALEVYEIYRDYASILELNVPVIGMLNGRIVGGGLALSLNCDWRVALKTSTIDFGNLPRGVCPGMMLSVNMESYVKRGRSFNMYLQPGSYGMTMEEALSIGIIQEIADSFEDLQEKAIRKAREIVQASK

SEQ ID NO: 6336 - protein, 206 aa, Neocallimastix californiae
  ClpP/crotonase-like_dom
NDDVIVKSTDKIVILTLNRPESMNDLHTGMIKKIIQAIDVQKSLIIENAGDNFCMGWSSLNAETETIESVYHYYSELINKMNSVTQPIISICKGIVFGGGMIFPCMSDIVIADNNTTFSFYESTFKQMPFILTKAAQNRIKSSHIKKMFLIEKEANIEEAINMELVDIAVASNKLEMEKKSVIRRINTLDPSVLKITKENINDTEL

SEQ ID NO: 6337 - protein, 181 aa, Neocallimastix californiae
  ClpP/crotonase-like_dom
TNIINLEVASQIGNSFEQMKEKNDAHVLIIKNASNDFCQGFDAEFLNSISGKSKSQLANEIYHIYKNYSKTYELTIPVLCCLSGSVMNAGLNLALTSDWRVASRESCLSFINKSNTVDSSVMMSHSLQDFVGRGKSFNILFNYDNKTSNAVEAYKQGIVQELVANPNQLMDIALTKARVIA

SEQ ID NO: 6338 - protein, 195 aa, Neocallimastix californiae
  ClpP/crotonase-like_dom
KYVHYQPIEDGIYSLTMTNDYMTLEYAEEFGQAITKLSQLKKMKALIIEYEDQLSKGLEPSLKEELNKTKPSKTKINEIYKIYFHCMKLANVNVPVICCLNGEITDLNILLAILSNWRLITRRSYLSSHNNPININWITELVNAKNDTQSLNLIEKIEKEKISAIQAYKLKYVNDIASNAENMKKMALEMAKSII

SEQ ID NO: 6339 - protein, 203 aa, Anaeromyces robustus
  ClpP/crotonase-like_dom
LYDLEEGIAVLEMCSLKNFNGMNLDISRQLHAHVNTLKTRKDIKCVILRGYKRHFCTGADPSWVANIEGKSHLRMALEVYEIYRDYASILELNVPVIGMLNGRIVGGGLALSLNCDWRVALKTSTIDFGNLPRGVCPGMMLSANMESFVKRGYSFNMYLQPGSYGMSMEEALELGIIQEIAESFEDLQEKALLKAREIVKASK

SEQ ID NO: 6340 - protein, 193 aa, Anaeromyces robustus
  ClpP/crotonase-like_dom
NDKSDIIIESTDRLVHVVFNRPEANNSFNGDMLIKLMDAYDPNKILLIESQGKNFSTGWDLNNGGFNSQAFEDSINKYSEFVERLENAVQPIVVICQGSCRGGSMLFPLMADYVIAYKDASFGFPEVRRGGIPALVSVAAMKKLSRTMAKRMMLLGEPIQVEEAKNTNLVDYICNTKEECNQIVKNLFNQFIT

SEQ ID NO: 6341 - protein, 207 aa, Anaeromyces robustus
  ClpP/crotonase-like_dom
SLPFSENDVIIRNTDKIVFITLNRSESMNDLNNKMIEKIIEAIDPQKSLIIDSTGDHLSMGWTSNESKSDTIENVYHIYGKLMDKMSEVTQPIVTICKGAVFGGGMIFPCMSDIVIADNNATFSFYETNFKQIPFILTKAAQNRIKNSQIMKMFLIEKEAEVNEARNMELVDIIVNSDKLDNEKKSVIRRINTLDSSVLKITKENIK

SEQ ID NO: 6342 - protein, 203 aa, Anaeromyces robustus
  ClpP/crotonase-like_dom
EMNTNIINLEVAAQIGHAIDIMKQKNDAHVLIIKSAAPDFCQGFDAEYLNSISGKSKSQLANEIYNIYKNYNKNSELTIPVLCCLSGSVMNAGLNLALSSDWRVASRESCLSFINKNNTVDSSVMMSHSLQEFIGRGKSFNMIFNYDNKKSNVLEAYKQGIVQELVANPGQLMDIALAKARIIASAPLKGINHSLNLMRIPYD

SEQ ID NO: 6343 - protein, 214 aa, Piromyces finnis
  ClpP/crotonase-like_dom
EKVKPQAFAEDDIIIRPTEKVVFLTLNRPGSMNDLHANMMRKIISAIDTQKALVIEGSGDNFCMGWTSSSMNKHETTENIYQLYGELIKKMNKVTQPIVTICKGVVFGGGMIFPCMSDIVIAENNAVFSFYENRLKQIPFILSKAAQNRIKHSQIKKMFLIEKEADIEEAINMELVDISVPADKLEMEKKSVLRRINTLDPTVLKITKENIKDA

SEQ ID NO: 6344 - protein, 202 aa, Piromyces finnis
  ClpP/crotonase-like_dom
KTNIINPEIAAQIGNAFEQMKEKDDAHVLIVKCNGDDFCQGFDAEFLNSISNKTKGQLANEIYNIYKNYSKSSELTIPVLCCLNGSVMNAGLNFALTSDWRVATRETCLSFINKTKTVDSSVMMSHSLQDFIGRGKSFNMIFNYDNTTNNAIEAHKQGIIQELVANQSQLLDAALVKARIIASAPLKGINHSLNLMRIPYDN

SEQ ID NO: 6345 - protein, 111 aa, Anaeromyces robustus
  CoA-dependent acyltransferases
IDEFTSEKINEYVKNNKISKTAFFLSIYGYILSKYSRQDIIYSSVMSTNRNNNYIQDMIGMFVSTQPILLKYSNKEMNSFTDIIKQIMSVLYDIYNYQDISFSELSNILNL

SEQ ID NO: 6346 - protein, 210 aa, Anaeromyces robustus
  CoA-dependent acyltransferases
KNCYKSIDKSTTSLINEYIKKHGISKAAFFITIYGYVLSKYSGQNIVYSSIVNANRNNHYTENMIGMFVSTQPILLKYDDEESSLLEIIKQNMNNLMEMYNNQDISFSELLKLLKLKKINNSFVFQPKVMFNNNNSENSIFSDDNNENMFTLYESSNELLNKENSKFDITFNVVENEENYLISIIYNDHLYESKIINNIIDSYLEVAKNI

SEQ ID NO: 6347 - protein, 156 aa, Anaeromyces robustus
  CoA-dependent acyltransferases
TTQQLGVYVDTIKNPDAIVYNTPLIFKLTKNIDINKIKEAFNKLFKNQEILRSKYYEKEINGKTEIYGFIDDECLLLFEEYTYENAKTFVRPFELSKAPLIRVGFIKNEILLIDMHHIISDGSTMLIIKKELNNYYNNNEIKELEIQFSDYAIDLN

SEQ ID NO: 6348 - protein, 157 aa, Anaeromyces robustus
  CoA-dependent acyltransferases
TSQQLGVYIDSIKNPDSIMYNIPSVFKLKKDIDINKIKMALNKIFKCQEILRSKYYEKEVNGKTEIFGYIDDECLLLFEEYTYENAKSFIRPFKLSEAPLIRIGFIKNEILLIDMHHIISDGSSMLIIKNELNSYFYNNEIIQELEIQFSDYSIYMN

SEQ ID NO: 6349 - protein, 70 aa, Anaeromyces robustus
  CoA-dependent acyltransferases
EKIIDSSLSKRINEYIRVNRISKTAFFISIYGYILSKYSGQDNIYTSMMSANRNNHYVENMIGMFVSTQP

SEQ ID NO: 6350 - protein, 185 aa, Neocallimastix californiae
  ConA-like_subgrp
NRWNLNSGGECIKVKDGMFIDSVSQSCPGSGNGGRMRTNVRYKSGKFEVRAKMPIASGLVPAIYFASTPDNTNGNQDEFDFELIGSNRMQTNLFIYGNGGREQVWNPPTDLSKDFHLYTFEWNSNSIVLKVDNQVIRTFNNPMPQQPCYFILTNWMCVGCDGWTGPADWSRQPYDFIVDYVKISD

SEQ ID NO: 6351 - protein, 213 aa, Neocallimastix californiae
  ConA-like_subgrp
KSDDFNYDSNHLDLVWQWNHNPDNSAWSVTERPGWLRLKNKHVASEILKARNTLTMRTEGPACSSVVKLDVTNLKVGDYAGLSAFQYNYGNVGVYVADNGEKRIYMASNGNTNGDVIKDSRNNIVQETKLNGNEVYLKLDFRFSNVERDGSASWNIDKVNFYYSYDGSKWTKIGKEIGMTYDLKLFTGYRSGLFSYPTKNTGGYADFDFFKYE

SEQ ID NO: 6352 - protein, 106 aa, Neocallimastix californiae
  ConA-like_subgrp
EKYWNYKYPWGSDHNGSARMYGTSTDHTHVYLKENTVVLFAKRINWDEGKSTSNPHPAIHYHSGAIHSKQTFTVNDQYPNYEIKGEFMVPTNSGTWPAFWLNGAKT

SEQ ID NO: 6353 - protein, 142 aa, Neocallimastix californiae
  ConA-like_subgrp
PPEIDIVEFKGSNVNWFNTFRTSSDVSTYKTTINNKGAWHEYRIWITKVSNTNIDIHFYIDGVWKAKHTANHVGKPFHLIMNLQMEGSSGGNGPSSNTYFRGKNIYVGRTRECVGDECSNQSNASPTTTTNEKTTTKATQPA

SEQ ID NO: 6354 - protein, 212 aa, Neocallimastix californiae
  ConA-like_subgrp
YWETLINDSLKDYGTFEKYWAYLYPWGSDHNGSARMYGAPDDHNHVYLENNSVVLQACRINWDEGKSTANPHPVIHYHSGAIHSIQTFTINDQYPNYEIRGEFIAPTTGGTWPAFWLNGAWTWPPEIDILEFKGTTTNWFNTFRTSSDVSTYKEAISNPNTWHEYRLWISKVSDVNMDIHFYIDGKWRAKHTANHVGKPFHLIMNLQMEGSA

SEQ ID NO: 6355 - protein, 157 aa, Neocallimastix californiae
  ConA-like_subgrp
GALTIPHNSKIDSALEGRNSFTIEVNVVPTGVQQFNMLAGKGDRSIGFRTSTNSIDFFIYAGNEWRTVNYNMGVDSASGWVGRKHQVAGIYDAENNMLRVYADGRILGERSVGTNSGVAHSNYNLMLGACPDTGRNSQGNFYEMRVYSKALTASELA

SEQ ID NO: 6356 - protein, 240 aa, Neocallimastix californiae
  ConA-like_subgrp
DEMKLVFSDEFDGDELDKSVWDVEVNCWGGGNGEKQCYVDHEENIFVKDGQLHIKAIPKGEYKLTDEEKKSCTNNNENSCGWTQSVTSGRIRTYKSGHAWKYGKVRVKAKLPAGPYLWPAIWMLPQDDVYGTWAASGEIDIMEARGQVPDAVGHAIHYGGQWPNNVFSSETASVKDVINDFHVYGLDWEENFLIFSVDEVEYFTVDLRKSFYSGKGSNPYKDIRQPFDEKFHLLLNVAVG

SEQ ID NO: 6357 - protein, 214 aa, Neocallimastix californiae
  ConA-like_subgrp
KSDDFDYSSNRLSLEWQWNHNPDNTAWSVTDRPGWLRLKNKYIAPELLKARNTLTMRTEGPACSGVVKLDTSNMKVGDYAGLSAFQYNYGNVGVYVADNGERRIYMASNGGYNGNADVTNSRNNIVQEVKLNGKEIYLKTDFRFSTVKSDGSASNNIDKVNFYYSLDGNQWNKIGKEIGMTYDLKLFTGYRNALFSYPTKNTGGYADFDYFEYQ

SEQ ID NO: 6358 - protein, 123 aa, Neocallimastix californiae
  ConA-like_subgrp
AYWETILSDSLTDYQTFEKYWDYLYPWGSDHNGSARMYGASDDHNHVYLENNTVVLKASRINWDEGKSTANPHPVIHYHSGAIHSKQTFTINDQYPNYEIRGEFQAPTNGGTWPAFWLNGAWT

SEQ ID NO: 6359 - protein, 135 aa, Neocallimastix californiae
  ConA-like_subgrp
PPEIDILEFKGTTTNWFNTFRTSSDVSTYKEAISNPSGWHEYRLWITKVSNTDMDIHFYIDNKWKAKHTANHVGKPFHLIMNLQMEGSASGSAPNGDTYYRGRNIYVGRSNESAPPSNAAAEVKTSKTAATTTVA

SEQ ID NO: 6360 - protein, 168 aa, Neocallimastix californiae
  ConA-like_subgrp
WNLNSGGECIKVQNGMFIDSVSQSCPGSGNGGRMRTNVRYKSGKFEVRAKMPIASGLVPAIYFASTPDNTNGDQDEFDFELIGSNRMQTNLFIHGNGGREQIWNPPTDLSKDFHLYTFEWSSNAIVLKVDNEVIRTFNNPMPDQPSYFILTNWMCIGCDGWTGPADWS

SEQ ID NO: 6361 - protein, 157 aa, Neocallimastix californiae
  ConA-like_subgrp
GALTIPHNSKLDSALQGRNSFTIEVNVVPTGVQSFNMLAGKGDYSLGFRTTTGALDFFVYAGNEWRMVSYTMGVDANSGWIGKKHQVAGIFDAGSNMLRLYVDGKMVAEKSVGTTAGVSSSNYNLMLGACPDTGRNSQGNFYEMRVYSKALSASELS

SEQ ID NO: 6362 - protein, 176 aa, Neocallimastix californiae
  ConA-like_subgrp
WLRLKNKYVVSELLRARNTLTMRTEGPACTSIVKMDTSKMKVGDYAGLSAFQFKYGNVGVYVADNGEKRVYMATNGGNEINNSRNYIEQETRMSGNEIYLKLEFRFNNVGNDGSASNNIDRVNFYYSYDGDKWTKIGKELGMTYDLTLFTGYRSALYSYPTKSTGGYVDFDYIKYT

SEQ ID NO: 6363 - protein, 211 aa, Anaeromyces robustus
  ConA-like_subgrp
KSDDFNYSSNDELDLVWQWNHNPDNSAWSVTEREGWLRLKNKYVVSELLRARNTLTMRTEGPACTSIVKMDTSKMKVGDYAGLSAFQFKYGNVGVYVADNGEKRVYMATNGGNEINNSRNYIEQETRMSGNEIYLKLEFRFNNVGNDGSASNNIDRVNFYYSYDGDKWTKIGKELGMTYDLTLFTGYRSALYSYPTKSTGGYVDFDYIKYT

SEQ ID NO: 6364 - protein, 185 aa, Anaeromyces robustus
  ConA-like_subgrp
TRWNLNSGAECMKVQGGMFIDSVSQSCRGSGNGGRMRTNVRYKSGKFEVRAKMPIASGLVPAIYFASTPDNTNGSQDEWDFELIGSNRMQTNLFINGQGGREEVWNPPYDLSRDFHTYTFEWTSNSIVLKVDNQVVRTFNNPMPTQPSYFILTNWMCVGCDGWTGPADWSRQPYDFIVDYVKITD

SEQ ID NO: 6365 - protein, 122 aa, Anaeromyces robustus
  ConA-like_subgrp
EWETVISDSLSDYQTFEKYWNYLYPWGSDHNGSARMYGAPDDHNHVYLKDNTVVILATRINWDEGKSTANPHPEIHYHSGAIHSKETFTINDQFPNYEIRGEFMVPTTRGTWPAFWLNGAWT

SEQ ID NO: 6366 - protein, 150 aa, Anaeromyces robustus
  ConA-like_subgrp
PPEIDIVEFKGDNVNWFNTFRTSSDVSTYKQGISNPGAWHEYRVWITKVSNTDMDIHFYIDGQWKAKHTANHVGKPFHLIMNLQMEGSSGNNGPTSNTYYRGRNIYVGRSRACVGNDCDKDKTTTTTTTKKSTTTTTTKKSTTTTTSNKP

SEQ ID NO: 6367 - protein, 60 aa, Anaeromyces robustus
  ConA-like_subgrp
SIPSMDDYKLVFSDEFEGNKLDRSVWDVEVNCWGGGNGEKQCYVDHDENIFVKNGQLHIK

SEQ ID NO: 6368 - protein, 273 aa, Anaeromyces robustus
  ConA-like_subgrp
DEMKLVFSDEFEGNELDRSVWDVEVNCWGGGNGEKQCYVDHDENIFVKNGQLHIKAVPKGQYKLTDQEMKTCTNNNENSCGWTQSTTSGRIRTYKSGNAWKYGKIRVKAKLPAGPYLWPAIWMLPQDDVYGTWAASGEIDIMEARGQVPDAVGHAIHFGGQWPDNDFMSETASIKNVINDFHVYGLDWEENFLIFTVDEKPYYTVDLRKSFWSGKGTNPYKKIRQPFDEKFHLLLNVAVGGNYFNGIGEFDYGRDTPQWTRPEMIIDYVRVYQ

SEQ ID NO: 6369 - protein, 278 aa, Anaeromyces robustus
  ConA-like_subgrp
SIPSMDDYKLVFSDEFEGNKLDRSVWDVEVNCWGGGNGEKQCYVDHDENIFVKNGQLHIKAVPKGQYKLTDQEMKTCTNNNEDSCGWTQSTTSGRIRTYKSGNAWKYGKIRVKAKLPAGPYLWPAIWMLPQDDVYGTWAASGEIDIMEARGQVSNAIGNAIHFGGQWPNNDFVDKTYNLSNIINDFHVYGLDWEEDYLLFSVDEEVTFFVDLRRSFWSGKGNNPYKKIRQPFDEKFHLLLNVAVGGNYFNGIGEFDYGRDTPQWTRPEMIVDYVRVYQ

SEQ ID NO: 6370 - protein, 157 aa, Piromyces finnis
  ConA-like_subgrp
GALTIPHNSRIDSALEGKNSFTIEINVVPSGVQQFNMFAGKGDHSFGFRTTTSSLDFFIFAGGEWRSLYHDMGVDSSSGWVGKKHQVAGIYDAENNMLRLYADGKMVRETKINTNSGVEHSSYNLMLGACPETGRNSQAKFYEMRVYNKALTASELA

SEQ ID NO: 6371 - protein, 134 aa, Piromyces finnis
  ConA-like_subgrp
IKPKTTTTTRRTTTTQYQQSTPTNTGDKCNWEEDFKSLDLNRWNLNSGGECIKVKDGMFYDSVSQSCPGSGNGGRMRTNVRYKSGKFEVRAKMPIASGLVPAIYFASTPDNTNGSQDEFDFELIGSNRMQTNLF

SEQ ID NO: 6372 - protein, 106 aa, Piromyces finnis
  ConA-like_subgrp
HQYWNYKYPWGSDHNGSARMYGSAEDHNHVYLKDNTVVLLATRINWDEGKSTANPHPAIHYHSGAIHSKQTFTINDQFPNYEIRGEFMAPTNGGTWPAFWLNGAWT

SEQ ID NO: 6373 - protein, 143 aa, Piromyces finnis
  ConA-like_subgrp
PPEIDIVEFKGNNVNWFNTFRTSSDVSTYKESVSNAGAWHEYRVWITKVDNTNMDIHFYIDGKWKAKHTANHVGKPFHLIMNLQMEGSSGGNGPTSDTYYRGRNIYVGRSHECTGNNCNANNAAATTTTVKTTTTSKAQTATS

SEQ ID NO: 6374 - protein, 129 aa, Piromyces finnis
  ConA-like_subgrp
CVKYASAVWETVISDSLTDYNTFEKYWDYLYPWGSDHNGSARMYGASDDHNHVYLKDNTIVLKACRINWDEGKSTANPHPVIRYHSGAIHSKQTFTINDEFPNYEFKGEFIVPTNGGTWPAFWLNGAWT

SEQ ID NO: 6375 - protein, 143 aa, Piromyces finnis; identical to SEQ ID NO: 6373
  ConA-like_subgrp

SEQ ID NO: 6376 - protein, 201 aa, Neocallimastix californiae
  Concanavalin A-like lectins/glucanases
RGNGNYRYEIWRDGNGGELTLYPKDACFKASWNNAGDYLGRVGLVWDQYINYKNLDGDLVAKYNYKKSGNDGGTYSYVGVYGWMDNPQIEYYVVDDWLHNRGAPGGSYMGSQKGTITVDGGTYKVWSGTRTGASKWGQSTFTQIFSVRTEQRTCGQINISEHFRQWEKLGLRIGSVMEAQILAESGGGSGYVDYTYATVEI

SEQ ID NO: 6377 - protein, 179 aa, Neocallimastix californiae
  Concanavalin A-like lectins/glucanases
DACFKASWNNAGDFLGRVGLVWDNKPNYKNLGGDLIANYSYKKSGNDGGTYSYVGIYGWMDNPQIEYYVVDDWLHNRGAPGGSYMGSQKGTINVDGGTYKVWTGTRTGASKWGQSTFTQIFSVRTQQRTCGQINISEHFRQWEKLGIRVGQLMEAQILAESGGGSGYVDFTYATVEIGS

SEQ ID NO: 6378 - protein, 106 aa, Neocallimastix californiae
  Concanavalin A-like lectins/glucanases
QWRPGDWVGNKKHGDFTIDGAKYTVYENTRYGPSIDGDTTFKQFFSIRQQARDCGTIDITAHFEQWEKLGMKLGKMHEAKVLGEAGSNGGGTTGTADFPYAKVYIA

SEQ ID NO: 6379 - protein, 197 aa, Neocallimastix californiae
  Concanavalin A-like lectins/glucanases
GDKCNWEEDFKSLDLNRWNLNSGGECIKVKDGMFIDSVSQSCPGSGNGGRMRTNVRYKSGKFEVRAKMPIASGLVPAIYFASTPDNTNGNQDEFDFELIGSNRMQTNLFIYGNGGREQVWNPPTDLSKDFHLYTFEWNSNSIVLKVDNQVIRTFNNPMPQQPCYFILTNWMCVGCDGWTGPADWSRQPYDFIVDYVK

SEQ ID NO: 6380 - protein, 211 aa, Neocallimastix californiae
  Concanavalin A-like lectins/glucanases
SDDFNYDSNHLDLVWQWNHNPDNSAWSVTERPGWLRLKNKHVASEILKARNTLTMRTEGPACSSVVKLDVTNLKVGDYAGLSAFQYNYGNVGVYVADNGEKRIYMASNGNTNGDVIKDSRNNIVQETKLNGNEVYLKLDFRFSNVERDGSASWNIDKVNFYYSYDGSKWTKIGKEIGMTYDLKLFTGYRSGLFSYPTKNTGGYADFDFFKY

SEQ ID NO: 6381 - protein, 209 aa, Neocallimastix californiae
  Concanavalin A-like lectins/glucanases
ETFEKYWNYKYPWGSDHNGSARMYGTSTDHTHVYLKENTVVLFAKRINWDEGKSTSNPHPAIHYHSGAIHSKQTFTVNDQYPNYEIKGEFMVPTNSGTWPAFWLNGAKTWPPEIDIVEFKGSNVNWFNTFRTSSDVSTYKTTINNKGAWHEYRIWITKVSNTNIDIHFYIDGVWKAKHTANHVGKPFHLIMNLQMEGSSGGNGPSSNTY

SEQ ID NO: 6382 - protein, 199 aa, Neocallimastix californiae
  Concanavalin A-like lectins/glucanases
STTGNKTGRIGSVDYEIWADGGNNSADFYKDGSFSCAFNNSKDYLCRSGVNIRPAKYPSEIGKIKAEYKVVKQNAQNVGYSYVGVYGWTLESGISGVFEFYIVDNWLSQYRPGDWVGNQKKGDFTIDGAVYTVYKNVNGNLTQYFSLRREPRTCGTIDVTAHFDQWEKLGLKMGKISEIKVLGEAGNTGGGCTGRVDFP

SEQ ID NO: 6383 - protein, 211 aa, Neocallimastix californiae
  Concanavalin A-like lectins/glucanases
KVTSNKVGSIGGVGYELWADSGNNSATFYSDGSFSCTFQNAKDYLCRSGLSFDSTKTHQQIGHMYADFKLVKQNIRNVDYSYIGIYGWTRNPLVEFYVVDNWLSQYRPGDWVGNKKHGDFTIDGARYTVYENTRYGPSIDGNTNFKQYFSIRQTARDCGTIDITAHFQQWEKLGMTMGKMHEAKVLGEAGSNGAGTTGTADFPYAKVYIGS

SEQ ID NO: 6384 - protein, 134 aa, Neocallimastix californiae
  Concanavalin A-like lectins/glucanases
KVTSNKVGSINGIGYELWADSGNNSATFYSDGSFSCTFQKAKDYLCRSGLSFDSTKTHDQLGHMYADFKLVKQNIQNVDYSYVGIYGWSKDPLVEFYVVDNWLSQWRPGDWVGNKKHGDYVIDGATYTVYENER

SEQ ID NO: 6385 - protein, 121 aa, Neocallimastix californiae
  Concanavalin A-like lectins/glucanases
DPLVEFYVVDNWLSQWRPGDWVGNKKHGDYVIDGATYTVYENERYGPSIVGDTNFKQFFSIRKEARDCGTIDITAHFLQWEKLGMKLGKMYEAKVLGEAGSNSSGTTGTADFPYAKVYISN

SEQ ID NO: 6386 - protein, 204 aa, Neocallimastix californiae
  Concanavalin A-like lectins/glucanases
EINGIGYELWADSGNNSATFYEDGSFSCSFNNAKDYLCRSGLSFDSTKTHKEIGHIYADFKLVKQNIRNVDYSYVGIYGWTRNPLVEFYVVDNWLSQWRPGDWVGNKKHGDFTIDGAKYTVYENTRYGPSIDGDTNFKQFFSIRQTARDCGTIDITAHFEQWEKLGMKLGKMHEAKVLGEAGSTGSGTTGTADFPYAKVYIGGK

SEQ ID NO: 6387 - protein, 175 aa, Neocallimastix californiae
  Concanavalin A-like lectins/glucanases
MYGAPDDHNHVYLENNSVVLQACRINWDEGKSTANPHPVIHYHSGAIHSIQTFTINDQYPNYEIRGEFIAPTTGGTWPAFWLNGAWTWPPEIDILEFKGTTTNWFNTFRTSSDVSTYKEAISNPNTWHEYRLWISKVSDVNMDIHFYIDGKWRAKHTANHVGKPFHLIMNLQMEG

SEQ ID NO: 6388 - protein, 211 aa, Neocallimastix californiae
  Concanavalin A-like lectins/glucanases
ETSNKVGAIGDIGYELWSDSGDNSATFYADGSFSCSFKNAKDYLCRSGLSFDSTKTHKEIGHIYADFKLVKQDIKDVDYSYIGIYGWTREPLVEYYVVDNWLSQYRPGDWVGNKKYGDFEIDGAEYTVYENTRTGPSIDGDNVTFKQYFSIRKEARDCGTIDITAHFEKWEELDLVLGKMHEAKVLGEAGSIHDGTSGTADFPYANVYIKD

SEQ ID NO: 6389 - protein, 211 aa, Neocallimastix californiae
  Concanavalin A-like lectins/glucanases
ETSNKVGAIGDIGYELWSDSGDNSATFYADGSFSCSFKNAKDYLCRSGLSFDSTKTHKEIGHIYADFKLVKQDIQDVDYSYIGIYGWTREPLVEYYVVDNWLSQYRPGDWVGNKKYGDFEIDGAEYTVYENTRTGPSIDGDNVTFKQYFSIRKEARDCGTIDITAHFEKWEELDLVLGKMHEAKVLGEAGSIHDGTSGTADFPYAKVYIKD

SEQ ID NO: 6390 - protein, 198 aa, Neocallimastix californiae
  Concanavalin A-like lectins/glucanases
IYAKLRSDGNLIQDKSNNGLIIPISSGAKLQKDNNGNYISGALTIPHNSKIDSALEGRNSFTIEVNVVPTGVQQFNMLAGKGDRSIGFRTSTNSIDFFIYAGNEWRTVNYNMGVDSASGWVGRKHQVAGIYDAENNMLRVYADGRILGERSVGTNSGVAHSNYNLMLGACPDTGRNSQGNFYEMRVYSKALTASELAS

SEQ ID NO: 6391 - protein, 211 aa, Neocallimastix californiae
  Concanavalin A-like lectins/glucanases
KVTSNKVGNIKGIGYELWADSGNNSATFYEDGSFSCSFSRAKDYLCRSGLSFDSTKTHDQIGHIYADFKLVKQNIQNVDYSYVGIYGWTRNPLVEFYVVDNWLSQWRPGDWVGNKKHGDFVIDGATYTVYENTRYGPSIDGDTNFKQFFSIRQQARDCGTIDITAHFQQWEKLGMKLGKMHEAKVLGEAGSNGQGTSGTADFPYAKVYIGN

SEQ ID NO: 6392 - protein, 243 aa, Neocallimastix californiae
  Concanavalin A-like lectins/glucanases
RSIDEMKLVFSDEFDGDELDKSVWDVEVNCWGGGNGEKQCYVDHEENIFVKDGQLHIKAIPKGEYKLTDEEKKSCTNNNENSCGWTQSVTSGRIRTYKSGHAWKYGKVRVKAKLPAGPYLWPAIWMLPQDDVYGTWAASGEIDIMEARGQVPDAVGHAIHYGGQWPNNVFSSETASVKDVINDFHVYGLDWEENFLIFSVDEVEYFTVDLRKSFYSGKGSNPYKDIRQPFDEKFHLLLNVAVG

SEQ ID NO: 6393 - protein, 203 aa, Neocallimastix californiae
  Concanavalin A-like lectins/glucanases
RGNGNYRYEIWRDGNGGELTLYPKDACFKASWNNAGDYLGRVGLVWDNKINYKNAGGDIIANYAYKKSGSDGGTYSYIGIYGWMDNPQIEYYVVDDWLHNRGAPGGSWMGQQKGTINVDGGTYKVWSGQRTGASKWGQSTFTQIFSVRTSQRQCGQINISEHFRQWEKLGLRIGQVMEAQILAEAGGGSGYVDFTYATVEIGS

SEQ ID NO: 6394 - protein, 199 aa, Neocallimastix californiae
  Concanavalin A-like lectins/glucanases
RGNGNYRYEIWRDGNGGELTLYPKDACFKASWNNAGDYLGRVGLVWDNKINYKNAGGDIVAKYAYKKSGSDGGTYSYIGIYGWMDNPQIEYYVVDDWLHNRGAPGGSWMGQQKGTINVDGGTYKVWSGQRTGASKWGQSTFTQIFSVRTSQRQCGQINISEHFRQWEKLGLRIGQVMEAQILAEAGGGSGYVDFTYATV

SEQ ID NO: 6395 - protein, 211 aa, Neocallimastix californiae
  Concanavalin A-like lectins/glucanases
RVTSNKVGQINGIGYELWADSGNNSATFYSDGSFSCSFQNAKDYLCRSGLSFDSTKTHQQLGHMYADFKLVKQGISNVDYSYVGIYGWTRSPLVEFYVVDNWLSQWRPGDWVGNKKYGDYTIDGAKYTVYENSRYGPSIDGDTNFKQFFSIRQQARDCGTIDITAHFEQWEKLGMKMGKMHEAKVLGEAGSTGSGTSGTADFPYAKVYIGK

SEQ ID NO: 6396 - protein, 211 aa, Neocallimastix californiae
  Concanavalin A-like lectins/glucanases
ETSNKVGAIGDIGYELWSDSGDNSATFYSDGSFSCSFKNAKDYLCRSGLSFDSTKTHKEIGHIYADFKLVKQDIQDVDYSYIGIYGWTREPLVEYYVVDNWLSQYRPGDWVGNKKYGDFEIDGAEYTVYENTRTGPSIDGDNVTFKQYFSIRKEARDCGTIDITAHFKKWEELGLTLGKMHEAKVLGEAGSIHDGTSGTADFPYAKVYIKD

SEQ ID NO: 6397 - protein, 211 aa, Neocallimastix californiae
  Concanavalin A-like lectins/glucanases
ETSNKVGTIGDIGYELWSDSGDNSATFYSDGSFSCSFKNAKDYLCRSGLSFDSTKTHKEIGHIYADFKLVKQDIKDVDYSYIGIYGWTRKPLVEYYVVDNWLSQYRPGDWVGNKKFGDFEIDGAEYTVYENTRTGPSIDGDNVTFKQYFSIRKEARDCGTIDITAHFEKWEELGLTLGKMHEAKVLGEAGSIHDGTSGTADFPYAKVYIKD

SEQ ID NO: 6398 - protein, 211 aa, Neocallimastix californiae
  Concanavalin A-like lectins/glucanases
ETSNKVGTIGDIGYELWSDSGDNSATFYSDGSFSCSFKNAKDYLCRSGLSFDSTKTHKEIGHIYADFKLVKQDIKDVDYSYIGIYGWTREPLVEYYVVDNWLSQYRPGDWVGNKKYGDFEIDGAEYTVYENTRTGPSIDGDNVTFKQYFSIRKEARDCGTIDITAHFEKWEELGLTLGKMHEAKVLGEAGSIHDGTSGTADFPYAKVYIKD

SEQ ID NO: 6399 - protein, 212 aa, Neocallimastix californiae
  Concanavalin A-like lectins/glucanases
SDDFDYSSNRLSLEWQWNHNPDNTAWSVTDRPGWLRLKNKYIAPELLKARNTLTMRTEGPACSGVVKLDTSNMKVGDYAGLSAFQYNYGNVGVYVADNGERRIYMASNGGYNGNADVTNSRNNIVQEVKLNGKEIYLKTDFRFSTVKSDGSASNNIDKVNFYYSLDGNQWNKIGKEIGMTYDLKLFTGYRNALFSYPTKNTGGYADFDYFEY

SEQ ID NO: 6400 - protein, 224 aa, Neocallimastix californiae
  Concanavalin A-like lectins/glucanases
NTKAYWETILSDSLTDYQTFEKYWDYLYPWGSDHNGSARMYGASDDHNHVYLENNTVVLKASRINWDEGKSTANPHPVIHYHSGAIHSKQTFTINDQYPNYEIRGEFQAPTNGGTWPAFWLNGAWTWPPEIDILEFKGTTTNWFNTFRTSSDVSTYKEAISNPSGWHEYRLWITKVSNTDMDIHFYIDNKWKAKHTANHVGKPFHLIMNLQMEGSASGSAPNGD

SEQ ID NO: 6401 - protein, 193 aa, Neocallimastix californiae
  Concanavalin A-like lectins/glucanases
SSGYHYEIWYQGGNNSMTYYDNGTFKASWGGTNDFLARVGLKYNEDKTHQQLGQIDAYFKWTKSGSAGGYNYIGIYGWTVDPLVEYYIVDDWYNKPGSYLGQKKGEFTVDGDTYEIFQNTRVNQPSIKGTSTFPQFFSVRRSARSCGHIDISAHFKKWESLGMKLGKMYEAKVLVEAGGGSGSFDVTYFKMTD

SEQ ID NO: 6402 - protein, 178 aa, Neocallimastix californiae
  Concanavalin A-like lectins/glucanases
WEEDFKSLDLNRWNLNSGGECIKVQNGMFIDSVSQSCPGSGNGGRMRTNVRYKSGKFEVRAKMPIASGLVPAIYFASTPDNTNGDQDEFDFELIGSNRMQTNLFIHGNGGREQIWNPPTDLSKDFHLYTFEWSSNAIVLKVDNEVIRTFNNPMPDQPSYFILTNWMCIGCDGWTGPAD

SEQ ID NO: 6403 - protein, 211 aa, Neocallimastix californiae
  Concanavalin A-like lectins/glucanases
KITNNNVGQIGDVGYELWSDSGYNSATFYSDGSFSCSFSNAKDYLCRSGLSFDSTQTHDQIGHMYADFKLVKQNIRNVDYSYIGVYGWSRDPLVEYYVVDNWLSQYRPGDWVGNKKHGDFTIDGAKYTVYENTRYGPSIDGDTQFKQYFSIRQQARDCGTIDITAHFQQWEKLGMKLGKMHEAKVLGEAGSNGSGTSGTADFPYAKVYIGS

SEQ ID NO: 6404 - protein, 190 aa, Neocallimastix californiae
  Concanavalin A-like lectins/glucanases
QETSNKVGQIGDVGYELWSDSGYNSATFYSDGSFSCSFNNAKDYLCRSGLSFDSTKTHDQIGHMYADFKLVKQNIRNVDYSYVGVYGWTRNPLVEYYIVDNWLSQYRPGDWVGNKKHGDFTIDGAQYTVYENTRYGPSIDGDTQFKQYFSIRQQARDCGTIDITAHFQQWEKLGMKLGKMHEAKVLGEAG

SEQ ID NO: 6405 - protein, 198 aa, Neocallimastix californiae
  Concanavalin A-like lectins/glucanases
TYVAQMRSDGAVVQDKSSNGLIIPISNGAKLGHNNDGNYISGALTIPHNSKLDSALQGRNSFTIEVNVVPTGVQSFNMLAGKGDYSLGFRTTTGALDFFVYAGNEWRMVSYTMGVDANSGWIGKKHQVAGIFDAGSNMLRLYVDGKMVAEKSVGTTAGVSSSNYNLMLGACPDTGRNSQGNFYEMRVYSKALSASELS

SEQ ID NO: 6406 - protein, 199 aa, Neocallimastix californiae
  Concanavalin A-like lectins/glucanases
RLGKIGSVDYEVWADGGNNSAVFYSDGSFSCSFSNTKDYLCRTGVSFSQAKYPSEIGHIKAEYKVVKQNAQNVGYSYVGVYGWTLNSGISGVFEFYIVDNWLSPGRPGDWVGNEKKGDFTIDGGKYTVYKNVNGNLTQYFSLRTSPRTCGTIDVTAHFEQWEKIGLKMGKITEVKVLGEAGNVGGGCSGTVDFPYAKIY

SEQ ID NO: 6407 - protein, 175 aa, Neocallimastix californiae
  Concanavalin A-like lectins/glucanases
WLRLKNKYVVSELLRARNTLTMRTEGPACTSIVKMDTSKMKVGDYAGLSAFQFKYGNVGVYVADNGEKRVYMATNGGNEINNSRNYIEQETRMSGNEIYLKLEFRFNNVGNDGSASNNIDRVNFYYSYDGDKWTKIGKELGMTYDLTLFTGYRSALYSYPTKSTGGYVDFDYIKY

SEQ ID NO: 6408 - protein, 48 aa, Neocallimastix californiae
  Concanavalin A-like lectins/glucanases
TEYSNKVGNIGNVGYELWADSGNNSATFYSDGSFSCTFQNAKDYLCRS

SEQ ID NO: 6409 - protein, 193 aa, Anaeromyces robustus; identical to SEQ ID NO: 6401
  Concanavalin A-like lectins/glucanases

SEQ ID NO: 6410 - protein, 211 aa, Anaeromyces robustus
  Concanavalin A-like lectins/glucanases
KVTSNKVGSIGGIGYELWADSGSNSATFYSDGSFSCSFSRAKDYLCRSGLSFDSTKTHQQIGHIYADFKLVKQNIQSVDYSYVGIYGWTRNPLVEFYVVDNWLSQYRPGDWVGNKKHGDFTIDGAKYTVYENTRYGPSIDGDTQFKQFFSIRQQARDCGTIDITAHFEQWEKLGMKLGKMHEAKVLGEAGSNGGGTSGTADFPYAKVYIGQ

SEQ ID NO: 6411 - protein, 199 aa, Anaeromyces robustus; identical to SEQ ID NO: 6406
  Concanavalin A-like lectins/glucanases

SEQ ID NO: 6412 - protein, 209 aa, Anaeromyces robustus
  Concanavalin A-like lectins/glucanases
SDDFNYSSNDELDLVWQWNHNPDNSAWSVTEREGWLRLKNKYVVSELLRARNTLTMRTEGPACTSIVKMDTSKMKVGDYAGLSAFQFKYGNVGVYVADNGEKRVYMATNGGNEINNSRNYIEQETRMSGNEIYLKLEFRFNNVGNDGSASNNIDRVNFYYSYDGDKWTKIGKELGMTYDLTLFTGYRSALYSYPTKSTGGYVDFDYIKY

SEQ ID NO: 6413 - protein, 210 aa, Anaeromyces robustus
  Concanavalin A-like lectins/glucanases
TVTSNKVGKIGDIGYELWADSGNNSATFYADGSFSCSFRQAKDYLCRSGLSFDSTQTHQQIGHMYADFKLVKQNIQSVDYSYVGIYGWTRNPLVEFYVVDNWLSQWRPGDWVGNKKHGDFTIDGAKYTVYENTRYGPSIDGDTNFKQYFSIRQQPRDCGTIDITAHFQQWEKLGMTMGKMHEAKVLGEAGSTGGGTSGTADFPYAKVYIK

SEQ ID NO: 6414 - protein, 204 aa, Anaeromyces robustus
  Concanavalin A-like lectins/glucanases
SSPSPVGDKCNWTEDFNSLDETRWNLNSGAECMKVQGGMFIDSVSQSCRGSGNGGRMRTNVRYKSGKFEVRAKMPIASGLVPAIYFASTPDNTNGSQDEWDFELIGSNRMQTNLFINGQGGREEVWNPPYDLSRDFHTYTFEWTSNSIVLKVDNQVVRTFNNPMPTQPSYFILTNWMCVGCDGWTGPADWSRQPYDFIVDYVKI

SEQ ID NO: 6415 - protein, 210 aa, Anaeromyces robustus
  Concanavalin A-like lectins/glucanases
CNSNRVGSIGGVGYELWSDSGSNSATFYSDGSFSCSFRSAKDYLCRSGLSFDSTKTHQQIGHIYADFKLVKQNIQNVDYSYVGIYGWTRNPLVEFYVVDNWLSQYRPGDWVGNKKHGDFTIDGAKYTVYENTRYGPSIDGNTNFKQYFSIRQQARDCGTIDITAHFEQWEKLGMTMGKMHEAKVLGEAGSNGGGTSGTADFPYAKVYIGN

SEQ ID NO: 6416 - protein, 210 aa, Anaeromyces robustus
  Concanavalin A-like lectins/glucanases
TCNSNKVGSIGSVGYELWSDSGNNSATFYSDGSFSCSFRSAKDYLCRSGLSFDSTKTHQQIGHIYADFKLVKQNIQNVDYSYVGIYGWTRNPLVEFYVVDNWLSQYRPGDWVGNKKHGEFTIDGAKYTVYENTRYGPSIDGDTSFKQYFSIRQQARDCGTIDITAHFEQWEKLGMTMGKMHEAKVLGEAGSNGGGTSGTADFPYAKVYIG

SEQ ID NO: 6417 - protein, 221 aa, Anaeromyces robustus
  Concanavalin A-like lectins/glucanases
FAEWETVISDSLSDYQTFEKYWNYLYPWGSDHNGSARMYGAPDDHNHVYLKDNTVVILATRINWDEGKSTANPHPEIHYHSGAIHSKETFTINDQFPNYEIRGEFMVPTTRGTWPAFWLNGAWTWPPEIDIVEFKGDNVNWFNTFRTSSDVSTYKQGISNPGAWHEYRVWITKVSNTDMDIHFYIDGQWKAKHTANHVGKPFHLIMNLQMEGSSGNNGPTS

SEQ ID NO: 6418 - protein, 61 aa, Anaeromyces robustus
  Concanavalin A-like lectins/glucanases
PSIPSMDDYKLVFSDEFEGNKLDRSVWDVEVNCWGGGNGEKQCYVDHDENIFVKNGQLHIK

SEQ ID NO: 6419 - protein, 277 aa, Anaeromyces robustus
  Concanavalin A-like lectins/glucanases
RSVDEMKLVFSDEFEGNELDRSVWDVEVNCWGGGNGEKQCYVDHDENIFVKNGQLHIKAVPKGQYKLTDQEMKTCTNNNENSCGWTQSTTSGRIRTYKSGNAWKYGKIRVKAKLPAGPYLWPAIWMLPQDDVYGTWAASGEIDIMEARGQVPDAVGHAIHFGGQWPDNDFMSETASIKNVINDFHVYGLDWEENFLIFTVDEKPYYTVDLRKSFWSGKGTNPYKKIRQPFDEKFHLLLNVAVGGNYFNGIGEFDYGRDTPQWTRPEMIIDYVRVYQL

SEQ ID NO: 6420 - protein, 280 aa, Anaeromyces robustus
  Concanavalin A-like lectins/glucanases
PSIPSMDDYKLVFSDEFEGNKLDRSVWDVEVNCWGGGNGEKQCYVDHDENIFVKNGQLHIKAVPKGQYKLTDQEMKTCTNNNEDSCGWTQSTTSGRIRTYKSGNAWKYGKIRVKAKLPAGPYLWPAIWMLPQDDVYGTWAASGEIDIMEARGQVSNAIGNAIHFGGQWPNNDFVDKTYNLSNIINDFHVYGLDWEEDYLLFSVDEEVTFFVDLRRSFWSGKGNNPYKKIRQPFDEKFHLLLNVAVGGNYFNGIGEFDYGRDTPQWTRPEMIVDYVRVYQL

SEQ ID NO: 6421 - protein, 209 aa, Anaeromyces robustus
  Concanavalin A-like lectins/glucanases
KETGNKVGSIGGVGYELWFEGGNNSATFYSDGSFSCSFQGSKDYLCRTGLSFNSDKTYQQIGHMFADFKLVKQGISNVDYSYVGIYGWTRNPLVEFYIVDNWLSPSRPGDWVGNRKHGDFTIDGAKYTVYENTRNGPSIDGNTNFKQYFSIRQQARDCGTIDINAHFEQWEKLGMQMGKMHEAKILGEAGSNGGGTSGTADFPYAKVYI

SEQ ID NO: 6422 - protein, 211 aa, Anaeromyces robustus
  Concanavalin A-like lectins/glucanases
ETSNKVGNIGGVGYELWADSGNNSATFYSDGSFSCTFQNAKDYLCRSGLSFDSTQTHDQIGHIYADFKLVKQNINNVDYSYVGIYGWTRNPLVEFYVVDNWLSQYRPGDWVGNKKHGDFTIDGAQYTVYENTRYGPSIDGDTQFKQYFSIRQQARDCGTIDITAHFQQWEKLGMTLGKMHEAKVLGEAGSNGSGTSGTADFPYAKVYIGNK

SEQ ID NO: 6423 - protein, 210 aa, Anaeromyces robustus
  Concanavalin A-like lectins/glucanases
ETSNKVGNIGGVGYELWADSGNNSATFYSDGSFSCTFQNAKDYLCRSGLSFDSTQTHDQIGHIYADFKLVKQNINNVDYSYVGIYGWTRNPLVEFYVVDNWLSQYRPGDWVGNKKHGDFTIDGAQYTVYENTRYGPSIDGDTQFKQYFSIRQQARDCGTIDITAHFQQWEKLGMTLGKMHEAKVLGEAGSNGAGTSGTADFPYAKVYIGK

SEQ ID NO: 6424 - protein, 200 aa, Anaeromyces robustus
  Concanavalin A-like lectins/glucanases
GVGYELWADSGNNSATFYSDGSFSCTFQSAKDYLCRSGLSFDSTQTHDQIGHIYADFKLVKQNINNVDYSYVGIYGWTRNPLVEFYVVDNWLSQYRPGDWVGNKKHGDFTIDGAQYTVYENTRYGPSIDGDTQFKQYFSIRQQARDCGTIDITAHFQQWEKLGMTLGKMHEAKVLGEAGSNGAGTSGTADFPYAKVYIGK

SEQ ID NO: 6425 - protein, 199 aa, Piromyces finnis
  Concanavalin A-like lectins/glucanases
TLSAKIRSDGAVIQDKSSNGLTIPISGGAKLGHSNDGNYISGALTIPHNSRIDSALEGKNSFTIEINVVPSGVQQFNMFAGKGDHSFGFRTTTSSLDFFIFAGGEWRSLYHDMGVDSSSGWVGKKHQVAGIYDAENNMLRLYADGKMVRETKINTNSGVEHSSYNLMLGACPETGRNSQAKFYEMRVYNKALTASELAS

SEQ ID NO: 6426 - protein, 122 aa, Piromyces finnis
  Concanavalin A-like lectins/glucanases
TGDKCNWEEDFKSLDLNRWNLNSGGECIKVKDGMFYDSVSQSCPGSGNGGRMRTNVRYKSGKFEVRAKMPIASGLVPAIYFASTPDNTNGSQDEFDFELIGSNRMQTNLFIYGNGGREQVWN

SEQ ID NO: 6427 - protein, 207 aa, Piromyces finnis
  Concanavalin A-like lectins/glucanases
FHQYWNYKYPWGSDHNGSARMYGSAEDHNHVYLKDNTVVLLATRINWDEGKSTANPHPAIHYHSGAIHSKQTFTINDQFPNYEIRGEFMAPTNGGTWPAFWLNGAWTWPPEIDIVEFKGNNVNWFNTFRTSSDVSTYKESVSNAGAWHEYRVWITKVDNTNMDIHFYIDGKWKAKHTANHVGKPFHLIMNLQMEGSSGGNGPTSDTY

SEQ ID NO: 6428 - protein, 223 aa, Piromyces finnis
  Concanavalin A-like lectins/glucanases
SAVWETVISDSLTDYNTFEKYWDYLYPWGSDHNGSARMYGASDDHNHVYLKDNTIVLKACRINWDEGKSTANPHPVIRYHSGAIHSKQTFTINDEFPNYEFKGEFIVPTNGGTWPAFWLNGAWTWPPEIDIVEFKGNNVNWFNTFRTSSDVSTYKESVSNAGAWHEYRVWITKVDNTNMDIHFYIDGKWKAKHTANHVGKPFHLIMNLQMEGSSGGNGPTSDT

SEQ ID NO: 6429 - protein, 62 aa, Piromyces finnis
  Concanavalin A-like lectins/glucanases
SIRKEARDCGTIDITAHFQQWEKLGMKLGKMHEAKVLGEAGSNGSGTTGTADFPYAKVFIGS

SEQ ID NO: 6430 - protein, 211 aa, Piromyces finnis
  Concanavalin A-like lectins/glucanases
EYSNKVGSISGIGYELWADSGNNSATFYSDGSFSCSFQNAKDYLCRSGLSFDSTKTHDQIGHMYADFKLVKQNIQNVDYSYVGIYGWTRSPLVEFYVVDNWLSQWRPGDWVGNKKHGDFVIDGATYTVYENTRYGPSIDGDTQFKQYFSIRQQARDCGTIDITAHFQQWAKLGMNLGKMHEAKVLGEAGSTGSGTSGTADFPYAKVYIGDG

SEQ ID NO: 6431 - protein, 210 aa, Piromyces finnis
  Concanavalin A-like lectins/glucanases
RSNKVGSIGGIGYELWADSGNNSATFYSDGSFSCSFQNAKDYLCRSGLSFDSTKTHDQIGHMYADFKLVKQNIQNVDYSYVGIYGWTRSPLVEFYVVDNWLSQWRPGDWVGNKKHGDFVIDGATYTVYENTRYGPSIDGDTQFKQYFSIRQQARDCGTIDITAHFQQWEKLGMKLGKMHEAKVLGEAGSTGSGTSGTADFPYAKVYIGDG

SEQ ID NO: 6432 - protein, 212 aa, Piromyces finnis
  Concanavalin A-like lectins/glucanases
KVTSNKVGSIGGIGYELWADSGNNSATFYSDGSFSCSFQNAKDYLCRSGLSFDSTKTHDQIGHMYADFKLVKQNIQNVDYSYVGIYGWTRSPLVEFYVVDNWLSQWRPGDWVGNKKHGDFVIDGATYTVYENTRYGPSIDGDTQFKQYFSIRQQARDCGTIDITAHFQQWEKLGMKLGKMHEAKVLGEAGSTGSGTSGTADFPYAKVYIGDG

SEQ ID NO: 6433 - protein, 175 aa, Piromyces finnis
  Concanavalin A-like lectins/glucanases
FSNAKDYLCRTGLSFDSTKTHDQLGHMYADFKLVKQNIRNVDYSYVGIYGWTRNPLVEFYVVDNWLSQWRPGDWVGNKKHGDFTIDGAQYTVYENTRYGPSIDGDTQFKQYFSIRQQARDCGTIDITAHFQQWEKLGMKLGKMHEAKVLGEAGSTGSGTSGTADFPYAKVYIGDG

SEQ ID NO: 6434 - protein, 285 aa, Anaeromyces robustus
  Condensation
KEFPVTTQQLGVYVDTIKNPDAIVYNTPLIFKLTKNIDINKIKEAFNKLFKNQEILRSKYYEKEINGKTEIYGFIDDECLLLFEEYTYENAKTFVRPFELSKAPLIRVGFIKNEILLIDMHHIISDGSTMLIIKKELNNYYNNNEIKELEIQFSDYAIDLNENKNNEYYNKQIEFYKEMFSCEYEKLNIPIRNNNLLSPEERNKNDMKCNICVNIIDEFTSEKINEYVKNNKISKTAFFLSIYGYILSKYSRQDIIYSSVMSTNRNNNYIQDMIGMFVSTQPILL

SEQ ID NO: 6435 - protein, 284 aa, Anaeromyces robustus
  Condensation
SKEFPITSQQLGVYIDSIKNPDSIMYNIPSVFKLKKDIDINKIKMALNKIFKCQEILRSKYYEKEVNGKTEIFGYIDDECLLLFEEYTYENAKSFIRPFKLSEAPLIRIGFIKNEILLIDMHHIISDGSSMLIIKNELNSYFYNNEIIQELEIQFSDYSIYMNEKKSEEYYDKEIEFYKKMFSCEYELLSIPMKGKILDENKTIESSSKNCYKSIDKSTTSLINEYIKKHGISKAAFFITIYGYVLSKYSGQNIVYSSIVNANRNNHYTENMIGMFVSTQPILL

SEQ ID NO: 6436 - protein, 71 aa, Anaeromyces robustus
  Condensation
EKIIDSSLSKRINEYIRVNRISKTAFFISIYGYILSKYSGQDNIYTSMMSANRNNHYVENMIGMFVSTQPI

SEQ ID NO: 6437 - protein, 286 aa, Neocallimastix californiae
  CotH
GVSSQYYKRQAFNIKIGKKQLLYGRKQFRIRSDAREPTMIRSKLFCDVMGRLGLKNAMSANYIKLSINGEDLGFYVIMDSLKLSYVEIEYGDVNSTNLLQCKDLNAFLTSSSGTTCLSENEDNPDTSAFKQFLSQLDSANSVSQMAQYFDYENFLRVTILEWLTGSWDHYTLFGHNYNVYKIPNGKWEVSLYDFDATWGQDLGLGLMLGGPRSISANNVSTWPNAKYEEWIQTQKQHPLSVIMQDKNLFLKNLQDILDTAFNPAILYERIDELKEFITPYVRETKS

SEQ ID NO: 6438 - protein, 278 aa, Neocallimastix californiae
  CotH
IRIKGASTRNSQMKSFNVYARKSYGESKFKYAIVEDNKSVIDDKLIKKYDSFSIRHCNWFDRMRESIVQRGLKESPVLATLDNSKCLLFLDGEFWGLYDIAEKSSDLYIENNYGIPKENVALIKNYELEEGTEDDLKDFTNLVKYCEKNDLTDEANYNYVADHLDLESIIYSYATGLYLGSWDWPNRNYLVYRNKGEPIEGNEYGDGKWRFGSFDFDYSAGITYDDFGGVPGYAHDSFTKFQSSKNYYPTSMFSNLIKNPKFYKRFAEVMHLMEDEIF

SEQ ID NO: 6439 - protein, 286 aa, Neocallimastix californiae
  CotH
IRIKGASTRNSQMKSFNVYARKSYGESKFKYAIVEDNKSVIDDKLIKKYDSFSIRHCNWFDRMRESIVQRGLKESPVLATLDNSKCLLFLDGEFWGLYDIAEKSSDLYIENNYGIPKENVALIKNYELEEGTEDDLKDFTNLVKYCEKNDLTDEANYNYVADHLDLESIIYSYATGLYLGSWDWPNRNYLVYRNKGEPIEGNEYGDGKWRFGSFDFDYSAGITYDDFGGVPGYAHDSFTKFQSSKNYYPTSMFSNLIKNPKFYKRFAEVMHLMEDEIFSFEKMEKI

SEQ ID NO: 6440 - protein, 288 aa, Neocallimastix californiae
  CotH
GNSGRGYGKLGYNVKIRNDKDDLFGARQFRLRGEARDPSVIRNKIGSDIYNKMGIPTSFAGFVRLYVNNEFFGLYSIHDSIKQKWIEREFGEADTKHLYKCGLVNQFLSYIPELDNCENDDDSVTDRTEWTDLLKAIDAAQTREDLEKFLDVDLFIKNMVAEWLVGSWDRFNLVGHNYYMYKNPQTGKWMFIPYDYDSDLGSDMYGGLFYNKKLFAYVYDWPFFTYDDYAAHRHITDVLVRADNSTFNKYAMEYVRDVFNPVVLFDHIDEVKNLINADVLADKTEDPV

SEQ ID NO: 6441 - protein, 119 aa, Neocallimastix californiae
  CotH
FNLVGHNYYMYKNPQTGKWMFIPYDYDSDLGSDMYGGLFYNKKLFAYVYDWPFFTYDDYAAHRHITDVLVRADNSTFNKYAMEYVRDVFNPVVLFDHIDEVKNLINADVLADKTEDPVT

SEQ ID NO: 6442 - protein, 342 aa, Neocallimastix californiae
  CotH
IRIKGASTRNSNMKSFNIYARKEYGKSKFKYEVIEDNKSVIDGKPITKYDSFSLRHSNWLDRMRESVVQRGLKDFPILATLDNSKCLVFLDGEFWGLYDLIEKPSDFYIKSNYDIPTENVALIKNDILEEGTEEDLNDLTSLVEFCAKNDLRDEANYNYVAEKVDVESLIYSYASGLYLGIWDWPNRNYLVYRNKGEPIEGNDYGDGKWKYGAFDFDYSAGITFASFGGVPGYAHDSFKKFQSAKDIFPTPIFDGMIKNPKFYKRFGEVMHLMEEEIFNPEKMKKIVEEQKSKYLDYIVKNDWRWHNGTPKKSWEAFREAQNKYYSDGWDVITEFFERRPQY

SEQ ID NO: 6443 - protein, 315 aa, Neocallimastix californiae
  CotH
GKSTATFSKPGYNIKIKGTNSTLHGTKNFRLRSDQRDVSMMRSKITTDILQKSGLIATEVGYTELYVNNEYMGFWVVSDSVKNKWIKRKFGDDGKEIKTLYECNGDVIRFDDGSAKTKCVNANEDYIDYMEPFINFVDQVNASTTREELEEIMDVDNFIKYMAWEWLMGSFDHFLSYYGHNLYWYQQPNGKWVYIPYDHDIELGQDEYIGFYPNRTFNHHGDIDFANLSFKDFELDHPIIQVLVHDDDTTFRELLGDIISKVFNPDTLLIHINKIRDIIAPYVKKDRDTGAGKINKLGKDSRFNYEHFLLNTEYT

SEQ ID NO: 6444 - protein, 284 aa, Neocallimastix californiae
  CotH
GSSSRTYSRQAFNLKIRGKNDLYGRKQFRIRSDAREATYLRSKLACDMHNRLGIPSIAANYISLYVNEEYWGFYVLMDSPKPSWAELEYGDKDTTHIYKCKSGGINLQYSNSATQCENENEDVTDHSDWTSFLSTLDRTNSIREAESFFDVDQFLYEMAYEYLSGSWDHFLNTGHNFAMYKMPQSYGGKWTMIEYDFDADFGQDVCAIEFAGSIKNDKDYPSWSFDDWSTKKNHVLDTFIKKDRTRFNQIMKRFVEEAFNPDLLFPRIDELKDFIRSYVKKDKT

SEQ ID NO: 6445 - protein, 128 aa, Neocallimastix californiae
  CotH
VKVRGNWTSNYVKKSLKINFSESQSMLGLNGGKKFKSWILLAEYKDGSMLRNKSTFAISREILGKDGLYASDSRLVELKINDEYFGVYLLCEVQQINKGRVDITKVDDDYQGTDMGYLLEYDAGYAMY

SEQ ID NO: 6446 - protein, 204 aa, Neocallimastix californiae
  CotH
NKKTLKFNNNYSQVVEASGLSTRQAIENVIDANSLADMFIISEIACDADLYYSSFYLDVDFGADGSKKLRFEAPWDFDSGLGNKDRCADGKGHFAANIIPDNGGFGNTINAWLAVIIYEDWFQDIIRNKWTKAYESGIFKNVANSIRSESSSYAEAFDRNYAKWNNIIENSQFANELSPGAKKCKTQKEAANYLADWLEKRVAF

SEQ ID NO: 6447 - protein, 339 aa, Neocallimastix californiae
  CotH
IGGRSTKFFAKLGYNINIKNGLLYGAKDLRLRPVVVDPSFLRDKLAYDLHNKIELPCISANYARLYINDTFMGLYLLRDAYKAQWVENTFGEKSTKHLYTCSNDYKDKGNDFFKCVNDDEDITDDEDMKIFLKKLENSKDRKDLEEFFDVKSFIRLQAARYLFGSFDHVTGENNNMLYMYHDVSSGRDLWIPLIYDFDMNFGNFRKPSTNRTFDEEIFEKKNPLYTMLNLNNNSEELISIMDEIMRTSFNPNILLPRIDQLRTFIEPYVKEDRTPGENGLFPGRFNIGVGRAHDSFTYEDFLTNTEFTTIKARRYINDFTDKYEEDTCLGLKQWVIERF

SEQ ID NO: 6448 - protein, 284 aa, Neocallimastix californiae
  CotH
GSSSRSYARQAFNLKIRGKNDLYGRKQFRIRSDAREATYLRSKLACDIHNRLGIPSIAANYISLYVNNEYWGFYVLMDAPKPTWAEIEYGDKDTTHIYKCKAGGINLQSSTSATQCENENEDVTDHSDWTNFLSSLDRANSMREAESFFDVDQFLYEMAYEYLTGSWDHFLNTGHNFAMYKMPQNYGGKWTMIEYDYDADFGQDVCAIEFAGSIKSDKDYPSWSFDDWSTKKSHVLDICIKNDRSRFNQIMKKFVEEAFNPEILFPRIDELKDFIRPYVQKDKT

SEQ ID NO: 6449 - protein, 342 aa, Neocallimastix californiae
  CotH
IRIKGASTRNSHMKSFNIYARKEYGKGKFSYPLIENNVNVVDGTPIEKYDSFSIRSNGWFDRMREAVVSRGVKDIPIVASFDTTKCVLFLDGEFWGTYEIVEKPSDYYFKTNYGIPSENLALLKDGKLEEGTEQDLQEFNSLVDFSKNNDLRNENNYNYIASKIDIESLLHHYAVNLYLGTWDWPNKNYLMYRNKGSPINGNPYSDGKWRYGVFDFDYTTGLTYADFGGVPGYAYDSFKKYETMNHMYPAPIFTSLIKNPKVYNRFSEIMHTMGDEVFNPNKMRKIIEEQKSKYLDYIVKTDWRWFSGTPTMSFETFRNGQNQYFSGGWNDMIEFFNNRPQY

SEQ ID NO: 6450 - protein, 336 aa, Neocallimastix californiae
  CotH
GMYARQNDKVSFNIKLEKKFLGRKNIRLRPDANDKSHLRSKLCCDIANRMGVPSIQAVYARLYMNDEYWGLYVLMDAIKPSWIKQTFNPSEKEITTLFQCKNGGMNLKQNSANKCVNANDDYQEMSVLQNFVKEINQCKTADEVENIMDVDIFLKFMAMEWLIGSFDHFLVYGHNFYFYKRETDGKWLIIEHDYDNTFGTGVKASLWASKGPNQDGSSNNDNNNNNRSQEGGPQAGGPQAGRGGNFGNFGNFGNFGNFGNFGGNNSYRGNNPIEYTFADWEMNIPIINVLVHKNKEKFTSIVREVLVSAFNPTLLDNHISELKEFLTPYVEEDSTP

SEQ ID NO: 6451 - protein, 332 aa, Neocallimastix californiae
  CotH
GSSSRALSKQGFNIKIRGNNNLYGRTQIRLRPDFREPTLLRTKLACDIQNRMGVPSISANFAKLYINDQFMGFYVLIDAFKLSWVESVYGEKDSTSLIQCKYMDNNLTYKYSIGGCSNENEDVTDNTEWANLLTAFDNAQTPEDLEDFFDIDLFLKNIAYEFLAGSWDHFLSYGHNFYLFKPKDGKWQFLLYDFDTEFGIDCSQGIGEPGTITTDFNFSEYTLDQWHKPRHLIDVLIGQNSTRFDNILRQQVKEVFNPEVVFPHIDELKKFIKPYIIEDYTPDENGKYPGRINERASNPYNLTHWDANIEFTTVKSAYHNAAYGLKMWFLRR

SEQ ID NO: 6452 - protein, 335 aa, Neocallimastix californiae
  CotH
GKYTKSFEKLGYNIKVKKGELFERKQLRLRSESVDPSFLREKIAYDICNLVELPSLSSNFADVYFNDRYMGLFAMRDAFKSQWIEYTYGEKSTKHLYTCDITYGSNEFFNCINDDEKLVDSDTEFKKFQDRLAKAKTREDLEEFFDVETFMKWQVIKYLFGSWDHETNAHNQCLYMFHDTTSGNDKWIPLLYDFDSEFGAYMDSNPRRTFSKEIFDSTNPLFTILNLKDDNKELIGYIDEFMRKAFNPKKLIPRIDQLKQFIDSYVKKDRTPDAEGNLPGRVKRVNIKIEDYFTYEDFLNNSEFTDIKLRKYSSDTSYREDRIVGLKRWMIERFK

SEQ ID NO: 6453 - protein, 256 aa, Neocallimastix californiae
  CotH
TTTFYSKLSYDVTINDGNLEGNNYIQFRAENGDPSLLREKVVYDILNAAQIPSLSANFVQLYFNDHYMGLYTMRDFLNSDWLENYFGAKNSKNLFFCDPDYTSCKNALQSSSDNVKRFQEKINNATTREELEKFFDVETYMKWQALKYLLGYTVIYSNVKNDYLYMHSYNNKEMWVPIPVQFDYFLGGSGDAKKTFNKDIKSKNNLFKVLDISESNPEIIKYMEEFMKTVFNPVILIPHIDELKESIDDAVKLDRT

SEQ ID NO: 6454 - protein, 166 aa, Neocallimastix californiae
  CotH
ELYKFLLKMTKAKSAADVESIFDIEQFYKEIAIELITSSWDQFYSGHNYYIYKNPKNNKWTYLIHDFDLTLGTGDIYYKRFISEDFIYFMENEILNMLISSNMDRFIEIIKEIVTNVFNPATLFPRIDEIKSFIRPYLQLDKTPNEDGQYPGRINNNDNTFYTMEE

SEQ ID NO: 6455 - protein, 312 aa, Neocallimastix californiae
  CotH
GKGSRNFVKPNYNIKLSKGKLFDLKLLRLRSNIRDATLMREKLSSDLLYKMGIKATSTNYAKVEVNGEYLGLYILTNKVKKDFMKKYFNDEELTTLYECKDDRIRFEDNTVAEKCINVNEDLVDYKDEIKSLNDAVNNAKTIDDIKDIIDVDAVLRSFAFEFVTISWDHFFLQGHNFFWYKKPEDGKWMIILNDFDETFAQDIYPNYYTDESRYVEKNYIPDIETINLPNLSVRDMDTGHKLVKLLILDDDTRWREILGEVVKTAFNPDVLYPRIDEIADLIHDEIAVSRGIVEETGKAHGCFNILGQDPGW

SEQ ID NO: 6456 - protein, 354 aa, Neocallimastix californiae
  CotH
GKFTRNFAKPGYNLKIENGDLFEVKSLRLRSGYRDNSLMREKLSSDMFYKMGVPTTSTNYIRVEVNGENLGLYIATNKIKKDFIKRYYGEKNTNNLYECRIDRTRFEDFSVAEKCDNIKEELVDKRDDIRKFNEAINNAKSIDDIKDIIDVETFLKTICFEFLTLAWDHFLVYNHNYFWYKKPDGKWTIILNDFDETWAQDLWTTIYRGEGLSEEQTYVDKSYIPDADGLPWANFPNFSIRDCDMGHKIIKLLIYDNEEQWREIVGEVVKNYFNPTILFKRIEEIKELIYDDVVINRTINPETGKFIGCFNTEGFDPKWNMTHFEEGINYVNWANNPDQARSYGLKFFIEERFK

SEQ ID NO: 6457 - protein, 310 aa, Neocallimastix californiae
  CotH
GSSSRIYGRQGFNLKIRGNKDLYGRSQFRIRSDAREATYLRSKLSCDIHNRLGLTSISANYITLYINEEYLGMYILMDAPKLPWIEQVYGEADTPNLYKCKDGSNYLSVMSSAELCYNENEDVTDRSEWVEFLTALDNAQSAEDIEDIFEVDQFLYEIALEYLTGSWDHFLSTGHNFSMYKQKSNGKWTIIYYDFDADFGQDVDNIEFGLTETDPNKDFPNYSFGEWDSKRQRIIEILIFKDPTRFLNILRKIVTEVFNPATLFAHIDELKEFIKPHVIKDKTADEIINRPGVLNKKGSDYSIEQWDANS

SEQ ID NO: 6458 - protein, 337 aa, Neocallimastix californiae
  CotH
GKYTKAFEKLGFNIKIKKGVFLERKNLRLRTEAVDPSFLREKLAYDLCNIIGLPTLSLNYARVFFNDKYMGLYALRDAFKSQWIEYTFGEKNTKHLYTCDREYKTKETEDLYNCINDDENIKDDPDWKHFIDRLKSVKNKADLEEFFDVETYIKWQVIKYLFGSWDHETSAHNQVVYMYHDTSNEKDKWIPMLYDFDSDFGAYRVPKPRRSFSQETKEASSPFYKLLQLNDENEVLISYIDEFMRKAFNPKDLIPRIDQLKEFLSPYIKEDRTPDENGRLPGRQERVNIKIEDYFTFDDFNDNSEFTTIRLNKYTSDTTYGTDNIMGLKQWIIERFQ

SEQ ID NO: 6459 - protein, 328 aa, Neocallimastix californiae
  CotH
GKYTKIFEKQQYNIKINNGDLFGRQQLRLRSEVVDPSFLRSKIGYDLCNILGLPSLQASYTLVYINDDNMGLYLLRDAYKPQWVEANYGIANTTSLYKCDKSYGSSDYFNCQNDETEVVDEDFTNFINKMEKAKDTRELSKFFDTDLYIKWQAFKYLTGSWDHITNYHNQYLFNNNGKWINLLYDFDSDFGAYRAPNPSLSFVSESVEMDYPLYKTLGLSNTHKELVNNIKKFVINGFNPVKLFPRIDELMKYLYPYILEDRTPEKETTERPGHFVRPDYKIENGFTVTDHVKNAEFHNYVLKKYSNNKSYSTDEIYGLKRWIIERFR

SEQ ID NO: 6460 - protein, 352 aa, Neocallimastix californiae
  CotH
GKITRNFAKPGYNIKINDGNIFDVKLLRLRSGIRDVSFMREKICSDIVYKMGLLSTSTNYVNVEVNGENLGIFILTNKIKKDFIKRHFGEKSTNNLYECKKDFSRFEDNSIVTNCENAKEELINDKDDLQKFVDAVNNAKSVDDLRQFLDVDTFIRTLAFEFVTLSWDHFMGLSHNYFWYKRTDGIWTIILNDFDETLGADVWPSIFQGDGDYVKKYVDKSYIIDDVTIINFPNCSVHDCEMGHKIVKLVIHDNEEQWREVIGDVVKNVYNPTFINKRIDEIKELIQDDLAVSRAIDETTGVSLGCFNSAGFYPKWNMTQFETGVNNVGWQANTGQSRCYGLKYFIEKRFDY

SEQ ID NO: 6461 - protein, 328 aa, Neocallimastix californiae
  CotH
GMYARSNSKVGFNMKFEQKIFGRKSLRLRPDPNDKSYMREKLSSDILNRAGLPSVQAGYARLYINSEFFGLYTLLDSVKPAMIKKVFRLEEETDDMILYQCKYDGMDFSIGSESHCIDAVNEDNTDLSELKDLIQKVNSATTIAQFEEFLDVDLFLKNVIVEWLIGSFDHFLILGHNFNLYKRPTDNKWCIVIYDFDNTFGYNLNAGSFNIRGRNGGWGFNQNIDYTTLSFKDFNSKVNHKIFQYLIYQDDTKFKALLKDVLVYAFNPQLLKQHMNELKTFLTPYVNEDLTPVGGQLPGRVNRKGYNSKANVNDFQRNNEVESYIQRR

SEQ ID NO: 6462 - protein, 323 aa, Neocallimastix californiae
  CotH
GNNSKKYQKLGYNIKIKKGELYGRKQLRLRAFVIDPSFIRDKLGNDIVNALGLPSLSSNFAHLYINGRFMGLYSIKDAYKAHWIEANFGEKSTEHLYTCDYGKNPYFNCVNDDDKITDDTEYKEFMDRLTKSKTREELDQFFDSETYIRWQVVKYLFGSWDHHSNIHNIYLYKRKDGIWTQFLYDYDNSFGSLQGPNTKRTFYDEIVKYYKEPSPLIDVLQIYDNSTEFKKILEESLEKVFNPKKLFPHIDEIKEFLDPYIKEDRTPDANGQLPGRFPRALTYYEDKYSYDDFKDNTEYTRVKIRYRSSEEKILALKQWILER

SEQ ID NO: 6463 - protein, 201 aa, Neocallimastix californiae
  CotH
ALAFTSDYTDVVEATGKTPKEAIESVIDANSLADLFIISEMTCDADLYYSSFYMDVDFGANGSKKLRFEAPWDFDSGLGNRDRCPDGKGHYAANIMPDNNGFGSKINPWLAVIIYEDWFQDIIKSKWSKAYDSGVFGRVVDMIHSDTKIAEAAFTRNYEKWNNLVDKHGFDNELSPGARQCTTQAQASEYLAKWFENRVAF

SEQ ID NO: 6464 - protein, 125 aa, Neocallimastix californiae
  CotH
VKVRGNWTSNYPKKSLKISFDDSQSVLGLNGGKKFKNWVLLAEYKDGSMLRNKASFALSRSILGPDGLYASDSQLVELKINDEYFGVYLLAENQQINEGRVSITKAKDDYQGTDIGYFLEFDTGY

SEQ ID NO: 6465 - protein, 337 aa, Neocallimastix californiae
  CotH
GMSSAVLTKPGYNIKIIGNYTLHGTKNFKLRSDQRDPSMMRSKITTDILQKSGLLATEAGYTELYVNEEYMGFWVVTDSLKKNWVQRKFGINEDNVSTLYKCDYFRFEKSYKCENAGDDRYAENWDPIWILVQHVRESKSIEDLEEMMDVENFIKYMAWEWLMGTWDHFLGIFNHNLNWLQRPDGKWIYIPNDHDIELGEEIHAKFYPEKPFVDEINDTDIDYANIPIEDFENNHPIMQILVHQDDTIFRRCVGDIISKVFNPDTLFPQIDKIRKLIGPYVKKDRELKGGYINKKGKNIVYTYDHFLLNTEYTYIRNNVDTWYKSYGLKDWIRRRYN

SEQ ID NO: 6466 - protein, 342 aa, Neocallimastix californiae
  CotH
RLGGKSSMEFSRPGYNFKIKGSGKTLHGTKQFRLRSEQRDPTYMRTKLTSEILLKSGLITTDSGYTELYINNQYMGFWVISDSIKKSWITRNFGEVGEEVKTLYQCKIDSIRIDNNTAKTACLNAYNEFLDYKEPFNKFVDQVNASKTRADLEKFLDVDNFLKYVAWEYLVGSWDHFLGPFGHNLYWYQQPNGIWVYLPYDFDLDLGACLWSDQFSSKSYTTAGDNIQFPAIAFKDFELEHPIIKILVHDDDTRFREIIGDVVSKVFNPDTLLPRIDELKKLVEPYIKKNIETGAGKINKVCPKQANWTMDDFYENCEYTYLYDTKDYVKAFGLKDWIRRRY

SEQ ID NO: 6467 - protein, 276 aa, Neocallimastix californiae
  CotH
MRTKLMCDIHNKLGLPSISANYIKLYINDEFMGLFILTDAYKESWIEYVYGEKDTTNLYKCEKCNLLFNKRYGFENENKEATDNQEFYEFLQAMTKAKSSVDVESIFDLDQFYKEIAIEYLSSSWDHINNQHNYYVYKNPKNNKWIYLIHDFDLDMCSELFEGLNECIKYDFKNFLYVPIVKKLIYNNIEHFKEILKEIVIKVFNPATLFPRIDEIKSFIRPYVQLDKTLNDNGEYPGRMNKNDDTFYTMEQWEASTEFEESLIGLKQFILLRYRY

SEQ ID NO: 6468 - protein, 282 aa, Neocallimastix californiae
  CotH
IKVGGRSTRSYSKLGYNINIKGDKDFHGVKNLRLRSEVVDPTFIRDKLGYDLYNIINLPTLSANYAKLYFNQKYMGFFLVRDAFKSHWIEQNYGEKNTTHLYSCDSKYGDNVFFNCHNDAKEDSDRSEDKEWTNFLQKLEKADTREKLAEFFDVDSYIKWQVSRYAFGSWDHVTRKHNNVVYMYHDTTNGRDFWIPFLYDFDLNFGARNIVNATKSFKEEVMEKEEVNPLYKILNINEESEEVRGILQEIFEKAFDPNKILSRIDQIRTFIAPYVLEDRTPD

SEQ ID NO: 6469 - protein, 328 aa, Neocallimastix californiae
  CotH
GKYTQNFEKPQFNVNIKDDSLYGIKHLRLRSEVIDPSFLRSKLGSDLTTVLGFPSNHATYSKVFLNNDDMGLYLLRDAIKANWVEYNFGVANTTSLYTCDLMYGDSLFYNCVNEETEEKDEDITNFSNQIENAKTVEELDQFFDTDLYIKWQAYKYLTGSWDHVTNQHNQYLYKDGDKWLDILYDFDSDLGAYKIPVPAQTFSEESLEMDFPIYKLIGLNDNHPKLVEYIKEMVTTYFNPVKVFPHIDELVEYLYPYVVEDRTPEDDPTARPGHYLRSDHKIENGFTADDFLKNSEFTNIFLNKYYTETNYDVDEIFGVKRWIIERFR

SEQ ID NO: 6470 - protein, 335 aa, Neocallimastix californiae
  CotH
GKSSTEFSKPGFNIKIKNGETLHGTKNFRLRSDQRDASMMRSKISTDILQKSGLIAVEVGYTELYINNEYRGFWVVSDSVKNKWIKRKFGDVDDITDLIQCRDDKIRFDDNSAKKKCVNANDEYADNMTNFNKFVDSVNAAKTRADLEKIMDVDNFIKYLAWEWLVFGWDHFLGVYGHNLYWYLQPNGKWVYIPYDHDLEVGQDIWTQSFPGKDFYNGNDIEFANISFKDFELNHPIVKILVHNDDTIFRECVGDIISKVFNPDTLLSHIDNIKNLISPYVKKDRDSGAGKLNKLGKDVDYTYEHFLQNVEYTYLFSYKGSVRGYGLKDWIRRRY

SEQ ID NO: 6471 - protein, 335 aa, Neocallimastix californiae
  CotH
GKYTKSFEKLGYNIKIKKGNLFERKQLRLRSEAVDPSFLREKLAYDICNVVELPSLSSNFARVYFNKKYMGLFAMRDAFKSQWIEYYFGEKSTKHLYTCDSNYGNNKFFNCVNDDEDIKETDTEFKKFQDRLATIKTREELEEFFDVKVFMKWQALKYLFGSWDHVTNAHNQCLYMFHDTTYGKDMWIPLLYDFDSEFGAYKDSNTQRTFNQEIYDSTNPLFTILSLNDDNKELIGYMDEIMRKAFNPKKLIPRIDELKEFIGPYVKEDRTPDEDGNLPGRVKRINIKIEDYFTYEDFLNNSEFTDIKLRKYSSTMTYNEDRIIGLKRWMIERFK

SEQ ID NO: 6472 - protein, 337 aa, Neocallimastix californiae
  CotH
GKYTRNFEKLGYNIKVKKGTLFERKQLRLRSEAVDPSFLREKIGYDICNLVELPSLSSNFAEVYFNKRYMGIFGMRDAFKSQWIEYTYGEKSTTHLYTCDKEYGDNEFFNCINDDEDLVESDTEFKKFQDRLAKAKTREELEKFFDVQTFMKWQAIKYLFGSWDHTTTYHNQCLYMFHDTTTENDMWIPLLYDFDSDFGAYRDSNPNRTFNKEIYDKTNPLFEVLQLNDDNKELIGYMDEIMRKAFNPKKLIPRIDQLREFIDPYVKKDRTPDADGNLPGRVKRVNIKVEDSFSYEDFLGNSEFMDIKLRKYATESDSSYSEDRIVGLKRWVIERFK

SEQ ID NO: 6473 - protein, 305 aa, Neocallimastix californiae
  CotH
GVSSQYYAKQAFNIKVRNDELYGRKQFRIRSDAREPTMIRSKLFCDVSNRLGLVNSVSANYIKLSINGEDLGFYVIMDSLKLTYVNIEYGDKDSTNLIQCKDLSAYLTSSSVNGKCLSENEDNPDISAFNQFVSQLDSANTINQMNQVLDVENFFKVTILEWLTGSWDHYTLFGHNYNVYKIPNGKWEVSLYDFDATWGQDLALSFPTAGTPAGLNANNVDTWPKAKFEDWINTQKQHPLAVIMNEDKNLFIKYLQEIIDSTFNPGLLFDRIDEIKDFIRPYVKDDRTKKLGRLNPNTSCTEYTY

SEQ ID NO: 6474 - protein, 358 aa, Neocallimastix californiae
  CotH
GMYARSNDKVGYNIKLDKKFLGRKNIRIRPDANDKTHLRSKLACDIANKIGVPSIQAAYARLYMNNEYWGLYTLMDAIKPSWIKQTYDPAEKEVSNLIQCKYDGMNLTPGSESKCLNANDENPDMSAFNQFVREVNAASSIEEIEKVLDVDVFLRFMAMEWLIGSFDHFLVLGHNFYFYKRETDGKWVLIEYDYDNTFGNGVSFPVYWMNKGKNNGGNNNNNNNNNNGGWGGFNFGFGGFGGFGGGNGLGNNVLQYTFADWELNIPIINTLVHKNPERFTGIVKDILANAFNPSLLNDYIDQLKTFLLPYVKEDCTPGANGRLPGRINQKGNQNPASVNDFEANIEGSVNNVEGVKSW

SEQ ID NO: 6475 - protein, 322 aa, Neocallimastix californiae
  CotH
GNNSKKYQKLGFNVNIKKGDLYGRKQLRLRAFVIDPSFIRDKIGNDIVNALGLPSLSSNFAHLYINDRFMGFYVIRDAYKPHWIEANFGEKNTKHLYTCDYGNNPYFNCVNDDEDIKKDAEYDEFLDRLTKTKTRDELEQFFDTKTFIRWQVVKYLFGTWDHRTNIHNIYLYKTQSGMWTQFLYDYDNAFGSLRSPNTRRTYGEETLTAFREPKPIIDILQLSDNSTEFQQVLNETISTVFNPKKLFPYIDQIKAFIDPYIKEDRTPDANGKRPGRFPRALEYYEDYYSYDDYKLNTEYTRVKLRYYNNEEKILGLKQWILE

SEQ ID NO: 6476 - protein, 330 aa, Neocallimastix californiae
  CotH
GKYTQIFEKQQYNIKINNGSLFGRQQFRLRSEVVDPSFLRSKIGYDLCNILGLPSLQATYTLVYINNDNMGLYLLRDAYKPQWVEYNYGITNTTSLYKCDKKYGSSDYFNCQNDETETVDEDFTDFIKQLEKAKNTKDLSRFFDTSLYIKWQALKYLLGSWDHITNQHNQYLYKHSNGKWLNLLYDFDSDFGAYRSPKPAQSFTSESGEMDFPLYKILGLSDTHKDLVANIKSMVINGFNPVKLFPRIDNLMEYLYPYILEDRSPEKETTERPGHFVRPDFKIENGFTVDDHVKNAEFHNYYLKKYENDKSYTIDEIYGLKRWIIERFRY

SEQ ID NO: 6477 - protein, 295 aa, Neocallimastix californiae
  CotH
GSSRVYSKPNYNLKIRGDKELFGRRQFKLRGDAADPSFMRTKLMSDIHNRLGLKSLSANYAFLYINDEFMGLQVLTDIYKETWIEYVYGEKNTTNLFKGNNADLTINNLNGYENENKDTTADDTKDLSKFLTDMTNAETATDVESIFELEQFNKEIALEYITIGTDHFMASHNYYIYKQPQNGKWIYLSHDFDLDLDTYTDETNHELTFNDFNTSNMVTKLILSNEEYFKEMIKEIIEKAFNPSVLFPHIDEIKSFIKPYVELDKKPDENGEYPGKINKNSYYEEYLFTLKQWND

SEQ ID NO: 6478 - protein, 402 aa, Neocallimastix californiae
  CotH
VKVRGNFTSNYPKKPLHIKFDKKQSILGMNNDGAYKNWILLSSYKDESLVRDVSVLSIAREIYSTEGYYVSDTRYVEVTINGEYEGVYILAEQQQIAEGRIEGVEPKKGYEGSDISYLLEHDGYAYLEDPLNKVLIDYHNRDPLKGYDGKGGLETKSPEGGMGDEQIAISSDINSQAQHDFIANYINKVYDIMYEAAYNNKTFEFNEDYSEIVENAELTPQQAVEKVVDVNSLALFYIINEIACDADVAFSSFYMDVDFSAEGKKKLRFEAPWDYDSALGIKRCENGQGLFAANIVPTASNAPGTDINPWLSVLMYQEWYQELIRKKWNEYYQKGAFNKAIDNIHKITETNAKAFEIEHQRWDTEDHDKSVAGEALPVIPPLDSQPEHANYVADWLKKRIEF

SEQ ID NO: 6479 - protein, 310 aa, Neocallimastix californiae
  CotH
GRLSRRYSKQLFNLKIRGGKELFGRRQFKLRSDATEPSYMRTKLMCDIYNKLGLPSISANYITLYINNEYMGFYILTDAFKESWIEYVYGEKDTTNLYKCEDCDLTYNTRYGFKNENNEATDIKELYEFLAKITKAKSITNIESFFDIDHFYKEIAMEFLSFGWDHYINHHNFYIYKNPQNNKWVYLNFDYDLDLGSFQYDFTKSITKKFSDMFYNDKLLSNIEHFNEILKEIVIKVFNPATLFPRIDEIKSFIRPYVQLDKTLNDNGEYPGRMNKNDDTFYSMEQWEASTEFDESLIGLKQFILLRYRY

SEQ ID NO: 6480 - protein, 332 aa, Neocallimastix californiae
  CotH
GNWSRSNDRVGFNLKLNKNDRLFNTKNIKLRPDTTDFTSMRTKIAMELLYKWNLPSPHSTYIELYINDKYFGLYYLEDGVKPNWIKNMYELPKDEEITTLFNCKKDGALMNLETANHCFNSNDDYANYTQPIDEAFGAIEKATSIEDLKKVINIDQFIKNIAIEFLFGSYDHFIVHAHNYLLYKKADGIWDMILVDFDNELGNGLLSSWSFVLNRTADDITKIKLEEMPKEESNIFNVAILKDQTLFKKALHELLVTGFNPDFIFPRIEEIKKLITPYVEKSITPNEDGSYPGVINLIGSPSVHTLKDFEDSFTSEDQMKIGLKTWIQKRFE

SEQ ID NO: 6481 - protein, 305 aa, Neocallimastix californiae
  CotH
GKSSRTFNKVAYNIKIHGDNLYGRKDLRLRADYNEPTFLRTKLYCDITNRLGIPSISANYVSLYINDEYMGLYILLDIYKSSWIKYNYNEANTSSLYKCGYANNYLTAQIEGTCNNDKDEVSDTSQWKELLETLDNAQTAADIENIFDIDLFLSQVAIEYLTGAWDHFLITGNNYYMYKPQNDKWKFFEYDFDSSFGDNIERSKNLKVIITDKLNIMKKYILDYPSISFDNWVVPSHLVDILILKDPTRFETILKNIVEKVFNPKILFSHLDNLKELIKPYVQLEKTQDANGNYPGQHNRNHKDY

SEQ ID NO: 6482 - protein, 305 aa, Neocallimastix californiae; identical to SEQ ID NO: 6481
  CotH

SEQ ID NO: 6483 - protein, 342 aa, Neocallimastix californiae
  CotH
GQYSRHLSKPNFNIKIHGEKDLYGRRNFKLRSDYTEPTFLRSKLTSDIYDRLGTVSISANYANLYINDRFMGLFVLTDTLKLSWAELVYGDVNSKNLYQCTGGANLTYRSINSCQCEYKMPYNRTEWAVLLKTLDNAKSARDLENVIDFDQFIYSMAVEYLLGSWDNYRNSNNFYMYKPLNSTKWLYIGYDFDHNFGTNLDYVFASHIYLDLPEAYERVNKNYPEYSIDKWFSSIADKPLIKYLILKDRTRFYEALRTIIEKVFNPGTLFLRIDELKEFIRPYVEIEYTPDENGKLPGRINESGNDPYTFAEWEANSEFTTVKTAQYNAYGIKYWILSRYRY

SEQ ID NO: 6484 - protein, 202 aa, Neocallimastix californiae
  CotH
GMYARVNDKVGFNIKLPKKFLGRKNIRIRPDPSDRTHLRSKLCCDMANRLGLPSIQAIYARLYMNEEYWGLYTLMDSIKTSWIKQTFNPSVEEITTLIQCKSGGADLAPGTERKCVNANDDYPNMDVFKQFVDEINAAKTIEEVEKILDVDVFLKFMAMEWLIGSFDHFLVLGHNFYFYKRESDGKWIIIEYDYDNTFGNGL

SEQ ID NO: 6485 - protein, 322 aa, Neocallimastix californiae
  CotH
GKGSRNFSKPGYNIKLEEGSIYEVKNLRLRSNSRDPTLLREKLSTDMLYKMGLPTTSTNFVNLEVNGEDLGLFIVTNKIKKDFIKRYFNDKNTDNLFECLSDHNRFETYEFANSCQNAKEELAANKEEIINFNNAINNATSVEDIEKVLDVDNFLRYIAYEFLTLSWDHFLGYNHNFFWYKKKEDGRFIMILNDFDETFGADFSNIIFLIYNQYADRSYMPGYEEMYVPNTAFRDIDLDHKIMKYLVHDDDTRFRRIIGEVVKQVFNPKVLNARIDELAELIHDDMANSRSIDEKTGYCRGCFNTIGLVTGWNITHFEDGVN

SEQ ID NO: 6486 - protein, 311 aa, Neocallimastix californiae
  CotH
GQSGLRFGKIGFNFKIRGKDELYGRTQFRLRPDAREATFLRSKLVCDIQNRLGIPSISANYATLYINDEYMGFYVLMDTFKLSWIEYEYGDKDTRFLYQCKETGNYLTETSSYNCINKNEEVLDHTEWNELLTSIKNAETASDIEEIFDVDLFVTQIALEYLLGSWDHFLNYGHNYYLYKPVNDKWKYLTYDFDGEFGQDIEMVYVGAIIDDVPEIMDTVNMDYPNYSFEQWTKKNHLIEILILNDKSRFNEILKNVVNEVFNPSILYPRIDELKTFIKPFVKLDKIKNDDGKYPGRLNEIIGDYTFDQWD

SEQ ID NO: 6487 - protein, 340 aa, Neocallimastix californiae
  CotH
GGRSSRSYGKPCYNIKIRNKDDLYGRTQFKIRSGSRDATFLRNKLACDIHNALGIPSISANYITLYINEDYLGFYIIMDAIKLSWVEFLYNDKNSTFLYKCDDVHNGISKKTAVKGCTNENENFTDKKDWEEFLTSIDEAESANNLEDILDIDQYLTEIALEYLFGSWDHYPVHSHNFYFYKANSVDKKWKYLIYDFDGEFGQDINSHFISQIEFPSSKSFFISNSTLYSSLLRRTDSSLNETEINQNNKTIASNNIEELFIDHEDKKYEFAAYSFTEWYNGQDHLIKILILNHPTRFVDTLKKIITKVFNPTILFPHIDEIKKFITPYVKKEKYPDENG

SEQ ID NO: 6488 - protein, 317 aa, Neocallimastix californiae
  CotH
GRSTKTYSKLGYNVKIKKGKLHGVKHLRFRSEVVDPTFMRDKLAYDLHRIIGLNTLTANYCKLYINDIYMGVFLIRDAFKNSWVEMYYGEKDTTHLYKSIDVSEDKDKNPFFNCENEDENITEDPDWDEFLQQLANAKSRKDLEEFFDVEGYIKSQVARYLFGSWDHTTNKQNSYLYRSIDKETGKYKWLYFLYDFDFNFGGKNGAYIEKTFDEEIVDETNPLYSLLNINGESQEIRNLMEEFMRKVFNPETLLVRIDQLKAFLNPYIYEDRTPDENGNRPGRFSRMVRRVEDTFNYNDFLTNSEFTTVKTIQHYDD

SEQ ID NO: 6489 - protein, 288 aa, Neocallimastix californiae
  CotH
GKSSLCFSKPGYNIKIRGDKDLFGRNQFKLRSESADPSFLRSKLASDVYISLGLPCISTNYATLYINDEYMGLFTISDAYKSSWIESEYGDKNTSSLYKCDVLSYLTLVNSPYLCENINDEVTDSSEFVQFLTTLDKAQSAADIEDIFEVDHFLTEMALEYILGSWDRILHQGHNYYMYKQPNGKWIYLAHDFDHEFGINMDRGIMGPITLDSPERVQKLNFDYPNYSFDDWETRHLHIIDILIRKDTTRFDKILKNIVEKVFNPATLYPHIDELKELIKPYVESDYK

SEQ ID NO: 6490 - protein, 335 aa, Neocallimastix californiae
  CotH
GKYTRNFEKLGYNIKIKKGELFERKQLRLRSEAVDPSFLREKLAYDICNLVELPSLSSNFAKVFLNNKFMGLFAMRDAFKAHWVEYYFGEKSTKHLYTCDRNYGSNKFFNCVNDNDEITDDTEFKKFQNRLEKAKTREELEKFFDVETFMRWQALKYLMGSWDHTTNDHNQCLYMFHDTSSGNDMWIPLLYDFDSEFGAYMDSNPRRTFNREIYDSNNPLFKILNLKDDNKELMGYVEEYMRKAFNPKKLIPRIDELKKFLDPYVKEDRTPDADGNLPGRLKRVNIKIEDYFTYEEFLSNTEYTDIKLRKYTSDTTYNEDRILGLKRWMVERFKF

SEQ ID NO: 6491 - protein, 335 aa, Neocallimastix californiae
  CotH
GKYTRNFEKLGYNIKIKKGELFERKQLRLRSEAVDPSFLREKLAYDICNLVELPSLSSNFARVFLNHNFMGLFAMRDAFKAHWVEYYFGEKSTKHLYTCDKDYGNNKFFNCINDDDEITDDTEFKKFQDRLEKAKTREELEKFFDVETFMKWQALKYLMGSWDHTTNAHNQCLYMFHDTSSGNDMWIPLLYDFDSEFGAYMDSNPRRTFNKEIFDSTNPLFTVLNLKDDNKELMGYVEEFMRKAFNPKKLIPRIDELKKFIDPYVKEDRTPDDDGNLPGRLKRVNIKIEDYFTYEDFLSNTEYTDIKLRKYTSDTTYNEDRILGLKRWMVERFKF

SEQ ID NO: 6492 - protein, 335 aa, Neocallimastix californiae
  CotH
GKYTRNFEKLGYNIKIKKGELFERKQLRLRSEAVDPSFLREKLAYDICNIVGLPSLSSNFVKVFLNHKFMGLFAMRDAFKAHWIEYYFGEKSTKHLYTCDREYGNNKFFNCINDDDEITDDTEFKKFQDRLEKAKTREELEKFFDVETFMKWQALKYLFGSWDHATNAHNQYLYMFHDTTYGKDMWIPLLYDFDSEFGAYMDSNPRRTFNKEIYDKNNPLFNVLNLKDDNKELMGYVEEFMKKVFNPKKLIPRIDELKKFLDPYVKEDRTPDADGNLPGRLKRVNIKIEDYFTYENFLSNTEYTDIKLRKYTSDTTYNEDRILGLKRWMIERFKF

SEQ ID NO: 6493 - protein, 303 aa, Neocallimastix californiae
  CotH
GNVSRIYSKRGFNIKIRNNKNLYGRSHIRMRPDASEATFLRSKLSCDILNRLGLTSLSSNYAKLYINDEYMGLYNMMDSFKLSWAEYAYDDENTTGLIQCPDSSSFLTVESSSEICKNENEEVTDNSEWVQFLTALDNAQSIEEIEKFFDVDHFLKLMAYEYLFGAWDNFLVTGHNYYLYKQQNGKWKFLLYDFDNSFGHDIDTAFKNVIFNKNTPLGTKNYPELSFTEWAKPSHIVDVLILKDPTRFNSIIKEVVADVFNPATLYPYIDQLKEKIRPYVELDKTPDENGHLPGRINPKASEY

SEQ ID NO: 6494 - protein, 349 aa, Neocallimastix californiae
  CotH
GQYARSNDKVSFNIKLEKKFLGRKNIRLRPDATDKSHLRSKICCDIANRMGVPSIQAVYARLYMNNEYWGLYTLMDALKPSWIKQTFNPTEKEVTTLYQCKNGGMNLKSGSASKCFNANDEYQHMTQLNNFVKGVNEAKNINDLSKIMDVNVFLKYVVFEWLIGSFDHFLIYGHNFYFYKRETDGKWLLIEHDFDNTFGSGISLNLWANKGPNQDGSSGNSNNNNNNNPWGWGWGFGGNNNNNRGSEPIKYSFADWEMNIPILKTLVYNNKDNFKKIVREVLVSAFNPTILDPHINELKKFLTPYVKEDSTKGKDGSLPGRINKKGQKHSSSVSEFENNIETSLKYWIK

SEQ ID NO: 6495 - protein, 284 aa, Neocallimastix californiae
  CotH
GSSSRSFGKQGYNFKIRGKENLYGRTQFRLRPDAREATFLRSKLLCDVHNRLGIPSVSANYATLYINDEYMGFYILMDSIKLSWIDFVYGDKDSTSLYRCKDVNNDLSVKMSSTGCINDNEEVTDNSEWIEFLTALDSAQSAEDIENIFDIDLFLTEIAIEYISGSWDHYLIYGHNFYLYKPKDDKWKFIVYDYDGDFGQDIDMGINGMSFDFTAPRNPSTDYPTYSFEEWTKSRHLVDILILNNSTRFDNILTNLVSEIFNPATLFPYIDELKEFVRPYVELD

SEQ ID NO: 6496 - protein, 322 aa, Neocallimastix californiae
  CotH
GKTSRFLAKPGYNIKIHGDDNAIYGVKKLRIRSIIRDASQMREKLSSDILQLMDVPTTSTGYINLEINGEFMGLYLLTNKIKKDFIKYYYGESKPKNLYDCKLDKTRFEDNTVVTQCENVDEKLTDKTELQSFVDAVNQAKSAEELEAFLDTEAVLKSFAFEFITVAWDNFLAFNHNYFLYKQTNGKWTMIINDFDYTFGQEFWSTHFQGNGVYVNKDYIPDATHVNIFNFSIRDCDLGHKLVTLLILNDDTRFREIIADVVKKAFNPQLLLPHIDAIKDLIYDSIVADRQFDDKFNGPGRINSLGKFVRWNVTHFIDTTEY

SEQ ID NO: 6497 - protein, 268 aa, Neocallimastix californiae
  CotH
GQNSRNYSKLNYNIKIKGGEDLYGRKQFKIRSDNSEPTFLRTKLIADIHNYIDLPSISANFANFYINDVYMGFYIITDSFKPSWINYIYGDEDTSNLYKCENTKNGLTTYKATYGCKNENDEVTDITEWVEFLNKVDQAESLSDLENVVDIDKFLIEMALEYLLDSWDHIQNGHNFYMYKTPQGLWTYLTYDFDLDFGQNKQPPQSYNDYLAMIKELNSHILNILILTEPTRFEEKIKQLVTEVFNPMILYPHIDELKEFIKPYVIFD

SEQ ID NO: 6498 - protein, 334 aa, Neocallimastix californiae
  CotH
GKYTRNFEKLGYNIKVKKGELFERKQLRLRSEAVDPSFLREKLAYDICNLVELPSLSSNFVNVYFNDRYMGLFAMRDAFKSQWIEYYFGEKSTTHLYTCDREYGNNVFFNCINDDDEITDDVDFKKFQDRLAETKTRKELEEFFDVETFMRWQALKYLFGSWDHATNDHNQSLYMLHDTTSGKDRWIPLLYDFDSEFGAYMDSNPRRTFNHEIYDKKNPLFEILNLKEDNEELMGYVEEYMRKAFNPKKLIPRIDQLKQFLDPYVKRDRTPDADGNLPGRVKRVNIKIEDYFTYEDFLSNTEYTDIKLRKYTSESTYNEDRILGLKRWMIERFK

SEQ ID NO: 6499 - protein, 306 aa, Neocallimastix californiae
  CotH
GVSSRYYPRQAFNVKIRNDKLYGRKQFRIRSEAREATFLRSKIFCDINNRIGQPDSVSANYIKMTINGEDMGFYVIMDAVKLTYVNIEYDDKNSTNLIQCGNLNSDLTMKSMRTCESENDDNPDMTSFQQLLTSLDGASTIEELEEVLNVEVFMKAVLMDYLSGSWDHYCLFGHNFNMYKPPNGKWQIVLYDFDATFGQDLSMGLMYGTPAGVVGNNINTWTQAKFENWHGNKHIINIILKDRPELFLSSLQEIVTKAFNPKYLFPHIDNLKKFIRPYVEEDKTNKPGRINSRSTCYDYTFSEWDA

SEQ ID NO: 6500 - protein, 338 aa, Neocallimastix californiae
  CotH
GKSSTEFSRPGYNIKIKGGENLHGTKNFRLRSDQRDPTYMRTKLVADIMQKSGLITVESGYTELYVNDQYMGFWIIQDSVKNKWIERNFGPYEGKDLKTLYQCKVDEIRFDDGSAKTKCVNANDDFADYMEPFHTFVDTVNAAKTREDLEKVMDVDNFLKYMAWEYLVGSWDHFLGPFGHNIYWYQQPNGKWAYIPYDYDLDLGSCMWKDQFKIKSYFEGEGDIQFPAIAFKDFELDHPIIKILVHDDDTKFRELLGDVVSKVFNPDTLLTRIDELRAFIEPYVKKQLETEAGKINKLAKKKALWTYDDFNENCEYTFLYDTNDHVKAFGLKDWIRRR

SEQ ID NO: 6501 - protein, 333 aa, Neocallimastix californiae
  CotH
GKYTKNFEKLGYNVKIKKGQLFERKQLRFRSEAVDPSFLREKLAYDICNVVELPSLSLNFAKLYFNDKFMGLFAMRDAFKSQWIEYNYGEKSTKHLYTCDRNYGNNKFFNCINDDEDIVDDPDFKAFQDRLEKTKTRKELEEFFDVKTFIKWQALKYLFGSWDHITNAHNSFIYMYHDKEKGKDQWIPLLYDYDSEFGAYKISNTRRTFTQEIYDGSNPLFKILDLNEENEELLRDMAEIMEKVFNPKKLLPRIDKLKQFIAPFIKEDRTPDENGSLPGRVKRINIKIEDYFNYEDFLENTEFTTVKLRKYQSDSIYNDDYILGLKQWIIERF

SEQ ID NO: 6502 - protein, 349 aa, Neocallimastix californiae
  CotH
GSGSRNYIKPGYNIKLKKGAKLGEVKSLRLRGNVRDPTLMREKLSSDILYRMGIPATSTNYANLIVNGEDLGIFVLTNKIKRDFAEKYYGDESPDNLFECKKAGSRFDNNGVAEWCENVKDELNDFRDDLIAFNEAINKATSVEDIEKVLDVDHFLRVAAFELLTDSWDHFITYSHNNFWYKRKEDGKWLIFLKDYDETFGNNFYSFIFMYFTEYSDRTYVPNDDELNIVNMSIRDLDYDHKFLKYLIHDDDTRFRKIIGEVVKEVFNPKVLLSRIDEIAELIRDDIKSSRTPDETTGLSKGYLNTLGFNPNFNVTHFDDCIGDGNWRSNVSNTVTYGLKYFIEERFKY

SEQ ID NO: 6503 - protein, 357 aa, Neocallimastix californiae
  CotH
GMFARSNDKVGFNFKLNKKFLGRKQLRIRPDANDKSYIRSKLSCDIANRIGLPSIQANYARLYMNDKYWGLYILMDAIKPSWIKQTFKPSQEEVTTLFQCKLDGMTMKIGTESLCNNANDDYPDMSEFSQFIRQINNAKTSEEIEKIMDVEVFLKFMAMEWLIGSFDHFLVLGHNFYFYKRESDGKWVIIEYDYDNTLGNGLSFSSYWNSKKNIGTNNKNNNRNNWGNNWGNNWGNIGRGFGMGGYSSNDLINFSFADWELDRPIIKILVHDNQERFKKIVHEVLVSAFNPDILNPYINQLKSFLLPYVQEDCTPDSNGRLPGRINRSGSQHRSTVSEFERNIETSSNGTEGVKSWI

SEQ ID NO: 6504 - protein, 306 aa, Neocallimastix californiae
  CotH
GSSSRMYARQAFNLKIRGKDDLFGRKQFRIRSEAREATYLRSKLVCDIQNRLGMTSISANYMSLYVNNEYWGFYVFMDSPKPTWAELEYGDKDSTHVMKCKSGGATLTVRDSATQCVNENDEVTDNTEWRNFLDTLDRAQSINDVKNIFDVDQFINNMIYEYLCGSWDHFLNTGHNFVVYKKPQQFGGKWTMIEYDFDGDFGQDVCAVEFAGSIKQDKDYPSWSFADWTSKSRHILDVCIKKDQTRFKQLLEKFVAEAFNPGLLFPRIDELKDFIRPYVQKDKTPVNGRKPGMLNTKATADYTMAQ

SEQ ID NO: 6505 - protein, 338 aa, Neocallimastix californiae
  CotH
GKYTKSFEKLGYNIKIKKGNLLERKNLRLRTEAVDPSFLREKVAYDICNVIGLPSLSLNYARVFFNDKYMGLYALRDAFKAQWIEYTFGEKNTKHLYTCDGQYMTEETENLYNCINDDENIKDDPDWKHFIERLKAVKTRADLEEFFDVKTFIKWQVIKYLFGSWDHDTTGHNQVVYMYHDTSSEKDKWIPMLYDFDSDFGAYRDHKTRRSFSEETREALSPFYKLLQLNDKNEELISYIDEFMRKGFNPKDLIPRIDQLKEFLSPYVKEDRTPDENGRLPGRQERVNIKIEDYFTYDDFNDNSEFTTIRLNKYTSETTYNSEEIMGLKQWIIERFQF

SEQ ID NO: 6506 - protein, 339 aa, Neocallimastix californiae
  CotH
IGGRSTTFFSKVGYNINIKNDLLYGAKDLRLRAVTVDPSFLRDKLAYDLHNKIELPCISANYAKLYINDTFMGLYLLRDAYKARWVENTFGEKSTKHLYTCSNAYESEGNDFFKCINDDEDITDDQDIKIFLKKLENSKNRKDLEKFFDIKSFIRLQAARYLFGSLDHITGENNNMLYMYHDVSSGNDLWIPLIYDFDMNFGNFGKPNTNRTFDEEIFEKKNPLYTMLNINDKSEELISIMDEIMRNAFNPNILLPRIDQLRNFIAPYVKEDRTPGENGRFPGRFDIGVGRPHDQFTYEDFINNSEFTTIKARQYYNNFTDIYEENTALGLKQWVIERF

SEQ ID NO: 6507 - protein, 342 aa, Neocallimastix californiae
  CotH
RVGGKSSAAMTKPGYNIKIKGKNQTLHGTKQFRLRSDQREASMMRSKITTDILQKSGLIAIEVGYAELYINDEYMGFWVVSDSIKNKWIERKFGDDSNNIKTLYQCKEAYMRLDDGSAKEKCTNANDEYADYMEPFHNFVDQVNAATSREDLEKIMDVDNFIKYIAWEYLMLSWDHFITALGHNLFWYQQPNGKWVYIPYDHDVELGQELSNDYCYYKPYCGLKEVDFSNISLIDYELGHPILKILIHDDDTKFRELVGDIISKVFNPDTLLIHIDKIKNLIDPYVKRDRESNAGRINKVGVEKKFSYEHFLLNTEYTYIIDNVHKTRSYGLKDWVRRRYNY

SEQ ID NO: 6508 - protein, 114 aa, Neocallimastix californiae
  CotH
GHNYSVYKKKDGKWIVLYYDFDGDFGQDVSQGIEFGKPFVNPKKNYPSYGYEEWFLVPMNIYDVLIKNDPARFEKILAKVVKEAFNPAALFPHIDELKKFIKPEIVRIRTPDEN

SEQ ID NO: 6509 - protein, 341 aa, Neocallimastix californiae
  CotH
IRLKGKSTRNHKFKSFNIRPRKKYGDSKFRADIIEGNRNVINNEEITEYDSFSLRSVGWFDRMREAIVQRALKDYPILATYDNNKSLVFLDGEFWGLYDIIEKCSAEFIESNYSIPHKQVAIIKDYELEEGTEQDFNDFKELVKFCQNNDLTQAQNYKYVSDRVDVDSLIYHYANGLYLGIWDWPNRNFFVYRNNGSPIEGNKYSDGKWRFASFDFDYSSGLTYEDFGGVQGYAHDSFTKFQKKKDEHPTPLFTYMMKNKEFQQKFVDVFYLMGEEIFGAQKMKSIVQTEKDKYLKFVIKTDWRWYGGTPNMSYNEFFGLQTRYYGGGYDDIATFFTNRAQ

SEQ ID NO: 6510 - protein, 276 aa, Neocallimastix californiae
  CotH
FAKLYFNEKYMGFYTLRDAFKPQWIEYTYGEKSTKHLYTCNESYGDNKFFNCFNDDEDLKDTDTEFTKFQNKLAKARNRKDLEEFFDVETFMRWQAFRYLLGSWDHYANYHNTVYYMYQDKSKGREKWIPLLYDFDSDIGAYRYPDPSRRFNDEILENDHPLFGLLDINENNPEFMKYVEEYMRRGVNPKDLIPRIDKLKAFVDPFIKEDRTPDAEGHRPGRVLRVDNRVEDNFSYEDFLGNTEFTTIKLRKYTTDKKYDSDYILGLKQWFIERFQ

SEQ ID NO: 6511 - protein, 102 aa, Neocallimastix californiae
  CotH
VYMFHDTSKGKDFWIPFLYDFDLNFGSRNIINATRTFNEEVVNKESVNPLYKILNINEDSKEVRDLLQEFFEKAFDPRKVLSRIDQIRAFLAPYVLEDRTPD

SEQ ID NO: 6512 - protein, 337 aa, Neocallimastix californiae
  CotH
GQYSRELIKPNFNLKIRGGKNLYSRSQFKLRSDYTEPTFLRSKLTSDIHNRLGLPSISANYATLYINDEFMGLFVLTDAIKQSWIKFVYGEEDSQSLYQCSSSNLTFNSRHGCGNEDSDFKDYTDWMDFLTKLDAAESASDIEDFFEVDNFIYEMAIEYLIGGWDHIQQIGHNFYMYKQTNGKWKYFSYDYDHEFGINIDRVFVAYIFEDLPERYEAINTDYPSYSFAEWTMPYHIIDILILKDSTRFDEALKDIVTRAFNPATLFPRIDELKEFIKPYVIIDKTPDENGNRPGRINVSAEETYTLEEWDANSEFTSISTIQYNAYGIKYWILAKYR

SEQ ID NO: 6513 - protein, 306 aa, Anaeromyces robustus; identical to SEQ ID NO: 6504
  CotH

SEQ ID NO: 6514 - protein, 341 aa, Anaeromyces robustus; identical to SEQ ID NO: 6509
  CotH

SEQ ID NO: 6515 - protein, 302 aa, Anaeromyces robustus
  CotH
GNSARDYGRQGFNLKIRGKEDLHGRSQFRLRADARDATFLRSKIACDIHNRLGLVSISASYVNLYVNGDYLGFYVIMDAPKLPWIEQVYGEKDTENLIKCKIGGNYLSEASCATQCVNENDDVTDNSEWVKILRTIDNAKTPADLEKDFEIDHFLHEAAFEYLVGGWDHLLTSGHNYSVYKKKDGKWIVLYYDFDGDFGQDVSQGIEFGKPFVNPNKNYPSYGYEEWFLVPMNIYDVLIKNDPARFEKILAKVVKEAFNPAALFPHIDELKKFIKPEIVRIRTPDENGKLPGVLNELNPVDY

SEQ ID NO: 6516 - protein, 121 aa, Anaeromyces robustus
  CotH
VKVRGNWTSNYVKKSLRINFDQNQTVLGLNNGNKIKSWVLLAEYKDGSMLRNKSAFAMSRDILGEDNLFASDSKLAELYINGEYFGVYLIAEVQQVNQYRVNITKPEDGYQGTDIGYFMEY

SEQ ID NO: 6517 - protein, 225 aa, Anaeromyces robustus
  CotH
QNDFISNFVNGAYKIMYEAAYNQNTLKFTSDYRSIVEAPELTPRQAIENVLDANSLADMFIISEMTCDADLYYSSFYVVADFGPKGSKKLRFEAPWDFDSALGNRDRCRDGQGHFAANIVLDTSGFGDRINPWLAVIIYEDWYQDIIRTKWTKAYNSGVFGKVVDMIHQDTKTAAEAFDRNYSVWDNIRNNSNFVNELSPGAKQCKTQQEAADYLAYWIEERTAF

SEQ ID NO: 6518 - protein, 282 aa, Anaeromyces robustus
  CotH
GNFARTFSKPGFNIKLSKKFYDRKSFRLRADVNDRSHLRQKIVCDISNRIGLPSTQSTYVRLTINENLYGVYTLMDSVKPANIKQIYNVKTDKEDLKLYKCDINGFDMSSKTANHCLNETGEDEKEISEFKEFMKQVDNAKTVDDLDKFMNVDIFLKSIALEWIIGSFDHLLVMGHNIYFYKNEINNKWDIFYYDFDNTLGVSLNENLWFSTGKNKGVKDFSKLSFKQFTNDQKIFDIAVNNDSTRFKKNLKEILTYGFNPVLLNPHIDDIKSYISPYVKEE

SEQ ID NO: 6519 - protein, 326 aa, Anaeromyces robustus
  CotH
GKGSRNYGKPGYNIKLEKGSIYDVKLLRLRSNIRDATLMREKLSSDLLYKMGVKTTSTNYANIIVNGEDIGLFVLTNKIKKDLIKKYFNDKTINDLYECKLDYARFEDNSIIEHCNNIKDELVDDKDDLQNLVDAVNNAKSVDDIKDLIDIDAVLTTFAFEFVTLSWDHFFILGHNYFWYKNPQSGKWMMILNDFDETFCQDIWSNYFTDDSRYISKPYIPNLEYLNLPNLAVRDMDSGHKLVKLLIYDDDTRWREILGEVVKKAFNPSVLFPRIDEIAELIHDDLAVSREILEETGRARGVFNTAGYDPKWTVTQFEDTTNYINW

SEQ ID NO: 6520 - protein, 332 aa, Anaeromyces robustus
  CotH
GKYTKIFEKQQYNIKINNDDLFGVKQLRLRSETVDPSFIRSKLGYDLCNIFGLPSIQASYTNLYINDDDMGLYLLRDAYKSHFIQTTFGVANVTNLYKCDSDFGKNNSFNCATEDEEIVDDEFKNFIKRIEEVEKTRDANELSKFFDTELYMKWQAYKYLVGSWDHITYQHNQYLYKHPNGKWMNFLYDFDSDFGAYKKPNPNNTFDQEMLYYESATPFYKILNINDKNEKFIGYIKDMVIKGFNPVKLIPRITEVMDFIYPHVLHDRTPEEETEKRPGHFKRPEYKIENGFKMEDFFKNSELYNYVLIKYADKENFSTDNIYGVKRWIIER

SEQ ID NO: 6521 - protein, 335 aa, Anaeromyces robustus
  CotH
GRSTKFFEKVGYNINVKGDNLLYGAKQIRLRSVTVDPTFMRDKLSYDLFNIMGIPCLSANYARLFINDTFMGLYLLRDAYKSQWVQNTFGEVDTKHIYKCSGGKNPFFNCANDDEDVTDNKDWEEFLDKLDKAKTRKDLEEFFDVDTYIRSQVARYLIGALDHQSGNNNNVVYMYHDVSANKDIWIPLLYDFDMNFGNFQKPNTKRTFVEEIVDKNNPLYSILELNNESEEVKKIMDEIMRKVFNPVVLVPRIDQLRTFLKSYVKEDRTKGDNGRYPGRFDIMATRVEDLFTYSHFKHNSEFTTIVSIEHYNNFNDFKHTSTALGLKQWVIERFQ

SEQ ID NO: 6522 - protein, 337 aa, Anaeromyces robustus
  CotH
GRSTKFFAKVGYNINIKDGNLFGVKQLRLRSVAVDPSFLRDKLAYDLTRAIGLPTLSENFARLYINDNFMGLYAMRDAYKTKWVEYTFGEKNSTHLYTCSDAFGDNAFFRCVNDEEEINDQDPDWNAFLDKLATVNTREQLEEFFDVKSYIKTQVSRYLFGSLDHISGTNNNDMYRIHDDLTGKDQWIQLLYDFDMNFGNFQTPDTHRSFEEDVPEQSNPMYQLLNLNSQNPEVVSVMDEIMRTVFNPNVLIDRIDKLKAFIDPYVKEDRTPDANGNLPGRFPLTIERPEELATYEDFLGNTEFTTIKANQHFNNFNDHTNLQTALGLKQWVIERFK

SEQ ID NO: 6523 - protein, 338 aa, Anaeromyces robustus
  CotH
GSSSKALSKVGYNINIKDGDLYGTKKLRLRAESVDPSFLREKLAYDLYKIVGLTTISANYAKLYVNDTFMGIYVLREAIKADWIRDNFGEKDTKNLFACEESTEGLKCSHDDEDITDNSDFDEFNSKLMKTKTREELEEFFDVDGFIRWQAAKYLFGSLDHNKGKNTFLYRFTDPTAETKNKEKWIIIYYDFDMNFGNYRQSRPNKTFNEEMLKDYYPFYHVLEVLKLNDKSEELISIMDEIMRDVYNPNIIIPRIDELRNHIVDYKREDFIPDENGRLPGRLESFERFGEDSFTFEDFEKNIEFTTIKTNVLNNQNVTEHETVSRGLKDWIIQRFKF

SEQ ID NO: 6524 - protein, 315 aa, Anaeromyces robustus
  CotH
GRSTKRYEKLGYNIKVKKGKLYDRKQLRIRSEAVDPSFLREKIAYDICNILGLPSLSSNFVKVYFNKRFMGFYLMRDAYKSQWIEATFGEKSTKHLYSCDGFGGDPFFNCHNDDDDLVNTDEDFKKFQDRLAKTKTRKELEEFFDVEIFLKWQALKFLLGSWDHPVAGHNKFMYMLHDVSKNKDIWIPLLYDFDNDFGGYNYMHPKKTFKDLIYESSNPIFEILDLKEDANKDVIKYMDEFMRKVFNPKILVPRIDELKKFIDPYMKEDRTPDENGNRPGRIPRTFIRIEDYFTYEDFQKNSDYTNITLKKHLRA

SEQ ID NO: 6525 - protein, 334 aa, Anaeromyces robustus
  CotH
GNSSKMYSKLSYNLNIKSGTLFGSKQLRLRSEPVDPAFIREKLAYDLHTVIGLPSLSANFAKLYINDEYMGFYLLRDAFKSKWVEQTFGEKSTKHIYKCGNGDNPFFNCSNDDEDMTEDKEWEKFLDRLDKAKTRQDLEEFFDVDTFIKWQASRYLFGSLDHQSGRNNNAMYMYHNVTNGKDIWIPLLYDFDMNFGNFRVPVIQRNFTQEIVDPYNPLYEILNLNDESEELKSIFDDIMRQVFNPLVMLARIDQLKYFLKQYIKEDRTPDAYGHRPGRFNLTMYFAEDLYTYDDFKKNSDYTTVKSRLYYNNFNDYSRYSEAVGIKRWVIERFQ

SEQ ID NO: 6526 - protein, 336 aa, Anaeromyces robustus
  CotH
GRSSKAYAKLSYNINIKKDLLYECKQLRLRADSVDPSYLREKIAYDLHNLIDLPSLYANYARLYINDKYMGFFLLRDAIKSRWIEMIFGEKDTKNIYKCHESATQIFNCENDDEKITDNTDFLKFVDKLKNVKSREELEKFFDVETFIKWQAARYLLGSLDHDKGKNTVLYMYHRKDTDVDYWVPLHYDFDMNFGNYKIPNTMQPFSKEIAYKENPLYPIYKLLKLDDESEELIGLMDEIMHKVFNPNVLIPRIDQLKYFIQKYVKDDLTEDKEGHLPGRFDIPVHRGEDLFDYNDFEKNSDFTTIETIQYHNDFNDKDFRRTTALGLKQWVIERF

SEQ ID NO: 6527 - protein, 283 aa, Anaeromyces robustus
  CotH
GNSSRLMARQGYNIKIRGKKDLYGLTQFKLRSDAHDATYLRTKLVSDIHNRLGLTSISASYVILYINDEYYGLHMIIESIKLPWIKGKFDDEDTPYLYNCSKGACFLNPNCMYMCENENEDVTDNSEFSEFLKRVDSANSAKDIEDIFEIDQFLYEMAYEYLLGAWDHIFIGHNFGLYKQKNGKWIIIYYDYDNDFGQDPVDVEYGLVETNPNKDYANYTFDEWFNRPIRVVDILLYKNQDRFKKIMNDFITKAFNPDVLYPRIDELKELIRPHVKYDKTPDE

SEQ ID NO: 6528 - protein, 304 aa, Anaeromyces robustus
  CotH
GGRSTRRYEKLGYNIKIKKSKLFDRKQLRLRTDAVDPSFLREKLAYDISNILEFPSLSSNYIKLYFNKTFMGLYLMRDAYKSQWIEATFGEKSTKHLYSCDGFGGDPFFNCHNDDDELRDKDTTFKSFQERLANTKTREELEEFFDVDLFLKLQAFKFVIGTWDHPANGHNKSMYLYHDVSRNKDRWIPLLYDFDNDFGAYNHMHPKKTFKELIIQKKNPIFKLLGMVEDANEDVIKYMDEFMRKIINPKILLPRIDELKEFLDPYMKEDRIPDKDGKRPGRLQRPFIRIEDYFTYDDFVNNCE

SEQ ID NO: 6529 - protein, 298 aa, Anaeromyces robustus
  CotH
GHFSRNFAKPAYNIKIRGGKELYGRRQFKLRSDPADPTYLRSKLVSDIHNRLGVPSISANYATLYINDEYMGLFVLTDAYKETWIEYVYGEKDTKLLYKCNISDLTYETRNGFKNENNEITDRKELYEFLAAMTTAQTPSEIEHIFDVDQFVTEIALEYLTSAWDHFMNQHNYYIYKNYKNNKWIYLAYDFDLDLGLNTYETDVTTTQSFDELSYPSLVEKLILNDFDKFNNTIKEIVTNAFNPGVLFPHIDELKAFIKPYVELDKTPDENGKSPGRINLNDDILFSMDQWDESSEFT

SEQ ID NO: 6530 - protein, 314 aa, Anaeromyces robustus
  CotH
GTSARLMSRQGFNVKIRGKDNLYGRSHFRLRPDAHEATYLRSKLACDIHNRLGLESVSANYATLYINDKYYGFYVLLDAPKLTWVEEKYDDKDTPYLYKCKSGGCFLSQNCAYICQNENDEITDNSELMQFLRKLDKAKSAEEIEDIFDIEKFLYETAYEYLSGAWDHLLHGGHNFSIYKQKNGKWTIIYYDFDSDLGQDPVGVEYGIVNTNPDKDFPSYTFDEWMSIPIHLLDILVYKNQDHFKEIMNRFVTEAFNPNILYPHIDELKKFIRPYVEYDKTPGENGLNPGVINLLNTVEYTLEEWNVNSEFTTI

SEQ ID NO: 6531 - protein, 295 aa, Anaeromyces robustus
  CotH
GRSTKSYSKLGYNLNIKGDELLYGTKQLRLRAEVVDPTFIRDKLGYDVHNFLGLPTLSANYARLYINGKFMGLYLVRDAFKSQWIKNNYGEENTKHLYECEKSYGQSTIFNCRNDDEKIKNDPNWTTFIEKLEKAKTPDEIKEFFDVDTFIRWQVARYLFGSWDHNSHGHNNVLYLYHDTTTDKDKWIPFLYDFDLNFGNYRDTKPDITFNEVVVDTKNKLYSILEINETNPLILSLMEEFMQQVFNPLFLFTRIDRLKVFLKSYVKKDRTADENGNYPGRFARMGNHVQDSFDY

SEQ ID NO: 6532 - protein, 344 aa, Anaeromyces robustus
  CotH
GMYARSNSKVGYNMKLGEKIFGRKNLRLRPDPNDKSFMREKLSTDILNRAGLPSVQSSYARLFINDEYFGLYTILDSVKPAMIKKVFKLDDETDNMILYQCKYDGMDFSVGSESHCINAVDEETNDMTQLKDFIQKVNSATTIAQFEEFLDVDLFLKSVIVEWLIGSFDHFLILGHNFNLYKRPTDGKWCIILYDFDNTFGYNLNAGSFNVRRNNNQGNNGFGGFGNFGGFGGFGMSNIDYNTLNFQEFNSKVNHKIFQYLIYQDDTKFKALLKDVLVYAFNPTLLGQHISELKTFLAPFVEEDLTPYDGVLPGRINQSGYGSKATYNDFINNTELETYIKNRF

SEQ ID NO: 6533 - protein, 292 aa, Anaeromyces robustus
  CotH
GKSSRYFNKPGYNIKIRGKEDLYGRTQFKFRPDASEPTYLRSKLASDIHKSLGIKGISSNYATLYINDEYLGLFIISDTYKLSWIEYEYGEKDTTSLYKCESNLESNYQSNSFINQNENITDLTEIMELLKTFDEAQSAADIENIFDVDNFLKELAIEYLLGSWDNFNNANNFFLYKQPNGKWIYLTYDFDNSFGANLDTLYCGVIYVDFPERMAECIKDHLIDTVEEYFKPLFKVEVAHMIDILILKDPSRFEKILSNIVKKVFNPATLYPHIDELKELIKPFIEKEKIRN

SEQ ID NO: 6534 - protein, 305 aa, Anaeromyces robustus
  CotH
GKSTTSFTKPGYNIKIKGKDQTLHGTKNFRLRSDQRDVSMMRSKITTDILQKSGLIATEVGYTELYVNDEYMGFWVISDSIKNKWIKRKFGDNGEEIKTLYECNGDEIRFDNGSAKTKCVNANKEYSDYMEPFHNFVDQVNAAKTRAELEEIMDVDNFIKYMAWEWLMGSFDHFLSWYGHNLYWYQQPNQKWVYIPYDHDIELGQDEYIGFYPNRTFNHGRDIDFAFLSFKDFELDHPIIQILVNDDDTNFRQLLGDIISKVFNPDTLLLHINKIRDFISPYVKKDRESGAGKINKIGRDSRFTY

SEQ ID NO: 6535 - protein, 293 aa, Anaeromyces robustus
  CotH
GYSSHSYGKQGFNFKIHGNKVLYGRKQFRLRSDAREATFLRSKLVCDIQNRLGIPSISANYATLYINDEYMGLYVLMDIYRPSWIKYEYGEKDTKTLYQCKSTGNFLTVEKSINSCINRNDEVKDHSEWVKFITSLNKAQTVEEIESIFDVDLFLTQIALEFLFGSWDHFLNYGHNYYLYKPVNDKWKYLSYDFDAEFGQDLDLPFFRFIYEDMPELMINFNTDYPKYSFGKWTKKNHLIEILILNNPGRFNKILKNIVTEVFNPTTLFSHIDELKEFIRPYVELDKIPDNNG

SEQ ID NO: 6536 - protein, 234 aa, Anaeromyces robustus
  CotH
GMYARSNDKVGFNIKLPKKFLGRKQIRLRPDPKDFTHMRSKLSCDIANRIGLPSIQAAYARLYMNNEYWGLYTLMDTIKPSWVKQTFKPFAEEVTTLIQCKYDGMTMVTGSESLCLNANDDYPDMSAFSQFISQVNSAKTTSDLEKIMDVDVFLKFMAMEWLIGSFDHFLVLGHNFYFYQRESDKKWLIIEYDYDNTFGCGLQFPMYWNNRKPVANQNNQNNQNNQNNQNNQGN

SEQ ID NO: 6537 - protein, 334 aa, Anaeromyces robustus
  CotH
GSSSRHFSKQGFNIKIRGNQNLYGRTQLRLRPDVREATLLRTKLACDIQNRLGLPSVSANYAKLYLNDIFMGFYVLTDSIKLSWVESVFGEKDTTDLIQCGAMENDLSYEYSIDGCTNLNDDVTDNTEWGELLKAFDNAQSIEDVEDFFDVDTFLKNIAFEYLTGSWDHYLNYGHNFYLFRPAGDKWKFLLYDFDGEFGQDLAQGVGKRGAVITDYNYARFPFNKWHKDRHLLDILIYKNSTRFDNILKQEVIDAFNPAVVFPHIDELKKFIKPYIIEDYTPDENGQLPGRINLRSQNRYNLTQWDANCEFTTVLTTNYNSAYGLKMWFLERYR

SEQ ID NO: 6538 - protein, 334 aa, Anaeromyces robustus
  CotH
GRSTKAYSKLSYNINIKNGGLLFGCKQLRLRAEVVDPSFLREKMAYDLHNVIGLPSLSANFARLYINDTFMGFYLLRDAFKSQWVENNFGEKNTKHIYKCDEGSHSIYNCKNDDDNIDTNKDKDYKKFIEQLDKAKSREDLEKFFDVKTFIRWQAARYLFGSWDHKTNGPNNVIYLYHNTVTEKDMWIPLLYDFDMNFGHTHTKTNRTFSEEIYDPNNKLFTLLKLNDENPEILSLLQEYMKQVFNPLVLVTRVNQLKVFIEKYIKEDRTPDAEGKLPGRFDKTFKSVRDTFDYNDFKKNTEFTTIRAKQYNSNIEYDTTIILGIKQWIIERFK

SEQ ID NO: 6539 - protein, 273 aa, Anaeromyces robustus
  CotH
GKYTKVFEKLGYNIKIKKGMLYERKQFRLRSESVDPSFIREKLSYDICNLIGLPSLSSNFARVYFNKKFMGLYSVRDAFKPQWIEYTYGEASTKHLYTCDSSYGNNAYFNCKNDDDDIKEDKEWDNFIKRLTKVKNRKDLEEFFDVETYMKWQAIKYLFGSWDHVTNAHNQFLYMFHDTTSGNDKWIPLLYDFDSEFGAYKDPKPRRSFYDDTLDSYNPIYNILELNDKNEELISYIDKFMREAFNPLKLIPRIDQLKTFLSKYVKEDRTPDE

SEQ ID NO: 6540 - protein, 280 aa, Anaeromyces robustus
  CotH
GGSSRNYAKQGYNIKIRGNKDLYGRTQFKLRPDSREATYLRSKLVCDMHNRLGLPSISANFATLYINDEYMGFYVLLDSIKLRWIEAVYDDPDSTSLYECKSTSNQLTVESSSEGCVNANDEVTDNTEWIEFLTALDNAKSPEDIEDIFDIDLFLTEIAFEYLSGSWDHYLYFGHNYDVYKPKNDKWKILYNDFDAELGQEVVFIEDTVQNANKNRDYYSYSFEDFAARKTHLLDILIFQNTTRFDNILKNFVTNAFNPTILFPHIDELKEFIRPYVELD

SEQ ID NO: 6541 - protein, 302 aa, Anaeromyces robustus
  CotH
DGNYARSFSKPNFNIKLPTEYNNRKNFHLHSSVNDKSHIKQKLVCDILNRVGLPSTQSTFVRLTINGNLYGLYTLMDTPEPSNIKRLYNTKKDDLKIIQCKYTGFTFTYGTANYCVSDDSDDKSNIQEFNEFLAEVDKAQTIEDLEKIMNIDIFLKYIAIDWIIGSSDHLLINGNNVYFYKSEINNKWDIIYYDFDNTFGQGIGDWVWTNGKNKDIKEYYKLSFKQFTNDQRIFDVAVNNDDTRFIQNLKDILTFGFNPVLLNLHINNIKELIDPYIREEFTSVNDQLPGRINKKGLSMESS

SEQ ID NO: 6542 - protein, 285 aa, Anaeromyces robustus
  CotH
GSSSRIFGRQAFNLKIRGKKDLFGRKQFRIRSDAREATYLRSKLVCDMHNRLGLTSISANYISLYVNDEYIGMYILMDAPKVSWAELEFGDENTGNLYKCKSGGNALTVKSCATGCTNENDEITDTTEWVEFLTAMDNAQSAEDIEDIFDVDQFLYEIAFEYLSGSWDHFVNTGHNFDMYKNPKTGKWTIIYYDFDGELGQDVNSINMFGQGNQDYPSYTFEEYANRKKHIFDILIFNDPTRFENILKNFVTEVFNPATLFPHIDELKKFIKPHIIKDKTPDENG

SEQ ID NO: 6543 - protein, 320 aa, Anaeromyces robustus
  CotH
AGNNSRLYGKPAYNLKIHDDNLYGRKQFKLRADGSEPTYLRTKLVSDIHDRLGIPSISTNYITLYINNKYMGLYLLIDAFKPSWIEKSYGDADTSSLYQCEYLFDFNPAYTDSCFNENKDVEDDSDLFQFLHDVYRAKSSADLENIFEIDHFLTEMAIDYLLGSWDHVHNPTTGHNFYLYKKKNGKWIYLSYDFDLDFGIPRDGYISISFEQFTKQLNIIDVLILKDPTRFEKILKYVVDKVFNPAILFPHIDELKNFIKPYVKADKTPDENGEYPGRLNTKATDLYSLEVWDAASEFTRVKTKYNYTYGLKYWILYRYR

SEQ ID NO: 6544 - protein, 280 aa, Anaeromyces robustus
  CotH
GSSARTYGRQGFNLKIRGKDKLFGRSQFRIRSDARDATTMRSKLACDIHNRLGLVSISANYMQLYINDEYLGFYILMDSPKLPWIEEIYGEKDTPNLYKCKAGGHFLSEETCAVRCENENDDITDKTEWIKFLRALDNAKTPEDIEKVLEVDQFLYEVAYEYLSGAWDHLIRSGHNYSLYKQKSNGKWIIYYYDFDADFGQDIVSIEFGQFNPNPDKNFPNYTYQQWFNVPMNVLNILIFNDPTRFENIIRKIVTDTFNPATLFPHIDEIKKFIQPYIKQ

SEQ ID NO: 6545 - protein, 322 aa, Anaeromyces robustus
  CotH
GKNSRQYYKPGYNIKIRGGKNFHGRNQFKLRADVTEPTRLRSKLALDIYNRSGLLSISANYAILYINDEYMGLYILTDIYKKSWVESVYGEKNTSTLYKCENGSFLSLETVKGCVNENEDVKDNTELIELVKTLDNAKSELDIKNIFDVDYFLHSMAIEYLLGSWDHILNGHNYYMYKPKNGKWLYLTHDFDYDIGYTDTNDYNYKDYSISKFFVEDNPLPFIKILILDNPVRFQYILKEIVENVFNPSILFPHIDELKAFIKPYIELDKTPNENGILPGQWNMNNKDRGIYTLEQWDASSEFTVVQNHVYGLKYWILERYR

SEQ ID NO: 6546 - protein, 305 aa, Anaeromyces robustus
  CotH
GKSSTEFSRPGYNIKIKGSDKTLHGTKNFRLRSDQRDPTYMRTKLSTEVIQKSGLIAVEAGYVELFVNDDYMGFWVISDSIKKNWLKRKFGDEREEVRTLYQCKADGIRFDDGTAKSKCVNSNEDIADYMEPFYTFVDQVNAAKTRADLEKIMDVDNFLKYIAWEYLIGSWDHILGPFGHNIYWYQQPNGKWVYLPYDFDLDLGSCMWDDQFSIKSYFKGEGEIDFPAISFKDFELDHPIIKILVHDDDTRFRELLGDVVSKVFNPDTLLTRIEELKEFVAPYVKNNIETGAGKINKICPKQCLW

SEQ ID NO: 6547 - protein, 303 aa, Anaeromyces robustus
  CotH
GSSSRIYGRQAFNLKIKDKKKDLYGRKQFRIRSDAREATYLRSKLSCDMHNRLNLLSIAANYMLLYINDQYFGIYIIMDAPKESWAKLEFNDENSKNLYKCKNGGAILSGISTANTCKNENDKITENSEWLEFLDRVEKAQSPDEIEDIFDIDQFLYELVFEYLTGSWDHFLNAAHNFSMYKNPKNGKWTIIYYDFDADIGQDVYSIEMDLNPSSNDNDHNKPNVKDYIECTFKEWANKPPQWTNQSRHILDLLVFNNTTRFDNILQKFVKEVFNPSTLYPHIDELKKFIKPHILKDKTPNEN

SEQ ID NO: 6548 - protein, 340 aa, Anaeromyces robustus
  CotH
IGGDFSKNSAKLGYNIKCNSGNLLGRKIFRLRANINDASLMRAKLSCDVLNRLGLPSISANYVRLFINKEFMGLYLLLDAYKTSWIKKVYDDDKEVENLYQCKTMNSDLTTNNIRLCKNANDDYANKTDTLEEFITSINKAESRKDVDDLMNVDNFVKTWIFEWLVGSWDHTLFNGKNYFLYKPVNDKWEVLLYDFDITFGKDLAMVLRGNQNGDASIIPFSEWHRKRYIVDVLIENDEETFIKNLQEVINTAFNPDVLFPHIDALKTWLAPYIKEDRTPVDGKLPGYINDNAMGGFGGFGGKEDTKKVGFTYEEFEENVEDVYINGGVGIKKWIQDRYN

SEQ ID NO: 6549 - protein, 286 aa, Anaeromyces robustus
  CotH
GGTSSREFGKQGYNVKIRGGENLYGRTQLRLRPDVRDASFLRSKLVCDIHNRLGVPSISANYALLYINEEYMGVYVLMDAINLSWIEFEYGDKDTTTLYQCKNTKQNLTLEASSTGCENKNEDVTDNSEWIKFLTALDKANSMEDIDDILDVDLFLTEIAFEYLVGSYDHFTNFGHNFYLYKPKNDKWKIILYDFDSEFGQEVAMGYNRVRKEQNITSSEYYAYSVEQTVRSVQRPLLDVLIFNNSTRFDNILKNYITKVFNPATLFPHIDELKEYIRPYVELDKT

SEQ ID NO: 6550 - protein, 289 aa, Anaeromyces robustus
  CotH
GFSSRFYPRQAFNVKIRNDKLYGRKQFRIRSEAREATFLRSKLFCDINNRLGQPDSVSANYMKMSINGEDLGFYVVMDSLKMTYVKIEHDDPDTTNLIKCGDLHSDLTANSIKSCENENDDNPDMTNFRQLLSTLDRANRVDQFEDIFDVETFMKAVLMEWLTGSWDHYTLYGHNFSMYRPPNGKWEIVLYDFDATFGQDLSSGFMFGTPKGISSNNIDTWTKAKFEDWHGGKHVINVILQDRPEIFRKCLQEIITTAFNPKILFDHIDNLKEFIRPYVEEDKKNLPGR

SEQ ID NO: 6551 - protein, 296 aa, Anaeromyces robustus
  CotH
MRSKIAMELLYQWNMPTLQSTYVELYVNNQYFGLYYLQNSLKPNWIKKFYERPDDEEITDLFNCKKDGANMDLKTVDHCLNANEDYSNYTEPLEEAFSKIEKATSIEELEKIMNVDLFMKNIAFEYLLGSYDHYIIHGHNYFFYRKPDGIWDMILVDFDNEFGNGLFTTWSFILQRDASIDLTKIKFEDMPKPGKKILDVTYFKDQTLFKKALRRLLVTGFNPDFLFKRIDELKKLITLYVEKTLTPNADGTYPGAINKKGQPSSHTLQDFEESFIIDNPKDQINIGLKTWIQKRF

SEQ ID NO: 6552 - protein, 268 aa, Anaeromyces robustus
  CotH
GRSSKDNSKLSYNINIKNGLLFETKNIRLRADSIDPTYIREKLAYDFHKLFELPTINANYARLYINDEFMGFYILRDAIKPKWIQDNFGEKNTKNIYKCHESAVQLFKCENDDEKITDNSDFEEFIEKLQNVKSREELEEFFDVKTFIRWQAARYLFGSLDHDKGKNTVLYMFHNENKKIWVPLHYDFDMNFGNYKIPNAKRTFTEEIANKSNPLYPIYKLLNLDNNNNEELISIMNDMVTSYYNPFIVFPRIDKIKRFIADYVYEDH

SEQ ID NO: 6553 - protein, 294 aa, Anaeromyces robustus
  CotH
GGSISRLGSKPPLNLKIRGKKDLYGRSQFKFRSDDADPSFLRTKLVADIHNRLGVPSVSAGYVTIYINNENMGLYILNDAYKLSWIKSVYEEEDTTSLYKCDNLSQLVPLDSYGCENENEDVEDYTELQEILKLLREAKTVSELEDVFEIDHFLTEMAIDYLLGSWDHTNNLTNEHNFYLYKQPNGKWIYLSFDFSNDFGMVLGNPFGIHPINQTFYEYAKKLDIFDTLIFNDSTRFEGIMKQVMEKVINPATLYSHIDELKQFIKSNLQLEKTSDDKGNYPGRLNKNSQYFYS

SEQ ID NO: 6554 - protein, 340 aa, Anaeromyces robustus
  CotH
GKSSTEFSKPGYNIKIKSGDNKSLHGTKHFRLRSDQRDASMMRSKITTDILQKSGLIAVEVGYTELYINNKYMGFWVVSDSVKSKWIKRKFGNNNNEDIKTLYQCKDDSIRFDDESAKNKCVNAEKSYADYMEPFNNFVDQVNAAKTRADLEKIMDVDNFIKYMAWEWLMGSWDHFLGIYGHNLYWYQQPNGKWVYIPYDHDIELGQDLWTKFYPNKPFNHMEDIDFTNVSFKDFELNHPIIKILIHDDDTIFRELLGDIISRVFNPDTLLIHIDEIKKLISPYVKKDRNNNSSKINKRGKDLGFTYEHFLLNSEYTYINNYIKGFKGYGLKDWIRRRYQ

SEQ ID NO: 6555 - protein, 322 aa, Piromyces finnis
  CotH
GGKSSKSKPKLGYNIKCDKGNLFGRKHFRIRPTVEDASFLRSKLSCDILNRLDVPSISANYARVFFNDRFMGLYIIMDIYKKSWVKQVYDDKKVSTLYQCSTAGSDFTMNNVNICVNGNDDLDGEMQSLEEFITTINKAQTRKDLEDIMNVDYFVQVWIFEWLTGSWDSSLIDGKNYYLYKQITNGKWTILPYDFDSTFGPNMGRGHGSDNVLFENYYNPRYIVDVLTKNDTTTFIKNLQYVLDTAFNPDILFPHIDSLKEWLYPYVEEDRTPINGVYPGFVNKKIPNPDDPYSLEEFIDNIEYSDVGANTGIKKWIEKRYN

SEQ ID NO: 6556 - protein, 336 aa, Piromyces finnis
  CotH
GMYARSNSKVGYNMKFEEKLFGRKSLRLRPDPNDKSYMREKLSSDILNRAGLPSVQASYARLYINNEFFGLYTILDSVKPFMVKKIFKLDDETNAMSLYQCKYDGMDLKVGSESHCINAVTEDNTNLGELQEFISKVNSATSLAQFEEFLDVDLFLKSVIVEWLIGSFDHFLILGHNFNFYKRPTDNKWCIILYDFDNTFGYNLGAGSFNLKNKNRNLGWGFQGFGANNVDYNTLSFKDFNSKVNHKIFQYLIYQDDTRFKSLLKDVLVSAFNPTILGQHIKELKAFLSPYVNEDLTPINGELPGRVNKKGYSSRVTANDFQKSNDLESYIQKRYD

SEQ ID NO: 6557 - protein, 334 aa, Piromyces finnis
  CotH
GRSTKAYSKLGYNINIKKGGLLYGAKQLRLRADVVDPSFLREKLVYDLCTLVDLPTLSANYVRFYINDTFMGLFLLRDAFKSQWVQNNFGEKNTKHIYTCDKTYGKSEFFNCINDDEDIKDDKDWPRFIELLNNSKSREDLEKFFDVNTYIRWQVSRYLFGSWDHKTSTHNNAVYMFHSEYADRDLWIPLLYDFDMDFGSYRTIDPKVKFSEEVVDKNNPLYTLLNLNDESEEVRAVMDDIMRRGFNPNILLPRIDELKKFIDPYIKEDRTVGENGRFPGRMVRMSDKADDHYQYEDFVANTEFTTLKAKQYSGDVQTGSATVLGLKVWVIERF

SEQ ID NO: 6558 - protein, 338 aa, Piromyces finnis
  CotH
TGGNWSRTNDRVGFNIKLKDDDRLFDQKYLRLRPDPTDFTVMRTKLSMELLYRFNVPTLQSAYVEVYVNDIYFGLFLLQSTIKPEWIQQEYELPENVEMKGLFNCKKDSADLNAESKDHCFNAVEEYANYTQPLDEFITSLDNAKSVEELRKVFNVDLFMKNVVFEYLVGSYDHYVTNGHNYFVYQKENGIWDLILNDFDNTFGNNLFVSYVYAMGNDPIDITEAPFEKLVKRKKHLLDLTYFDDKNKTLFKKTLRELLVTGFNEEFLFNRIEEIKKIILPYVKKTITPNDDGTYPGAINLIGQPSVHTLEEFEESFTVTSEDQFKIGLKNWISKRIA

SEQ ID NO: 6559 - protein, 314 aa, Piromyces finnis
  CotH
GKSTTSFSKPGYNIKIKDGKNLHGTKNFRLRSDQRDVSMMRSKITTDILQKSGLIAVETGYTELYVNDEYMGLWVISDSIKNHWIKRKFGDNGEEIKTLYECNGDVIRFDDGSAKTKCINKNDEYSDYMEPFNTFVDQVNAAKTRQDLEEIMDVDNFIKYMAWEWLMGSFDHFLSYYGHNLCWYKQPNDKWIYIPYDHDIEMGQDEYIGFYPNRTFNHGNDIDFTNLSFKEFELDHPIIQVLINDDDTVFRELLDDIISKVFNPDTLLLHIDEVRSLIGPYVKKDRESGAGKINKIGKDTRFTYDHFLLNTEYT

SEQ ID NO: 6560 - protein, 180 aa, Piromyces finnis
  CotH
YMAWEYITLSWDHFIGIFGHNIYWFKQPNGKWVYIPYDYDLELGQDLWVANFPGRPFYIGGGDIDFTNISFEDYELNHPILKILIRDDDTFFRECIGDIISKIFNPDILLIHIDEIRNLISPYVKRDRDLGAGKINNSGKDISYSYQHFIDNSEYKYLFDYKGSTRGYGLKDWIRRRYSY

SEQ ID NO: 6561 - protein, 196 aa, Piromyces finnis
  CotH
DLEEFFDTELFLRWEALKYLLGSWDHMTNYHNKNIYMFHNNYTNKDRWMVLLYDFDSDFGAYKKPNPENTFNTEIYEKSHPLHKLLNVTDSNEEIIQYMAEFMMNGFNPKELFQRIDELTEFLAPYIKEDRTPDKNGKLPGRVPRSLNKIEDSFSYGDFRNNTEFTKLKLKKYDSDTSSSSEYIYGIKQWVLERFR

SEQ ID NO: 6562 - protein, 287 aa, Piromyces finnis
  CotH
TSGNFSKSFTKPGFNIELSEKYKQRKIFRLRTDSSDVSHIRQKVVCDIANRVGLPSIQSTFVRLTINGKLFGLFGLMDSLKPYNIKRMYNTKTDKKDLKLIQCKDMGFRFTSDTVNICSSDGGDESAFEEFKQFVAEVEKANSLEDLEKIMNVDIFLKYFALEWVIGSFDHMLVLGHNFYFYKNEINNKWDVIYYDFDNTLGQAQRVDWAWSSGKNQGVEDYTTLTFEEFTDNQRIFDIAVNKDDTRFKKNLKELLTFGYNPVLLNEHIDDLKSYISPYVKEEYTPI

SEQ ID NO: 6563 - protein, 287 aa, Piromyces finnis
  CotH
GSTSRHFAKQGFNLKIRGKEDLYGRTNIRLRPDFREPTFLRSKLACDIQNRIGVPSISANFARLYINDNFMGLYVLLDAFKLSWIEAVYGEKDSTSLIQCKYMDNNLTYKYSINGCINENDEVTDKTEWADFLTALDDAQTPEEIEKVLDVDIFLKNVAYEFLAGSWDHYLSYGHNFYLYKPQNSNVWKLLEYDFDSEFGCDTSQGIGGPGAVITNFNFAEYPLEKWHKSRHLLDVLVYQNSTRFENILKQQVKEVFNPAVIFPHIDKLKEFIKPYVIEDFTPDENG

SEQ ID NO: 6564 - protein, 123 aa, Piromyces finnis
  CotH
VKVRGNWTSNYVKKGLRISFDESQSMLGLNEGHKFKNWVLLAEYKDGSMLRNKSSFDLSRGLLNPDGYYSSDGTLVELQINNEYFGVYLLAEQQQINEHRVKITKGEENYTGTDIGYLLEYDT

SEQ ID NO: 6565 - protein, 228 aa, Piromyces finnis
  CotH
QAQNDFISNFVNNAYKIMYEASYNQKTLKFNNNYSDVVDAPELTPRQAIENVLEPESLADLFIISEMTCDADLYYSSFYLDVDFGPNGSKKLRFEAPWDFDSGLGNKDRCANGQGHFAANIIPDNGNMGGQKINPWLAVIMYEDWYQELIRSRWTKAYDSGVLNKIVDMIHTQTQVASAAFDRNYAKWNNIIQNQSFVSELSPGAKQCKTQKEAANYLADWFESRIAF

SEQ ID NO: 6566 - protein, 124 aa, Piromyces finnis
  CotH
VKVRGNWTSNYVKKGLRISFDESQSMLGLNEGHKFKNWVLLAEYKDGSMLRNKSSFDLSRGLLNPDGYYSSDGTLVELQINNEYFGVYLLAEQQQINEHRVKITKGEENYTGTDIGYLLEYDTG

SEQ ID NO: 6567 - protein, 293 aa, Piromyces finnis
  CotH
GKSSPEFSKPGYNIKIKGDKQTLHGTKNFRLRSDQREASMMRSKITTDILQKSGLIAIEVGYTELYVNDEYMGFWVISDSIKSKWIKRKFGDESKDIKTLYQCKNDGIRFNDGSAKKKCVNANSEYTDYMEPFNNFVDQVNAATTREDLEKIMDVDNFMKYMAWEWLMGTWDHFLGPYGHNLYWYQQPNGKWVYIPYDHDIELGQDLWTSFFKNKAYNKGSDIDFSNVSFKDFELDHPIIKILVHNDDTRFRELLGDIISKVFNPDTILAHIDDVKELISPYVKKDRETNAGR

SEQ ID NO: 6568 - protein, 265 aa, Piromyces finnis
  CotH
GKYTRAFEKQQYNIKINNGELFGRQQIRLRSEVVDPSFIRSKLGYDLCNVLDIPSVEATYTIVYINDDNMGLYLLRDVPKSQWFEYNFGISNSTYVYECDSKYGTSKYFNCMNDATEEEGDANIQALNAKFEKAKNAEEISQFFDTDLYIKWQAYKYLTGSWDHVTPQHNQYLFYNEINGKWMNFLYDFDSDFGAYKKPDPNLSFTEESLEMTLPLYQKLELNNHNTQLVNTIKEFVINGFNPVKLIPRINELLDYLYPYVLEDR

SEQ ID NO: 6569 - protein, 337 aa, Piromyces finnis
  CotH
GQYSRQLSKPNFNLKIRGKKDLYGRSQFKLRSDFAEPTFLRSKLTSDIHNRLGLVSISANYVTLYINNENMGLFVLTDAIKKSWIKYIYDEDETTSLYQCGSSNLSIRLGYGCRNENDDVKDYSEWMNFLLKLDQAQTASDIEDIFDVDHFLTEMVIEYLIGGWDHIQQIGHNFYMYKEPNGKWKYITYDFDQEFGINIDRVFVGYILEDLPEHYLRRKTDYVNYSFSDWTVHHHIIEILILNNPSRFEKILKNVIEKVFNPATLFPHIDELKEFIKPYVMMDKTPDENGYYPGRINYSAEETYSLAQWDANSEFTMVDTIQYNAYGIKYWILAKYR

SEQ ID NO: 6570 - protein, 112 aa, Piromyces finnis
  CotH
WDHYLNFGHNFYMYKPKNDKWKFLLYDFDGEIGQDVSLASGFGKQNVNTDYPSYSFAEWTKQRHLIDILILKDSTRFDNILRNFVTEVFNPATLFPRIDELKEFIRPYVELD

SEQ ID NO: 6571 - protein, 196 aa, Piromyces finnis
  CotH
GDKDTTHLFKCKSGGLTLTSSTSNCENENDEATDRSEWNSFISNLDRANSASEADRFFDVDQFLYEMAYEYLSGSWDHYLNTGHNFAVYKKPDNYGGKWTMVHYDFDGDFGQDVCAVEFAGSINSNKDYPSWSFEDWSTKKSHLLDICIKKDRTRFNKVMQKFVEEAFNPDLLFPHIDDLKDMIRPYIKKDKTPGS

SEQ ID NO: 6572 - protein, 269 aa, Piromyces finnis
  CotH
GKYTKIFEKLGYNIKVKKGEFLERKQLRLRTEAVDPSFLREKLAYDICNVVGLPSLSANYVRVFFNEKYMGLYVLRDAFKSQWIEYTFGEKSTKHLYTCDRKYGDNSYFNCINDDETITEDKDWENFLIRLAETKTREELEEFFDVKTFIKWQALKYLFGSWDHITNAHNQVLYMYHDTSNDRDMWIPLLYDFDSEFGAYKDIKTNRSFDEEALDSPNPLYKLLKLHDDNEELLSYIDEIMRKAFNPGNLFARIDQLKEFLSPYVKEDR

SEQ ID NO: 6573 - protein, 331 aa, Piromyces finnis
  CotH
GKYTKSFEKLGYNIKIKKGQLFERKQLRLRSEAVDPSFLREKLAYDICNLVELPSLSLNYAEVYINKKFMGLFALRDAFKSQWIEYTFGEKGTDHLYTCDRSHGNNEFFNCINDDEEITNDSTFKEFQDRLAKTKTREELEEFFDVKTFMQWQALKYLFGSWDHITNAHNSYLYMYQNEFTGKSMWIPLLYDFDSEFGAYKNANPRKTFDNSIYDRLNPLFDILNIKESNPEIIGYMSDIMKKAFNPKKLLPRIDKLKEFIAPYIKKDRTPDADGNLQGRVKRVNIKIEDYFTYNDFEKNSEFTKITLRKYQSKYFSTDDYILGLKQWIIE

SEQ ID NO: 6574 - protein, 331 aa, Piromyces finnis; identical to SEQ ID NO: 6573
  CotH

SEQ ID NO: 6575 - protein, 269 aa, Piromyces finnis
  CotH
GKYTKSFEKLGYNIKIKKGQLFERKQLRLRSEAVDPSFLREKLAYDICNLVELPSLSLNYAEVYINKKFMGLFALRDAFKSQWIEYTFGEKGTDHLYTCDRSHGNNEFFNCINDDEEITNDSTFKEFQDRLAKTKTREELEEFFDVKTFMQWQALKYLFGSWDHITNAHNSYLYMYQNEFTGKSMWIPLLYDFDSEFGAYKDIKTNRSFDEEALDSPNPLYKLLKLHDDNEELLSYIDEIMRKAFNPGNLFARIDQLKEFLSPYVKEDR

SEQ ID NO: 6576 - protein, 269 aa, Piromyces finnis
  CotH
GKYTKNFEKLGYNIKIKKGLLFDRKQLRLRSEAVDPSFLREKLAYDICNILELPSLSSNFARFYLNDEFMGLYSLRDAYKSQWIEYTFGEKSTKHLYTCDRKYGDNSYFNCINDDETITEDKDWENFLIRLAETKTREELEEFFDVKTFIKWQALKYLFGSWDHITNAHNQVLYMYHDTSNDRDMWIPLLYDFDSEFGAYKDIKTNRSFDEEALDSPNPLYKLLKLHDDNEELLSYIDEIMRKAFNPGNLFARIDQLKEFLSPYVKEDR

SEQ ID NO: 6577 - protein, 331 aa, Piromyces finnis
  CotH
GKYTKNFEKLGYNIKIKKGLLFDRKQLRLRSEAVDPSFLREKLAYDICNILELPSLSSNFARFYLNDEFMGLYSLRDAYKSQWIEYTFGEKSTKHLYTCDRKYGDNSYFNCINDDETITEDKDWENFLIRLAETKTREELEEFFDVKTFIKWQALKYLFGSWDHITNAHNQVLYMYHDTSNDRDMWIPLLYDFDSEFGAYKNANPRKTFDNSIYDRLNPLFDILNIKESNPEIIGYMSDIMKKAFNPKKLLPRIDKLKEFIAPYIKKDRTPDADGNLQGRVKRVNIKIEDYFTYNDFEKNSEFTKITLRKYQSKYFSTDDYILGLKQWIIE

SEQ ID NO: 6578 - protein, 331 aa, Piromyces finnis
  CotH
GRSTKQYEKLGFNIKIKKGKLYDRKQIRLRTEAVDPSFIREKLIYDMANILEIPSLSLNYCKVYFNDKFMGFYAMRDSFKSQWIEYTFGEKGTDHLYTCDRSHGNNEFFNCINDDEEITNDSTFKEFQDRLAKTKTREELEEFFDVKTFMQWQALKYLFGSWDHITNAHNSYLYMYQNEFTGKSMWIPLLYDFDSEFGAYKNANPRKTFDNSIYDRLNPLFDILNIKESNPEIIGYMSDIMKKAFNPKKLLPRIDKLKEFIAPYIKKDRTPDADGNLQGRVKRVNIKIEDYFTYNDFEKNSEFTKITLRKYQSKYFSTDDYILGLKQWIIE

SEQ ID NO: 6579 - protein, 331 aa, Piromyces finnis
  CotH
GKYTKIFEKLGYNIKVKKGEFLERKQLRLRTEAVDPSFLREKLAYDICNVVGLPSLSANYVRVFFNEKYMGLYVLRDAFKSQWIEYTFGEKSTKHLYTCDRKYGDNSYFNCINDDETITEDKDWENFLIRLAETKTREELEEFFDVKTFIKWQALKYLFGSWDHITNAHNQVLYMYHDTSNDRDMWIPLLYDFDSEFGAYKNANPRKTFDNSIYDRLNPLFDILNIKESNPEIIGYMSDIMKKAFNPKKLLPRIDKLKEFIAPYIKKDRTPDADGNLQGRVKRVNIKIEDYFTYNDFEKNSEFTKITLRKYQSKYFSTDDYILGLKQWIIE

SEQ ID NO: 6580 - protein, 269 aa, Piromyces finnis; identical to SEQ ID NO: 6575
  CotH

SEQ ID NO: 6581 - protein, 269 aa, Piromyces finnis
  CotH
GRSTKQYEKLGFNIKIKKGKLYDRKQIRLRTEAVDPSFIREKLIYDMANILEIPSLSLNYCKVYFNDKFMGFYAMRDSFKSQWIEYTFGEKGTDHLYTCDRSHGNNEFFNCINDDEEITNDSTFKEFQDRLAKTKTREELEEFFDVKTFMQWQALKYLFGSWDHITNAHNSYLYMYQNEFTGKSMWIPLLYDFDSEFGAYKDIKTNRSFDEEALDSPNPLYKLLKLHDDNEELLSYIDEIMRKAFNPGNLFARIDQLKEFLSPYVKEDR

SEQ ID NO: 6582 - protein, 285 aa, Piromyces finnis
  CotH
GSSSRNYARQAFNLKIRGKNDLYGRQQFRIRSEAREATYLRSKLACDLHNRLGLTSISANYITLYVNNEYWGFYVLMDAPKPSWAELEFGDKDTTHLFKCKSGGLTLTSSTSNCENENDEATDRSEWNSFISNLDRANSASEADRFFDVDQFLYEMAYEYLSGSWDHYLNTGHNFAVYKKPDNYGGKWTMVHYDFDGDFGQDVCAVEFAGSINSNKDYPSWSFEDWSTKKSHLLDICIKKDRTRFNKVMQKFVEEAFNPDLLFPHIDDLKDMIRPYIKKDKTPGS

SEQ ID NO: 6583 - protein, 285 aa, Piromyces finnis; identical to SEQ ID NO: 6582
  CotH

SEQ ID NO: 6584 - protein, 322 aa, Piromyces finnis
  CotH
AGHYTRYYSKPGYNIKLENGSLFDVKTLRLRSMANDVSFMREKLSCDMLYKMGVPTTSANYVNVEINNENVGLYVITDKVKKDMIKRYFNEKNTDNFYECQNIAVRFEDNSIANECVNSKEELANYKDDLQKLVDAVNLAKTIDDIKDIIDVDSFLKVIAFEYILLANDNFLLYGHNFYLYKKQDGKWIMILNDFNRTFAQDIWVNNFEGDDRYIKKHYFPDLQRINLPNISIRDMDLGHKIVKLLIHDDDTRFREILGEIVKEIFNPKILNARIDDIADLIRDDLAISREVQEDGYPIGSFNTPGMNPLWNMTQFEDCINY

SEQ ID NO: 6585 - protein, 64 aa, Anaeromyces robustus
  Cystine-knot_cytokine
KTKFEVALKNYGLNESDISSSALSYTPKSFDYCNGSCNNTKDDDDNSTNNNNNTNNNTNNNTNN

SEQ ID NO: 6586 - protein, 100 aa, Neocallimastix californiae
  CYTH-like phosphatases
EIERKWLLDKEKIPYDLTTNFIGIAFKIKQTYICFDPEIRVREYTSVSNNGLSYEMTIKTNLTEDGLIRDEVNIPINKEQYDNMIKKQEGNVIYKTRYQL

SEQ ID NO: 6587 - protein, 154 aa, Anaeromyces robustus
  CYTH-like phosphatases
EIEKKWLIDKEKIPYDLSAITVLKADIKQTYICFDPEIRVREYTDETPDHTYEMTIKTNLSEDGLIRDETNIDLNQEQYNNMAKKQEGNVIYKTRYQLLDNHEILAIDIFHGDLDGLAYLEIEFSTKEESDAYKTPDWAIKDVTNDIRYKNGHL

SEQ ID NO: 6588 - protein, 99 aa, Neocallimastix californiae
  CYTH-like_domain
KEIERKWLLDKEKIPYDLTTNFIGIAFKIKQTYICFDPEIRVREYTSVSNNGLSYEMTIKTNLTEDGLIRDEVNIPINKEQYDNMIKKQEGNVIYKTRY

SEQ ID NO: 6589 - protein, 157 aa, Anaeromyces robustus
  CYTH-like_domain
KEIEKKWLIDKEKIPYDLSAITVLKADIKQTYICFDPEIRVREYTDETPDHTYEMTIKTNLSEDGLIRDETNIDLNQEQYNNMAKKQEGNVIYKTRYQLLDNHEILAIDIFHGDLDGLAYLEIEFSTKEESDAYKTPDWAIKDVTNDIRYKNGHLAR

SEQ ID NO: 6590 - protein, 30 aa, Neocallimastix californiae; identical to SEQ ID NO: 3973
  Dockerin_dom

SEQ ID NO: 6591 - protein, 37 aa, Neocallimastix californiae
  Dockerin_dom
ECWAKKLGYSCCTSTSRVEYTDNDGKWGIENGNWCGI

SEQ ID NO: 6592 - protein, 32 aa, Neocallimastix californiae
  Dockerin_dom
AYQCCNSCTTTYTDNDGRWGYENGDWCGIKYS

SEQ ID NO: 6593 - protein, 41 aa, Neocallimastix californiae
  Dockerin_dom
CWAQSQGYKCCDNPGSTKVEFSDGSGQWGIQNGDWCGIDYS

SEQ ID NO: 6594 - protein, 31 aa, Neocallimastix californiae
  Dockerin_dom
YPCCNTCTATYTDGEGKWAIENGNWCGIKNS

SEQ ID NO: 6595 - protein, 39 aa, Neocallimastix californiae
  Dockerin_dom
NANVIAQGYNCCKSCGTVYFEDGDGKWGVENNNWCGMPL

SEQ ID NO: 6596 - protein, 39 aa, Neocallimastix californiae
  Dockerin_dom
PASITRQGYKCCRVGCTVEYTDNDGEWGVEDGDWCGCGK

SEQ ID NO: 6597 - protein, 38 aa, Neocallimastix californiae
  Dockerin_dom
CSAAITAQGYKCCSNNCEVVYSDDDGDWGVENNQWCGC

SEQ ID NO: 6598 - protein, 37 aa, Neocallimastix californiae
  Dockerin_dom
ITNQGYKCCSTCGTVYYTDADGDWGVENNDWCGMPTN

SEQ ID NO: 6599 - protein, 40 aa, Neocallimastix californiae
  Dockerin_dom
PASITNQGYPCCSSCGTVYYTDNDGLWGVENNDWCGMPTD

SEQ ID NO: 6600 - protein, 38 aa, Neocallimastix californiae
  Dockerin_dom
CSAAITAQGYKCCSANCVVEYTDADGDWGVENGQWCGC

SEQ ID NO: 6601 - protein, 38 aa, Neocallimastix californiae; identical to SEQ ID NO: 3985
  Dockerin_dom

SEQ ID NO: 6602 - protein, 37 aa, Neocallimastix californiae
  Dockerin_dom
ITNQGYKCCSSCSTVYYSDNDGDWGVENNDWCGMPTS

SEQ ID NO: 6603 - protein, 40 aa, Neocallimastix californiae
  Dockerin_dom
PASITNQGYKCCSSCSTVYYTDNDGAWGVENNDWCGMPTN

SEQ ID NO: 6604 - protein, 38 aa, Neocallimastix californiae; identical to SEQ ID NO: 3987
  Dockerin_dom

SEQ ID NO: 6605 - protein, 37 aa, Neocallimastix californiae; identical to SEQ ID NO: 6602
  Dockerin_dom

SEQ ID NO: 6606 - protein, 38 aa, Neocallimastix californiae; identical to SEQ ID NO: 3985
  Dockerin_dom

SEQ ID NO: 6607 - protein, 25 aa, Neocallimastix californiae
  Dockerin_dom
CWSEKLGYPCCQNTSSVVYTDNDGN

SEQ ID NO: 6608 - protein, 40 aa, Neocallimastix californiae
  Dockerin_dom
NSCFSVNLGYSCCNGCEVAYTDSDGKWGVENGNWCGIKSS

SEQ ID NO: 6609 - protein, 38 aa, Neocallimastix californiae; identical to SEQ ID NO: 3993
  Dockerin_dom

SEQ ID NO: 6610 - protein, 37 aa, Neocallimastix californiae
  Dockerin_dom
QSCWSESLGFPCCQNTKEVYYTDNDGNWGVENNNWCG

SEQ ID NO: 6611 - protein, 40 aa, Neocallimastix californiae; identical to SEQ ID NO: 3994
  Dockerin_dom

SEQ ID NO: 6612 - protein, 38 aa, Neocallimastix californiae
  Dockerin_dom
PASITRQGYKCCRVGCTVEYTDNDGEWGVEDGDWCGCG

SEQ ID NO: 6613 - protein, 39 aa, Neocallimastix californiae; identical to SEQ ID NO: 3996
  Dockerin_dom

SEQ ID NO: 6614 - protein, 37 aa, Neocallimastix californiae; identical to SEQ ID NO: 3997
  Dockerin_dom

SEQ ID NO: 6615 - protein, 38 aa, Neocallimastix californiae
  Dockerin_dom
CWANAYGYDCCVDGTLTYLEDETGKWGVTSDYQWCGIK

SEQ ID NO: 6616 - protein, 42 aa, Neocallimastix californiae
  Dockerin_dom
ACWAEALGYKCCTPGAYTPVLLTDESGDWSAENGEWCGLLKS

SEQ ID NO: 6617 - protein, 36 aa, Neocallimastix californiae
  Dockerin_dom
CFAKSDGYDCCFDNEVVYEDETGKWGINDEGEWCGV

SEQ ID NO: 6618 - protein, 28 aa, Neocallimastix californiae
  Dockerin_dom
PCCSGNDVVYTDNDGKWGVENGNWCGIA

SEQ ID NO: 6619 - protein, 39 aa, Neocallimastix californiae; identical to SEQ ID NO: 4001
  Dockerin_dom

SEQ ID NO: 6620 - protein, 42 aa, Neocallimastix californiae
  Dockerin_dom
NKCISEFLGYPCCSSSNTPVYYKDDDGDWGIDSATGDWCGIT

SEQ ID NO: 6621 - protein, 40 aa, Neocallimastix californiae; identical to SEQ ID NO: 4003
  Dockerin_dom

SEQ ID NO: 6622 - protein, 38 aa, Neocallimastix californiae
  Dockerin_dom
SCWSTKLGYPCCKKTCTAIEKDNDGAWAIEGSHWCGIP

SEQ ID NO: 6623 - protein, 42 aa, Neocallimastix californiae
  Dockerin_dom
NKCVSEFLGYPCCSSSNTLVYYKDDDGDWGVDPATGDWCGIT

SEQ ID NO: 6624 - protein, 39 aa, Neocallimastix californiae; identical to SEQ ID NO: 4007
  Dockerin_dom

SEQ ID NO: 6625 - protein, 39 aa, Neocallimastix californiae
  Dockerin_dom
ECWSNKFGYPCCDTCDVFLTDESGDWGVKDLDWCGVPST

SEQ ID NO: 6626 - protein, 39 aa, Neocallimastix californiae; identical to SEQ ID NO: 4010
  Dockerin_dom

SEQ ID NO: 6627 - protein, 39 aa, Neocallimastix californiae
  Dockerin_dom
TCWSESLGYPCCSSNTGVAYIDNDGEWGVENGGWCGIKG

SEQ ID NO: 6628 - protein, 38 aa, Neocallimastix californiae; identical to SEQ ID NO: 4011
  Dockerin_dom

SEQ ID NO: 6629 - protein, 40 aa, Neocallimastix californiae; identical to SEQ ID NO: 4012
  Dockerin_dom

SEQ ID NO: 6630 - protein, 38 aa, Neocallimastix californiae; identical to SEQ ID NO: 4014
  Dockerin_dom

SEQ ID NO: 6631 - protein, 39 aa, Neocallimastix californiae; identical to SEQ ID NO: 4013
  Dockerin_dom

SEQ ID NO: 6632 - protein, 21 aa, Neocallimastix californiae
  Dockerin_dom
NCWATKLGYPCCKTTTTTEYT

SEQ ID NO: 6633 - protein, 30 aa, Neocallimastix californiae
  Dockerin_dom
YPCCSDPNTTPIETDDSGEWGLENGDWCGI

SEQ ID NO: 6634 - protein, 39 aa, Neocallimastix californiae
  Dockerin_dom
CWSMKLNPPIPCCTGKDLKVIEEDSNGKWSEENGEKCGI

SEQ ID NO: 6635 - protein, 42 aa, Neocallimastix californiae; identical to SEQ ID NO: 4017
  Dockerin_dom

SEQ ID NO: 6636 - protein, 33 aa, Neocallimastix californiae
  Dockerin_dom
YPCCSDPNTTPIEIDGSGEWGVENGEWCGIRKN

SEQ ID NO: 6637 - protein, 41 aa, Neocallimastix californiae
  Dockerin_dom
CWSLELANPFPCCSDPNATVEYTNDKGDWGVENGQWCGIIK

SEQ ID NO: 6638 - protein, 43 aa, Neocallimastix californiae
  Dockerin_dom
SCWASGLGYKCCSGCDVILSDSNGKWGFDFETNDWCGIIESKC

SEQ ID NO: 6639 - protein, 36 aa, Neocallimastix californiae; identical to SEQ ID NO: 4020
  Dockerin_dom

SEQ ID NO: 6640 - protein, 39 aa, Neocallimastix californiae; identical to SEQ ID NO: 4021
  Dockerin_dom

SEQ ID NO: 6641 - protein, 38 aa, Neocallimastix californiae; identical to SEQ ID NO: 4025
  Dockerin_dom

SEQ ID NO: 6642 - protein, 39 aa, Neocallimastix californiae; identical to SEQ ID NO: 4024
  Dockerin_dom

SEQ ID NO: 6643 - protein, 27 aa, Neocallimastix californiae
  Dockerin_dom
SCWASGLGYKCCSGCDVILSDSNGKWA

SEQ ID NO: 6644 - protein, 37 aa, Neocallimastix californiae; identical to SEQ ID NO: 4026
  Dockerin_dom

SEQ ID NO: 6645 - protein, 38 aa, Neocallimastix californiae
  Dockerin_dom
ACWSTSLGYPCCSSSSAQVYYTDNDGKWGVENNDWCGI

SEQ ID NO: 6646 - protein, 39 aa, Neocallimastix californiae; identical to SEQ ID NO: 4028
  Dockerin_dom

SEQ ID NO: 6647 - protein, 39 aa, Neocallimastix californiae
  Dockerin_dom
SCWAAAEGYPCCTSTTTVEIVDSKGKWGIENGNWCGIVE

SEQ ID NO: 6648 - protein, 41 aa, Neocallimastix californiae
  Dockerin_dom
SCWASSQGYNCCSGCDPILTDGSGKWGFENGNWCGIIESKC

SEQ ID NO: 6649 - protein, 36 aa, Neocallimastix californiae
  Dockerin_dom
ASKDGYPCCKGCSVVDQDGSGKWGIENGNWCGIDSS

SEQ ID NO: 6650 - protein, 40 aa, Neocallimastix californiae
  Dockerin_dom
PCWSEKLGYKCCSTCTQVYYNDQDGSWGVENNDWCGIPTN

SEQ ID NO: 6651 - protein, 38 aa, Neocallimastix californiae
  Dockerin_dom
CWATSLGYKCCSNPNTESVYEDESGEWGVENNDWCGIV

SEQ ID NO: 6652 - protein, 40 aa, Neocallimastix californiae
  Dockerin_dom
SCWSIALGYPCCEVNDFVVQTDENGDWSVENNDWCGIKNS

SEQ ID NO: 6653 - protein, 39 aa, Neocallimastix californiae
  Dockerin_dom
DCWSTVLGYPCCEVNDFIVNTDEYGSWSVENNDWCGIKN

SEQ ID NO: 6654 - protein, 42 aa, Neocallimastix californiae
  Dockerin_dom
KCFSLNLGYPCCENDSDDNIIFTDENGDWGIENNNWCGIGKS

SEQ ID NO: 6655 - protein, 40 aa, Neocallimastix californiae; identical to SEQ ID NO: 4037
  Dockerin_dom

SEQ ID NO: 6656 - protein, 36 aa, Neocallimastix californiae; identical to SEQ ID NO: 1486
  Dockerin_dom

SEQ ID NO: 6657 - protein, 39 aa, Neocallimastix californiae
  Dockerin_dom
ECFSIALGYPCCKGNDIVYTDDDGNWGVENNEWCGINDS

SEQ ID NO: 6658 - protein, 36 aa, Neocallimastix californiae; identical to SEQ ID NO: 4039
  Dockerin_dom

SEQ ID NO: 6659 - protein, 38 aa, Neocallimastix californiae; identical to SEQ ID NO: 4042
  Dockerin_dom

SEQ ID NO: 6660 - protein, 40 aa, Neocallimastix californiae; identical to SEQ ID NO: 4041
  Dockerin_dom

SEQ ID NO: 6661 - protein, 36 aa, Neocallimastix californiae; identical to SEQ ID NO: 1493
  Dockerin_dom

SEQ ID NO: 6662 - protein, 38 aa, Neocallimastix californiae; identical to SEQ ID NO: 4044
  Dockerin_dom

SEQ ID NO: 6663 - protein, 40 aa, Neocallimastix californiae
  Dockerin_dom
NCWARSLGYNCCSTSTCRNAQFSDNDGQWDIENGNWCGIA

SEQ ID NO: 6664 - protein, 38 aa, Neocallimastix californiae
  Dockerin_dom
NCWAKALGYPCCTQATEVVYTDSNGQWGIQNNDWCGKP

SEQ ID NO: 6665 - protein, 37 aa, Neocallimastix californiae; identical to SEQ ID NO: 4047
  Dockerin_dom

SEQ ID NO: 6666 - protein, 34 aa, Neocallimastix californiae; identical to SEQ ID NO: 1499
  Dockerin_dom

SEQ ID NO: 6667 - protein, 33 aa, Neocallimastix californiae
  Dockerin_dom
GYKCCTQSNPTVVYTDASGEWAVENGDWCIIKK

SEQ ID NO: 6668 - protein, 38 aa, Neocallimastix californiae
  Dockerin_dom
DCFAKALGYECCNDNEIVTSDESGDWGVKDGEWCGIGG

SEQ ID NO: 6669 - protein, 31 aa, Neocallimastix californiae
  Dockerin_dom
YPCCNECDVVYTDDSGDWGIENNDWCLLKKS

SEQ ID NO: 6670 - protein, 33 aa, Neocallimastix californiae
  Dockerin_dom
EGYSKCSNCDVQYSDGSGDWGVENGDWCGISSK

SEQ ID NO: 6671 - protein, 40 aa, Neocallimastix californiae
  Dockerin_dom
NSCFSVNLGYSCCNGCEVVYTDSDGKWGVENGNWCGIKSS

SEQ ID NO: 6672 - protein, 36 aa, Neocallimastix californiae; identical to SEQ ID NO: 1503
  Dockerin_dom

SEQ ID NO: 6673 - protein, 40 aa, Neocallimastix californiae; identical to SEQ ID NO: 6671
  Dockerin_dom

SEQ ID NO: 6674 - protein, 36 aa, Neocallimastix californiae; identical to SEQ ID NO: 1503
  Dockerin_dom

SEQ ID NO: 6675 - protein, 30 aa, Neocallimastix californiae
  Dockerin_dom
YPCCVGSKVIETDKQGDWGYEDNHWCGIVK

SEQ ID NO: 6676 - protein, 41 aa, Neocallimastix californiae
  Dockerin_dom
DCWSTVLGYDCCKGCHVYEEDTDGKWGYENKKWCGIDDEVC

SEQ ID NO: 6677 - protein, 30 aa, Neocallimastix californiae
  Dockerin_dom
YPCCKGNDIITTDSQGDWGYEDKHWCGIIK

SEQ ID NO: 6678 - protein, 30 aa, Neocallimastix californiae; identical to SEQ ID NO: 6675
  Dockerin_dom

SEQ ID NO: 6679 - protein, 41 aa, Neocallimastix californiae; identical to SEQ ID NO: 6676
  Dockerin_dom

SEQ ID NO: 6680 - protein, 30 aa, Neocallimastix californiae; identical to SEQ ID NO: 6677
  Dockerin_dom

SEQ ID NO: 6681 - protein, 36 aa, Neocallimastix californiae; identical to SEQ ID NO: 4065
  Dockerin_dom

SEQ ID NO: 6682 - protein, 41 aa, Neocallimastix californiae
  Dockerin_dom
SCWAEAEGFRCCKGCEAIYIDGDKRWGVENMEWCGIIESNC

SEQ ID NO: 6683 - protein, 38 aa, Neocallimastix californiae; identical to SEQ ID NO: 4064
  Dockerin_dom

SEQ ID NO: 6684 - protein, 40 aa, Neocallimastix californiae; identical to SEQ ID NO: 4066
  Dockerin_dom

SEQ ID NO: 6685 - protein, 38 aa, Neocallimastix californiae; identical to SEQ ID NO: 4067
  Dockerin_dom

SEQ ID NO: 6686 - protein, 40 aa, Neocallimastix californiae; identical to SEQ ID NO: 4068
  Dockerin_dom

SEQ ID NO: 6687 - protein, 38 aa, Neocallimastix californiae; identical to SEQ ID NO: 4069
  Dockerin_dom

SEQ ID NO: 6688 - protein, 34 aa, Neocallimastix californiae
  Dockerin_dom
CFGYKCCETCEVQYSDDTGSWGIENNDWCGIPDS

SEQ ID NO: 6689 - protein, 28 aa, Neocallimastix californiae
  Dockerin_dom
YPTCSANIEIAYVDDRIWGIENGDWCII

SEQ ID NO: 6690 - protein, 36 aa, Neocallimastix californiae; identical to SEQ ID NO: 4073
  Dockerin_dom

SEQ ID NO: 6691 - protein, 39 aa, Neocallimastix californiae; identical to SEQ ID NO: 4072
  Dockerin_dom

SEQ ID NO: 6692 - protein, 34 aa, Neocallimastix californiae
  Dockerin_dom
GYPCCDKTTEVVYEDEDGKWGVQNGDEWCLIKEN

SEQ ID NO: 6693 - protein, 35 aa, Neocallimastix californiae
  Dockerin_dom
AQEYGECTSCVVQYKDQDGNWGYENDDWCLINDKK

SEQ ID NO: 6694 - protein, 38 aa, Neocallimastix californiae
  Dockerin_dom
ECWSKALGYPCCTTTKEVVYTDESGKWGLEGNDEWCGI

SEQ ID NO: 6695 - protein, 32 aa, Neocallimastix californiae
  Dockerin_dom
YPCCSSCTVVYNDSDGDWGVENGNWCKIKADK

SEQ ID NO: 6696 - protein, 36 aa, Neocallimastix californiae; identical to SEQ ID NO: 4079
  Dockerin_dom

SEQ ID NO: 6697 - protein, 39 aa, Neocallimastix californiae
  Dockerin_dom
TCTGKSEGYKCCDNCDVVYTDDSGAWGIMNGDWCGIKST

SEQ ID NO: 6698 - protein, 34 aa, Neocallimastix californiae; identical to SEQ ID NO: 4082
  Dockerin_dom

SEQ ID NO: 6699 - protein, 31 aa, Neocallimastix californiae; identical to SEQ ID NO: 4081
  Dockerin_dom

SEQ ID NO: 6700 - protein, 38 aa, Neocallimastix californiae; identical to SEQ ID NO: 4080
  Dockerin_dom

SEQ ID NO: 6701 - protein, 37 aa, Neocallimastix californiae; identical to SEQ ID NO: 4083
  Dockerin_dom

SEQ ID NO: 6702 - protein, 38 aa, Neocallimastix californiae
  Dockerin_dom
TCWSLKLGYPCCQNTNVVYYTDDDGDWSVENNDWCGIV

SEQ ID NO: 6703 - protein, 37 aa, Neocallimastix californiae
  Dockerin_dom
CWSTALGYPCCKNSSIVYFTDNDGKWSVENNDWCGII

SEQ ID NO: 6704 - protein, 37 aa, Neocallimastix californiae; identical to SEQ ID NO: 4085
  Dockerin_dom

SEQ ID NO: 6705 - protein, 38 aa, Neocallimastix californiae
  Dockerin_dom
CFSEALGYPCCSSGVAVVYTDNDGPWGVENNDWCGITN

SEQ ID NO: 6706 - protein, 38 aa, Neocallimastix californiae; identical to SEQ ID NO: 4088
  Dockerin_dom

SEQ ID NO: 6707 - protein, 31 aa, Neocallimastix californiae
  Dockerin_dom
YPCCSTCEASYVDNEGGWNVENNDWCKIDDK

SEQ ID NO: 6708 - protein, 37 aa, Neocallimastix californiae
  Dockerin_dom
DCFALDLGFKCCNNNEVVYTDQDGKWGYTDDWCGIGG

SEQ ID NO: 6709 - protein, 39 aa, Neocallimastix californiae; identical to SEQ ID NO: 4091
  Dockerin_dom

SEQ ID NO: 6710 - protein, 39 aa, Neocallimastix californiae; identical to SEQ ID NO: 4092
  Dockerin_dom

SEQ ID NO: 6711 - protein, 41 aa, Neocallimastix californiae; identical to SEQ ID NO: 4093
  Dockerin_dom

SEQ ID NO: 6712 - protein, 40 aa, Neocallimastix californiae
  Dockerin_dom
SCWSEALGYSCCTNSSSPVVYTDDDGQWSVENNEWCGILK

SEQ ID NO: 6713 - protein, 24 aa, Neocallimastix californiae
  Dockerin_dom
ACWSQPLGYPCCSSPNAEVYYTDN

SEQ ID NO: 6714 - protein, 38 aa, Neocallimastix californiae; identical to SEQ ID NO: 4096
  Dockerin_dom

SEQ ID NO: 6715 - protein, 36 aa, Neocallimastix californiae
  Dockerin_dom
AQGYPCCQNSCIVYSTDADGRWSIENGDWCLIKNNS

SEQ ID NO: 6716 - protein, 40 aa, Neocallimastix californiae
  Dockerin_dom
NSCWSSRLGYPCCKSCNVVFTDNDGKWGVENDDWCGISST

SEQ ID NO: 6717 - protein, 40 aa, Neocallimastix californiae
  Dockerin_dom
NCWASALGFNCCKTTKTVVFEDQDGSWGVEDDFWCGIVED

SEQ ID NO: 6718 - protein, 40 aa, Neocallimastix californiae
  Dockerin_dom
CASSIIAQGYKCCSSNCEVVYVDDDGNWGVENGQWCGCGV

SEQ ID NO: 6719 - protein, 32 aa, Neocallimastix californiae; identical to SEQ ID NO: 4100
  Dockerin_dom

SEQ ID NO: 6720 - protein, 23 aa, Neocallimastix californiae
  Dockerin_dom
ACWSQPLGYPCCSSPNAEVYYTD

SEQ ID NO: 6721 - protein, 35 aa, Neocallimastix californiae
  Dockerin_dom
ENSGYQCCDNCDVVYEDESGKWGIKDNDWCVLSDK

SEQ ID NO: 6722 - protein, 34 aa, Neocallimastix californiae
  Dockerin_dom
ADGYECCSGCSVVDNSDGIKWGVENDNWCIIKNT

SEQ ID NO: 6723 - protein, 39 aa, Neocallimastix californiae; identical to SEQ ID NO: 4105
  Dockerin_dom

SEQ ID NO: 6724 - protein, 40 aa, Neocallimastix californiae; identical to SEQ ID NO: 4107
  Dockerin_dom

SEQ ID NO: 6725 - protein, 32 aa, Neocallimastix californiae
  Dockerin_dom
YNCCNSCDVVYTDNEGEWGVENNNWCFINDAK

SEQ ID NO: 6726 - protein, 37 aa, Neocallimastix californiae; identical to SEQ ID NO: 4109
  Dockerin_dom

SEQ ID NO: 6727 - protein, 37 aa, Neocallimastix californiae; identical to SEQ ID NO: 4108
  Dockerin_dom

SEQ ID NO: 6728 - protein, 39 aa, Neocallimastix californiae; identical to SEQ ID NO: 4111
  Dockerin_dom

SEQ ID NO: 6729 - protein, 38 aa, Neocallimastix californiae
  Dockerin_dom
WASALGFNCCKTTKTVVFEDQDGSWGVEDDFWCGIVED

SEQ ID NO: 6730 - protein, 35 aa, Neocallimastix californiae; identical to SEQ ID NO: 1561
  Dockerin_dom

SEQ ID NO: 6731 - protein, 40 aa, Neocallimastix californiae; identical to SEQ ID NO: 4114
  Dockerin_dom

SEQ ID NO: 6732 - protein, 36 aa, Neocallimastix californiae; identical to SEQ ID NO: 4119
  Dockerin_dom

SEQ ID NO: 6733 - protein, 36 aa, Neocallimastix californiae
  Dockerin_dom
ACFSERLGYPCCSGNEVVYTDNDGKWGVENGNWCGI

SEQ ID NO: 6734 - protein, 39 aa, Neocallimastix californiae; identical to SEQ ID NO: 4116
  Dockerin_dom

SEQ ID NO: 6735 - protein, 39 aa, Neocallimastix californiae; identical to SEQ ID NO: 4116
  Dockerin_dom

SEQ ID NO: 6736 - protein, 36 aa, Neocallimastix californiae; identical to SEQ ID NO: 6733
  Dockerin_dom

SEQ ID NO: 6737 - protein, 36 aa, Neocallimastix californiae; identical to SEQ ID NO: 4119
  Dockerin_dom

SEQ ID NO: 6738 - protein, 39 aa, Neocallimastix californiae; identical to SEQ ID NO: 4072
  Dockerin_dom

SEQ ID NO: 6739 - protein, 36 aa, Neocallimastix californiae; identical to SEQ ID NO: 4119
  Dockerin_dom

SEQ ID NO: 6740 - protein, 25 aa, Neocallimastix californiae
  Dockerin_dom
TCWSLSQGYPCCSSSNAEVWYTDAS

SEQ ID NO: 6741 - protein, 39 aa, Neocallimastix californiae; identical to SEQ ID NO: 4123
  Dockerin_dom

SEQ ID NO: 6742 - protein, 41 aa, Neocallimastix californiae
  Dockerin_dom
ECWAKALGFECCTSEDIEVQYTDKDGKWGIENYEWCGIIED

SEQ ID NO: 6743 - protein, 39 aa, Neocallimastix californiae
  Dockerin_dom
SCWSLAYGYDCCKGCEVSFIDNDGKWGFENEEWCGIKED

SEQ ID NO: 6744 - protein, 39 aa, Neocallimastix californiae; identical to SEQ ID NO: 4126
  Dockerin_dom

SEQ ID NO: 6745 - protein, 31 aa, Neocallimastix californiae
  Dockerin_dom
YSTCKNTCEIEYEDDNKWGIENNEWCILPGS

SEQ ID NO: 6746 - protein, 29 aa, Neocallimastix californiae
  Dockerin_dom
YPCCSSGIEVAYVDDQGEWGVENGEWCGI

SEQ ID NO: 6747 - protein, 36 aa, Neocallimastix californiae
  Dockerin_dom
CWSDPYPCCEGTTVEYVDDQGEWGVENGEWCGIVKS

SEQ ID NO: 6748 - protein, 31 aa, Neocallimastix californiae
  Dockerin_dom
YPCCKNTRYSYYTDSAGNEWGVENGDWCGII

SEQ ID NO: 6749 - protein, 33 aa, Neocallimastix californiae
  Dockerin_dom
GYNCCRNTCDISYVDEDGNWGVENGNWCGVPFS

SEQ ID NO: 6750 - protein, 39 aa, Neocallimastix californiae; identical to SEQ ID NO: 4133
  Dockerin_dom

SEQ ID NO: 6751 - protein, 31 aa, Neocallimastix californiae
  Dockerin_dom
YPCCTSCDVVESDGDQRWGIENNEWCGIPDS

SEQ ID NO: 6752 - protein, 31 aa, Neocallimastix californiae
  Dockerin_dom
YPCCNSCDVSYSDSIGDWGIENNDWCGIKSS

SEQ ID NO: 6753 - protein, 37 aa, Neocallimastix californiae
  Dockerin_dom
GAQGYPCCKSSCAIYSSDSDGDWSIENGDWCLIDKKA

SEQ ID NO: 6754 - protein, 41 aa, Neocallimastix californiae
  Dockerin_dom
NTCWAKALGYECCKSCLPVVTTDGDGSWSVVNDDWCGLPTS

SEQ ID NO: 6755 - protein, 41 aa, Neocallimastix californiae; identical to SEQ ID NO: 6754
  Dockerin_dom

SEQ ID NO: 6756 - protein, 37 aa, Neocallimastix californiae; identical to SEQ ID NO: 6753
  Dockerin_dom

SEQ ID NO: 6757 - protein, 39 aa, Neocallimastix californiae
  Dockerin_dom
CSSKITSQGYSCCSASCEIVYTDDDGTWGVENGDWCGCG

SEQ ID NO: 6758 - protein, 32 aa, Neocallimastix californiae; identical to SEQ ID NO: 4139
  Dockerin_dom

SEQ ID NO: 6759 - protein, 38 aa, Neocallimastix californiae
  Dockerin_dom
PASITNQGYACCAVGCEVVYTDNDGEWGVENNEWCGCG

SEQ ID NO: 6760 - protein, 41 aa, Neocallimastix californiae
  Dockerin_dom
CSSAILAQGYSCCSSCGTVYYTDADGDWGVENNDWCGMPTK

SEQ ID NO: 6761 - protein, 27 aa, Neocallimastix californiae
  Dockerin_dom
ACWSQPLGYPCCSSPNAEVYYTDNDGK

SEQ ID NO: 6762 - protein, 37 aa, Neocallimastix californiae
  Dockerin_dom
GAQGYPCCQKTCEVYSTDSDGSWNIENNDWCLIDKSK

SEQ ID NO: 6763 - protein, 40 aa, Neocallimastix californiae; identical to SEQ ID NO: 4144
  Dockerin_dom

SEQ ID NO: 6764 - protein, 37 aa, Neocallimastix californiae; identical to SEQ ID NO: 4147
  Dockerin_dom

SEQ ID NO: 6765 - protein, 42 aa, Neocallimastix californiae
  Dockerin_dom
TCWSETYGYPCCQSTCARLIEDESGAWGAENGEWCGIQAENC

SEQ ID NO: 6766 - protein, 42 aa, Neocallimastix californiae; identical to SEQ ID NO: 6765
  Dockerin_dom

SEQ ID NO: 6767 - protein, 37 aa, Neocallimastix californiae; identical to SEQ ID NO: 4147
  Dockerin_dom

SEQ ID NO: 6768 - protein, 39 aa, Neocallimastix californiae; identical to SEQ ID NO: 4150
  Dockerin_dom

SEQ ID NO: 6769 - protein, 41 aa, Neocallimastix californiae
  Dockerin_dom
QSCWSTSLGYPCCKTNCEVLDTDDNGNWGVENDEWCGISES

SEQ ID NO: 6770 - protein, 32 aa, Neocallimastix californiae
  Dockerin_dom
YDCCKGCQTILTDEEGNWGSENGQWCFVDEKK

SEQ ID NO: 6771 - protein, 39 aa, Neocallimastix californiae; identical to SEQ ID NO: 4152
  Dockerin_dom

SEQ ID NO: 6772 - protein, 38 aa, Neocallimastix californiae
  Dockerin_dom
TCWSEPDYPCCKDNSNIVYSDGQGDWGYENENWCGIVK

SEQ ID NO: 6773 - protein, 37 aa, Neocallimastix californiae
  Dockerin_dom
CWSLPSYPCCTEEQEPVYVDDLGKWGIENNDWCGIKP

SEQ ID NO: 6774 - protein, 39 aa, Neocallimastix californiae; identical to SEQ ID NO: 4154
  Dockerin_dom

SEQ ID NO: 6775 - protein, 32 aa, Neocallimastix californiae
  Dockerin_dom
YLCCKEGTEVIYTDEEGDWGLDGKNWCKIKKA

SEQ ID NO: 6776 - protein, 39 aa, Neocallimastix californiae
  Dockerin_dom
TCTGSNDGYSCCKTCNVAYTDDQGDWGFENDEWCGIKSS

SEQ ID NO: 6777 - protein, 39 aa, Neocallimastix californiae; identical to SEQ ID NO: 4157
  Dockerin_dom

SEQ ID NO: 6778 - protein, 39 aa, Neocallimastix californiae; identical to SEQ ID NO: 4161
  Dockerin_dom

SEQ ID NO: 6779 - protein, 31 aa, Neocallimastix californiae
  Dockerin_dom
FPCCKGCDVAFSDTTGDWGVENNEWCGIKST

SEQ ID NO: 6780 - protein, 31 aa, Neocallimastix californiae
  Dockerin_dom
YPCCTSCNVVETDGNQRWGIENNEWCGIPDS

SEQ ID NO: 6781 - protein, 31 aa, Neocallimastix californiae; identical to SEQ ID NO: 4163
  Dockerin_dom

SEQ ID NO: 6782 - protein, 37 aa, Neocallimastix californiae
  Dockerin_dom
CWAKALGYECCKTCQASQLKDESGDWGIENGEWCGIT

SEQ ID NO: 6783 - protein, 34 aa, Neocallimastix californiae; identical to SEQ ID NO: 4165
  Dockerin_dom

SEQ ID NO: 6784 - protein, 31 aa, Neocallimastix californiae
  Dockerin_dom
YPCCSSCQTIYSDNDGDWGYEDDKWCGIKDS

SEQ ID NO: 6785 - protein, 39 aa, Neocallimastix californiae; identical to SEQ ID NO: 4167
  Dockerin_dom

SEQ ID NO: 6786 - protein, 39 aa, Neocallimastix californiae; identical to SEQ ID NO: 4166
  Dockerin_dom

SEQ ID NO: 6787 - protein, 38 aa, Neocallimastix californiae
  Dockerin_dom
CWSLPDYPCCEESTDVVYSDESGDWSVENDDWCGIIKS

SEQ ID NO: 6788 - protein, 41 aa, Neocallimastix californiae
  Dockerin_dom
SCWSESQGYNCCSGCEVVYEDDSGKWGVENDDWCGIEDSVC

SEQ ID NO: 6789 - protein, 38 aa, Neocallimastix californiae; identical to SEQ ID NO: 4171
  Dockerin_dom

SEQ ID NO: 6790 - protein, 38 aa, Neocallimastix californiae; identical to SEQ ID NO: 4172
  Dockerin_dom

SEQ ID NO: 6791 - protein, 39 aa, Neocallimastix californiae; identical to SEQ ID NO: 4173
  Dockerin_dom

SEQ ID NO: 6792 - protein, 37 aa, Neocallimastix californiae
  Dockerin_dom
GAAGYPCCARSCIVVTKDDDGYWGIENNNWCLIDKDL

SEQ ID NO: 6793 - protein, 37 aa, Neocallimastix californiae; identical to SEQ ID NO: 1625
  Dockerin_dom

SEQ ID NO: 6794 - protein, 35 aa, Neocallimastix californiae; identical to SEQ ID NO: 1627
  Dockerin_dom

SEQ ID NO: 6795 - protein, 31 aa, Neocallimastix californiae
  Dockerin_dom
TYPCCKGNTVIYTDEQGAWGIENDNWCGIES

SEQ ID NO: 6796 - protein, 38 aa, Neocallimastix californiae
  Dockerin_dom
ACWSEKLGYPCCKSTNDVYYEDDDGQWGVENNDWCGIQ

SEQ ID NO: 6797 - protein, 40 aa, Neocallimastix californiae
  Dockerin_dom
TCWSEKLGYPCCNSTNEVVYEDNDGPWGVENNNWCGIINN

SEQ ID NO: 6798 - protein, 36 aa, Neocallimastix californiae
  Dockerin_dom
CWSLPEYPCCEGNSIVTSDSQGDWGYENNHWCGIIK

SEQ ID NO: 6799 - protein, 30 aa, Neocallimastix californiae
  Dockerin_dom
YPCCEGNTIVTTDSHGDWGYENNHWCGILK

SEQ ID NO: 6800 - protein, 40 aa, Neocallimastix californiae; identical to SEQ ID NO: 4180
  Dockerin_dom

SEQ ID NO: 6801 - protein, 39 aa, Neocallimastix californiae
  Dockerin_dom
TCWSEPDYKCCSTCDIVYTDDHNWGVEDDEWCGIDDAKC

SEQ ID NO: 6802 - protein, 39 aa, Neocallimastix californiae
  Dockerin_dom
SCGAAAIGYPCCENTCTEVYTDEYRWGVENNDWCGLKDS

SEQ ID NO: 6803 - protein, 42 aa, Neocallimastix californiae; identical to SEQ ID NO: 4186
  Dockerin_dom

SEQ ID NO: 6804 - protein, 38 aa, Neocallimastix californiae
  Dockerin_dom
CPGSNQGYSCCKTCEVYMTDETGPWNIENDEWCSVKTN

SEQ ID NO: 6805 - protein, 32 aa, Neocallimastix californiae; identical to SEQ ID NO: 4188
  Dockerin_dom

SEQ ID NO: 6806 - protein, 40 aa, Neocallimastix californiae
  Dockerin_dom
CSAKIVQQGYKCCGNNCIVVYQDNDGYWGVENNQWCGCGT

SEQ ID NO: 6807 - protein, 38 aa, Neocallimastix californiae; identical to SEQ ID NO: 4190
  Dockerin_dom

SEQ ID NO: 6808 - protein, 38 aa, Neocallimastix californiae; identical to SEQ ID NO: 4189
  Dockerin_dom

SEQ ID NO: 6809 - protein, 39 aa, Neocallimastix californiae; identical to SEQ ID NO: 4191
  Dockerin_dom

SEQ ID NO: 6810 - protein, 40 aa, Neocallimastix californiae
  Dockerin_dom
NECVVASLGYACCSPGNTVVYYQDENGDWGVENDDWCGIT

SEQ ID NO: 6811 - protein, 40 aa, Neocallimastix californiae
  Dockerin_dom
NSCWSKALGYNCCTSTSDVIFEDSDGQWGIENDDWCGIVK

SEQ ID NO: 6812 - protein, 39 aa, Neocallimastix californiae; identical to SEQ ID NO: 4193
  Dockerin_dom

SEQ ID NO: 6813 - protein, 43 aa, Neocallimastix californiae; identical to SEQ ID NO: 4195
  Dockerin_dom

SEQ ID NO: 6814 - protein, 31 aa, Neocallimastix californiae; identical to SEQ ID NO: 1647
  Dockerin_dom

SEQ ID NO: 6815 - protein, 42 aa, Neocallimastix californiae; identical to SEQ ID NO: 4197
  Dockerin_dom

SEQ ID NO: 6816 - protein, 32 aa, Neocallimastix californiae
  Dockerin_dom
YECCSNCEVIYSDDEGDWGVENYDWCFIDKSK

SEQ ID NO: 6817 - protein, 34 aa, Neocallimastix californiae
  Dockerin_dom
NGYPKCSSCVVYYTDENGDWGVENNDWCLIQKSR

SEQ ID NO: 6818 - protein, 39 aa, Neocallimastix californiae; identical to SEQ ID NO: 4201
  Dockerin_dom

SEQ ID NO: 6819 - protein, 39 aa, Neocallimastix californiae; identical to SEQ ID NO: 4200
  Dockerin_dom

SEQ ID NO: 6820 - protein, 38 aa, Neocallimastix californiae; identical to SEQ ID NO: 4202
  Dockerin_dom

SEQ ID NO: 6821 - protein, 38 aa, Neocallimastix californiae
  Dockerin_dom
TSITDQGYKCCSTCGTVYYTDDDGDWGVENNEWCGMPC

SEQ ID NO: 6822 - protein, 39 aa, Neocallimastix californiae
  Dockerin_dom
TSITDQGYSCCSVCGTVYYTDGDGDWGVENNQWCGMPYD

SEQ ID NO: 6823 - protein, 38 aa, Neocallimastix californiae; identical to SEQ ID NO: 4204
  Dockerin_dom

SEQ ID NO: 6824 - protein, 38 aa, Neocallimastix californiae
  Dockerin_dom
CWSEQLGYPCCQGCTVFETDADGSWGYESNHWCGIQSY

SEQ ID NO: 6825 - protein, 41 aa, Neocallimastix californiae; identical to SEQ ID NO: 4206
  Dockerin_dom

SEQ ID NO: 6826 - protein, 39 aa, Neocallimastix californiae; identical to SEQ ID NO: 4072
  Dockerin_dom

SEQ ID NO: 6827 - protein, 37 aa, Neocallimastix californiae; identical to SEQ ID NO: 4115
  Dockerin_dom

SEQ ID NO: 6828 - protein, 39 aa, Neocallimastix californiae; identical to SEQ ID NO: 4211
  Dockerin_dom

SEQ ID NO: 6829 - protein, 35 aa, Neocallimastix californiae; identical to SEQ ID NO: 1661
  Dockerin_dom

SEQ ID NO: 6830 - protein, 39 aa, Neocallimastix californiae
  Dockerin_dom
CWASALGFNCCKTTKTVVFEDQDGSWGVEDDFWCGIVED

SEQ ID NO: 6831 - protein, 36 aa, Neocallimastix californiae; identical to SEQ ID NO: 6733
  Dockerin_dom

SEQ ID NO: 6832 - protein, 39 aa, Neocallimastix californiae; identical to SEQ ID NO: 4214
  Dockerin_dom

SEQ ID NO: 6833 - protein, 39 aa, Neocallimastix californiae
  Dockerin_dom
SCFAEKLGYPCCSSCDVLYTDNDGEWGVENDNWCGIKDS

SEQ ID NO: 6834 - protein, 38 aa, Neocallimastix californiae; identical to SEQ ID NO: 4216
  Dockerin_dom

SEQ ID NO: 6835 - protein, 40 aa, Neocallimastix californiae; identical to SEQ ID NO: 4217
  Dockerin_dom

SEQ ID NO: 6836 - protein, 40 aa, Neocallimastix californiae; identical to SEQ ID NO: 4219
  Dockerin_dom

SEQ ID NO: 6837 - protein, 40 aa, Neocallimastix californiae
  Dockerin_dom
CSSKITDLGYKCCSSGCQVVYTDDDGTWGVENEEWCGCGQ

SEQ ID NO: 6838 - protein, 39 aa, Neocallimastix californiae; identical to SEQ ID NO: 4221
  Dockerin_dom

SEQ ID NO: 6839 - protein, 36 aa, Neocallimastix californiae
  Dockerin_dom
CWSLPSYPCCSSGIESAYEDDLGKWGIENGDWCGIK

SEQ ID NO: 6840 - protein, 37 aa, Neocallimastix californiae
  Dockerin_dom
KCWSEPDYPCCSGNTEIIYSDASGDWGYENNNWCGII

SEQ ID NO: 6841 - protein, 37 aa, Neocallimastix californiae; identical to SEQ ID NO: 6840
  Dockerin_dom

SEQ ID NO: 6842 - protein, 39 aa, Neocallimastix californiae; identical to SEQ ID NO: 4221
  Dockerin_dom

SEQ ID NO: 6843 - protein, 36 aa, Neocallimastix californiae; identical to SEQ ID NO: 6839
  Dockerin_dom

SEQ ID NO: 6844 - protein, 39 aa, Neocallimastix californiae; identical to SEQ ID NO: 4226
  Dockerin_dom

SEQ ID NO: 6845 - protein, 42 aa, Neocallimastix californiae
  Dockerin_dom
SCWASTIGFPCCKSSCEVAYTDNDGDWAIENDEWCGIDPSKC

SEQ ID NO: 6846 - protein, 39 aa, Neocallimastix californiae; identical to SEQ ID NO: 4231
  Dockerin_dom

SEQ ID NO: 6847 - protein, 39 aa, Neocallimastix californiae; identical to SEQ ID NO: 4230
  Dockerin_dom

SEQ ID NO: 6848 - protein, 40 aa, Neocallimastix californiae
  Dockerin_dom
CWSENLGEKSRPCCKNDDGIVVLKDMNGSWGLEEDGMCGY

SEQ ID NO: 6849 - protein, 39 aa, Neocallimastix californiae
  Dockerin_dom
CWSEPLGYPCCKETKKIEYYDDNGPWGMENDDWCGIDDE

SEQ ID NO: 6850 - protein, 37 aa, Neocallimastix californiae
  Dockerin_dom
CWAYKLGYPCCEGNTIIEINEDGKWGIENDEWCGVIE

SEQ ID NO: 6851 - protein, 39 aa, Neocallimastix californiae
  Dockerin_dom
NCWTLDQSYPCCSSLSAKVDGYSDKWGYENGDWCGLTDE

SEQ ID NO: 6852 - protein, 41 aa, Neocallimastix californiae
  Dockerin_dom
QSCWSTSLGYPCCKTNCDVVVTDGDGDWGVENDEWCGISNS

SEQ ID NO: 6853 - protein, 39 aa, Neocallimastix californiae; identical to SEQ ID NO: 4234
  Dockerin_dom

SEQ ID NO: 6854 - protein, 41 aa, Neocallimastix californiae
  Dockerin_dom
DCWSEKLGWPCCSKGNTEVYYVDDDGDWGVENDDWCGMEKE

SEQ ID NO: 6855 - protein, 35 aa, Neocallimastix californiae
  Dockerin_dom
KGLGFPCCQECTVVTSDDDGDWGVENNEWCGIPNS

SEQ ID NO: 6856 - protein, 41 aa, Neocallimastix californiae
  Dockerin_dom
KCWAKDLGFSCCQACEVTYTDNDGDWGFENGDWCGIIEQNC

SEQ ID NO: 6857 - protein, 41 aa, Neocallimastix californiae
  Dockerin_dom
CFTEEKGMDFPCCQGCEVYYTDDDGEWGFENNQWCGINSET

SEQ ID NO: 6858 - protein, 41 aa, Neocallimastix californiae
  Dockerin_dom
NSCWSTALGYPCCDTCVSVSFEDGDGKWGIQNDDWCGLQKS

SEQ ID NO: 6859 - protein, 38 aa, Neocallimastix californiae; identical to SEQ ID NO: 4240
  Dockerin_dom

SEQ ID NO: 6860 - protein, 41 aa, Neocallimastix californiae; identical to SEQ ID NO: 6858
  Dockerin_dom

SEQ ID NO: 6861 - protein, 38 aa, Neocallimastix californiae; identical to SEQ ID NO: 4240
  Dockerin_dom

SEQ ID NO: 6862 - protein, 41 aa, Neocallimastix californiae
  Dockerin_dom
CSSKITAQGYKCCSANCEVVYTDDDGNWGVENNNWCGCGTE

SEQ ID NO: 6863 - protein, 31 aa, Neocallimastix californiae; identical to SEQ ID NO: 1694
  Dockerin_dom

SEQ ID NO: 6864 - protein, 40 aa, Neocallimastix californiae; identical to SEQ ID NO: 4245
  Dockerin_dom

SEQ ID NO: 6865 - protein, 39 aa, Neocallimastix californiae
  Dockerin_dom
CSKKITSQGYSCCPANCQIVYTDSDGTWGVHNDQWCGCG

SEQ ID NO: 6866 - protein, 41 aa, Neocallimastix californiae
  Dockerin_dom
CSSSFTSQGYGCCSRCGEVYFTDESGNWGIENGDWCGLPSN

SEQ ID NO: 6867 - protein, 31 aa, Neocallimastix californiae; identical to SEQ ID NO: 4248
  Dockerin_dom

SEQ ID NO: 6868 - protein, 38 aa, Neocallimastix californiae; identical to SEQ ID NO: 4249
  Dockerin_dom

SEQ ID NO: 6869 - protein, 35 aa, Neocallimastix californiae
  Dockerin_dom
NGYECCKSCDVVFTDDDGEWGVEDGQWCGIDKEKC

SEQ ID NO: 6870 - protein, 35 aa, Neocallimastix californiae; identical to SEQ ID NO: 1701
  Dockerin_dom

SEQ ID NO: 6871 - protein, 39 aa, Neocallimastix californiae; identical to SEQ ID NO: 4252
  Dockerin_dom

SEQ ID NO: 6872 - protein, 39 aa, Neocallimastix californiae; identical to SEQ ID NO: 4253
  Dockerin_dom

SEQ ID NO: 6873 - protein, 39 aa, Neocallimastix californiae
  Dockerin_dom
ACWSVGLGYQCCKSCNVEYKDNDGEWGIENNKWCGISKD

SEQ ID NO: 6874 - protein, 38 aa, Neocallimastix californiae; identical to SEQ ID NO: 4254
  Dockerin_dom

SEQ ID NO: 6875 - protein, 38 aa, Neocallimastix californiae; identical to SEQ ID NO: 4257
  Dockerin_dom

SEQ ID NO: 6876 - protein, 39 aa, Neocallimastix californiae; identical to SEQ ID NO: 4256
  Dockerin_dom

SEQ ID NO: 6877 - protein, 37 aa, Neocallimastix californiae; identical to SEQ ID NO: 4258
  Dockerin_dom

SEQ ID NO: 6878 - protein, 37 aa, Neocallimastix californiae; identical to SEQ ID NO: 4260
  Dockerin_dom

SEQ ID NO: 6879 - protein, 31 aa, Neocallimastix californiae
  Dockerin_dom
DGYPPCQETTEVLYTDDSEWGVENDGWCVIC

SEQ ID NO: 6880 - protein, 40 aa, Neocallimastix californiae
  Dockerin_dom
ECWSERLGWPCCSKENTDVYYVDDDGEWGVENDDWCGMST

SEQ ID NO: 6881 - protein, 36 aa, Neocallimastix californiae
  Dockerin_dom
AQGYPCCQSSCNVISTDSDGKWSVENDDWCLIDSSK

SEQ ID NO: 6882 - protein, 39 aa, Neocallimastix californiae; identical to SEQ ID NO: 4263
  Dockerin_dom

SEQ ID NO: 6883 - protein, 41 aa, Neocallimastix californiae; identical to SEQ ID NO: 4265
  Dockerin_dom

SEQ ID NO: 6884 - protein, 39 aa, Neocallimastix californiae
  Dockerin_dom
CWSEKLGYPCCTSEKAKVSYSDENGHWGIENNQWCGIIN

SEQ ID NO: 6885 - protein, 41 aa, Neocallimastix californiae; identical to SEQ ID NO: 4265
  Dockerin_dom

SEQ ID NO: 6886 - protein, 39 aa, Neocallimastix californiae
  Dockerin_dom
CSAKILAQGYSCCPKGCRVYVTDDDGDWGYVNNEWCGCK

SEQ ID NO: 6887 - protein, 32 aa, Neocallimastix californiae
  Dockerin_dom
CAQGYPCCKGKSEIYFVDKDGNWGYENGDWCL

SEQ ID NO: 6888 - protein, 38 aa, Neocallimastix californiae
  Dockerin_dom
PASITDQGYPCCSTGCTVYYTDNDGDWGVENNQWCGCG

SEQ ID NO: 6889 - protein, 38 aa, Neocallimastix californiae
  Dockerin_dom
PASITSQGYECCSENCEIVYTDDDGNWGVENNQWCGCG

SEQ ID NO: 6890 - protein, 40 aa, Neocallimastix californiae; identical to SEQ ID NO: 4276
  Dockerin_dom

SEQ ID NO: 6891 - protein, 40 aa, Neocallimastix californiae; identical to SEQ ID NO: 4275
  Dockerin_dom

SEQ ID NO: 6892 - protein, 41 aa, Neocallimastix californiae
  Dockerin_dom
TCWSSGYGYPCCNNCKVYFIDETGEWGIQDGNWCGIVDSKC

SEQ ID NO: 6893 - protein, 40 aa, Neocallimastix californiae; identical to SEQ ID NO: 4271
  Dockerin_dom

SEQ ID NO: 6894 - protein, 40 aa, Neocallimastix californiae; identical to SEQ ID NO: 4273
  Dockerin_dom

SEQ ID NO: 6895 - protein, 39 aa, Neocallimastix californiae
  Dockerin_dom
CWSESKGYPCCKSCDVVTVDRHGSWGIENGQWCGVKSEA

SEQ ID NO: 6896 - protein, 41 aa, Neocallimastix californiae
  Dockerin_dom
CSSSITAQGYKCCSSCGTVYYTDGDGDWGVENGNWCGMPTN

SEQ ID NO: 6897 - protein, 38 aa, Neocallimastix californiae
  Dockerin_dom
CSASITAQGYKCCSANCEVVYTDNDGDWGVENNEWCGC

SEQ ID NO: 6898 - protein, 41 aa, Neocallimastix californiae
  Dockerin_dom
SCWATKLGYKCCTAECPVVYYTDDDGKWSVENDDWCGIIKT

SEQ ID NO: 6899 - protein, 37 aa, Neocallimastix californiae; identical to SEQ ID NO: 4280
  Dockerin_dom

SEQ ID NO: 6900 - protein, 32 aa, Neocallimastix californiae
  Dockerin_dom
AQGYPCCKSTKQVYYTDDDGSWGIEDGDWCII

SEQ ID NO: 6901 - protein, 39 aa, Neocallimastix californiae; identical to SEQ ID NO: 4282
  Dockerin_dom

SEQ ID NO: 6902 - protein, 39 aa, Neocallimastix californiae; identical to SEQ ID NO: 4283
  Dockerin_dom

SEQ ID NO: 6903 - protein, 39 aa, Neocallimastix californiae; identical to SEQ ID NO: 4284
  Dockerin_dom

SEQ ID NO: 6904 - protein, 31 aa, Neocallimastix californiae
  Dockerin_dom
YTCCEGCNVIEEDGSGKWGIENNQWCGIKDS

SEQ ID NO: 6905 - protein, 32 aa, Neocallimastix californiae
  Dockerin_dom
AYSECRGCAVYYVEDGVNWGVENDDWCLIPSR

SEQ ID NO: 6906 - protein, 31 aa, Neocallimastix californiae
  Dockerin_dom
TGYGCCVFKNTIVETVDESGKWGHEGNEWCL

SEQ ID NO: 6907 - protein, 31 aa, Neocallimastix californiae
  Dockerin_dom
SYSCCKKCDVIYTDEYKWGVEGGDWCIIPYS

SEQ ID NO: 6908 - protein, 42 aa, Neocallimastix californiae
  Dockerin_dom
NCWSLADGYPCCRKETTKIEYVSKSSGKEWGLENGDWCGITD

SEQ ID NO: 6909 - protein, 39 aa, Neocallimastix californiae
  Dockerin_dom
RGAQGYPCCKKSCAIYSTDGDGDWSIENNDWCLIDNSIC

SEQ ID NO: 6910 - protein, 40 aa, Neocallimastix californiae; identical to SEQ ID NO: 4290
  Dockerin_dom

SEQ ID NO: 6911 - protein, 39 aa, Neocallimastix californiae; identical to SEQ ID NO: 4028
  Dockerin_dom

SEQ ID NO: 6912 - protein, 39 aa, Neocallimastix californiae; identical to SEQ ID NO: 4293
  Dockerin_dom

SEQ ID NO: 6913 - protein, 40 aa, Neocallimastix californiae
  Dockerin_dom
QCWSDKLGFPCCSGCIDTVYTDNDGKWGVQNDDWCGIPTN

SEQ ID NO: 6914 - protein, 43 aa, Neocallimastix californiae; identical to SEQ ID NO: 4295
  Dockerin_dom

SEQ ID NO: 6915 - protein, 40 aa, Neocallimastix californiae; identical to SEQ ID NO: 4296
  Dockerin_dom

SEQ ID NO: 6916 - protein, 35 aa, Neocallimastix californiae; identical to SEQ ID NO: 4297
  Dockerin_dom

SEQ ID NO: 6917 - protein, 36 aa, Neocallimastix californiae; identical to SEQ ID NO: 4073
  Dockerin_dom

SEQ ID NO: 6918 - protein, 42 aa, Neocallimastix californiae
  Dockerin_dom
CSSAVTSQGYKCCSANNCNVYFTDDAGKWGIENDDWCGISNQ

SEQ ID NO: 6919 - protein, 36 aa, Neocallimastix californiae
  Dockerin_dom
AILKQGYKCCASGCSVIYTDDDGTWGVENGEWCGCS

SEQ ID NO: 6920 - protein, 41 aa, Neocallimastix californiae; identical to SEQ ID NO: 4301
  Dockerin_dom

SEQ ID NO: 6921 - protein, 38 aa, Neocallimastix californiae; identical to SEQ ID NO: 4302
  Dockerin_dom

SEQ ID NO: 6922 - protein, 37 aa, Neocallimastix californiae; identical to SEQ ID NO: 4303
  Dockerin_dom

SEQ ID NO: 6923 - protein, 39 aa, Neocallimastix californiae; identical to SEQ ID NO: 4304
  Dockerin_dom

SEQ ID NO: 6924 - protein, 32 aa, Neocallimastix californiae; identical to SEQ ID NO: 4305
  Dockerin_dom

SEQ ID NO: 6925 - protein, 31 aa, Neocallimastix californiae
  Dockerin_dom
YSCCKSCTVIAEDDNGQWGIEDDEWCGIRDS

SEQ ID NO: 6926 - protein, 33 aa, Neocallimastix californiae
  Dockerin_dom
GYTCCEGCKVSEIDGDGISWGIENGEWCIVPLS

SEQ ID NO: 6927 - protein, 28 aa, Neocallimastix californiae
  Dockerin_dom
CSTCRAVTVEDGISWGVENNDWCIVPAS

SEQ ID NO: 6928 - protein, 39 aa, Neocallimastix californiae; identical to SEQ ID NO: 4308
  Dockerin_dom

SEQ ID NO: 6929 - protein, 41 aa, Neocallimastix californiae
  Dockerin_dom
DCFSTRLGFPCCSSWNKKVEFSDGDGNWGIENGSWCGIGNQ

SEQ ID NO: 6930 - protein, 40 aa, Neocallimastix californiae; identical to SEQ ID NO: 4310
  Dockerin_dom

SEQ ID NO: 6931 - protein, 40 aa, Neocallimastix californiae; identical to SEQ ID NO: 4311
  Dockerin_dom

SEQ ID NO: 6932 - protein, 32 aa, Neocallimastix californiae
  Dockerin_dom
YECCKSCKVKHISKSGNTWGVEDGKWCSIPYR

SEQ ID NO: 6933 - protein, 40 aa, Neocallimastix californiae
  Dockerin_dom
KCWSLAEGYPCCEKKGTKVRHVSKNGNEWGVEHGDWCGIT

SEQ ID NO: 6934 - protein, 39 aa, Neocallimastix californiae; identical to SEQ ID NO: 4314
  Dockerin_dom

SEQ ID NO: 6935 - protein, 40 aa, Neocallimastix californiae; identical to SEQ ID NO: 4313
  Dockerin_dom

SEQ ID NO: 6936 - protein, 36 aa, Neocallimastix californiae
  Dockerin_dom
CWSLPDFPCCNGNTVVYTDIQGDWGYENDNWCGIVK

SEQ ID NO: 6937 - protein, 40 aa, Neocallimastix californiae; identical to SEQ ID NO: 4316
  Dockerin_dom

SEQ ID NO: 6938 - protein, 38 aa, Neocallimastix californiae
  Dockerin_dom
SCWSLPEYPCCNGDTVVYTDGQGDWGYENGDWCGIKKQ

SEQ ID NO: 6939 - protein, 31 aa, Neocallimastix californiae
  Dockerin_dom
YKCCESCKVWYTDEQGDWGVENNDWCSIKYS

SEQ ID NO: 6940 - protein, 41 aa, Neocallimastix californiae; identical to SEQ ID NO: 4319
  Dockerin_dom

SEQ ID NO: 6941 - protein, 39 aa, Neocallimastix californiae; identical to SEQ ID NO: 4028
  Dockerin_dom

SEQ ID NO: 6942 - protein, 40 aa, Neocallimastix californiae; identical to SEQ ID NO: 4321
  Dockerin_dom

SEQ ID NO: 6943 - protein, 40 aa, Neocallimastix californiae
  Dockerin_dom
CWSEVLGYPCCKGCTIFEEDEDGQWGYDFKEATWCGIQTF

SEQ ID NO: 6944 - protein, 36 aa, Neocallimastix californiae; identical to SEQ ID NO: 1774
  Dockerin_dom

SEQ ID NO: 6945 - protein, 40 aa, Neocallimastix californiae; identical to SEQ ID NO: 4324
  Dockerin_dom

SEQ ID NO: 6946 - protein, 30 aa, Neocallimastix californiae
  Dockerin_dom
YPCCKECNVYYTDTEDWGIENGEWCSIPHT

SEQ ID NO: 6947 - protein, 34 aa, Neocallimastix californiae
  Dockerin_dom
NTGYNCCLFTTTVITSDSVGDWGVENDDWCLIES

SEQ ID NO: 6948 - protein, 32 aa, Neocallimastix californiae
  Dockerin_dom
YRCCLKTCKASYTDSTGDWAVESNNWCLIPYT

SEQ ID NO: 6949 - protein, 37 aa, Neocallimastix californiae
  Dockerin_dom
AILKQGYKCCSKDCTIIYTDDDGSWGVENDEWCGCSN

SEQ ID NO: 6950 - protein, 41 aa, Neocallimastix californiae
  Dockerin_dom
PSSITSQGYKCCSSDNCNVYATDDDGKWGIEDGDWCGISKN

SEQ ID NO: 6951 - protein, 36 aa, Neocallimastix californiae; identical to SEQ ID NO: 1774
  Dockerin_dom

SEQ ID NO: 6952 - protein, 20 aa, Neocallimastix californiae
  Dockerin_dom
VYTDNDGKWGVENGNWCGID

SEQ ID NO: 6953 - protein, 39 aa, Neocallimastix californiae; identical to SEQ ID NO: 4001
  Dockerin_dom

SEQ ID NO: 6954 - protein, 29 aa, Neocallimastix californiae
  Dockerin_dom
YPCCSAGAEVVYEDDQGQWGVENGEWCGI

SEQ ID NO: 6955 - protein, 33 aa, Neocallimastix californiae
  Dockerin_dom
AAPYPCCKGNEVVYTDDQGDWGVEDGDWCGIVK

SEQ ID NO: 6956 - protein, 39 aa, Neocallimastix californiae; identical to SEQ ID NO: 4336
  Dockerin_dom

SEQ ID NO: 6957 - protein, 40 aa, Neocallimastix californiae
  Dockerin_dom
NECWSKKYGYPCCDTCNVFIIDKYGEWGIKDNDWCGIPST

SEQ ID NO: 6958 - protein, 39 aa, Neocallimastix californiae; identical to SEQ ID NO: 4337
  Dockerin_dom

SEQ ID NO: 6959 - protein, 39 aa, Neocallimastix californiae; identical to SEQ ID NO: 4338
  Dockerin_dom

SEQ ID NO: 6960 - protein, 36 aa, Neocallimastix californiae
  Dockerin_dom
CFAKSDGYDCCFDNEVVYEDDSGKWGINDEGEWCGV

SEQ ID NO: 6961 - protein, 40 aa, Neocallimastix californiae
  Dockerin_dom
NTCWSKTYGYDCCAEGTAVYLEDESGKWGVTDDYQWCGIK

SEQ ID NO: 6962 - protein, 42 aa, Neocallimastix californiae
  Dockerin_dom
SCWAEALGYKCCSADAFTPVIFTDSDGDWSAENGEWCGILKS

SEQ ID NO: 6963 - protein, 39 aa, Neocallimastix californiae; identical to SEQ ID NO: 4342
  Dockerin_dom

SEQ ID NO: 6964 - protein, 31 aa, Neocallimastix californiae; identical to SEQ ID NO: 4343
  Dockerin_dom

SEQ ID NO: 6965 - protein, 38 aa, Neocallimastix californiae
  Dockerin_dom
SCWSEPDYPCCKYSCEVYFTDDHKWGIENGEWCGISDS

SEQ ID NO: 6966 - protein, 35 aa, Neocallimastix californiae; identical to SEQ ID NO: 1795
  Dockerin_dom

SEQ ID NO: 6967 - protein, 37 aa, Neocallimastix californiae; identical to SEQ ID NO: 4347
  Dockerin_dom

SEQ ID NO: 6968 - protein, 40 aa, Neocallimastix californiae
  Dockerin_dom
SCWANELGYACCKSAKTVYATDKDGKWSVENNEWCGIVES

SEQ ID NO: 6969 - protein, 37 aa, Neocallimastix californiae
  Dockerin_dom
SINNLGYPCCEGCEILYTDDDGDWGVENEDWCGIPYH

SEQ ID NO: 6970 - protein, 40 aa, Neocallimastix californiae
  Dockerin_dom
NCWSHRYGYPCCTKTNEVLYSDSDGDWGIENGEWCGVARS

SEQ ID NO: 6971 - protein, 41 aa, Neocallimastix californiae; identical to SEQ ID NO: 4350
  Dockerin_dom

SEQ ID NO: 6972 - protein, 30 aa, Neocallimastix californiae
  Dockerin_dom
YPYCNNCVTVYEDDQKWGILNNQWCRILPN

SEQ ID NO: 6973 - protein, 41 aa, Neocallimastix californiae
  Dockerin_dom
DCFSTRLGYPCCSSWNKQVAYTDNDGNWGVENGNWCGISNQ

SEQ ID NO: 6974 - protein, 39 aa, Neocallimastix californiae; identical to SEQ ID NO: 4352
  Dockerin_dom

SEQ ID NO: 6975 - protein, 38 aa, Neocallimastix californiae; identical to SEQ ID NO: 4354
  Dockerin_dom

SEQ ID NO: 6976 - protein, 38 aa, Neocallimastix californiae; identical to SEQ ID NO: 4355
  Dockerin_dom

SEQ ID NO: 6977 - protein, 39 aa, Neocallimastix californiae
  Dockerin_dom
PSTIKDQGYPCCKSCNVILTDESGDWGVENNDWCGISET

SEQ ID NO: 6978 - protein, 38 aa, Neocallimastix californiae
  Dockerin_dom
CKAEALGYKCCSTCVSILEDENGLWGAENGEWCGITDK

SEQ ID NO: 6979 - protein, 40 aa, Neocallimastix californiae
  Dockerin_dom
NECWSTQFGYPCCDTCDVFLSDESGDWGVKDLDWCGIPST

SEQ ID NO: 6980 - protein, 31 aa, Neocallimastix californiae
  Dockerin_dom
YKCCKDCQVVYEDEDGKWGYENDEWCGMKSS

SEQ ID NO: 6981 - protein, 42 aa, Neocallimastix californiae
  Dockerin_dom
NECWSESLGFPCCPSDYCEVAKTDSSGSWGIFDNNWCGISTD

SEQ ID NO: 6982 - protein, 31 aa, Neocallimastix californiae
  Dockerin_dom
YPCCESCNIYSEEEGDKWGIENNDWCSIKFK

SEQ ID NO: 6983 - protein, 38 aa, Neocallimastix californiae
  Dockerin_dom
TCWSEPDYPCCKSSCEVYYTDEHKWGVENGDWCGITDS

SEQ ID NO: 6984 - protein, 37 aa, Neocallimastix californiae; identical to SEQ ID NO: 4365
  Dockerin_dom

SEQ ID NO: 6985 - protein, 38 aa, Neocallimastix californiae; identical to SEQ ID NO: 4366
  Dockerin_dom

SEQ ID NO: 6986 - protein, 37 aa, Neocallimastix californiae; identical to SEQ ID NO: 4363
  Dockerin_dom

SEQ ID NO: 6987 - protein, 40 aa, Neocallimastix californiae; identical to SEQ ID NO: 4364
  Dockerin_dom

SEQ ID NO: 6988 - protein, 33 aa, Neocallimastix californiae
  Dockerin_dom
PLYPCCNGCDVIEETEEGKWGVENDEWCGLKDS

SEQ ID NO: 6989 - protein, 33 aa, Neocallimastix californiae
  Dockerin_dom
AFAYEECKGCGVVYEDDMKWGVENDDWCIIPAK

SEQ ID NO: 6990 - protein, 40 aa, Neocallimastix californiae
  Dockerin_dom
KCFSQKLNPSYPCCKGNEVVYTDESGDWGVENNSWCGISN

SEQ ID NO: 6991 - protein, 39 aa, Neocallimastix californiae; identical to SEQ ID NO: 4371
  Dockerin_dom

SEQ ID NO: 6992 - protein, 37 aa, Neocallimastix californiae; identical to SEQ ID NO: 4369
  Dockerin_dom

SEQ ID NO: 6993 - protein, 37 aa, Neocallimastix californiae
  Dockerin_dom
KCWAFELGYTCCKKTKTVQKIDENKRKWGYEYSGLCG

SEQ ID NO: 6994 - protein, 40 aa, Neocallimastix californiae; identical to SEQ ID NO: 4373
  Dockerin_dom

SEQ ID NO: 6995 - protein, 39 aa, Neocallimastix californiae
  Dockerin_dom
CWSLDLGYPCCNPKNTNVVYTDGTGKWGVENGDWCGIIN

SEQ ID NO: 6996 - protein, 39 aa, Neocallimastix californiae
  Dockerin_dom
KSWSNELGYPSCQSTKEIKFYAEQGGFGYENGSWCGLEN

SEQ ID NO: 6997 - protein, 41 aa, Neocallimastix californiae
  Dockerin_dom
CWSELLSNPFPCCKNDDVKEIGKDMDGAWGEENGTKCGIRN

SEQ ID NO: 6998 - protein, 35 aa, Neocallimastix californiae
  Dockerin_dom
NCWSLDQGYPCCEGQYQKYDDDWGYQNNEWCGIIE

SEQ ID NO: 6999 - protein, 39 aa, Neocallimastix californiae
  Dockerin_dom
ECFAKRLGYSCCTTTKEVVSIDPNGKWGIENGHICGIEE

SEQ ID NO: 7000 - protein, 39 aa, Neocallimastix californiae
  Dockerin_dom
KCLSEFIGYPCCSPEFTTIYAQDEYGDWSYDFVKNEWCG

SEQ ID NO: 7001 - protein, 40 aa, Neocallimastix californiae
  Dockerin_dom
ECWSEELGYPCCKGCRVYETDSDGSWGYEFNQWCGIISAQ

SEQ ID NO: 7002 - protein, 40 aa, Neocallimastix californiae; identical to SEQ ID NO: 4380
  Dockerin_dom

SEQ ID NO: 7003 - protein, 29 aa, Neocallimastix californiae
  Dockerin_dom
CSPEFTTIYAQDEYGDWSYDFVKNEWCGL

SEQ ID NO: 7004 - protein, 33 aa, Neocallimastix californiae; identical to SEQ ID NO: 1831
  Dockerin_dom

SEQ ID NO: 7005 - protein, 37 aa, Neocallimastix californiae; identical to SEQ ID NO: 4382
  Dockerin_dom

SEQ ID NO: 7006 - protein, 39 aa, Neocallimastix californiae
  Dockerin_dom
KCFSQKLNPSYPCCTGNEVVYTDENGDWGVENNSWCGIS

SEQ ID NO: 7007 - protein, 37 aa, Neocallimastix californiae; identical to SEQ ID NO: 4382
  Dockerin_dom

SEQ ID NO: 7008 - protein, 39 aa, Neocallimastix californiae
  Dockerin_dom
KCFSQKLNPSYPCCTGNEVVYTDESGDWGVENNSWCGIS

SEQ ID NO: 7009 - protein, 39 aa, Neocallimastix californiae; identical to SEQ ID NO: 4384
  Dockerin_dom

SEQ ID NO: 7010 - protein, 37 aa, Neocallimastix californiae; identical to SEQ ID NO: 4382
  Dockerin_dom

SEQ ID NO: 7011 - protein, 39 aa, Neocallimastix californiae; identical to SEQ ID NO: 7006
  Dockerin_dom

SEQ ID NO: 7012 - protein, 39 aa, Neocallimastix californiae; identical to SEQ ID NO: 4384
  Dockerin_dom

SEQ ID NO: 7013 - protein, 39 aa, Neocallimastix californiae; identical to SEQ ID NO: 4391
  Dockerin_dom

SEQ ID NO: 7014 - protein, 36 aa, Neocallimastix californiae
  Dockerin_dom
CWSLPSYPCCSTSTSVVYEDELGKWGIENDDWCGIK

SEQ ID NO: 7015 - protein, 37 aa, Neocallimastix californiae; identical to SEQ ID NO: 4390
  Dockerin_dom

SEQ ID NO: 7016 - protein, 40 aa, Neocallimastix californiae; identical to SEQ ID NO: 4394
  Dockerin_dom

SEQ ID NO: 7017 - protein, 41 aa, Neocallimastix californiae
  Dockerin_dom
QCWSTKLGYGCCEGCHTYEVDDNGKWGYENGKWCGIVEDKC

SEQ ID NO: 7018 - protein, 39 aa, Neocallimastix californiae; identical to SEQ ID NO: 4395
  Dockerin_dom

SEQ ID NO: 7019 - protein, 39 aa, Neocallimastix californiae
  Dockerin_dom
SCWSESYNYECCRGRNLEIVEKFGDYYWSEENGIRCGIP

SEQ ID NO: 7020 - protein, 41 aa, Neocallimastix californiae; identical to SEQ ID NO: 4396
  Dockerin_dom

SEQ ID NO: 7021 - protein, 33 aa, Neocallimastix californiae
  Dockerin_dom
YPCCSNENTAVITTDEQGDWGVENGDWCGIINK

SEQ ID NO: 7022 - protein, 39 aa, Neocallimastix californiae
  Dockerin_dom
SITSQGYKCCKDNNCSVIETDDAGKWGIEDDDWCGISNK

SEQ ID NO: 7023 - protein, 39 aa, Neocallimastix californiae
  Dockerin_dom
CSQAILSQGYKCCSSDCVVIFTDDDGTWGIENDEWCGCN

SEQ ID NO: 7024 - protein, 38 aa, Neocallimastix californiae; identical to SEQ ID NO: 4067
  Dockerin_dom

SEQ ID NO: 7025 - protein, 39 aa, Neocallimastix californiae
  Dockerin_dom
SCWSLPFGYPCCPHCKVLTEDENGKWGELNGEWCGIVAD

SEQ ID NO: 7026 - protein, 40 aa, Neocallimastix californiae
  Dockerin_dom
SCWADALGYNCCIYTKEVIYTDESGDWGVENNEWCGIIET

SEQ ID NO: 7027 - protein, 39 aa, Neocallimastix californiae
  Dockerin_dom
NCWANILGYQCCENTKEVFLKDESGSWGIENDDWCGIVQ

SEQ ID NO: 7028 - protein, 42 aa, Neocallimastix californiae
  Dockerin_dom
TCWSKALGYPCCKSSCEVIYSDDDGEWGVEDADWCGIEASKC

SEQ ID NO: 7029 - protein, 38 aa, Neocallimastix californiae
  Dockerin_dom
CFSEEMGYPCCSDCSVVYTDSDGGWGVEGDDWCGIKDK

SEQ ID NO: 7030 - protein, 40 aa, Neocallimastix californiae; identical to SEQ ID NO: 4407
  Dockerin_dom

SEQ ID NO: 7031 - protein, 40 aa, Neocallimastix californiae
  Dockerin_dom
CWSKKFGYDCCNGCTSYEEDSNGKWGYEENKWCGIVSENC

SEQ ID NO: 7032 - protein, 41 aa, Neocallimastix californiae
  Dockerin_dom
CSVRITSQGYECCSSCGTVYYTDDDGEWGVENNNWCGMPTN

SEQ ID NO: 7033 - protein, 38 aa, Neocallimastix californiae
  Dockerin_dom
CSASILAQGYECCSDNCEVVYTDADGDWGVENEQWCGC

SEQ ID NO: 7034 - protein, 41 aa, Neocallimastix californiae
  Dockerin_dom
PSNIAAQGYQCCSPGNCSIYLEDDTGRWGIENDEWCGTPSN

SEQ ID NO: 7035 - protein, 40 aa, Neocallimastix californiae; identical to SEQ ID NO: 4411
  Dockerin_dom

SEQ ID NO: 7036 - protein, 39 aa, Neocallimastix californiae
  Dockerin_dom
QCMAEIIGYPCCDKNVKTVYEKDVYGDWGYDFKKGEWCG

SEQ ID NO: 7037 - protein, 39 aa, Neocallimastix californiae
  Dockerin_dom
ECWSEVFGYPCCKGCYVYETDDDGKWGYENQHWCGIQSY

SEQ ID NO: 7038 - protein, 39 aa, Neocallimastix californiae; identical to SEQ ID NO: 4414
  Dockerin_dom

SEQ ID NO: 7039 - protein, 35 aa, Neocallimastix californiae; identical to SEQ ID NO: 4416
  Dockerin_dom

SEQ ID NO: 7040 - protein, 34 aa, Neocallimastix californiae
  Dockerin_dom
ADGYECCNGCSVVEQSDGYKWGVENNKWCIIKNT

SEQ ID NO: 7041 - protein, 38 aa, Neocallimastix californiae; identical to SEQ ID NO: 4417
  Dockerin_dom

SEQ ID NO: 7042 - protein, 35 aa, Neocallimastix californiae
  Dockerin_dom
KNQGYSYCNLCDVIYNDNDGRWGIENGEWCGIKST

SEQ ID NO: 7043 - protein, 39 aa, Neocallimastix californiae
  Dockerin_dom
NCFSINLGYPCCNGNTVYYTDNDGQWGYENNNWCGIKES

SEQ ID NO: 7044 - protein, 40 aa, Neocallimastix californiae; identical to SEQ ID NO: 4420
  Dockerin_dom

SEQ ID NO: 7045 - protein, 39 aa, Neocallimastix californiae; identical to SEQ ID NO: 4423
  Dockerin_dom

SEQ ID NO: 7046 - protein, 38 aa, Neocallimastix californiae
  Dockerin_dom
CFSEELGYPCCSSGVLVYEKDEHGSWGIENNDWCGIIG

SEQ ID NO: 7047 - protein, 36 aa, Neocallimastix californiae; identical to SEQ ID NO: 4422
  Dockerin_dom

SEQ ID NO: 7048 - protein, 39 aa, Neocallimastix californiae; identical to SEQ ID NO: 4423
  Dockerin_dom

SEQ ID NO: 7049 - protein, 38 aa, Neocallimastix californiae; identical to SEQ ID NO: 7046
  Dockerin_dom

SEQ ID NO: 7050 - protein, 36 aa, Neocallimastix californiae; identical to SEQ ID NO: 4422
  Dockerin_dom

SEQ ID NO: 7051 - protein, 33 aa, Neocallimastix californiae
  Dockerin_dom
YPCCDNCEVYYTDNEGKWGILNNDWCKINDNRC

SEQ ID NO: 7052 - protein, 40 aa, Neocallimastix californiae
  Dockerin_dom
CSSRITSQGYKCCSNCIVYYTDNDGEWGVEDGNWCGTPDK

SEQ ID NO: 7053 - protein, 37 aa, Neocallimastix californiae
  Dockerin_dom
CWSEKLGYPCCKPTNTEILEVDKYGEWGMENGERCGI

SEQ ID NO: 7054 - protein, 37 aa, Neocallimastix californiae; identical to SEQ ID NO: 4431
  Dockerin_dom

SEQ ID NO: 7055 - protein, 36 aa, Neocallimastix californiae; identical to SEQ ID NO: 1879
  Dockerin_dom

SEQ ID NO: 7056 - protein, 37 aa, Neocallimastix californiae; identical to SEQ ID NO: 7053
  Dockerin_dom

SEQ ID NO: 7057 - protein, 39 aa, Neocallimastix californiae
  Dockerin_dom
CNANIIAQGYKCCRVGCTVEYTDNDGEWGVEDGDWCGCG

SEQ ID NO: 7058 - protein, 39 aa, Neocallimastix californiae
  Dockerin_dom
CPSSITRQGYKCCRVGCTVEYTDNDGEWGVEDGDWCGCG

SEQ ID NO: 7059 - protein, 30 aa, Neocallimastix californiae
  Dockerin_dom
YPCCTGNEVVYTDSDGDWGYENNQWCGIAK

SEQ ID NO: 7060 - protein, 38 aa, Neocallimastix californiae
  Dockerin_dom
CFSESLGYNCCKGCDIILTDDYGSWGVENNDWCGINDS

SEQ ID NO: 7061 - protein, 38 aa, Neocallimastix californiae
  Dockerin_dom
SCWSLPEYKCCSEGIESIFEDSIGKWGIEDNEWCGIKA

SEQ ID NO: 7062 - protein, 27 aa, Neocallimastix californiae
  Dockerin_dom
YKCCGNCDVYYVDDFEWGVEDGKWCLT

SEQ ID NO: 7063 - protein, 42 aa, Neocallimastix californiae
  Dockerin_dom
KCWALAEGYPCCKNKDAKVYSTDKHGKKWGIEDNNWCGIIEE

SEQ ID NO: 7064 - protein, 33 aa, Neocallimastix californiae
  Dockerin_dom
NSGYSCCVLTKKVELTDNVGQWGVENGEWCLFE

SEQ ID NO: 7065 - protein, 39 aa, Neocallimastix californiae; identical to SEQ ID NO: 4441
  Dockerin_dom

SEQ ID NO: 7066 - protein, 40 aa, Neocallimastix californiae
  Dockerin_dom
CWAKALGSNCCSTSSCRNVVYFDYDGQWDVENGEWCGIST

SEQ ID NO: 7067 - protein, 39 aa, Neocallimastix californiae; identical to SEQ ID NO: 4442
  Dockerin_dom

SEQ ID NO: 7068 - protein, 38 aa, Neocallimastix californiae
  Dockerin_dom
NECTFESIGYKCCSNSCTVVYTDESGDWGVENGEWCGI

SEQ ID NO: 7069 - protein, 40 aa, Neocallimastix californiae; identical to SEQ ID NO: 4444
  Dockerin_dom

SEQ ID NO: 7070 - protein, 41 aa, Neocallimastix californiae
  Dockerin_dom
SSCSGAQGYPCCKSTCSSYFQDNDGEWGVENDDWCLINKSI

SEQ ID NO: 7071 - protein, 38 aa, Neocallimastix californiae; identical to SEQ ID NO: 4447
  Dockerin_dom

SEQ ID NO: 7072 - protein, 36 aa, Neocallimastix californiae; identical to SEQ ID NO: 4446
  Dockerin_dom

SEQ ID NO: 7073 - protein, 39 aa, Neocallimastix californiae; identical to SEQ ID NO: 4448
  Dockerin_dom

SEQ ID NO: 7074 - protein, 39 aa, Neocallimastix californiae
  Dockerin_dom
ECWSEKLGYSCCSENNTRVVLTDDDGKWGAENGEWCGIR

SEQ ID NO: 7075 - protein, 41 aa, Neocallimastix californiae; identical to SEQ ID NO: 4449
  Dockerin_dom

SEQ ID NO: 7076 - protein, 36 aa, Neocallimastix californiae; identical to SEQ ID NO: 4453
  Dockerin_dom

SEQ ID NO: 7077 - protein, 41 aa, Neocallimastix californiae
  Dockerin_dom
SCWATSQGYPCCTGCDAIYTDGSGKWGFENNNWCGIVDSQC

SEQ ID NO: 7078 - protein, 39 aa, Neocallimastix californiae; identical to SEQ ID NO: 4451
  Dockerin_dom

SEQ ID NO: 7079 - protein, 37 aa, Neocallimastix californiae; identical to SEQ ID NO: 1906
  Dockerin_dom

SEQ ID NO: 7080 - protein, 36 aa, Neocallimastix californiae
  Dockerin_dom
NTGYHCCSDPNTTVYTSDSSGDWGVEGDYWCLIVKE

SEQ ID NO: 7081 - protein, 39 aa, Neocallimastix californiae; identical to SEQ ID NO: 4456
  Dockerin_dom

SEQ ID NO: 7082 - protein, 33 aa, Neocallimastix californiae
  Dockerin_dom
DYPNCKNKDTEILYSSDDTKKEWGEENDDWCII

SEQ ID NO: 7083 - protein, 37 aa, Neocallimastix californiae
  Dockerin_dom
CPGENLGYNCCSSCIEPYEEDENGKWAVVDESWCSLP

SEQ ID NO: 7084 - protein, 30 aa, Neocallimastix californiae
  Dockerin_dom
FPCCTSTTEVVEVDENGEWGIENGNWCGIR

SEQ ID NO: 7085 - protein, 39 aa, Neocallimastix californiae
  Dockerin_dom
ECFSNGLGYPCCNSCDIIYIDESGNWGVENGDWCGIKDT

SEQ ID NO: 7086 - protein, 39 aa, Neocallimastix californiae
  Dockerin_dom
SCFAISLGYSCCEGSEIVYTDDDGDWGYENDNWCGIENN

SEQ ID NO: 7087 - protein, 39 aa, Neocallimastix californiae
  Dockerin_dom
SCPGKSEGYQCCSSCNVVFTDENGSWGVENNEWCGIRNT

SEQ ID NO: 7088 - protein, 40 aa, Neocallimastix californiae; identical to SEQ ID NO: 4462
  Dockerin_dom

SEQ ID NO: 7089 - protein, 34 aa, Neocallimastix californiae; identical to SEQ ID NO: 4464
  Dockerin_dom

SEQ ID NO: 7090 - protein, 38 aa, Neocallimastix californiae
  Dockerin_dom
CWAKALGYECCKTCQTTVSKDENGEWGIENDEWCGITT

SEQ ID NO: 7091 - protein, 34 aa, Neocallimastix californiae
  Dockerin_dom
NEGYSKCDNCEVVYSDDSGNWGVQNNDWCGISNK

SEQ ID NO: 7092 - protein, 31 aa, Neocallimastix californiae
  Dockerin_dom
YPCCSECNSVYSDESGEWGVENNDWCLLKKS

SEQ ID NO: 7093 - protein, 38 aa, Neocallimastix californiae
  Dockerin_dom
DCFAKAQGFECCNDSEVVYSDDSGDWGVVNGQWCGIGG

SEQ ID NO: 7094 - protein, 33 aa, Neocallimastix californiae
  Dockerin_dom
GQEYNCCKGCDVIYTDTSDWGVEDDDWCSIPYT

SEQ ID NO: 7095 - protein, 41 aa, Neocallimastix californiae
  Dockerin_dom
ECWATELGYPCCELKTTKIEFTDSGSGKQFGVENNHICGIN

SEQ ID NO: 7096 - protein, 41 aa, Neocallimastix californiae
  Dockerin_dom
CSEKILAQGYKCCSDKNCIVYYEDSDGYWGIENDDWCGCGT

SEQ ID NO: 7097 - protein, 34 aa, Neocallimastix californiae
  Dockerin_dom
GVQGYPCCKNTSTVFYTDDDGDWGVENNNWCVIK

SEQ ID NO: 7098 - protein, 39 aa, Neocallimastix californiae
  Dockerin_dom
KCTSEKLGYPCCSSNNNKVYYTDNDGDWGFDENTNNWCG

SEQ ID NO: 7099 - protein, 40 aa, Neocallimastix californiae; identical to SEQ ID NO: 4473
  Dockerin_dom

SEQ ID NO: 7100 - protein, 38 aa, Neocallimastix californiae; identical to SEQ ID NO: 4474
  Dockerin_dom

SEQ ID NO: 7101 - protein, 40 aa, Neocallimastix californiae; identical to SEQ ID NO: 4477
  Dockerin_dom

SEQ ID NO: 7102 - protein, 32 aa, Neocallimastix californiae
  Dockerin_dom
AYPCCSKCNVVYTDEEGEWGYEKGSWCGIKDT

SEQ ID NO: 7103 - protein, 40 aa, Neocallimastix californiae; identical to SEQ ID NO: 4476
  Dockerin_dom

SEQ ID NO: 7104 - protein, 36 aa, Neocallimastix californiae
  Dockerin_dom
CWSKKFNIPCCKSTDAVVRSTYDGEWGLENGEWCGL

SEQ ID NO: 7105 - protein, 41 aa, Neocallimastix californiae
  Dockerin_dom
TCWSKKFGYGCCEGCRAYEEDADGKWGYENNEWCGIVEQNC

SEQ ID NO: 7106 - protein, 40 aa, Neocallimastix californiae; identical to SEQ ID NO: 4479
  Dockerin_dom

SEQ ID NO: 7107 - protein, 39 aa, Neocallimastix californiae
  Dockerin_dom
CWSKALGYNCCTTTSVVQYEDQDGPWGIENNDWCGIIKN

SEQ ID NO: 7108 - protein, 39 aa, Neocallimastix californiae
  Dockerin_dom
DCWSSRLGYPCCTSTNSIYFSDGDGDWGIENNQWCGLPK

SEQ ID NO: 7109 - protein, 38 aa, Neocallimastix californiae; identical to SEQ ID NO: 4483
  Dockerin_dom

SEQ ID NO: 7110 - protein, 30 aa, Neocallimastix californiae
  Dockerin_dom
YNCCQGCKVKYVDSEKWGYENGEWCSIPYS

SEQ ID NO: 7111 - protein, 40 aa, Neocallimastix californiae
  Dockerin_dom
ACWSIEEGYPCCQKKTTKVKHVSKNGNEWGVENNNWCGIT

SEQ ID NO: 7112 - protein, 39 aa, Neocallimastix californiae; identical to SEQ ID NO: 4486
  Dockerin_dom

SEQ ID NO: 7113 - protein, 32 aa, Neocallimastix californiae
  Dockerin_dom
NKKNTLPCCTTCDIYLIDATGRYGYENGEWCN

SEQ ID NO: 7114 - protein, 40 aa, Neocallimastix californiae
  Dockerin_dom
CWSRSIGFVCCDKCNVLYVDEQGQWGVEDGYWCGINPSKC

SEQ ID NO: 7115 - protein, 38 aa, Neocallimastix californiae; identical to SEQ ID NO: 4489
  Dockerin_dom

SEQ ID NO: 7116 - protein, 37 aa, Neocallimastix californiae
  Dockerin_dom
CWSERLGYPCCVGYTDTIFADADGEWGLQNDDWCGIT

SEQ ID NO: 7117 - protein, 39 aa, Neocallimastix californiae
  Dockerin_dom
ECWSESYGYKCCTDPDAKIEYDGDGNLWGVENGEWCGIK

SEQ ID NO: 7118 - protein, 37 aa, Neocallimastix californiae
  Dockerin_dom
CWSEPEYRCCNPETQVFYSDDQGKWGIENGEWCGIIE

SEQ ID NO: 7119 - protein, 39 aa, Neocallimastix californiae; identical to SEQ ID NO: 4490
  Dockerin_dom

SEQ ID NO: 7120 - protein, 37 aa, Neocallimastix californiae; identical to SEQ ID NO: 4494
  Dockerin_dom

SEQ ID NO: 7121 - protein, 36 aa, Neocallimastix californiae; identical to SEQ ID NO: 4496
  Dockerin_dom

SEQ ID NO: 7122 - protein, 36 aa, Neocallimastix californiae
  Dockerin_dom
CWAVKYGYSCCKETTVIEEVDENGRWGFENGGRCGF

SEQ ID NO: 7123 - protein, 40 aa, Neocallimastix californiae
  Dockerin_dom
CSPKILAQGYSCCPKGCRVYETDEDGDWGYVDNEWCGCKV

SEQ ID NO: 7124 - protein, 33 aa, Neocallimastix californiae; identical to SEQ ID NO: 4498
  Dockerin_dom

SEQ ID NO: 7125 - protein, 40 aa, Neocallimastix californiae; identical to SEQ ID NO: 4499
  Dockerin_dom

SEQ ID NO: 7126 - protein, 40 aa, Neocallimastix californiae; identical to SEQ ID NO: 4504
  Dockerin_dom

SEQ ID NO: 7127 - protein, 40 aa, Neocallimastix californiae; identical to SEQ ID NO: 4503
  Dockerin_dom

SEQ ID NO: 7128 - protein, 40 aa, Neocallimastix californiae; identical to SEQ ID NO: 4502
  Dockerin_dom

SEQ ID NO: 7129 - protein, 40 aa, Neocallimastix californiae
  Dockerin_dom
CWSESKGYPCCKYCDVVSVDRYGSWGIENGKWCGVKSDVC

SEQ ID NO: 7130 - protein, 40 aa, Neocallimastix californiae; identical to SEQ ID NO: 4501
  Dockerin_dom

SEQ ID NO: 7131 - protein, 39 aa, Neocallimastix californiae
  Dockerin_dom
ECFATKLGYPCCSVGYPTVLKDESGSWSVENGEWCGVSD

SEQ ID NO: 7132 - protein, 38 aa, Neocallimastix californiae; identical to SEQ ID NO: 4506
  Dockerin_dom

SEQ ID NO: 7133 - protein, 40 aa, Neocallimastix californiae; identical to SEQ ID NO: 4508
  Dockerin_dom

SEQ ID NO: 7134 - protein, 37 aa, Neocallimastix californiae; identical to SEQ ID NO: 1959
  Dockerin_dom

SEQ ID NO: 7135 - protein, 37 aa, Neocallimastix californiae
  Dockerin_dom
ECWSLKLNYPCCDRNNTISFYRNDYGAWGNVDNKWCG

SEQ ID NO: 7136 - protein, 40 aa, Neocallimastix californiae; identical to SEQ ID NO: 4511
  Dockerin_dom

SEQ ID NO: 7137 - protein, 37 aa, Neocallimastix californiae; identical to SEQ ID NO: 4510
  Dockerin_dom

SEQ ID NO: 7138 - protein, 39 aa, Neocallimastix californiae; identical to SEQ ID NO: 4513
  Dockerin_dom

SEQ ID NO: 7139 - protein, 37 aa, Neocallimastix californiae
  Dockerin_dom
CTFESIGYNCCSSTTDVIYQDENGDWGVENNDWCGII

SEQ ID NO: 7140 - protein, 41 aa, Neocallimastix californiae; identical to SEQ ID NO: 4514
  Dockerin_dom

SEQ ID NO: 7141 - protein, 38 aa, Neocallimastix californiae
  Dockerin_dom
CWSDALGYPCCHGCTVYETDADGSWGYESNQWCGIQSY

SEQ ID NO: 7142 - protein, 38 aa, Neocallimastix californiae; identical to SEQ ID NO: 4516
  Dockerin_dom

SEQ ID NO: 7143 - protein, 39 aa, Neocallimastix californiae; identical to SEQ ID NO: 4517
  Dockerin_dom

SEQ ID NO: 7144 - protein, 30 aa, Neocallimastix californiae
  Dockerin_dom
YKCCSHCNVSYTDSTKWGIENNHWCHIPST

SEQ ID NO: 7145 - protein, 44 aa, Neocallimastix californiae
  Dockerin_dom
TCWSEAYGYHCCKNPDTVLIEPRSKSNPGREWYGVEDNKWCGIA

SEQ ID NO: 7146 - protein, 33 aa, Neocallimastix californiae
  Dockerin_dom
EYNCCVFSTTENVQTTEEGKWGVEFNKWCLIDD

SEQ ID NO: 7147 - protein, 32 aa, Neocallimastix californiae
  Dockerin_dom
YECCSGCDVFYSDNEALWGVENGNWCVIQNSV

SEQ ID NO: 7148 - protein, 33 aa, Neocallimastix californiae
  Dockerin_dom
DYPNCNSCDVYYTDATGKWGVENRNWCIIQESR

SEQ ID NO: 7149 - protein, 35 aa, Neocallimastix californiae
  Dockerin_dom
HAYEDCEGCYVVTEEDGIKWGVENNDWCKIVSSKC

SEQ ID NO: 7150 - protein, 32 aa, Neocallimastix californiae
  Dockerin_dom
TYMCCEGCDVYDQTEEGMWGIENDNWCGIKDS

SEQ ID NO: 7151 - protein, 32 aa, Neocallimastix californiae
  Dockerin_dom
SYKCCQGCNVIEEDASGKWGIENNEWCGIKDS

SEQ ID NO: 7152 - protein, 39 aa, Neocallimastix californiae
  Dockerin_dom
WATKLGYKCCTAKCPVEEYVDNDGSWGIENNNWCGITKS

SEQ ID NO: 7153 - protein, 41 aa, Neocallimastix californiae; identical to SEQ ID NO: 4526
  Dockerin_dom

SEQ ID NO: 7154 - protein, 40 aa, Neocallimastix californiae
  Dockerin_dom
NECSASKFGYPCCKGCTVYEKDEVGEWGYENDEWCSIKAT

SEQ ID NO: 7155 - protein, 42 aa, Neocallimastix californiae; identical to SEQ ID NO: 4528
  Dockerin_dom

SEQ ID NO: 7156 - protein, 40 aa, Neocallimastix californiae
  Dockerin_dom
NCWAAKLGFNCCKTTKTVVYEDADGNWGVEDDYWCGIIED

SEQ ID NO: 7157 - protein, 35 aa, Neocallimastix californiae
  Dockerin_dom
KCEFSTIGYSCCPDNEVIFEDDHKWGVNSNGQWCG

SEQ ID NO: 7158 - protein, 38 aa, Neocallimastix californiae; identical to SEQ ID NO: 4531
  Dockerin_dom

SEQ ID NO: 7159 - protein, 38 aa, Neocallimastix californiae; identical to SEQ ID NO: 1984
  Dockerin_dom

SEQ ID NO: 7160 - protein, 33 aa, Neocallimastix californiae
  Dockerin_dom
EKGYNSCTLGTKVSFTDVNGIWGIENDKWCAIL

SEQ ID NO: 7161 - protein, 36 aa, Neocallimastix californiae; identical to SEQ ID NO: 4536
  Dockerin_dom

SEQ ID NO: 7162 - protein, 40 aa, Neocallimastix californiae; identical to SEQ ID NO: 4535
  Dockerin_dom

SEQ ID NO: 7163 - protein, 39 aa, Neocallimastix californiae
  Dockerin_dom
ECWSLSEGYKCCSAGTTVALVDSKGKWGIENGDWCGIID

SEQ ID NO: 7164 - protein, 40 aa, Neocallimastix californiae
  Dockerin_dom
DCWATKLDYPCCSYSTQVFETDENGQWSIENGEWCGIVSS

SEQ ID NO: 7165 - protein, 39 aa, Neocallimastix californiae; identical to SEQ ID NO: 4539
  Dockerin_dom

SEQ ID NO: 7166 - protein, 40 aa, Neocallimastix californiae
  Dockerin_dom
DCFSEKLGYPCCKKTKDIVYSDEDGPWGVEDNSWCGIQRE

SEQ ID NO: 7167 - protein, 39 aa, Neocallimastix californiae; identical to SEQ ID NO: 4543
  Dockerin_dom

SEQ ID NO: 7168 - protein, 39 aa, Neocallimastix californiae
  Dockerin_dom
SCWSEALGYPCCQGEVEYVESNENGDWGLENNEWCGLPK

SEQ ID NO: 7169 - protein, 38 aa, Neocallimastix californiae; identical to SEQ ID NO: 4544
  Dockerin_dom

SEQ ID NO: 7170 - protein, 38 aa, Neocallimastix californiae; identical to SEQ ID NO: 4541
  Dockerin_dom

SEQ ID NO: 7171 - protein, 39 aa, Neocallimastix californiae; identical to SEQ ID NO: 4545
  Dockerin_dom

SEQ ID NO: 7172 - protein, 39 aa, Neocallimastix californiae
  Dockerin_dom
ECWSSKLGYKCCSRGCNTAVVVTDNDGAWGVENGEWCGV

SEQ ID NO: 7173 - protein, 36 aa, Neocallimastix californiae
  Dockerin_dom
TCWSEPDYPCCKNTCRVVYTDSSEWGVENGNWCGIP

SEQ ID NO: 7174 - protein, 32 aa, Neocallimastix californiae
  Dockerin_dom
YPCCSTCDVYLTEDNGSRWGVENNDWCSIKNS

SEQ ID NO: 7175 - protein, 24 aa, Neocallimastix californiae
  Dockerin_dom
CWSEKLGYPCCQNTSSVVYTDNDG

SEQ ID NO: 7176 - protein, 39 aa, Neocallimastix californiae; identical to SEQ ID NO: 4550
  Dockerin_dom

SEQ ID NO: 7177 - protein, 14 aa, Neocallimastix californiae
  Dockerin_dom
WGVENGNWCGIKSS

SEQ ID NO: 7178 - protein, 38 aa, Neocallimastix californiae
  Dockerin_dom
SCWSEPDYKCCTTCDIVYTDDHNWGVENGEWCGIDDSK

SEQ ID NO: 7179 - protein, 39 aa, Neocallimastix californiae
  Dockerin_dom
ECGAAALGYPCCQSTCTEVYTDEYRWGVENGDWCGLKDS

SEQ ID NO: 7180 - protein, 40 aa, Neocallimastix californiae; identical to SEQ ID NO: 4554
  Dockerin_dom

SEQ ID NO: 7181 - protein, 41 aa, Neocallimastix californiae
  Dockerin_dom
ECWSEILGYPCCKGCKIYETDSDGSWGYEFNQWCGIISSRC

SEQ ID NO: 7182 - protein, 38 aa, Neocallimastix californiae
  Dockerin_dom
NCFSIALGFPCCKGNTVIYTDDDGDWGVENEEWCGISG

SEQ ID NO: 7183 - protein, 39 aa, Neocallimastix californiae
  Dockerin_dom
SCFAKALGYECCSTCDVVYTDDDGDWGVDNGEWCGIKDN

SEQ ID NO: 7184 - protein, 40 aa, Neocallimastix californiae
  Dockerin_dom
SCWAEELDDGYPCCKTTNVVIETDGNGEWGIENDQWCGIR

SEQ ID NO: 7185 - protein, 38 aa, Neocallimastix californiae
  Dockerin_dom
NKCWSNFLGYPCCKKTDDIIYNAVKGSWGYENNSWCGL

SEQ ID NO: 7186 - protein, 40 aa, Neocallimastix californiae
  Dockerin_dom
CWSELLDDPFPCCTKDDGPIEGENMEGSWGIENGQKCGYR

SEQ ID NO: 7187 - protein, 40 aa, Neocallimastix californiae; identical to SEQ ID NO: 4557
  Dockerin_dom

SEQ ID NO: 7188 - protein, 38 aa, Neocallimastix californiae
  Dockerin_dom
DCKGLSEGYPCCSSLSMKTSGYDDQWGYEDNDWCRLTD

SEQ ID NO: 7189 - protein, 40 aa, Neocallimastix californiae
  Dockerin_dom
CWSLKLDEPYPCCVYATEIIYTNENGKWSMENGDWCGIIE

SEQ ID NO: 7190 - protein, 39 aa, Neocallimastix californiae
  Dockerin_dom
DCWATKKGFPCCSNKDTSIVSVDSEGQWGMENGQWCGIE

SEQ ID NO: 7191 - protein, 41 aa, Neocallimastix californiae
  Dockerin_dom
KCWSLSQGYPCCSIQPYHIELSDESGDWGIENGDWCGIPKS

SEQ ID NO: 7192 - protein, 38 aa, Neocallimastix californiae
  Dockerin_dom
CWSVSKGYPCCVGDNPSIEFVDSDGQWGLENGNWCGIA

SEQ ID NO: 7193 - protein, 34 aa, Neocallimastix californiae
  Dockerin_dom
STGYSCCMFNTTAIATKDSDGYWGVENGQWCLFE

SEQ ID NO: 7194 - protein, 38 aa, Neocallimastix californiae
  Dockerin_dom
CPAAKNGYKCCNACKVKTTDKNGDWGVENGEWCSIPYT

SEQ ID NO: 7195 - protein, 42 aa, Neocallimastix californiae
  Dockerin_dom
KCWSKSQGYSCCKDATTTVRTTDSKGYLWGIENNEWCGITGN

SEQ ID NO: 7196 - protein, 40 aa, Neocallimastix californiae; identical to SEQ ID NO: 4569
  Dockerin_dom

SEQ ID NO: 7197 - protein, 35 aa, Neocallimastix californiae; identical to SEQ ID NO: 4568
  Dockerin_dom

SEQ ID NO: 7198 - protein, 39 aa, Neocallimastix californiae
  Dockerin_dom
CSGAILSQGYKCCSSGCSVVYTDGDGTWGFENDQWCGCN

SEQ ID NO: 7199 - protein, 41 aa, Neocallimastix californiae
  Dockerin_dom
PASIASQGYKCCSSNNCDVYLTDESGKWGVENNDWCGISNS

SEQ ID NO: 7200 - protein, 38 aa, Neocallimastix californiae
  Dockerin_dom
CSAAILSQGYKCCSGGCSVVYTDGDGTWGVENGQWCGC

SEQ ID NO: 7201 - protein, 41 aa, Neocallimastix californiae
  Dockerin_dom
PATITSQGYKCCSSNNCDVYLTDESGRWGVENNDWCGISNS

SEQ ID NO: 7202 - protein, 33 aa, Neocallimastix californiae
  Dockerin_dom
ALGYECCKTTTTVIYTDESGKWGIENNEWCEIK

SEQ ID NO: 7203 - protein, 39 aa, Neocallimastix californiae; identical to SEQ ID NO: 4581
  Dockerin_dom

SEQ ID NO: 7204 - protein, 39 aa, Neocallimastix californiae; identical to SEQ ID NO: 4583
  Dockerin_dom

SEQ ID NO: 7205 - protein, 31 aa, Neocallimastix californiae
  Dockerin_dom
YSNCKNTCEIAYEDENKWGIENEDWCILPDS

SEQ ID NO: 7206 - protein, 39 aa, Neocallimastix californiae
  Dockerin_dom
SCWASSLGYSCCKGCDIIITDSNGDWGVEDNEWCGILST

SEQ ID NO: 7207 - protein, 36 aa, Neocallimastix californiae; identical to SEQ ID NO: 4586
  Dockerin_dom

SEQ ID NO: 7208 - protein, 40 aa, Neocallimastix californiae; identical to SEQ ID NO: 4587
  Dockerin_dom

SEQ ID NO: 7209 - protein, 31 aa, Neocallimastix californiae
  Dockerin_dom
YYPCCKTTTEIVSTDNSGDWGIENDEWCGIG

SEQ ID NO: 7210 - protein, 36 aa, Neocallimastix californiae
  Dockerin_dom
EGTEYKCCSSCLDVYEEDENGPWAIEDEQWCSLPYY

SEQ ID NO: 7211 - protein, 31 aa, Neocallimastix californiae
  Dockerin_dom
YGYPCCSNCELTYQDETGKWGVEGEEWCGLR

SEQ ID NO: 7212 - protein, 40 aa, Neocallimastix californiae
  Dockerin_dom
SCWSLKYGYLCCNSDSTSVVKTNKYGNWGKENGKWCGIKD

SEQ ID NO: 7213 - protein, 39 aa, Neocallimastix californiae
  Dockerin_dom
KCPFKAIGYGCCKNSKTEIVFTDSFGNYGVEKGKRCGII

SEQ ID NO: 7214 - protein, 40 aa, Neocallimastix californiae; identical to SEQ ID NO: 4594
  Dockerin_dom

SEQ ID NO: 7215 - protein, 30 aa, Neocallimastix californiae
  Dockerin_dom
YRCCKECNVIFTDSEDWGIEDGDWCSIPYT

SEQ ID NO: 7216 - protein, 32 aa, Neocallimastix californiae
  Dockerin_dom
NTGYHCCLYTTEVETTDAVGQWGIEAGEWCLF

SEQ ID NO: 7217 - protein, 37 aa, Neocallimastix californiae; identical to SEQ ID NO: 4596
  Dockerin_dom

SEQ ID NO: 7218 - protein, 41 aa, Neocallimastix californiae
  Dockerin_dom
SCWSLPLGYNCCSSDNTEVYYTDDDGQWGVENGDWCGIMSD

SEQ ID NO: 7219 - protein, 39 aa, Neocallimastix californiae
  Dockerin_dom
CWSEPLGYECCDPKDNTYYYEDDDGYWGLVDGEWCGIIA

SEQ ID NO: 7220 - protein, 37 aa, Neocallimastix californiae; identical to SEQ ID NO: 4600
  Dockerin_dom

SEQ ID NO: 7221 - protein, 35 aa, Neocallimastix californiae
  Dockerin_dom
DYPCCSRCDIKVILDDGDNKQWGIENSNWCGLPDN

SEQ ID NO: 7222 - protein, 38 aa, Neocallimastix californiae
  Dockerin_dom
ECFANKLGYPCCTQTNEIVSIDENGKWGLENGQICGIE

SEQ ID NO: 7223 - protein, 40 aa, Neocallimastix californiae; identical to SEQ ID NO: 4602
  Dockerin_dom

SEQ ID NO: 7224 - protein, 39 aa, Neocallimastix californiae
  Dockerin_dom
CWAKELGYECCSTNSCRNAIYTDDDGEWDVENGNWCGIT

SEQ ID NO: 7225 - protein, 40 aa, Neocallimastix californiae
  Dockerin_dom
CSKKFNQMGYKCCNSCNAVYTDSTGRWGVENRQWCGIRND

SEQ ID NO: 7226 - protein, 41 aa, Neocallimastix californiae
  Dockerin_dom
SSMLRQGYKCCEINNCNIYHKDGDGDWGLDRNLKWCGIRFE

SEQ ID NO: 7227 - protein, 40 aa, Neocallimastix californiae; identical to SEQ ID NO: 4606
  Dockerin_dom

SEQ ID NO: 7228 - protein, 30 aa, Neocallimastix californiae
  Dockerin_dom
YPCCKECNIYYTDSEDWGIEDGKWCSIPHS

SEQ ID NO: 7229 - protein, 30 aa, Neocallimastix californiae
  Dockerin_dom
TGFNCCLFTTIVATTDSVGQWGVENGEWCL

SEQ ID NO: 7230 - protein, 42 aa, Neocallimastix californiae
  Dockerin_dom
CWATYLDKNYTCCSNDNIEIKSINMDGEWGLENNNWCGLRNS

SEQ ID NO: 7231 - protein, 38 aa, Neocallimastix californiae
  Dockerin_dom
CWSLPDYSCCKDKNIDVIYTDNMGNWGIENGEWCGIIR

SEQ ID NO: 7232 - protein, 37 aa, Neocallimastix californiae; identical to SEQ ID NO: 4614
  Dockerin_dom

SEQ ID NO: 7233 - protein, 31 aa, Neocallimastix californiae
  Dockerin_dom
YPCCNNNNIAVVITDDKGNWGIENGEWCGIL

SEQ ID NO: 7234 - protein, 39 aa, Neocallimastix californiae
  Dockerin_dom
SCWSLPDYPCCRNKKTDVVYTDDNGNWGIENENWCGIIR

SEQ ID NO: 7235 - protein, 40 aa, Neocallimastix californiae; identical to SEQ ID NO: 4612
  Dockerin_dom

SEQ ID NO: 7236 - protein, 39 aa, Neocallimastix californiae; identical to SEQ ID NO: 4613
  Dockerin_dom

SEQ ID NO: 7237 - protein, 28 aa, Neocallimastix californiae
  Dockerin_dom
KCWSTSLGYSCCKTCTDIILVDSNGKWG

SEQ ID NO: 7238 - protein, 38 aa, Neocallimastix californiae; identical to SEQ ID NO: 4617
  Dockerin_dom

SEQ ID NO: 7239 - protein, 38 aa, Neocallimastix californiae; identical to SEQ ID NO: 4618
  Dockerin_dom

SEQ ID NO: 7240 - protein, 39 aa, Neocallimastix californiae; identical to SEQ ID NO: 4619
  Dockerin_dom

SEQ ID NO: 7241 - protein, 39 aa, Neocallimastix californiae
  Dockerin_dom
QCWSEAQGYPCCKFTSDVVFTDNDGNWGVENGNWCGIQK

SEQ ID NO: 7242 - protein, 40 aa, Neocallimastix californiae
  Dockerin_dom
PCWSESLGYKCCSSCGQVYFTDENGRWSVENDDWCGLLAN

SEQ ID NO: 7243 - protein, 38 aa, Neocallimastix californiae
  Dockerin_dom
SCWSNSLGYNCCSDSNTQVYYEDQDGQWGIENNNWCGI

SEQ ID NO: 7244 - protein, 41 aa, Neocallimastix californiae
  Dockerin_dom
CSSSFTSQGYKCCSYCSTVYYTDDSGKWGIENGNWCGLPSN

SEQ ID NO: 7245 - protein, 39 aa, Neocallimastix californiae
  Dockerin_dom
CSEKILKQGYKCCPANCQIVYADNDGTWGVDNNQWCGCG

SEQ ID NO: 7246 - protein, 39 aa, Neocallimastix californiae
  Dockerin_dom
ECTGRNQGYQCCNSCDVYYTDNDGRWGVENNAWCGIKNT

SEQ ID NO: 7247 - protein, 38 aa, Neocallimastix californiae
  Dockerin_dom
NCFSVNLGYPCCNGNTVYYTDDDGKWGYENDNWCGIKE

SEQ ID NO: 7248 - protein, 41 aa, Neocallimastix californiae; identical to SEQ ID NO: 4627
  Dockerin_dom

SEQ ID NO: 7249 - protein, 40 aa, Neocallimastix californiae
  Dockerin_dom
PAAITNQGYKCCSAKCNPVVYKDESGDWGVENNQWCGCPT

SEQ ID NO: 7250 - protein, 38 aa, Neocallimastix californiae
  Dockerin_dom
TAITSQGYKCCRNKCNPVVYQDEAGDWGVENNQWCGCP

SEQ ID NO: 7251 - protein, 38 aa, Neocallimastix californiae; identical to SEQ ID NO: 7250
  Dockerin_dom

SEQ ID NO: 7252 - protein, 41 aa, Neocallimastix californiae
  Dockerin_dom
CNSKVTQQGYKCCSTCTATVYVDDAGKWGVENNDWCGIPTN

SEQ ID NO: 7253 - protein, 38 aa, Neocallimastix californiae
  Dockerin_dom
TAITSQGYKCCSAKCNPVVYQDEAGDWGVENNQWCGCP

SEQ ID NO: 7254 - protein, 41 aa, Neocallimastix californiae
  Dockerin_dom
CNSKVTQQGYKCCSTCTETFYVDDAGKWGIENNDWCGIPTT

SEQ ID NO: 7255 - protein, 31 aa, Neocallimastix californiae
  Dockerin_dom
YPCCESCDVVTTDQNGKWGIENGHWCSIKYS

SEQ ID NO: 7256 - protein, 39 aa, Neocallimastix californiae; identical to SEQ ID NO: 4634
  Dockerin_dom

SEQ ID NO: 7257 - protein, 36 aa, Neocallimastix californiae
  Dockerin_dom
TYGYPYCYGCQVTYTSNDGICWGWENNNSCVINNSR

SEQ ID NO: 7258 - protein, 39 aa, Neocallimastix californiae; identical to SEQ ID NO: 4636
  Dockerin_dom

SEQ ID NO: 7259 - protein, 42 aa, Neocallimastix californiae; identical to SEQ ID NO: 4637
  Dockerin_dom

SEQ ID NO: 7260 - protein, 34 aa, Neocallimastix californiae
  Dockerin_dom
YPCCSKCDIEVAFNEGEHKLWGIENSNWCGIPES

SEQ ID NO: 7261 - protein, 38 aa, Neocallimastix californiae
  Dockerin_dom
NECWSLKLGYSCCKESTKVYTTDESGSWGVENGQWCGI

SEQ ID NO: 7262 - protein, 28 aa, Neocallimastix californiae
  Dockerin_dom
YECCSPGTKVEYTDEEALWGVENGNWCY

SEQ ID NO: 7263 - protein, 38 aa, Neocallimastix californiae
  Dockerin_dom
TCWANDYGYDCCGPEIVKGNYIDNDGIWYQNDSYWCGL

SEQ ID NO: 7264 - protein, 29 aa, Neocallimastix californiae
  Dockerin_dom
YECCSPGTKVEYTDEEALWGVENGNWCYI

SEQ ID NO: 7265 - protein, 29 aa, Neocallimastix californiae
  Dockerin_dom
FKCCSPGTKVEYTDEEALWGVENGNWCYI

SEQ ID NO: 7266 - protein, 29 aa, Neocallimastix californiae
  Dockerin_dom
YECCSPGTKVEYTDEEALWGVENGNWCYI

SEQ ID NO: 7267 - protein, 39 aa, Neocallimastix californiae; identical to SEQ ID NO: 4644
  Dockerin_dom

SEQ ID NO: 7268 - protein, 39 aa, Neocallimastix californiae
  Dockerin_dom
KCRSEVKGYPCCPPEITEIYMVDTDGDWGFDEKTNNWCG

SEQ ID NO: 7269 - protein, 31 aa, Neocallimastix californiae
  Dockerin_dom
QYKCCQHCKVVYTDSQKWGIEDNEWCHIPYT

SEQ ID NO: 7270 - protein, 44 aa, Neocallimastix californiae
  Dockerin_dom
NTCWSEKYGYPCCKDPNTLLVSPQSKSNPDHEWYGVENNEWCGI

SEQ ID NO: 7271 - protein, 37 aa, Neocallimastix californiae
  Dockerin_dom
KNTGYPCCSNPDAQVYTTDSSGDWSIEGDFWCLVEKE

SEQ ID NO: 7272 - protein, 37 aa, Neocallimastix californiae; identical to SEQ ID NO: 2101
  Dockerin_dom

SEQ ID NO: 7273 - protein, 31 aa, Neocallimastix californiae; identical to SEQ ID NO: 4650
  Dockerin_dom

SEQ ID NO: 7274 - protein, 31 aa, Neocallimastix californiae
  Dockerin_dom
YHVCKNCSVAAYQNDIYWGFENNQWCEISSE

SEQ ID NO: 7275 - protein, 36 aa, Neocallimastix californiae
  Dockerin_dom
LDKYGYRCCSTCTISYTDDTGNWGVENDEWCIVEDS

SEQ ID NO: 7276 - protein, 40 aa, Neocallimastix californiae; identical to SEQ ID NO: 4654
  Dockerin_dom

SEQ ID NO: 7277 - protein, 40 aa, Neocallimastix californiae
  Dockerin_dom
ECWATSLGYSCCSEGADIILEDENGKWGLENDDWCGIIEK

SEQ ID NO: 7278 - protein, 40 aa, Neocallimastix californiae; identical to SEQ ID NO: 4655
  Dockerin_dom

SEQ ID NO: 7279 - protein, 38 aa, Neocallimastix californiae
  Dockerin_dom
CFSDTLGYPCCTSTTNVIYTDSYGRWGIENSNWCILDD

SEQ ID NO: 7280 - protein, 40 aa, Neocallimastix californiae
  Dockerin_dom
SCFSLALGYNCCKHTTEVISVDNDGSWGIENNEWCGIGNS

SEQ ID NO: 7281 - protein, 37 aa, Neocallimastix californiae
  Dockerin_dom
CFSEALGYPCCSDGVAVVYTDNDGPWGVENNDWCGIS

SEQ ID NO: 7282 - protein, 40 aa, Neocallimastix californiae; identical to SEQ ID NO: 4660
  Dockerin_dom

SEQ ID NO: 7283 - protein, 41 aa, Neocallimastix californiae
  Dockerin_dom
SCWSSALGYPCCSSSNVPIIETDGDGQWGIENDEWCGVPKS

SEQ ID NO: 7284 - protein, 31 aa, Neocallimastix californiae; identical to SEQ ID NO: 4661
  Dockerin_dom

SEQ ID NO: 7285 - protein, 40 aa, Neocallimastix californiae
  Dockerin_dom
KCWAEAYGYPCCSKCLPVIDTTNDKEWALENGNWCGLPSK

SEQ ID NO: 7286 - protein, 40 aa, Neocallimastix californiae
  Dockerin_dom
CLSEFYGYPCCSPELTEVYAQDDYGDWGYDFSKSEWCGLT

SEQ ID NO: 7287 - protein, 41 aa, Neocallimastix californiae; identical to SEQ ID NO: 4663
  Dockerin_dom

SEQ ID NO: 7288 - protein, 34 aa, Neocallimastix californiae
  Dockerin_dom
SGYPCCKSCDVVDTDDDGQWGVENNDWCSIDTEK

SEQ ID NO: 7289 - protein, 40 aa, Neocallimastix californiae; identical to SEQ ID NO: 4665
  Dockerin_dom

SEQ ID NO: 7290 - protein, 31 aa, Neocallimastix californiae; identical to SEQ ID NO: 4666
  Dockerin_dom

SEQ ID NO: 7291 - protein, 42 aa, Neocallimastix californiae
  Dockerin_dom
TCWVSVYGYPCCEGKIKEHVYATDNDGKWGYDFSKKIWCGIS

SEQ ID NO: 7292 - protein, 39 aa, Neocallimastix californiae
  Dockerin_dom
DCWSLEQGYNCCVGCTTFLTTDEGNWGIENAEWCGIPSY

SEQ ID NO: 7293 - protein, 37 aa, Neocallimastix californiae; identical to SEQ ID NO: 4670
  Dockerin_dom

SEQ ID NO: 7294 - protein, 33 aa, Neocallimastix californiae
  Dockerin_dom
KYNYPYCKTTSSVVYTDDFEWGIENDDWCIIKA

SEQ ID NO: 7295 - protein, 40 aa, Neocallimastix californiae; identical to SEQ ID NO: 4672
  Dockerin_dom

SEQ ID NO: 7296 - protein, 40 aa, Neocallimastix californiae
  Dockerin_dom
SCWSEKFNIPCCKSTTSVERSTYNGDFGKENGQWCGLGES

SEQ ID NO: 7297 - protein, 36 aa, Neocallimastix californiae; identical to SEQ ID NO: 4675
  Dockerin_dom

SEQ ID NO: 7298 - protein, 40 aa, Neocallimastix californiae; identical to SEQ ID NO: 4674
  Dockerin_dom

SEQ ID NO: 7299 - protein, 39 aa, Neocallimastix californiae
  Dockerin_dom
ACWSESLGYSCCHGCTIYETDDDGSWGYENDSWCGIQSY

SEQ ID NO: 7300 - protein, 40 aa, Neocallimastix californiae; identical to SEQ ID NO: 4676
  Dockerin_dom

SEQ ID NO: 7301 - protein, 41 aa, Neocallimastix californiae
  Dockerin_dom
NKCWSEELGFLCCKESKTKVKLEDINGKWGKEKGRWCGIIE

SEQ ID NO: 7302 - protein, 36 aa, Neocallimastix californiae; identical to SEQ ID NO: 2135
  Dockerin_dom

SEQ ID NO: 7303 - protein, 34 aa, Neocallimastix californiae
  Dockerin_dom
VYDCCTGCKPIVADDEGLWGAENGDWCLIDSEKC

SEQ ID NO: 7304 - protein, 32 aa, Neocallimastix californiae
  Dockerin_dom
YKVCKGCEVVVTDIEGAWGAENGEWCYIDEII

SEQ ID NO: 7305 - protein, 40 aa, Neocallimastix californiae; identical to SEQ ID NO: 4554
  Dockerin_dom

SEQ ID NO: 7306 - protein, 41 aa, Neocallimastix californiae; identical to SEQ ID NO: 7181
  Dockerin_dom

SEQ ID NO: 7307 - protein, 41 aa, Neocallimastix californiae; identical to SEQ ID NO: 4685
  Dockerin_dom

SEQ ID NO: 7308 - protein, 33 aa, Neocallimastix californiae
  Dockerin_dom
TAYPCCSHCNVSISEEYIRWGIENGDWCMINFS

SEQ ID NO: 7309 - protein, 40 aa, Neocallimastix californiae
  Dockerin_dom
SCWAFADGYECCKNTKNIQYINKDGNSFGFENGVICALRK

SEQ ID NO: 7310 - protein, 36 aa, Neocallimastix californiae
  Dockerin_dom
ESKKFPCCSSNNVKVAGKDMDGSWGYENGVKCGIRS

SEQ ID NO: 7311 - protein, 38 aa, Neocallimastix californiae; identical to SEQ ID NO: 4689
  Dockerin_dom

SEQ ID NO: 7312 - protein, 41 aa, Neocallimastix californiae
  Dockerin_dom
SCWSVSLGYPCCSEDNQGIYLIDENGSWGLENNDWCGIIDK

SEQ ID NO: 7313 - protein, 39 aa, Neocallimastix californiae; identical to SEQ ID NO: 4686
  Dockerin_dom

SEQ ID NO: 7314 - protein, 36 aa, Neocallimastix californiae; identical to SEQ ID NO: 4690
  Dockerin_dom

SEQ ID NO: 7315 - protein, 38 aa, Neocallimastix californiae; identical to SEQ ID NO: 4691
  Dockerin_dom

SEQ ID NO: 7316 - protein, 38 aa, Neocallimastix californiae
  Dockerin_dom
TCWSKKLGYPCCNGCKIYESDLDGLWGYEKHQWCGIQP

SEQ ID NO: 7317 - protein, 39 aa, Neocallimastix californiae
  Dockerin_dom
NCMAELLGYICCPTTITIVYDHDEYGDWGYDFAKKEWCG

SEQ ID NO: 7318 - protein, 39 aa, Neocallimastix californiae; identical to SEQ ID NO: 7317
  Dockerin_dom

SEQ ID NO: 7319 - protein, 38 aa, Neocallimastix californiae; identical to SEQ ID NO: 7316
  Dockerin_dom

SEQ ID NO: 7320 - protein, 41 aa, Neocallimastix californiae; identical to SEQ ID NO: 4697
  Dockerin_dom

SEQ ID NO: 7321 - protein, 38 aa, Neocallimastix californiae
  Dockerin_dom
CWSESVGYPCCTGCEVVEVEDDKKWGVESNEWCGIPTS

SEQ ID NO: 7322 - protein, 39 aa, Neocallimastix californiae; identical to SEQ ID NO: 4699
  Dockerin_dom

SEQ ID NO: 7323 - protein, 41 aa, Neocallimastix californiae
  Dockerin_dom
NCWANKLSYRCCSTSDADVVFKDGSGEWAIENGDWCGIIKE

SEQ ID NO: 7324 - protein, 15 aa, Neocallimastix californiae
  Dockerin_dom
KWGVEGDDWCGIPTS

SEQ ID NO: 7325 - protein, 35 aa, Neocallimastix californiae; identical to SEQ ID NO: 4700
  Dockerin_dom

SEQ ID NO: 7326 - protein, 35 aa, Neocallimastix californiae; identical to SEQ ID NO: 4700
  Dockerin_dom

SEQ ID NO: 7327 - protein, 33 aa, Neocallimastix californiae
  Dockerin_dom
ENGYGSCSLQTKIIAVDNDGIWGIENNKWCAIL

SEQ ID NO: 7328 - protein, 37 aa, Neocallimastix californiae; identical to SEQ ID NO: 2157
  Dockerin_dom

SEQ ID NO: 7329 - protein, 41 aa, Neocallimastix californiae; identical to SEQ ID NO: 4705
  Dockerin_dom

SEQ ID NO: 7330 - protein, 31 aa, Neocallimastix californiae
  Dockerin_dom
YPCCEGCKTAYRDNNGKWGYENNNWCSIKYS

SEQ ID NO: 7331 - protein, 41 aa, Neocallimastix californiae; identical to SEQ ID NO: 4706
  Dockerin_dom

SEQ ID NO: 7332 - protein, 40 aa, Neocallimastix californiae; identical to SEQ ID NO: 4707
  Dockerin_dom

SEQ ID NO: 7333 - protein, 38 aa, Neocallimastix californiae; identical to SEQ ID NO: 4708
  Dockerin_dom

SEQ ID NO: 7334 - protein, 39 aa, Neocallimastix californiae
  Dockerin_dom
NSCWSEILGYLCCSECIKVVEVDSNGKWGIENNHWCGIP

SEQ ID NO: 7335 - protein, 40 aa, Neocallimastix californiae; identical to SEQ ID NO: 4709
  Dockerin_dom

SEQ ID NO: 7336 - protein, 38 aa, Neocallimastix californiae
  Dockerin_dom
SHATKLGYKCCKSCTIYLNDSTGKWGVENNQWCGIDTS

SEQ ID NO: 7337 - protein, 42 aa, Neocallimastix californiae
  Dockerin_dom
NTCWAASQGYKCCNSCQPVYTDGSRRWGVENNQWCGIIESKC

SEQ ID NO: 7338 - protein, 40 aa, Neocallimastix californiae
  Dockerin_dom
NCWAASEGYKCCKAGTAVVLTDSKGKWGIENNQWCGIVQS

SEQ ID NO: 7339 - protein, 40 aa, Neocallimastix californiae
  Dockerin_dom
SCFSLKLGYPCCSNASTPSVYEDSDGKWGVENGNWCGIPE

SEQ ID NO: 7340 - protein, 36 aa, Neocallimastix californiae
  Dockerin_dom
CWSEKLGYPCCTSTSVSVFEDNDGKWGIENGNWCGI

SEQ ID NO: 7341 - protein, 41 aa, Neocallimastix californiae
  Dockerin_dom
QCYAELLNYPCCSSSITEVFAHDNLGDWGYDFEKKTWCGLT

SEQ ID NO: 7342 - protein, 38 aa, Neocallimastix californiae
  Dockerin_dom
CWSEKFGYSCCKKCVVYETDNNGKWGYENNHWCGIPSY

SEQ ID NO: 7343 - protein, 36 aa, Neocallimastix californiae
  Dockerin_dom
CFSEALGYPCCTNNSRVYFIGESGSWGIQDDQWCGI

SEQ ID NO: 7344 - protein, 39 aa, Neocallimastix californiae; identical to SEQ ID NO: 4720
  Dockerin_dom

SEQ ID NO: 7345 - protein, 36 aa, Neocallimastix californiae; identical to SEQ ID NO: 4718
  Dockerin_dom

SEQ ID NO: 7346 - protein, 39 aa, Neocallimastix californiae
  Dockerin_dom
DCFSQALGYPCCSNPNTSVKATDKDGEWGIENNAWCGIN

SEQ ID NO: 7347 - protein, 39 aa, Neocallimastix californiae
  Dockerin_dom
KCKAAIKGYSCCSQCKVKYTDNDGDWGVENNQWCSIPYT

SEQ ID NO: 7348 - protein, 37 aa, Neocallimastix californiae
  Dockerin_dom
TCWAEKLGYSCCTSTSQVVYTDGDGNWGVENGNWCGI

SEQ ID NO: 7349 - protein, 38 aa, Neocallimastix californiae; identical to SEQ ID NO: 4723
  Dockerin_dom

SEQ ID NO: 7350 - protein, 37 aa, Neocallimastix californiae; identical to SEQ ID NO: 7348
  Dockerin_dom

SEQ ID NO: 7351 - protein, 38 aa, Neocallimastix californiae; identical to SEQ ID NO: 4726
  Dockerin_dom

SEQ ID NO: 7352 - protein, 39 aa, Neocallimastix californiae
  Dockerin_dom
TCWSKKLGYPCCKGCKLYSTDDDGSWGYESNQWCGIQSF

SEQ ID NO: 7353 - protein, 42 aa, Neocallimastix californiae; identical to SEQ ID NO: 4729
  Dockerin_dom

SEQ ID NO: 7354 - protein, 41 aa, Neocallimastix californiae
  Dockerin_dom
NSCWSELIGYPCCSSENTTVYQQDEYGDWGYDFTKQEWCGI

SEQ ID NO: 7355 - protein, 39 aa, Neocallimastix californiae; identical to SEQ ID NO: 4731
  Dockerin_dom

SEQ ID NO: 7356 - protein, 39 aa, Neocallimastix californiae; identical to SEQ ID NO: 4730
  Dockerin_dom

SEQ ID NO: 7357 - protein, 31 aa, Neocallimastix californiae
  Dockerin_dom
YPCCKGCNVVEEDASGKWGIENNYWCAIKDS

SEQ ID NO: 7358 - protein, 32 aa, Neocallimastix californiae
  Dockerin_dom
AYSNCYGCQVVTEEDGYKWGVENNDWCIINGN

SEQ ID NO: 7359 - protein, 40 aa, Neocallimastix californiae
  Dockerin_dom
ECFSVHLGFPCCQNTQEIIYSDNDGDWGVENNSWCGIKNE

SEQ ID NO: 7360 - protein, 38 aa, Neocallimastix californiae
  Dockerin_dom
ACWSEPDYPCCKNTCNVILNDGSEWGSENGEWCGIPSS

SEQ ID NO: 7361 - protein, 33 aa, Neocallimastix californiae
  Dockerin_dom
DYPCCSSCNVILVEDDGSRWGVQDNNWCSIKNN

SEQ ID NO: 7362 - protein, 40 aa, Neocallimastix californiae
  Dockerin_dom
KCWSEPLGYPCCSECGYSYYSDSDGEWGVENDDWCGLLPS

SEQ ID NO: 7363 - protein, 38 aa, Neocallimastix californiae
  Dockerin_dom
CWTEELGYPCCQTCQISQFKDESGDWGYENDDWCGIID

SEQ ID NO: 7364 - protein, 34 aa, Neocallimastix californiae; identical to SEQ ID NO: 4739
  Dockerin_dom

SEQ ID NO: 7365 - protein, 42 aa, Neocallimastix californiae; identical to SEQ ID NO: 4740
  Dockerin_dom

SEQ ID NO: 7366 - protein, 42 aa, Neocallimastix californiae
  Dockerin_dom
DCWSTPLGYQCCPSGCKAEVYETDDNGKWGYENGKWCGVPKD

SEQ ID NO: 7367 - protein, 30 aa, Neocallimastix californiae
  Dockerin_dom
YNCCEECNVVYTDSEDWGIENGKWCSIPYS

SEQ ID NO: 7368 - protein, 40 aa, Neocallimastix californiae; identical to SEQ ID NO: 4743
  Dockerin_dom

SEQ ID NO: 7369 - protein, 32 aa, Neocallimastix californiae
  Dockerin_dom
NSGYNCCLFSTSVITTDNVGKWGIENDEWCLF

SEQ ID NO: 7370 - protein, 32 aa, Neocallimastix californiae
  Dockerin_dom
NSGYNCCLFSTSVITTDKVGQWGIENDEWCLF

SEQ ID NO: 7371 - protein, 30 aa, Neocallimastix californiae
  Dockerin_dom
YNCCKECNVVYTDSEDWGIEDGKWCSIPHS

SEQ ID NO: 7372 - protein, 40 aa, Neocallimastix californiae; identical to SEQ ID NO: 4747
  Dockerin_dom

SEQ ID NO: 7373 - protein, 34 aa, Neocallimastix californiae
  Dockerin_dom
NSGYNCCLFTTTVETTDSVGDWGIENGDWCLFES

SEQ ID NO: 7374 - protein, 30 aa, Neocallimastix californiae; identical to SEQ ID NO: 4748
  Dockerin_dom

SEQ ID NO: 7375 - protein, 40 aa, Neocallimastix californiae; identical to SEQ ID NO: 4749
  Dockerin_dom

SEQ ID NO: 7376 - protein, 36 aa, Neocallimastix californiae
  Dockerin_dom
CWSEKLGYPCCTSGAQVYYTDADGQWGVENNNWCGI

SEQ ID NO: 7377 - protein, 39 aa, Neocallimastix californiae
  Dockerin_dom
DCFATKLGYPCCTTTTEVVFTDNDGKWGVENNNWCGMAD

SEQ ID NO: 7378 - protein, 39 aa, Neocallimastix californiae; identical to SEQ ID NO: 4754
  Dockerin_dom

SEQ ID NO: 7379 - protein, 39 aa, Neocallimastix californiae; identical to SEQ ID NO: 4753
  Dockerin_dom

SEQ ID NO: 7380 - protein, 38 aa, Neocallimastix californiae
  Dockerin_dom
DCFSTRLGYPCCSGNTVAYTDNDGDWGVENGNWCGIGN

SEQ ID NO: 7381 - protein, 39 aa, Neocallimastix californiae; identical to SEQ ID NO: 4756
  Dockerin_dom

SEQ ID NO: 7382 - protein, 21 aa, Neocallimastix californiae
  Dockerin_dom
VWYTDNDGAWGVENGDWCGIP

SEQ ID NO: 7383 - protein, 40 aa, Neocallimastix californiae; identical to SEQ ID NO: 4758
  Dockerin_dom

SEQ ID NO: 7384 - protein, 39 aa, Neocallimastix californiae
  Dockerin_dom
ECWSESLNYPCCDNCVVYEVDDNGKWGYDFQTQTWCGSP

SEQ ID NO: 7385 - protein, 39 aa, Neocallimastix californiae; identical to SEQ ID NO: 4072
  Dockerin_dom

SEQ ID NO: 7386 - protein, 37 aa, Neocallimastix californiae; identical to SEQ ID NO: 4298
  Dockerin_dom

SEQ ID NO: 7387 - protein, 40 aa, Neocallimastix californiae
  Dockerin_dom
ECWSEALGYPCCSECINAYAEDADGKWGIENDNWCGLLSH

SEQ ID NO: 7388 - protein, 35 aa, Neocallimastix californiae; identical to SEQ ID NO: 4763
  Dockerin_dom

SEQ ID NO: 7389 - protein, 37 aa, Neocallimastix californiae; identical to SEQ ID NO: 4764
  Dockerin_dom

SEQ ID NO: 7390 - protein, 33 aa, Neocallimastix californiae
  Dockerin_dom
KGYECCEGCTVEYEENNIKWGYENRNWCVIPYS

SEQ ID NO: 7391 - protein, 40 aa, Neocallimastix californiae
  Dockerin_dom
CWSKGLFKIPCCKKTDVVVRTTYDGEWGQEDNGKWCSLSK

SEQ ID NO: 7392 - protein, 42 aa, Neocallimastix californiae
  Dockerin_dom
DCWSEILGYSCCKKTCKTKYSDKHGNWGVENKQWCGIIDEKC

SEQ ID NO: 7393 - protein, 33 aa, Neocallimastix californiae
  Dockerin_dom
GEYSCCEKCKVRYSDKHGDWGIENKEWCSIKYT

SEQ ID NO: 7394 - protein, 42 aa, Neocallimastix californiae
  Dockerin_dom
DCWSEILGYSCCKETCKTKYTDKHGNWGVENKQWCGIIDEKC

SEQ ID NO: 7395 - protein, 40 aa, Neocallimastix californiae; identical to SEQ ID NO: 4770
  Dockerin_dom

SEQ ID NO: 7396 - protein, 29 aa, Neocallimastix californiae
  Dockerin_dom
ECWSEVLGYPCCKSCTVYDTDSDGQWGYE

SEQ ID NO: 7397 - protein, 39 aa, Neocallimastix californiae; identical to SEQ ID NO: 4001
  Dockerin_dom

SEQ ID NO: 7398 - protein, 37 aa, Neocallimastix californiae; identical to SEQ ID NO: 4772
  Dockerin_dom

SEQ ID NO: 7399 - protein, 40 aa, Neocallimastix californiae; identical to SEQ ID NO: 4773
  Dockerin_dom

SEQ ID NO: 7400 - protein, 37 aa, Neocallimastix californiae; identical to SEQ ID NO: 2229
  Dockerin_dom

SEQ ID NO: 7401 - protein, 38 aa, Neocallimastix californiae; identical to SEQ ID NO: 4776
  Dockerin_dom

SEQ ID NO: 7402 - protein, 33 aa, Neocallimastix californiae
  Dockerin_dom
YKCCSSSDAEVWYVDDDGNWGVENGEWCFIDTE

SEQ ID NO: 7403 - protein, 38 aa, Neocallimastix californiae
  Dockerin_dom
KCLSEIIGYSCCPLGYENIYHDNYGDWGYDFENDTWCG

SEQ ID NO: 7404 - protein, 39 aa, Neocallimastix californiae
  Dockerin_dom
QCWSEPLGYPCCQKCSIIETNESGSWGFELNQWCGIPTY

SEQ ID NO: 7405 - protein, 40 aa, Neocallimastix californiae; identical to SEQ ID NO: 4781
  Dockerin_dom

SEQ ID NO: 7406 - protein, 33 aa, Neocallimastix californiae
  Dockerin_dom
NSGYNCCLFTTKVETSDTVGDWGIENNEWCLFE

SEQ ID NO: 7407 - protein, 30 aa, Neocallimastix californiae; identical to SEQ ID NO: 4779
  Dockerin_dom

SEQ ID NO: 7408 - protein, 40 aa, Neocallimastix californiae
  Dockerin_dom
NSCWSTSLGFPCCSGNSIVYFTDSNGQWGIENDQWCGKPN

SEQ ID NO: 7409 - protein, 40 aa, Neocallimastix californiae; identical to SEQ ID NO: 4783
  Dockerin_dom

SEQ ID NO: 7410 - protein, 41 aa, Neocallimastix californiae; identical to SEQ ID NO: 4785
  Dockerin_dom

SEQ ID NO: 7411 - protein, 40 aa, Neocallimastix californiae
  Dockerin_dom
SCIGAQGYPCCKTTCSVFSTDSDGKWGIENDNWCLIDSSK

SEQ ID NO: 7412 - protein, 36 aa, Neocallimastix californiae
  Dockerin_dom
CWSERFNIPCCKSTNTVVRSTYDGEWGMENGEWCGL

SEQ ID NO: 7413 - protein, 38 aa, Neocallimastix californiae
  Dockerin_dom
CSQKIIAQGYKCCADSNCTVYYTDADGTWGVENGEWCG

SEQ ID NO: 7414 - protein, 41 aa, Neocallimastix californiae
  Dockerin_dom
CSSKITAQGYKCCSDPNCVVYYTDADGTWGVENGQWCGCGS

SEQ ID NO: 7415 - protein, 39 aa, Neocallimastix californiae; identical to SEQ ID NO: 4789
  Dockerin_dom

SEQ ID NO: 7416 - protein, 33 aa, Neocallimastix californiae; identical to SEQ ID NO: 4790
  Dockerin_dom

SEQ ID NO: 7417 - protein, 39 aa, Neocallimastix californiae
  Dockerin_dom
CTCWAQAQGYQCCTSTSEVVFTDESGDWGVENGEWCGIK

SEQ ID NO: 7418 - protein, 35 aa, Neocallimastix californiae; identical to SEQ ID NO: 4792
  Dockerin_dom

SEQ ID NO: 7419 - protein, 33 aa, Neocallimastix californiae; identical to SEQ ID NO: 4790
  Dockerin_dom

SEQ ID NO: 7420 - protein, 39 aa, Neocallimastix californiae; identical to SEQ ID NO: 7417
  Dockerin_dom

SEQ ID NO: 7421 - protein, 35 aa, Neocallimastix californiae; identical to SEQ ID NO: 4792
  Dockerin_dom

SEQ ID NO: 7422 - protein, 40 aa, Neocallimastix californiae
  Dockerin_dom
TCWSVKLGYPCCEVSNAIYSVDDNGSWGVEDDFWCGIVED

SEQ ID NO: 7423 - protein, 41 aa, Neocallimastix californiae
  Dockerin_dom
ACWSDSLGYPCCSSADIQVVSEDSSGKWGIENNNWCGIPKE

SEQ ID NO: 7424 - protein, 38 aa, Neocallimastix californiae
  Dockerin_dom
CWAEALGYSCCPSGTPVSYTDASGDWGYVNDWCGIVKS

SEQ ID NO: 7425 - protein, 39 aa, Neocallimastix californiae
  Dockerin_dom
KCWSEPDYPCCKLSSTRVEYTDASGSWGIENGNWCGIVK

SEQ ID NO: 7426 - protein, 32 aa, Neocallimastix californiae
  Dockerin_dom
AYDECKACNVVYVEGDEKWGVENNDWCIIPSK

SEQ ID NO: 7427 - protein, 31 aa, Neocallimastix californiae; identical to SEQ ID NO: 4800
  Dockerin_dom

SEQ ID NO: 7428 - protein, 39 aa, Neocallimastix californiae
  Dockerin_dom
NQCWAEAYGYSCCTKCVSVVDISNNRKWGIENNRWCGIP

SEQ ID NO: 7429 - protein, 32 aa, Neocallimastix californiae
  Dockerin_dom
SKYKCCDSCKVSVDDGNKWGILNGEWCSITYD

SEQ ID NO: 7430 - protein, 38 aa, Neocallimastix californiae
  Dockerin_dom
CSASIIAQGYKCCSANCEVVYTDNDGDWGVENNEWCGC

SEQ ID NO: 7431 - protein, 40 aa, Neocallimastix californiae
  Dockerin_dom
PSAITAQGYKCCSSCGTVYYTDGDGEWGVENGDWCGMPTN

SEQ ID NO: 7432 - protein, 37 aa, Neocallimastix californiae; identical to SEQ ID NO: 4806
  Dockerin_dom

SEQ ID NO: 7433 - protein, 39 aa, Neocallimastix californiae
  Dockerin_dom
SCWSSSLSYGCCSGCKVLYTDKDGKWGIENGDWCGIPKN

SEQ ID NO: 7434 - protein, 39 aa, Neocallimastix californiae
  Dockerin_dom
ECPGKKYGYPCCESCDVFLEDESGIWGAENGQWCSIKTS

SEQ ID NO: 7435 - protein, 40 aa, Neocallimastix californiae
  Dockerin_dom
ECWSEAFGYKCCSAGCNSVVVVIDESGYWSAENGEWCGIP

SEQ ID NO: 7436 - protein, 41 aa, Neocallimastix californiae; identical to SEQ ID NO: 4810
  Dockerin_dom

SEQ ID NO: 7437 - protein, 32 aa, Neocallimastix californiae
  Dockerin_dom
YPCCSGCDVIYTDTDGEWGVENYDWCFIDSNR

SEQ ID NO: 7438 - protein, 41 aa, Neocallimastix californiae
  Dockerin_dom
CSSTIKSQGYACCRSCDIIYSDESGDWGIENSYWCGISNSC

SEQ ID NO: 7439 - protein, 40 aa, Neocallimastix californiae
  Dockerin_dom
CSANIKKQGYSCCSSCIIYFTDNDGKWGVENGKWCGIQEY

SEQ ID NO: 7440 - protein, 41 aa, Neocallimastix californiae; identical to SEQ ID NO: 7438
  Dockerin_dom

SEQ ID NO: 7441 - protein, 40 aa, Neocallimastix californiae; identical to SEQ ID NO: 7439
  Dockerin_dom

SEQ ID NO: 7442 - protein, 39 aa, Neocallimastix californiae
  Dockerin_dom
SCTGMNLGYPCCDDCNVVYTDHDGKWGVQNDDWCGIKST

SEQ ID NO: 7443 - protein, 38 aa, Neocallimastix californiae
  Dockerin_dom
SCKFTQLGYPCCDNPKTVSVYTDESGDWGIENGDWCGI

SEQ ID NO: 7444 - protein, 34 aa, Neocallimastix californiae
  Dockerin_dom
YPCCKNCEVIYTDEDDGTQYGLDKIEWCIIDKTV

SEQ ID NO: 7445 - protein, 33 aa, Neocallimastix californiae
  Dockerin_dom
GYKWCSDPNTKRYPYNDEDFWGVENGNWCVIKN

SEQ ID NO: 7446 - protein, 40 aa, Neocallimastix californiae
  Dockerin_dom
KCWSEPLGYPCCTGNTKTEYTDKDGEWGLQNGDWCGINED

SEQ ID NO: 7447 - protein, 36 aa, Neocallimastix californiae; identical to SEQ ID NO: 4821
  Dockerin_dom

SEQ ID NO: 7448 - protein, 31 aa, Neocallimastix californiae
  Dockerin_dom
ECCSSDNVKVIGKHMDGTWGEENGKKCGIRN

SEQ ID NO: 7449 - protein, 39 aa, Neocallimastix californiae; identical to SEQ ID NO: 4820
  Dockerin_dom

SEQ ID NO: 7450 - protein, 39 aa, Neocallimastix californiae; identical to SEQ ID NO: 4823
  Dockerin_dom

SEQ ID NO: 7451 - protein, 40 aa, Neocallimastix californiae; identical to SEQ ID NO: 4819
  Dockerin_dom

SEQ ID NO: 7452 - protein, 36 aa, Neocallimastix californiae
  Dockerin_dom
CWSAKFGYPCCKETTVVEAVDENGRWGLENGGRCGF

SEQ ID NO: 7453 - protein, 31 aa, Neocallimastix californiae
  Dockerin_dom
NKCWAEAYGYSCCSECVSVLDKSYNKKWGIE

SEQ ID NO: 7454 - protein, 30 aa, Neocallimastix californiae
  Dockerin_dom
YKCCESCNVSYDDGNKWGVLNGEWCSLTYE

SEQ ID NO: 7455 - protein, 33 aa, Neocallimastix californiae
  Dockerin_dom
SYPCCENTCAVQYTDADGQWGIENGEWCSISKS

SEQ ID NO: 7456 - protein, 38 aa, Neocallimastix californiae; identical to SEQ ID NO: 4826
  Dockerin_dom

SEQ ID NO: 7457 - protein, 31 aa, Neocallimastix californiae
  Dockerin_dom
ALGYPCCKSTCNVYSSDESGQWGIEDNNWCL

SEQ ID NO: 7458 - protein, 40 aa, Neocallimastix californiae; identical to SEQ ID NO: 4828
  Dockerin_dom

SEQ ID NO: 7459 - protein, 31 aa, Neocallimastix californiae
  Dockerin_dom
YICCEGCNVIEETAEGKWGIEKNQWCGIKSS

SEQ ID NO: 7460 - protein, 31 aa, Neocallimastix californiae
  Dockerin_dom
AYEYCQGCRVFYEDDQQWGVENNDWCIIPSK

SEQ ID NO: 7461 - protein, 28 aa, Neocallimastix californiae
  Dockerin_dom
SKTGYPYCSLENIDIAYTHETGSWGFEN

SEQ ID NO: 7462 - protein, 30 aa, Neocallimastix californiae
  Dockerin_dom
YPCCTNTKTAVYTDNAGNEWGMENNNWCGI

SEQ ID NO: 7463 - protein, 33 aa, Neocallimastix californiae
  Dockerin_dom
GYNCCKNSCNVTYKDNDGNWDVENGNWCGVPFS

SEQ ID NO: 7464 - protein, 39 aa, Neocallimastix californiae; identical to SEQ ID NO: 4835
  Dockerin_dom

SEQ ID NO: 7465 - protein, 30 aa, Neocallimastix californiae
  Dockerin_dom
YKCCSSCEILYTDTEEWGIEDGEWCSIPHS

SEQ ID NO: 7466 - protein, 40 aa, Neocallimastix californiae; identical to SEQ ID NO: 4837
  Dockerin_dom

SEQ ID NO: 7467 - protein, 34 aa, Neocallimastix californiae
  Dockerin_dom
NSGYNCCVFDTTAVQTVDVVGKWGIENGDWCLFD

SEQ ID NO: 7468 - protein, 38 aa, Neocallimastix californiae
  Dockerin_dom
ITSQGYKCCKEDNCSVIETDDAGKWGIEDGQWCGISDK

SEQ ID NO: 7469 - protein, 36 aa, Neocallimastix californiae; identical to SEQ ID NO: 4839
  Dockerin_dom

SEQ ID NO: 7470 - protein, 38 aa, Neocallimastix californiae
  Dockerin_dom
CSYRITSQGYKCCSRNCVVVYSDADGNWGVENGEWCGC

SEQ ID NO: 7471 - protein, 32 aa, Neocallimastix californiae; identical to SEQ ID NO: 4841
  Dockerin_dom

SEQ ID NO: 7472 - protein, 39 aa, Neocallimastix californiae; identical to SEQ ID NO: 4844
  Dockerin_dom

SEQ ID NO: 7473 - protein, 40 aa, Neocallimastix californiae; identical to SEQ ID NO: 4843
  Dockerin_dom

SEQ ID NO: 7474 - protein, 37 aa, Neocallimastix californiae
  Dockerin_dom
NKCFATALGYPCCSPYAKERFRDKNGRWGIEYGAWCG

SEQ ID NO: 7475 - protein, 39 aa, Neocallimastix californiae
  Dockerin_dom
NKCFTIPLGYPCCTKTKEVTYTNGYGTWGTENGDWCGLK

SEQ ID NO: 7476 - protein, 39 aa, Neocallimastix californiae
  Dockerin_dom
NSCFSKSLGYPCCTSKNPRIYFSDSKGNWSYENGKWCGA

SEQ ID NO: 7477 - protein, 41 aa, Neocallimastix californiae
  Dockerin_dom
CWSKTLGYDCCKNTCNVVYSDNDGEWGVENNEWCGIIQSNC

SEQ ID NO: 7478 - protein, 24 aa, Neocallimastix californiae
  Dockerin_dom
YPCCTHCDIYYVDENGNWGIENNN

SEQ ID NO: 7479 - protein, 31 aa, Neocallimastix californiae
  Dockerin_dom
YPCCEECNVYEEDDSGKWGIENNQWCGIKDS

SEQ ID NO: 7480 - protein, 34 aa, Neocallimastix californiae
  Dockerin_dom
AYSNCNSTCRVVTVEDGVSWGVENNDWCIIKPSL

SEQ ID NO: 7481 - protein, 41 aa, Neocallimastix californiae
  Dockerin_dom
CSEKIQSQGYKCCSDKNCAVVYSDNDGTWGVENGQWCGCNN

SEQ ID NO: 7482 - protein, 30 aa, Neocallimastix californiae; identical to SEQ ID NO: 4853
  Dockerin_dom

SEQ ID NO: 7483 - protein, 39 aa, Neocallimastix californiae; identical to SEQ ID NO: 4854
  Dockerin_dom

SEQ ID NO: 7484 - protein, 40 aa, Neocallimastix californiae
  Dockerin_dom
DCVVKSLGYPCCSPNNTEVFYTDENGDWGVENGDWCGITK

SEQ ID NO: 7485 - protein, 39 aa, Neocallimastix californiae
  Dockerin_dom
CWSEALGYPCCSTCSSPVYSDNDGNWGIENGDWCGLLAS

SEQ ID NO: 7486 - protein, 40 aa, Neocallimastix californiae; identical to SEQ ID NO: 4857
  Dockerin_dom

SEQ ID NO: 7487 - protein, 37 aa, Neocallimastix californiae; identical to SEQ ID NO: 4858
  Dockerin_dom

SEQ ID NO: 7488 - protein, 39 aa, Neocallimastix californiae
  Dockerin_dom
NCWSIDLGYPCCIENNVVEVNENGKWGIENNNWCGIIEK

SEQ ID NO: 7489 - protein, 40 aa, Neocallimastix californiae
  Dockerin_dom
KCWASEFGYPCCKTTTEVIEKDEHGKWGFENKEWCGIVDS

SEQ ID NO: 7490 - protein, 36 aa, Neocallimastix californiae; identical to SEQ ID NO: 2319
  Dockerin_dom

SEQ ID NO: 7491 - protein, 39 aa, Neocallimastix californiae; identical to SEQ ID NO: 4863
  Dockerin_dom

SEQ ID NO: 7492 - protein, 40 aa, Neocallimastix californiae; identical to SEQ ID NO: 4860
  Dockerin_dom

SEQ ID NO: 7493 - protein, 40 aa, Neocallimastix californiae; identical to SEQ ID NO: 4861
  Dockerin_dom

SEQ ID NO: 7494 - protein, 26 aa, Neocallimastix californiae
  Dockerin_dom
YSCCSSCDVYYVDEFEWGVEDGSWCL

SEQ ID NO: 7495 - protein, 42 aa, Neocallimastix californiae
  Dockerin_dom
NCWAISEGYPCCKNKNTQVQDISSDGRKWGFENDDWCGIIEE

SEQ ID NO: 7496 - protein, 33 aa, Neocallimastix californiae
  Dockerin_dom
NSGYNCCILTKSVKLIDNVGQWGVENGEWCLFE

SEQ ID NO: 7497 - protein, 37 aa, Neocallimastix californiae
  Dockerin_dom
FSKFGYSCCKKETTAILTTDRDADWGVEDGKWCAIKE

SEQ ID NO: 7498 - protein, 35 aa, Neocallimastix californiae; identical to SEQ ID NO: 2327
  Dockerin_dom

SEQ ID NO: 7499 - protein, 38 aa, Neocallimastix californiae; identical to SEQ ID NO: 4871
  Dockerin_dom

SEQ ID NO: 7500 - protein, 32 aa, Neocallimastix californiae; identical to SEQ ID NO: 4870
  Dockerin_dom

SEQ ID NO: 7501 - protein, 37 aa, Neocallimastix californiae
  Dockerin_dom
DCWATALGYKCCQSTSVVVETDANGKWGIENNEWCGI

SEQ ID NO: 7502 - protein, 38 aa, Neocallimastix californiae; identical to SEQ ID NO: 4872
  Dockerin_dom

SEQ ID NO: 7503 - protein, 40 aa, Neocallimastix californiae; identical to SEQ ID NO: 4874
  Dockerin_dom

SEQ ID NO: 7504 - protein, 30 aa, Neocallimastix californiae
  Dockerin_dom
YPCCKECNVYYTDTEDWGIEDGEWCSIPYT

SEQ ID NO: 7505 - protein, 33 aa, Neocallimastix californiae
  Dockerin_dom
NTGYNCCLFTTTVVTTDSVGDWGVENEDWCLFE

SEQ ID NO: 7506 - protein, 40 aa, Neocallimastix californiae; identical to SEQ ID NO: 4876
  Dockerin_dom

SEQ ID NO: 7507 - protein, 39 aa, Neocallimastix californiae
  Dockerin_dom
CSTAIINQGYKCCSDGCTVIYIDSDGDWGAENGEWCGCG

SEQ ID NO: 7508 - protein, 38 aa, Neocallimastix californiae
  Dockerin_dom
SITRYGYKCCSSCSKVYYTDKDGKWGIENRDWCGIPSH

SEQ ID NO: 7509 - protein, 39 aa, Neocallimastix californiae
  Dockerin_dom
ECWSKAQGYDCCAEGTSVFLEDESGKWGVTPNGLWCGIK

SEQ ID NO: 7510 - protein, 41 aa, Neocallimastix californiae; identical to SEQ ID NO: 4881
  Dockerin_dom

SEQ ID NO: 7511 - protein, 36 aa, Neocallimastix californiae
  Dockerin_dom
CFALSDGYECCFDNEVVYEDETGKWGINDKGEWCGV

SEQ ID NO: 7512 - protein, 40 aa, Neocallimastix californiae; identical to SEQ ID NO: 4885
  Dockerin_dom

SEQ ID NO: 7513 - protein, 29 aa, Neocallimastix californiae
  Dockerin_dom
DCCKNSNLKVSYVDNNGYWGIESESWCKI

SEQ ID NO: 7514 - protein, 38 aa, Neocallimastix californiae
  Dockerin_dom
KCWSESLGYKCCSLDIEPIFTDNDGIWGMENEQWCGII

SEQ ID NO: 7515 - protein, 37 aa, Neocallimastix californiae; identical to SEQ ID NO: 4886
  Dockerin_dom

SEQ ID NO: 7516 - protein, 39 aa, Neocallimastix californiae; identical to SEQ ID NO: 4888
  Dockerin_dom

SEQ ID NO: 7517 - protein, 38 aa, Neocallimastix californiae; identical to SEQ ID NO: 4887
  Dockerin_dom

SEQ ID NO: 7518 - protein, 39 aa, Neocallimastix californiae
  Dockerin_dom
TCWSTRLGYPCCEDSNVVYAVDENGIWGYENKHWCGITK

SEQ ID NO: 7519 - protein, 28 aa, Neocallimastix californiae
  Dockerin_dom
ECEFNALGYSCCPDAAVVFEDDHKWGYV

SEQ ID NO: 7520 - protein, 39 aa, Neocallimastix californiae; identical to SEQ ID NO: 4890
  Dockerin_dom

SEQ ID NO: 7521 - protein, 41 aa, Neocallimastix californiae
  Dockerin_dom
NSCFSVALGFPCCSSSATEVFRDSYGSWGVEYGEWCGMSKA

SEQ ID NO: 7522 - protein, 39 aa, Neocallimastix californiae
  Dockerin_dom
TCFSIPLGYPCCTSTKEVIDTNEYGTWGIENGDWCGLKK

SEQ ID NO: 7523 - protein, 39 aa, Neocallimastix californiae
  Dockerin_dom
SCFSKSLGFPCCSSKNKDIYFTDEKGNWGIENGEWCGIS

SEQ ID NO: 7524 - protein, 40 aa, Neocallimastix californiae
  Dockerin_dom
SCFSSALGIPCCSSKNAEIYYSDIKGNWGIENGDWCGISA

SEQ ID NO: 7525 - protein, 42 aa, Neocallimastix californiae; identical to SEQ ID NO: 4895
  Dockerin_dom

SEQ ID NO: 7526 - protein, 24 aa, Neocallimastix californiae
  Dockerin_dom
EGYTCCKGCDVIYTDDFKWGFEAG

SEQ ID NO: 7527 - protein, 32 aa, Neocallimastix californiae
  Dockerin_dom
TGYACCIFKNTIVETVDESGQWGHEGNDWCLM

SEQ ID NO: 7528 - protein, 25 aa, Neocallimastix californiae
  Dockerin_dom
CSVSYEDETGKWGIENGQWCGIDSS

SEQ ID NO: 7529 - protein, 39 aa, Neocallimastix californiae; identical to SEQ ID NO: 4897
  Dockerin_dom

SEQ ID NO: 7530 - protein, 39 aa, Neocallimastix californiae
  Dockerin_dom
CWSKTYGYPCCSSASTKVMYTDNDGEWGVENGNWCGIVK

SEQ ID NO: 7531 - protein, 39 aa, Neocallimastix californiae
  Dockerin_dom
SCFSYTLGYPCCTSTTNVIYTDSYGRWGIEKGNWCFLGD

SEQ ID NO: 7532 - protein, 36 aa, Neocallimastix californiae
  Dockerin_dom
ALAYEDCKSCYIHYEDSDGYWGYNGDEWCIINEEYC

SEQ ID NO: 7533 - protein, 40 aa, Neocallimastix californiae
  Dockerin_dom
DCWIKDYFSCCDEGAEVIYEDHNGKWGIQGANDWCLIVEK

SEQ ID NO: 7534 - protein, 38 aa, Neocallimastix californiae
  Dockerin_dom
ECWSLELGYPCCKTTKDVVYTDNSGDWGLENGDWCGIV

SEQ ID NO: 7535 - protein, 36 aa, Neocallimastix californiae; identical to SEQ ID NO: 4905
  Dockerin_dom

SEQ ID NO: 7536 - protein, 40 aa, Neocallimastix californiae
  Dockerin_dom
CFAEVLGYKCCEDQNGPRTSIDADGEWYEDKYGNWCGYSN

SEQ ID NO: 7537 - protein, 39 aa, Neocallimastix californiae; identical to SEQ ID NO: 4908
  Dockerin_dom

SEQ ID NO: 7538 - protein, 39 aa, Neocallimastix californiae; identical to SEQ ID NO: 4906
  Dockerin_dom

SEQ ID NO: 7539 - protein, 29 aa, Neocallimastix californiae
  Dockerin_dom
YPCCTSTKTVMYTDEKGPWGIENGNWCGI

SEQ ID NO: 7540 - protein, 40 aa, Neocallimastix californiae; identical to SEQ ID NO: 4909
  Dockerin_dom

SEQ ID NO: 7541 - protein, 40 aa, Neocallimastix californiae
  Dockerin_dom
CWATKLGYKCCTAKCPEVSYVDQDGAWGVENGNWCGITKT

SEQ ID NO: 7542 - protein, 40 aa, Neocallimastix californiae
  Dockerin_dom
SCWATKLGFNCCKNTSAVYETDANGRWGIENGNWCGIIES

SEQ ID NO: 7543 - protein, 32 aa, Neocallimastix californiae; identical to SEQ ID NO: 4913
  Dockerin_dom

SEQ ID NO: 7544 - protein, 34 aa, Neocallimastix californiae
  Dockerin_dom
IMAQGYPCCSANCQVVYTDADGEWGVENGDWCGC

SEQ ID NO: 7545 - protein, 36 aa, Neocallimastix californiae; identical to SEQ ID NO: 4914
  Dockerin_dom

SEQ ID NO: 7546 - protein, 26 aa, Neocallimastix californiae
  Dockerin_dom
CCSGNEVVYTDNDGKWGVENGNWCGI

SEQ ID NO: 7547 - protein, 41 aa, Neocallimastix californiae
  Dockerin_dom
CSASILKQGYSCCSSRCTVTFTDEDGDWGVENGQWCGCGNR

SEQ ID NO: 7548 - protein, 41 aa, Neocallimastix californiae; identical to SEQ ID NO: 4916
  Dockerin_dom

SEQ ID NO: 7549 - protein, 42 aa, Neocallimastix californiae; identical to SEQ ID NO: 4917
  Dockerin_dom

SEQ ID NO: 7550 - protein, 24 aa, Neocallimastix californiae
  Dockerin_dom
QCFSISLGYPCCQGNTVVYTDKDG

SEQ ID NO: 7551 - protein, 36 aa, Neocallimastix californiae; identical to SEQ ID NO: 4920
  Dockerin_dom

SEQ ID NO: 7552 - protein, 31 aa, Neocallimastix californiae; identical to SEQ ID NO: 4923
  Dockerin_dom

SEQ ID NO: 7553 - protein, 38 aa, Neocallimastix californiae; identical to SEQ ID NO: 4922
  Dockerin_dom

SEQ ID NO: 7554 - protein, 33 aa, Neocallimastix californiae
  Dockerin_dom
GYECCKSCNIVLTDESGNWGVEDGQWCGIDEDK

SEQ ID NO: 7555 - protein, 42 aa, Neocallimastix californiae; identical to SEQ ID NO: 4924
  Dockerin_dom

SEQ ID NO: 7556 - protein, 36 aa, Neocallimastix californiae; identical to SEQ ID NO: 4925
  Dockerin_dom

SEQ ID NO: 7557 - protein, 39 aa, Neocallimastix californiae; identical to SEQ ID NO: 4926
  Dockerin_dom

SEQ ID NO: 7558 - protein, 41 aa, Neocallimastix californiae
  Dockerin_dom
SCWATAQGYGCCTGCEAIMTDDNRKWGFENGNWCGIIDSVC

SEQ ID NO: 7559 - protein, 31 aa, Neocallimastix californiae
  Dockerin_dom
KQGYPCCKNTKDVYYRDADGNWGIENNNWCY

SEQ ID NO: 7560 - protein, 41 aa, Neocallimastix californiae
  Dockerin_dom
CSAKIVQQGYKCCSSSNCVVQYVDSDGYWAVENNQWCGCGT

SEQ ID NO: 7561 - protein, 27 aa, Neocallimastix californiae
  Dockerin_dom
CSSSIRSLGYSCCSDNNCTVYATDESG

SEQ ID NO: 7562 - protein, 40 aa, Neocallimastix californiae; identical to SEQ ID NO: 4930
  Dockerin_dom

SEQ ID NO: 7563 - protein, 38 aa, Neocallimastix californiae
  Dockerin_dom
DCFALDLGFKCCNDATVVYTDDSGDWGYVNNDWCGIGG

SEQ ID NO: 7564 - protein, 32 aa, Neocallimastix californiae
  Dockerin_dom
YPCCSECTVVYTDESGDWGVENNEWCLIKKSK

SEQ ID NO: 7565 - protein, 39 aa, Neocallimastix californiae
  Dockerin_dom
DCFAIKLGYKCCKTTTVTIYEDNDGPWGIENDEWCGLKK

SEQ ID NO: 7566 - protein, 37 aa, Neocallimastix californiae; identical to SEQ ID NO: 2395
  Dockerin_dom

SEQ ID NO: 7567 - protein, 30 aa, Neocallimastix californiae; identical to SEQ ID NO: 2397
  Dockerin_dom

SEQ ID NO: 7568 - protein, 39 aa, Neocallimastix californiae
  Dockerin_dom
KCVSELVGFPCCPENNKAVYNRDEFGDWGYDFAKGTWCG

SEQ ID NO: 7569 - protein, 36 aa, Neocallimastix californiae
  Dockerin_dom
CWSLPQFPCCKNNVVVYTDGSGDWGFENNNWCGIIK

SEQ ID NO: 7570 - protein, 30 aa, Neocallimastix californiae
  Dockerin_dom
YPCCKGNTVVLTDVKGDWGVENNAWCGINK

SEQ ID NO: 7571 - protein, 22 aa, Neocallimastix californiae
  Dockerin_dom
VYTDEDGNWGVENDQWCGCEDT

SEQ ID NO: 7572 - protein, 39 aa, Neocallimastix californiae
  Dockerin_dom
ATSILEKGYSCCPKDCKVLYTDEEGTWGINNYKWCICNS

SEQ ID NO: 7573 - protein, 40 aa, Neocallimastix californiae; identical to SEQ ID NO: 4942
  Dockerin_dom

SEQ ID NO: 7574 - protein, 32 aa, Neocallimastix californiae; identical to SEQ ID NO: 4941
  Dockerin_dom

SEQ ID NO: 7575 - protein, 13 aa, Neocallimastix californiae
  Dockerin_dom
WGVENHEWCGITK

SEQ ID NO: 7576 - protein, 17 aa, Neocallimastix californiae
  Dockerin_dom
DGDYGFENNDWCGIADS

SEQ ID NO: 7577 - protein, 39 aa, Neocallimastix californiae
  Dockerin_dom
CTCWATKLGYPCCTTTSQSLFTDENGEWGVENNDWCGIS

SEQ ID NO: 7578 - protein, 33 aa, Neocallimastix californiae
  Dockerin_dom
PNGYPYCKQTNEVVFTDTVEWGVENGAWCVIKS

SEQ ID NO: 7579 - protein, 41 aa, Neocallimastix californiae
  Dockerin_dom
ECWSKALGYECCSKDNTRVVVSDDSGKWGVENGQWCGINKS

SEQ ID NO: 7580 - protein, 30 aa, Neocallimastix californiae; identical to SEQ ID NO: 2405
  Dockerin_dom

SEQ ID NO: 7581 - protein, 37 aa, Neocallimastix californiae; identical to SEQ ID NO: 4948
  Dockerin_dom

SEQ ID NO: 7582 - protein, 40 aa, Neocallimastix californiae; identical to SEQ ID NO: 4947
  Dockerin_dom

SEQ ID NO: 7583 - protein, 29 aa, Neocallimastix californiae
  Dockerin_dom
AQGYPCCAYSCDSLFTDSDGEWSVENENW

SEQ ID NO: 7584 - protein, 40 aa, Neocallimastix californiae; identical to SEQ ID NO: 4950
  Dockerin_dom

SEQ ID NO: 7585 - protein, 41 aa, Neocallimastix californiae
  Dockerin_dom
CWSLQYGYDCCKKKETEPYYYSQSIKKWYGVEDGEWCGIED

SEQ ID NO: 7586 - protein, 33 aa, Neocallimastix californiae
  Dockerin_dom
TGYDCCQYTTIPTYTDKQGYWAMEDEEWCIIDQ

SEQ ID NO: 7587 - protein, 32 aa, Neocallimastix californiae
  Dockerin_dom
YKCCTTTCEVYYSDESGDWGVEDNDWCSMPYT

SEQ ID NO: 7588 - protein, 28 aa, Neocallimastix californiae
  Dockerin_dom
FPCCTGKDIVYSDGSGDWGFENGSWCGI

SEQ ID NO: 7589 - protein, 38 aa, Neocallimastix californiae
  Dockerin_dom
CWSLPEYPCCTDSNTPVMEEDTLGKWGIENGSWCGIKA

SEQ ID NO: 7590 - protein, 33 aa, Neocallimastix californiae
  Dockerin_dom
SGYSCCIFDTTPVVSKDNTGYWGVENGQWCLFE

SEQ ID NO: 7591 - protein, 43 aa, Neocallimastix californiae; identical to SEQ ID NO: 4957
  Dockerin_dom

SEQ ID NO: 7592 - protein, 31 aa, Neocallimastix californiae
  Dockerin_dom
YPCCKSCVEVYEDDLGKWGIENDVWCGIKDS

SEQ ID NO: 7593 - protein, 29 aa, Neocallimastix californiae
  Dockerin_dom
CCEGCKVIQEDKDGKWGYENNEWCGIKDS

SEQ ID NO: 7594 - protein, 30 aa, Neocallimastix californiae
  Dockerin_dom
YKCCKSCDIIYTDTSDWGVEDDDWCSIPYT

SEQ ID NO: 7595 - protein, 40 aa, Neocallimastix californiae; identical to SEQ ID NO: 4961
  Dockerin_dom

SEQ ID NO: 7596 - protein, 35 aa, Neocallimastix californiae; identical to SEQ ID NO: 2421
  Dockerin_dom

SEQ ID NO: 7597 - protein, 41 aa, Neocallimastix californiae
  Dockerin_dom
SCWAQGLGYPCCEGCEASFTDGDGDWAIENGNWCGIDPKKC

SEQ ID NO: 7598 - protein, 39 aa, Neocallimastix californiae; identical to SEQ ID NO: 4965
  Dockerin_dom

SEQ ID NO: 7599 - protein, 39 aa, Neocallimastix californiae; identical to SEQ ID NO: 4964
  Dockerin_dom

SEQ ID NO: 7600 - protein, 37 aa, Neocallimastix californiae
  Dockerin_dom
CWSTALGYPCCKNSSIVYFTDNDGKWSVEDNEWCGIS

SEQ ID NO: 7601 - protein, 25 aa, Neocallimastix californiae
  Dockerin_dom
CWSTALGYPCCKNSSIVYFTDNDGK

SEQ ID NO: 7602 - protein, 43 aa, Neocallimastix californiae
  Dockerin_dom
NECWSEQLGYPCCNSGNKEVVFEDENGNWGISPKTNDWCGIRS

SEQ ID NO: 7603 - protein, 40 aa, Neocallimastix californiae; identical to SEQ ID NO: 4970
  Dockerin_dom

SEQ ID NO: 7604 - protein, 32 aa, Neocallimastix californiae; identical to SEQ ID NO: 4969
  Dockerin_dom

SEQ ID NO: 7605 - protein, 40 aa, Neocallimastix californiae; identical to SEQ ID NO: 4971
  Dockerin_dom

SEQ ID NO: 7606 - protein, 19 aa, Neocallimastix californiae
  Dockerin_dom
DNDGDWGFENDNWCGLNDY

SEQ ID NO: 7607 - protein, 32 aa, Neocallimastix californiae
  Dockerin_dom
YSCCKSTCTPSLSDNTGDWAVENGAWCSIPYT

SEQ ID NO: 7608 - protein, 34 aa, Neocallimastix californiae; identical to SEQ ID NO: 4974
  Dockerin_dom

SEQ ID NO: 7609 - protein, 39 aa, Neocallimastix californiae; identical to SEQ ID NO: 4975
  Dockerin_dom

SEQ ID NO: 7610 - protein, 39 aa, Neocallimastix californiae; identical to SEQ ID NO: 4976
  Dockerin_dom

SEQ ID NO: 7611 - protein, 39 aa, Neocallimastix californiae; identical to SEQ ID NO: 4978
  Dockerin_dom

SEQ ID NO: 7612 - protein, 30 aa, Neocallimastix californiae; identical to SEQ ID NO: 4977
  Dockerin_dom

SEQ ID NO: 7613 - protein, 40 aa, Neocallimastix californiae
  Dockerin_dom
CWANAYGYDCCVDGTLTYLEDETGKWGVTSDYQWCGLLKS

SEQ ID NO: 7614 - protein, 28 aa, Neocallimastix californiae
  Dockerin_dom
CWANAYGYDCCVDGTLTYLEDETGKWGV

SEQ ID NO: 7615 - protein, 41 aa, Neocallimastix californiae
  Dockerin_dom
ECWANAYGYDCCVDGTLTYLEDETGKWGVTSDYQWCGLLKS

SEQ ID NO: 7616 - protein, 37 aa, Neocallimastix californiae; identical to SEQ ID NO: 4982
  Dockerin_dom

SEQ ID NO: 7617 - protein, 39 aa, Neocallimastix californiae; identical to SEQ ID NO: 4983
  Dockerin_dom

SEQ ID NO: 7618 - protein, 41 aa, Neocallimastix californiae
  Dockerin_dom
CSAKITSQGYPCCSSSCTVVYTDESGDWGVENNQWCGCGKV

SEQ ID NO: 7619 - protein, 31 aa, Neocallimastix californiae
  Dockerin_dom
AQGYPCCRTATFVYYTDSDGNWSVENNDWCL

SEQ ID NO: 7620 - protein, 40 aa, Neocallimastix californiae; identical to SEQ ID NO: 4986
  Dockerin_dom

SEQ ID NO: 7621 - protein, 36 aa, Neocallimastix californiae
  Dockerin_dom
CFSEPFYPCCEKNTVVFTDKQGKWGIENGSWCGIGK

SEQ ID NO: 7622 - protein, 39 aa, Neocallimastix californiae; identical to SEQ ID NO: 4988
  Dockerin_dom

SEQ ID NO: 7623 - protein, 30 aa, Neocallimastix californiae
  Dockerin_dom
YKCCKGCEVVYTDSEDWGIEDGKWCSIPHS

SEQ ID NO: 7624 - protein, 20 aa, Neocallimastix californiae
  Dockerin_dom
YTDNDGEWGINNGEWCGCGG

SEQ ID NO: 7625 - protein, 25 aa, Neocallimastix californiae
  Dockerin_dom
ECFSIKLGYPCCQGNTVYYIDNDGQ

SEQ ID NO: 7626 - protein, 33 aa, Neocallimastix californiae
  Dockerin_dom
SYSCCVLTTTVVTTDGTGKWGIEGNQWCLMKED

SEQ ID NO: 7627 - protein, 34 aa, Neocallimastix californiae; identical to SEQ ID NO: 4994
  Dockerin_dom

SEQ ID NO: 7628 - protein, 36 aa, Neocallimastix californiae
  Dockerin_dom
FSFPQYHCCNECNVVLEDEEGKWGFENNKWCGLKDS

SEQ ID NO: 7629 - protein, 39 aa, Neocallimastix californiae; identical to SEQ ID NO: 4995
  Dockerin_dom

SEQ ID NO: 7630 - protein, 26 aa, Neocallimastix californiae
  Dockerin_dom
CSAKIIAQGYECCPSDCETIYTDDDG

SEQ ID NO: 7631 - protein, 33 aa, Neocallimastix californiae; identical to SEQ ID NO: 4998
  Dockerin_dom

SEQ ID NO: 7632 - protein, 33 aa, Neocallimastix californiae
  Dockerin_dom
YPYCNGCESNYTDGDGDWYFVDNNWCKVNEKKC

SEQ ID NO: 7633 - protein, 31 aa, Neocallimastix californiae
  Dockerin_dom
GYQCCKNSSTVAVYSDKDGEWGVENNDWCII

SEQ ID NO: 7634 - protein, 40 aa, Neocallimastix californiae; identical to SEQ ID NO: 5000
  Dockerin_dom

SEQ ID NO: 7635 - protein, 39 aa, Neocallimastix californiae
  Dockerin_dom
TCGAAGYPCCKSSCTVYAEDSDGKWSIENDNWCLIDQSK

SEQ ID NO: 7636 - protein, 27 aa, Neocallimastix californiae
  Dockerin_dom
CSEKFTKQGYKCCSSCSFVYYTDESGD

SEQ ID NO: 7637 - protein, 37 aa, Neocallimastix californiae
  Dockerin_dom
PAAIRNQGYKCCKAGCQVIYKDSDGDWGVENNQWCGC

SEQ ID NO: 7638 - protein, 33 aa, Neocallimastix californiae
  Dockerin_dom
YKCCSETCEVKKFTKSGKVLGYENGKWCSIPYK

SEQ ID NO: 7639 - protein, 38 aa, Neocallimastix californiae
  Dockerin_dom
NCWAYKLGYQCCLGDNVKSIYNDVDGDWNYLNGRWCGI

SEQ ID NO: 7640 - protein, 20 aa, Neocallimastix californiae
  Dockerin_dom
VVYVDKDGEWGVENGNWCGI

SEQ ID NO: 7641 - protein, 35 aa, Neocallimastix californiae; identical to SEQ ID NO: 2465
  Dockerin_dom

SEQ ID NO: 7642 - protein, 34 aa, Neocallimastix californiae
  Dockerin_dom
RLGYNCCKYRSTPVYEKDNDGLWGIEDNDWCGVT

SEQ ID NO: 7643 - protein, 33 aa, Neocallimastix californiae; identical to SEQ ID NO: 5008
  Dockerin_dom

SEQ ID NO: 7644 - protein, 37 aa, Neocallimastix californiae; identical to SEQ ID NO: 5009
  Dockerin_dom

SEQ ID NO: 7645 - protein, 35 aa, Neocallimastix californiae; identical to SEQ ID NO: 5010
  Dockerin_dom

SEQ ID NO: 7646 - protein, 39 aa, Neocallimastix californiae
  Dockerin_dom
QCWSEVVGYSCCSSNETTVYAHDDNGDWGYDFNKQEWCG

SEQ ID NO: 7647 - protein, 31 aa, Neocallimastix californiae; identical to SEQ ID NO: 5012
  Dockerin_dom

SEQ ID NO: 7648 - protein, 37 aa, Neocallimastix californiae
  Dockerin_dom
CWSLPRYPCCSNVTITLIKDMYGNKWGMENKNYCGIL

SEQ ID NO: 7649 - protein, 31 aa, Neocallimastix californiae; identical to SEQ ID NO: 5014
  Dockerin_dom

SEQ ID NO: 7650 - protein, 37 aa, Neocallimastix californiae
  Dockerin_dom
SCGAAAIGYPCCENTCTEVYTDEYRWGVEDDEWCGID

SEQ ID NO: 7651 - protein, 36 aa, Neocallimastix californiae; identical to SEQ ID NO: 1774
  Dockerin_dom

SEQ ID NO: 7652 - protein, 29 aa, Neocallimastix californiae
  Dockerin_dom
ACWSQPLGYPCCSSPNAEVYYTDNDGKWS

SEQ ID NO: 7653 - protein, 34 aa, Neocallimastix californiae; identical to SEQ ID NO: 2478
  Dockerin_dom

SEQ ID NO: 7654 - protein, 30 aa, Neocallimastix californiae
  Dockerin_dom
YPCCQECNVLYTDTEDWGIENGSWCSIPYT

SEQ ID NO: 7655 - protein, 36 aa, Neocallimastix californiae; identical to SEQ ID NO: 2480
  Dockerin_dom

SEQ ID NO: 7656 - protein, 26 aa, Neocallimastix californiae
  Dockerin_dom
ACWSQPLGYPCCSSPNAEVYYTDNDG

SEQ ID NO: 7657 - protein, 38 aa, Neocallimastix californiae; identical to SEQ ID NO: 5022
  Dockerin_dom

SEQ ID NO: 7658 - protein, 37 aa, Neocallimastix californiae; identical to SEQ ID NO: 1478
  Dockerin_dom

SEQ ID NO: 7659 - protein, 38 aa, Neocallimastix californiae; identical to SEQ ID NO: 4042
  Dockerin_dom

SEQ ID NO: 7660 - protein, 39 aa, Neocallimastix californiae; identical to SEQ ID NO: 4028
  Dockerin_dom

SEQ ID NO: 7661 - protein, 39 aa, Neocallimastix californiae; identical to SEQ ID NO: 4028
  Dockerin_dom

SEQ ID NO: 7662 - protein, 39 aa, Neocallimastix californiae; identical to SEQ ID NO: 4028
  Dockerin_dom

SEQ ID NO: 7663 - protein, 32 aa, Neocallimastix californiae; identical to SEQ ID NO: 2488
  Dockerin_dom

SEQ ID NO: 7664 - protein, 29 aa, Neocallimastix californiae
  Dockerin_dom
ACWSQPLGYPCCSSPNAEVYYTDNDGKWS

SEQ ID NO: 7665 - protein, 33 aa, Neocallimastix californiae; identical to SEQ ID NO: 5030
  Dockerin_dom

SEQ ID NO: 7666 - protein, 36 aa, Neocallimastix californiae; identical to SEQ ID NO: 1774
  Dockerin_dom

SEQ ID NO: 7667 - protein, 34 aa, Neocallimastix californiae
  Dockerin_dom
AQGYPCCKTATEVFYTDNDGNWGVENGQWCGCGV

SEQ ID NO: 7668 - protein, 38 aa, Neocallimastix californiae; identical to SEQ ID NO: 5022
  Dockerin_dom

SEQ ID NO: 7669 - protein, 39 aa, Neocallimastix californiae; identical to SEQ ID NO: 4028
  Dockerin_dom

SEQ ID NO: 7670 - protein, 37 aa, Neocallimastix californiae; identical to SEQ ID NO: 1478
  Dockerin_dom

SEQ ID NO: 7671 - protein, 39 aa, Neocallimastix californiae; identical to SEQ ID NO: 4028
  Dockerin_dom

SEQ ID NO: 7672 - protein, 27 aa, Neocallimastix californiae
  Dockerin_dom
ACWSQPLGYPCCSSPNAEVYYTDNDGK

SEQ ID NO: 7673 - protein, 37 aa, Neocallimastix californiae; identical to SEQ ID NO: 1478
  Dockerin_dom

SEQ ID NO: 7674 - protein, 34 aa, Neocallimastix californiae; identical to SEQ ID NO: 2478
  Dockerin_dom

SEQ ID NO: 7675 - protein, 39 aa, Neocallimastix californiae; identical to SEQ ID NO: 4028
  Dockerin_dom

SEQ ID NO: 7676 - protein, 39 aa, Neocallimastix californiae; identical to SEQ ID NO: 4028
  Dockerin_dom

SEQ ID NO: 7677 - protein, 29 aa, Neocallimastix californiae
  Dockerin_dom
ACWSQPLGYPCCSSPNAEVYYTDNDGKWS

SEQ ID NO: 7678 - protein, 31 aa, Neocallimastix californiae; identical to SEQ ID NO: 2503
  Dockerin_dom

SEQ ID NO: 7679 - protein, 39 aa, Neocallimastix californiae; identical to SEQ ID NO: 4028
  Dockerin_dom

SEQ ID NO: 7680 - protein, 37 aa, Neocallimastix californiae; identical to SEQ ID NO: 4575
  Dockerin_dom_fun

SEQ ID NO: 7681 - protein, 35 aa, Neocallimastix californiae
  Dockerin_dom_fun
HENGYPYCKNTKIVVYTDDVEWGVENNEWCVIKDD

SEQ ID NO: 7682 - protein, 38 aa, Neocallimastix californiae
  Dockerin_dom_fun
CKCWSEKLGYPCCVGNTVYTTDESGSWGLENDDWCGIK

SEQ ID NO: 7683 - protein, 39 aa, Neocallimastix californiae; identical to SEQ ID NO: 4578
  Dockerin_dom_fun

SEQ ID NO: 7684 - protein, 39 aa, Neocallimastix californiae
  Dockerin_dom_fun
ECFSLVLGFPCCSSCDSIYEDDDGKWGVENNNWCGIKNS

SEQ ID NO: 7685 - protein, 32 aa, Neocallimastix californiae
  Dockerin_dom_fun
YDCCNGCDVYYTDDEGEWGIQNNNWCFINDAN

SEQ ID NO: 7686 - protein, 38 aa, Neocallimastix californiae; identical to SEQ ID NO: 4579
  Dockerin_dom_fun

SEQ ID NO: 7687 - protein, 40 aa, Anaeromyces robustus; identical to SEQ ID NO: 7249
  Dockerin_dom_fun

SEQ ID NO: 7688 - protein, 41 aa, Anaeromyces robustus; identical to SEQ ID NO: 4627
  Dockerin_dom_fun

SEQ ID NO: 7689 - protein, 38 aa, Anaeromyces robustus; identical to SEQ ID NO: 7250
  Dockerin_dom_fun

SEQ ID NO: 7690 - protein, 37 aa, Anaeromyces robustus; identical to SEQ ID NO: 7348
  Dockerin_dom_fun

SEQ ID NO: 7691 - protein, 39 aa, Anaeromyces robustus
  Dockerin_dom_fun
SCFSVKLGYPCCSSANVPVAYTDNDGNWGIENGDWCGIP

SEQ ID NO: 7692 - protein, 40 aa, Anaeromyces robustus; identical to SEQ ID NO: 5049
  Dockerin_dom_fun

SEQ ID NO: 7693 - protein, 34 aa, Anaeromyces robustus; identical to SEQ ID NO: 4739
  Dockerin_dom_fun

SEQ ID NO: 7694 - protein, 38 aa, Anaeromyces robustus; identical to SEQ ID NO: 7363
  Dockerin_dom_fun

SEQ ID NO: 7695 - protein, 40 aa, Anaeromyces robustus; identical to SEQ ID NO: 7362
  Dockerin_dom_fun

SEQ ID NO: 7696 - protein, 36 aa, Anaeromyces robustus; identical to SEQ ID NO: 7376
  Dockerin_dom_fun

SEQ ID NO: 7697 - protein, 39 aa, Anaeromyces robustus; identical to SEQ ID NO: 7377
  Dockerin_dom_fun

SEQ ID NO: 7698 - protein, 26 aa, Anaeromyces robustus
  Dockerin_dom_fun
CSSKITAQGYKCCSDPNCTVYYTDAD

SEQ ID NO: 7699 - protein, 40 aa, Anaeromyces robustus; identical to SEQ ID NO: 7408
  Dockerin_dom_fun

SEQ ID NO: 7700 - protein, 40 aa, Anaeromyces robustus; identical to SEQ ID NO: 4783
  Dockerin_dom_fun

SEQ ID NO: 7701 - protein, 41 aa, Anaeromyces robustus; identical to SEQ ID NO: 7423
  Dockerin_dom_fun

SEQ ID NO: 7702 - protein, 38 aa, Anaeromyces robustus; identical to SEQ ID NO: 7424
  Dockerin_dom_fun

SEQ ID NO: 7703 - protein, 39 aa, Anaeromyces robustus; identical to SEQ ID NO: 7425
  Dockerin_dom_fun

SEQ ID NO: 7704 - protein, 32 aa, Anaeromyces robustus; identical to SEQ ID NO: 7426
  Dockerin_dom_fun

SEQ ID NO: 7705 - protein, 31 aa, Anaeromyces robustus; identical to SEQ ID NO: 4800
  Dockerin_dom_fun

SEQ ID NO: 7706 - protein, 41 aa, Anaeromyces robustus; identical to SEQ ID NO: 4785
  Dockerin_dom_fun

SEQ ID NO: 7707 - protein, 40 aa, Anaeromyces robustus; identical to SEQ ID NO: 7411
  Dockerin_dom_fun

SEQ ID NO: 7708 - protein, 40 aa, Anaeromyces robustus; identical to SEQ ID NO: 7387
  Dockerin_dom_fun

SEQ ID NO: 7709 - protein, 41 aa, Anaeromyces robustus; identical to SEQ ID NO: 4810
  Dockerin_dom_fun

SEQ ID NO: 7710 - protein, 32 aa, Anaeromyces robustus; identical to SEQ ID NO: 7437
  Dockerin_dom_fun

SEQ ID NO: 7711 - protein, 40 aa, Anaeromyces robustus; identical to SEQ ID NO: 7339
  Dockerin_dom_fun

SEQ ID NO: 7712 - protein, 37 aa, Anaeromyces robustus; identical to SEQ ID NO: 4715
  Dockerin_dom_fun

SEQ ID NO: 7713 - protein, 40 aa, Anaeromyces robustus; identical to SEQ ID NO: 7339
  Dockerin_dom_fun

SEQ ID NO: 7714 - protein, 37 aa, Anaeromyces robustus; identical to SEQ ID NO: 4715
  Dockerin_dom_fun

SEQ ID NO: 7715 - protein, 33 aa, Anaeromyces robustus; identical to SEQ ID NO: 7455
  Dockerin_dom_fun

SEQ ID NO: 7716 - protein, 38 aa, Anaeromyces robustus; identical to SEQ ID NO: 4826
  Dockerin_dom_fun

SEQ ID NO: 7717 - protein, 31 aa, Anaeromyces robustus; identical to SEQ ID NO: 7459
  Dockerin_dom_fun

SEQ ID NO: 7718 - protein, 31 aa, Anaeromyces robustus; identical to SEQ ID NO: 7460
  Dockerin_dom_fun

SEQ ID NO: 7719 - protein, 36 aa, Anaeromyces robustus
  Dockerin_dom_fun
ALGYPCCKSTCNVYSSDESGQWGIEDNNWCLIDASK

SEQ ID NO: 7720 - protein, 40 aa, Anaeromyces robustus; identical to SEQ ID NO: 4828
  Dockerin_dom_fun

SEQ ID NO: 7721 - protein, 33 aa, Anaeromyces robustus; identical to SEQ ID NO: 5081
  Dockerin_dom_fun

SEQ ID NO: 7722 - protein, 35 aa, Anaeromyces robustus
  Dockerin_dom_fun
ALGYSCCKSCDSFNYKDNDGEWGIENDAWCGIPKE

SEQ ID NO: 7723 - protein, 35 aa, Anaeromyces robustus
  Dockerin_dom_fun
ALGYPCCKSTCNVYSSDESGQWGIENDAWCGIPKE

SEQ ID NO: 7724 - protein, 38 aa, Anaeromyces robustus; identical to SEQ ID NO: 7443
  Dockerin_dom_fun

SEQ ID NO: 7725 - protein, 34 aa, Anaeromyces robustus; identical to SEQ ID NO: 7444
  Dockerin_dom_fun

SEQ ID NO: 7726 - protein, 39 aa, Anaeromyces robustus; identical to SEQ ID NO: 7442
  Dockerin_dom_fun

SEQ ID NO: 7727 - protein, 36 aa, Anaeromyces robustus; identical to SEQ ID NO: 4839
  Dockerin_dom_fun

SEQ ID NO: 7728 - protein, 38 aa, Anaeromyces robustus; identical to SEQ ID NO: 7468
  Dockerin_dom_fun

SEQ ID NO: 7729 - protein, 38 aa, Anaeromyces robustus; identical to SEQ ID NO: 4872
  Dockerin_dom_fun

SEQ ID NO: 7730 - protein, 37 aa, Anaeromyces robustus; identical to SEQ ID NO: 7501
  Dockerin_dom_fun

SEQ ID NO: 7731 - protein, 31 aa, Anaeromyces robustus; identical to SEQ ID NO: 7479
  Dockerin_dom_fun

SEQ ID NO: 7732 - protein, 34 aa, Anaeromyces robustus; identical to SEQ ID NO: 7480
  Dockerin_dom_fun

SEQ ID NO: 7733 - protein, 39 aa, Anaeromyces robustus; identical to SEQ ID NO: 4890
  Dockerin_dom_fun

SEQ ID NO: 7734 - protein, 39 aa, Anaeromyces robustus; identical to SEQ ID NO: 7518
  Dockerin_dom_fun

SEQ ID NO: 7735 - protein, 34 aa, Anaeromyces robustus; identical to SEQ ID NO: 2552
  Dockerin_dom_fun

SEQ ID NO: 7736 - protein, 41 aa, Anaeromyces robustus; identical to SEQ ID NO: 7481
  Dockerin_dom_fun

SEQ ID NO: 7737 - protein, 30 aa, Anaeromyces robustus; identical to SEQ ID NO: 4853
  Dockerin_dom_fun

SEQ ID NO: 7738 - protein, 32 aa, Anaeromyces robustus; identical to SEQ ID NO: 4841
  Dockerin_dom_fun

SEQ ID NO: 7739 - protein, 38 aa, Anaeromyces robustus; identical to SEQ ID NO: 7470
  Dockerin_dom_fun

SEQ ID NO: 7740 - protein, 39 aa, Anaeromyces robustus; identical to SEQ ID NO: 7485
  Dockerin_dom_fun

SEQ ID NO: 7741 - protein, 40 aa, Anaeromyces robustus; identical to SEQ ID NO: 7484
  Dockerin_dom_fun

SEQ ID NO: 7742 - protein, 36 aa, Anaeromyces robustus; identical to SEQ ID NO: 2561
  Dockerin_dom_fun

SEQ ID NO: 7743 - protein, 41 aa, Anaeromyces robustus; identical to SEQ ID NO: 4881
  Dockerin_dom_fun

SEQ ID NO: 7744 - protein, 36 aa, Anaeromyces robustus; identical to SEQ ID NO: 7511
  Dockerin_dom_fun

SEQ ID NO: 7745 - protein, 36 aa, Anaeromyces robustus; identical to SEQ ID NO: 7532
  Dockerin_dom_fun

SEQ ID NO: 7746 - protein, 40 aa, Anaeromyces robustus; identical to SEQ ID NO: 7533
  Dockerin_dom_fun

SEQ ID NO: 7747 - protein, 38 aa, Anaeromyces robustus; identical to SEQ ID NO: 7534
  Dockerin_dom_fun

SEQ ID NO: 7748 - protein, 25 aa, Anaeromyces robustus
  Dockerin_dom_fun
DCWIKDYFSCCDEGAEVIYEDHNGK

SEQ ID NO: 7749 - protein, 40 aa, Anaeromyces robustus; identical to SEQ ID NO: 7533
  Dockerin_dom_fun

SEQ ID NO: 7750 - protein, 34 aa, Anaeromyces robustus; identical to SEQ ID NO: 7544
  Dockerin_dom_fun

SEQ ID NO: 7751 - protein, 32 aa, Anaeromyces robustus; identical to SEQ ID NO: 4913
  Dockerin_dom_fun

SEQ ID NO: 7752 - protein, 29 aa, Anaeromyces robustus
  Dockerin_dom_fun
YPCCTSTKTVMYTDEKGPWGIENGNWCGI

SEQ ID NO: 7753 - protein, 39 aa, Anaeromyces robustus; identical to SEQ ID NO: 4908
  Dockerin_dom_fun

SEQ ID NO: 7754 - protein, 39 aa, Anaeromyces robustus; identical to SEQ ID NO: 4906
  Dockerin_dom_fun

SEQ ID NO: 7755 - protein, 39 aa, Anaeromyces robustus; identical to SEQ ID NO: 4975
  Dockerin_dom_fun

SEQ ID NO: 7756 - protein, 39 aa, Anaeromyces robustus; identical to SEQ ID NO: 4976
  Dockerin_dom_fun

SEQ ID NO: 7757 - protein, 36 aa, Anaeromyces robustus; identical to SEQ ID NO: 7569
  Dockerin_dom_fun

SEQ ID NO: 7758 - protein, 30 aa, Anaeromyces robustus; identical to SEQ ID NO: 7570
  Dockerin_dom_fun

SEQ ID NO: 7759 - protein, 39 aa, Anaeromyces robustus; identical to SEQ ID NO: 5115
  Dockerin_dom_fun

SEQ ID NO: 7760 - protein, 38 aa, Anaeromyces robustus; identical to SEQ ID NO: 4922
  Dockerin_dom_fun

SEQ ID NO: 7761 - protein, 31 aa, Anaeromyces robustus; identical to SEQ ID NO: 4923
  Dockerin_dom_fun

SEQ ID NO: 7762 - protein, 33 aa, Anaeromyces robustus; identical to SEQ ID NO: 7554
  Dockerin_dom_fun

SEQ ID NO: 7763 - protein, 31 aa, Anaeromyces robustus; identical to SEQ ID NO: 2581
  Dockerin_dom_fun

SEQ ID NO: 7764 - protein, 36 aa, Anaeromyces robustus; identical to SEQ ID NO: 5120
  Dockerin_dom_fun

SEQ ID NO: 7765 - protein, 36 aa, Anaeromyces robustus; identical to SEQ ID NO: 4920
  Dockerin_dom_fun

SEQ ID NO: 7766 - protein, 39 aa, Anaeromyces robustus
  Dockerin_dom_fun
SCWSESFGYPCCHSCYVFETDDNGKWGFENNTWCGIQSY

SEQ ID NO: 7767 - protein, 39 aa, Anaeromyces robustus; identical to SEQ ID NO: 7568
  Dockerin_dom_fun

SEQ ID NO: 7768 - protein, 40 aa, Anaeromyces robustus; identical to SEQ ID NO: 4857
  Dockerin_dom_fun

SEQ ID NO: 7769 - protein, 37 aa, Anaeromyces robustus; identical to SEQ ID NO: 4858
  Dockerin_dom_fun

SEQ ID NO: 7770 - protein, 31 aa, Anaeromyces robustus; identical to SEQ ID NO: 7559
  Dockerin_dom_fun

SEQ ID NO: 7771 - protein, 41 aa, Anaeromyces robustus; identical to SEQ ID NO: 7560
  Dockerin_dom_fun

SEQ ID NO: 7772 - protein, 40 aa, Anaeromyces robustus
  Dockerin_dom_fun
NTCWSKSLGYPCCTSKSTVIFTDSNGQWGIENGNWCGKPN

SEQ ID NO: 7773 - protein, 41 aa, Anaeromyces robustus
  Dockerin_dom_fun
NCWAKSLGYNCCSTSSCRTAQFSDADGQWDVENGNWCGITT

SEQ ID NO: 7774 - protein, 28 aa, Anaeromyces robustus
  Dockerin_dom_fun
FPCCTGKDIVYSDGSGDWGFENGSWCGI

SEQ ID NO: 7775 - protein, 38 aa, Anaeromyces robustus; identical to SEQ ID NO: 7589
  Dockerin_dom_fun

SEQ ID NO: 7776 - protein, 39 aa, Anaeromyces robustus; identical to SEQ ID NO: 5132
  Dockerin_dom_fun

SEQ ID NO: 7777 - protein, 32 aa, Anaeromyces robustus; identical to SEQ ID NO: 5134
  Dockerin_dom_fun

SEQ ID NO: 7778 - protein, 38 aa, Anaeromyces robustus; identical to SEQ ID NO: 5133
  Dockerin_dom_fun

SEQ ID NO: 7779 - protein, 40 aa, Anaeromyces robustus
  Dockerin_dom_fun
KCWSLEYGYKCCSHCKVLLKDDYGKWGEMNGQWCGIDPAK

SEQ ID NO: 7780 - protein, 41 aa, Anaeromyces robustus; identical to SEQ ID NO: 7579
  Dockerin_dom_fun

SEQ ID NO: 7781 - protein, 32 aa, Anaeromyces robustus
  Dockerin_dom_fun
YECCKGCQTILTDDEGNWGAENNQWCFIDENK

SEQ ID NO: 7782 - protein, 39 aa, Anaeromyces robustus; identical to SEQ ID NO: 4854
  Dockerin_dom_fun

SEQ ID NO: 7783 - protein, 39 aa, Anaeromyces robustus; identical to SEQ ID NO: 4926
  Dockerin_dom_fun

SEQ ID NO: 7784 - protein, 41 aa, Anaeromyces robustus; identical to SEQ ID NO: 7558
  Dockerin_dom_fun

SEQ ID NO: 7785 - protein, 36 aa, Anaeromyces robustus; identical to SEQ ID NO: 4925
  Dockerin_dom_fun

SEQ ID NO: 7786 - protein, 31 aa, Anaeromyces robustus
  Dockerin_dom_fun
YPCCEGCKVIQEDKDGKWGYENNEWCGIKDS

SEQ ID NO: 7787 - protein, 33 aa, Anaeromyces robustus; identical to SEQ ID NO: 5144
  Dockerin_dom_fun

SEQ ID NO: 7788 - protein, 31 aa, Anaeromyces robustus; identical to SEQ ID NO: 7592
  Dockerin_dom_fun

SEQ ID NO: 7789 - protein, 32 aa, Anaeromyces robustus
  Dockerin_dom_fun
YPCCNNCEVIYVDSDGEWGVENNNWCAIDASQ

SEQ ID NO: 7790 - protein, 32 aa, Anaeromyces robustus
  Dockerin_dom_fun
YPFCKGCTVVYTDNDGDWGVENNDWCLIKKSN

SEQ ID NO: 7791 - protein, 42 aa, Anaeromyces robustus
  Dockerin_dom_fun
CSSSIRSLGYSCCSDNNCTVYATDESGKWGIENDQWCGISNK

SEQ ID NO: 7792 - protein, 40 aa, Anaeromyces robustus; identical to SEQ ID NO: 4930
  Dockerin_dom_fun

SEQ ID NO: 7793 - protein, 36 aa, Anaeromyces robustus
  Dockerin_dom_fun
RKNLGYKCCQYCDIVYTDSDGDYGFENNDWCGIADS

SEQ ID NO: 7794 - protein, 39 aa, Anaeromyces robustus; identical to SEQ ID NO: 7577
  Dockerin_dom_fun

SEQ ID NO: 7795 - protein, 33 aa, Anaeromyces robustus; identical to SEQ ID NO: 7578
  Dockerin_dom_fun

SEQ ID NO: 7796 - protein, 39 aa, Anaeromyces robustus; identical to SEQ ID NO: 7565
  Dockerin_dom_fun

SEQ ID NO: 7797 - protein, 37 aa, Anaeromyces robustus; identical to SEQ ID NO: 2395
  Dockerin_dom_fun

SEQ ID NO: 7798 - protein, 30 aa, Anaeromyces robustus
  Dockerin_dom_fun
VGYPCCKTNKQVYFTDNDGNWSFENNNWCL

SEQ ID NO: 7799 - protein, 42 aa, Anaeromyces robustus
  Dockerin_dom_fun
CSAKIQAQGYKCCSDKNCTIFYSDNDGNWGVENGQWCGCENS

SEQ ID NO: 7800 - protein, 33 aa, Anaeromyces robustus
  Dockerin_dom_fun
LGYNCCRNTCSISYKDDDGNWGIENGNWCGIPF

SEQ ID NO: 7801 - protein, 30 aa, Anaeromyces robustus
  Dockerin_dom_fun
YQCCRNTRVSQYTDSAGNEWGIENNQWCGI

SEQ ID NO: 7802 - protein, 39 aa, Anaeromyces robustus; identical to SEQ ID NO: 5159
  Dockerin_dom_fun

SEQ ID NO: 7803 - protein, 41 aa, Anaeromyces robustus; identical to SEQ ID NO: 7597
  Dockerin_dom_fun

SEQ ID NO: 7804 - protein, 40 aa, Anaeromyces robustus; identical to SEQ ID NO: 5000
  Dockerin_dom_fun

SEQ ID NO: 7805 - protein, 39 aa, Anaeromyces robustus; identical to SEQ ID NO: 7635
  Dockerin_dom_fun

SEQ ID NO: 7806 - protein, 32 aa, Anaeromyces robustus; identical to SEQ ID NO: 4941
  Dockerin_dom_fun

SEQ ID NO: 7807 - protein, 39 aa, Anaeromyces robustus; identical to SEQ ID NO: 5163
  Dockerin_dom_fun

SEQ ID NO: 7808 - protein, 40 aa, Anaeromyces robustus; identical to SEQ ID NO: 5165
  Dockerin_dom_fun

SEQ ID NO: 7809 - protein, 40 aa, Anaeromyces robustus; identical to SEQ ID NO: 4942
  Dockerin_dom_fun

SEQ ID NO: 7810 - protein, 36 aa, Anaeromyces robustus; identical to SEQ ID NO: 5167
  Dockerin_dom_fun

SEQ ID NO: 7811 - protein, 40 aa, Anaeromyces robustus
  Dockerin_dom_fun
TSITSQGYRCCKENNCSVIETDDSGKWGIEDGQWCGISNK

SEQ ID NO: 7812 - protein, 39 aa, Anaeromyces robustus; identical to SEQ ID NO: 4995
  Dockerin_dom_fun

SEQ ID NO: 7813 - protein, 38 aa, Anaeromyces robustus; identical to SEQ ID NO: 5169
  Dockerin_dom_fun

SEQ ID NO: 7814 - protein, 41 aa, Anaeromyces robustus; identical to SEQ ID NO: 7618
  Dockerin_dom_fun

SEQ ID NO: 7815 - protein, 31 aa, Anaeromyces robustus; identical to SEQ ID NO: 7619
  Dockerin_dom_fun

SEQ ID NO: 7816 - protein, 41 aa, Anaeromyces robustus; identical to SEQ ID NO: 5173
  Dockerin_dom_fun

SEQ ID NO: 7817 - protein, 30 aa, Anaeromyces robustus; identical to SEQ ID NO: 2631
  Dockerin_dom_fun

SEQ ID NO: 7818 - protein, 40 aa, Anaeromyces robustus; identical to SEQ ID NO: 5179
  Dockerin_dom_fun

SEQ ID NO: 7819 - protein, 40 aa, Anaeromyces robustus; identical to SEQ ID NO: 5176
  Dockerin_dom_fun

SEQ ID NO: 7820 - protein, 33 aa, Anaeromyces robustus
  Dockerin_dom_fun
GYPCCKKCDVYSYDRHGYWGIEKGNWCGIDTIK

SEQ ID NO: 7821 - protein, 40 aa, Anaeromyces robustus; identical to SEQ ID NO: 5174
  Dockerin_dom_fun

SEQ ID NO: 7822 - protein, 40 aa, Anaeromyces robustus; identical to SEQ ID NO: 5178
  Dockerin_dom_fun

SEQ ID NO: 7823 - protein, 41 aa, Anaeromyces robustus
  Dockerin_dom_fun
NCWASWYGYECCKGCKVKGEDSKGKWGWENGKWCGIDEDYC

SEQ ID NO: 7824 - protein, 37 aa, Anaeromyces robustus
  Dockerin_dom_fun
DCFAIKLGYKCCNNEAVVLVDNDGKWGYNGDWCGIGG

SEQ ID NO: 7825 - protein, 32 aa, Anaeromyces robustus
  Dockerin_dom_fun
PCCSHCNGIYHDNDGDWGVENNQWCLIKSSKC

SEQ ID NO: 7826 - protein, 38 aa, Anaeromyces robustus
  Dockerin_dom_fun
CKSTSYPCCSSCNLPVYSTDSDGKWSIENNNWCNFNTN

SEQ ID NO: 7827 - protein, 39 aa, Anaeromyces robustus; identical to SEQ ID NO: 4978
  Dockerin_dom_fun

SEQ ID NO: 7828 - protein, 32 aa, Anaeromyces robustus
  Dockerin_dom_fun
TYPCCSKCNVVYTDDEGDWGFEKGAWCSIREN

SEQ ID NO: 7829 - protein, 41 aa, Anaeromyces robustus
  Dockerin_dom_fun
KCWSEELGYKCCKYCNVLMEDENGQWGFENDEWCGITESAC

SEQ ID NO: 7830 - protein, 40 aa, Anaeromyces robustus; identical to SEQ ID NO: 4950
  Dockerin_dom_fun

SEQ ID NO: 7831 - protein, 36 aa, Anaeromyces robustus; identical to SEQ ID NO: 5187
  Dockerin_dom_fun

SEQ ID NO: 7832 - protein, 39 aa, Anaeromyces robustus; identical to SEQ ID NO: 5190
  Dockerin_dom_fun

SEQ ID NO: 7833 - protein, 36 aa, Anaeromyces robustus; identical to SEQ ID NO: 5188
  Dockerin_dom_fun

SEQ ID NO: 7834 - protein, 31 aa, Anaeromyces robustus
  Dockerin_dom_fun
YSNCKSTCEVSYEDDQKWGIENGQWCILPES

SEQ ID NO: 7835 - protein, 39 aa, Anaeromyces robustus; identical to SEQ ID NO: 5192
  Dockerin_dom_fun

SEQ ID NO: 7836 - protein, 39 aa, Anaeromyces robustus
  Dockerin_dom_fun
SCTGIEDGYPCCKTCNAIYNDEQGPWGYENNEWCGIKTS

SEQ ID NO: 7837 - protein, 31 aa, Anaeromyces robustus
  Dockerin_dom_fun
YPCCSKGAEVIYTDESGDWGLENGDWCFIKE

SEQ ID NO: 7838 - protein, 40 aa, Anaeromyces robustus
  Dockerin_dom_fun
TCWSTAEGYPCCTPGTAVTLTDSKGKWGIENGSWCGITET

SEQ ID NO: 7839 - protein, 36 aa, Anaeromyces robustus
  Dockerin_dom_fun
ASKDGYPCCKGCSVTYEDASGKWGVENNAWCGIDSS

SEQ ID NO: 7840 - protein, 42 aa, Anaeromyces robustus
  Dockerin_dom_fun
NSCWASSLGYGCCNGCEAITVDGSGKWGFENGAWCGIIDSKC

SEQ ID NO: 7841 - protein, 36 aa, Anaeromyces robustus; identical to SEQ ID NO: 7839
  Dockerin_dom_fun

SEQ ID NO: 7842 - protein, 26 aa, Anaeromyces robustus
  Dockerin_dom_fun
TCWSTAEGYPCCTPGTAVTLTDSKGK

SEQ ID NO: 7843 - protein, 38 aa, Anaeromyces robustus; identical to SEQ ID NO: 5199
  Dockerin_dom_fun

SEQ ID NO: 7844 - protein, 38 aa, Anaeromyces robustus
  Dockerin_dom_fun
SCFSIALGYPCCKGNTIVYTDDSGDWGVENNNWCGIPS

SEQ ID NO: 7845 - protein, 33 aa, Anaeromyces robustus; identical to SEQ ID NO: 7632
  Dockerin_dom_fun

SEQ ID NO: 7846 - protein, 31 aa, Anaeromyces robustus; identical to SEQ ID NO: 7633
  Dockerin_dom_fun

SEQ ID NO: 7847 - protein, 40 aa, Anaeromyces robustus
  Dockerin_dom_fun
CPGYELGYECCNNNEVVYTDETGDWGLTDTVPPQWCSIGK

SEQ ID NO: 7848 - protein, 33 aa, Anaeromyces robustus
  Dockerin_dom_fun
PLYPCCEGCNVYEETEEGKWGIENDAWCGVKDS

SEQ ID NO: 7849 - protein, 31 aa, Anaeromyces robustus
  Dockerin_dom_fun
AYDECKGCTVYYEDDTKWGVENDDWCIIPSS

SEQ ID NO: 7850 - protein, 37 aa, Anaeromyces robustus
  Dockerin_dom_fun
ECWSERLGYPCCTSGAQVYYSDADGQWGVENNNWCGI

SEQ ID NO: 7851 - protein, 38 aa, Anaeromyces robustus; identical to SEQ ID NO: 5207
  Dockerin_dom_fun

SEQ ID NO: 7852 - protein, 40 aa, Anaeromyces robustus
  Dockerin_dom_fun
SCFAAKLNYKCCSTCDVAYTDGDGDWGFENNEWCGIKDSC

SEQ ID NO: 7853 - protein, 28 aa, Anaeromyces robustus
  Dockerin_dom_fun
YPCCSSSVGVSFVDESGSWGIENGNWCG

SEQ ID NO: 7854 - protein, 40 aa, Anaeromyces robustus; identical to SEQ ID NO: 5210
  Dockerin_dom_fun

SEQ ID NO: 7855 - protein, 38 aa, Anaeromyces robustus
  Dockerin_dom_fun
KCFSQKLNPSYPCCEGDVVVYVDKDGEWGVENGNWCGI

SEQ ID NO: 7856 - protein, 40 aa, Anaeromyces robustus; identical to SEQ ID NO: 5212
  Dockerin_dom_fun

SEQ ID NO: 7857 - protein, 30 aa, Anaeromyces robustus
  Dockerin_dom_fun
YPCCEGTDVVYSDASGDWGVENGQWCGIVE

SEQ ID NO: 7858 - protein, 31 aa, Anaeromyces robustus
  Dockerin_dom_fun
YPCCKEGAEAIYEDAQGKWGVENGQWCGIEP

SEQ ID NO: 7859 - protein, 41 aa, Anaeromyces robustus
  Dockerin_dom_fun
QSCWSTALNYPCCKNSCDVVISDDDGDWGVEDGQWCGITKN

SEQ ID NO: 7860 - protein, 38 aa, Anaeromyces robustus; identical to SEQ ID NO: 5215
  Dockerin_dom_fun

SEQ ID NO: 7861 - protein, 37 aa, Anaeromyces robustus
  Dockerin_dom_fun
CWSLPDYKCCSGCDIVYTDNHNWGVENGEWCGIDDKQ

SEQ ID NO: 7862 - protein, 39 aa, Anaeromyces robustus
  Dockerin_dom_fun
ECAVLSQGYPCCQQTCDVVYVDDYKWGVENGEWCGIKDS

SEQ ID NO: 7863 - protein, 45 aa, Anaeromyces robustus
  Dockerin_dom_fun
DCWAKALGFKCCDEENPQVYYTDESGDWSVEFKGDSGEWCGIIKS

SEQ ID NO: 7864 - protein, 38 aa, Anaeromyces robustus; identical to SEQ ID NO: 5221
  Dockerin_dom_fun

SEQ ID NO: 7865 - protein, 36 aa, Anaeromyces robustus
  Dockerin_dom_fun
SCWANRLGYQCCKGNTVVYTDSDGKWGVENGNWCGI

SEQ ID NO: 7866 - protein, 31 aa, Anaeromyces robustus
  Dockerin_dom_fun
YPCCKGCDISYSDESGDWGVENGKWCGIKAS

SEQ ID NO: 7867 - protein, 31 aa, Anaeromyces robustus
  Dockerin_dom_fun
YPCCNSCNIVETDALGRWGVENGEWCGIPDS

SEQ ID NO: 7868 - protein, 40 aa, Anaeromyces robustus; identical to SEQ ID NO: 5222
  Dockerin_dom_fun

SEQ ID NO: 7869 - protein, 33 aa, Anaeromyces robustus; identical to SEQ ID NO: 2684
  Dockerin_dom_fun
  MOD_RES (24)..(24): Any amino acid

SEQ ID NO: 7870 - protein, 14 aa, Anaeromyces robustus
  Dockerin_dom_fun
DGDWGVENGNWCGI

SEQ ID NO: 7871 - protein, 37 aa, Anaeromyces robustus; identical to SEQ ID NO: 5227
  Dockerin_dom_fun

SEQ ID NO: 7872 - protein, 38 aa, Anaeromyces robustus
  Dockerin_dom_fun
ECFSVSLGYPCCQKTTKVVVVDEDGEWGAEDGNWCGLK

SEQ ID NO: 7873 - protein, 37 aa, Anaeromyces robustus; identical to SEQ ID NO: 5229
  Dockerin_dom_fun

SEQ ID NO: 7874 - protein, 40 aa, Anaeromyces robustus
  Dockerin_dom_fun
ECWAEKLGYGCCKTTTTPILEDDDGKWGVENDEWCGIMEQ

SEQ ID NO: 7875 - protein, 39 aa, Anaeromyces robustus; identical to SEQ ID NO: 5231
  Dockerin_dom_fun

SEQ ID NO: 7876 - protein, 32 aa, Anaeromyces robustus
  Dockerin_dom_fun
NYPCCSECKTIYTDQTGDWGYENEQWCGIKDS

SEQ ID NO: 7877 - protein, 25 aa, Anaeromyces robustus
  Dockerin_dom_fun
EEKDMGYPCCDNCEVVTTDSDGGWG

SEQ ID NO: 7878 - protein, 41 aa, Anaeromyces robustus
  Dockerin_dom_fun
ECWAEALGYSCCKGCDIIYSDNDGDWSVENDEWCGIISKKC

SEQ ID NO: 7879 - protein, 30 aa, Anaeromyces robustus
  Dockerin_dom_fun
YKCCKKCNVVYRDDYDWGVENNDWCSIPHS

SEQ ID NO: 7880 - protein, 40 aa, Anaeromyces robustus
  Dockerin_dom_fun
ECWSEASGYSCCKLKTTTVEFTDSKGNKYGIENGHFCGIN

SEQ ID NO: 7881 - protein, 37 aa, Anaeromyces robustus; identical to SEQ ID NO: 7637
  Dockerin_dom_fun

SEQ ID NO: 7882 - protein, 27 aa, Anaeromyces robustus
  Dockerin_dom_fun
CSEKFTKQGYKCCSSCSFVYYTDESGD

SEQ ID NO: 7883 - protein, 40 aa, Anaeromyces robustus
  Dockerin_dom_fun
CSASIKNQGFSCCEGCTKYYSDNDGDWGFENDNWCGLNDY

SEQ ID NO: 7884 - protein, 40 aa, Anaeromyces robustus; identical to SEQ ID NO: 4971
  Dockerin_dom_fun

SEQ ID NO: 7885 - protein, 38 aa, Anaeromyces robustus
  Dockerin_dom_fun
TCWSEPEFKCCTKSCTVYFTDDHEWGVEDDEWCGIPES

SEQ ID NO: 7886 - protein, 38 aa, Anaeromyces robustus
  Dockerin_dom_fun
SCKSASFYPCCETCNVFSEEDGDRWGVENDQWCSIKYK

SEQ ID NO: 7887 - protein, 31 aa, Anaeromyces robustus
  Dockerin_dom_fun
AYEECKGCVVYYEDDTKWGIENDDWCIIPSS

SEQ ID NO: 7888 - protein, 31 aa, Anaeromyces robustus; identical to SEQ ID NO: 5242
  Dockerin_dom_fun

SEQ ID NO: 7889 - protein, 39 aa, Anaeromyces robustus; identical to SEQ ID NO: 5245
  Dockerin_dom_fun

SEQ ID NO: 7890 - protein, 32 aa, Anaeromyces robustus
  Dockerin_dom_fun
YPCCNGCEVVYTDVDGEWGVENGAWCLLQPSK

SEQ ID NO: 7891 - protein, 39 aa, Anaeromyces robustus; identical to SEQ ID NO: 5247
  Dockerin_dom_fun

SEQ ID NO: 7892 - protein, 37 aa, Anaeromyces robustus
  Dockerin_dom_fun
NQCWSEKLGYQCCKSTKDIVFTDNDGNWGIENGNWCG

SEQ ID NO: 7893 - protein, 41 aa, Anaeromyces robustus
  Dockerin_dom_fun
CWSLKRNHPYPCCEKSETEVVYISSNGDEWGTENGDWCGIT

SEQ ID NO: 7894 - protein, 32 aa, Anaeromyces robustus
  Dockerin_dom_fun
QDYPCCKGCIVKYVDDYEWGVEENNWCYIPFK

SEQ ID NO: 7895 - protein, 39 aa, Anaeromyces robustus
  Dockerin_dom_fun
ECWSLRLGYNCCKYRSTPVYEKDNDGLWGIEDNDWCGVT

SEQ ID NO: 7896 - protein, 33 aa, Anaeromyces robustus; identical to SEQ ID NO: 5251
  Dockerin_dom_fun

SEQ ID NO: 7897 - protein, 37 aa, Anaeromyces robustus; identical to SEQ ID NO: 5252
  Dockerin_dom_fun

SEQ ID NO: 7898 - protein, 38 aa, Anaeromyces robustus
  Dockerin_dom_fun
CKCWSEKLGYPCCTNKNVVHVDENGQWGIENDMWCGIK

SEQ ID NO: 7899 - protein, 38 aa, Anaeromyces robustus
  Dockerin_dom_fun
CWATKLGYKCCTAKCPEVSYVDQDGAWGVENGNWCGIT

SEQ ID NO: 7900 - protein, 40 aa, Anaeromyces robustus; identical to SEQ ID NO: 7542
  Dockerin_dom_fun

SEQ ID NO: 7901 - protein, 40 aa, Anaeromyces robustus; identical to SEQ ID NO: 7542
  Dockerin_dom_fun

SEQ ID NO: 7902 - protein, 40 aa, Anaeromyces robustus; identical to SEQ ID NO: 7541
  Dockerin_dom_fun

SEQ ID NO: 7903 - protein, 40 aa, Anaeromyces robustus; identical to SEQ ID NO: 5259
  Dockerin_dom_fun

SEQ ID NO: 7904 - protein, 29 aa, Anaeromyces robustus
  Dockerin_dom_fun
KCWAKRYGYECCSENAKYYKEDSNGPWGK

SEQ ID NO: 7905 - protein, 29 aa, Anaeromyces robustus
  Dockerin_dom_fun
PCCKNPDTEVISFDMDGRYGNENGVICGI

SEQ ID NO: 7906 - protein, 37 aa, Anaeromyces robustus; identical to SEQ ID NO: 5261
  Dockerin_dom_fun

SEQ ID NO: 7907 - protein, 38 aa, Anaeromyces robustus; identical to SEQ ID NO: 7639
  Dockerin_dom_fun

SEQ ID NO: 7908 - protein, 39 aa, Anaeromyces robustus
  Dockerin_dom_fun
CWSESLGYSCCTFCSPIIYSDESGDWGVINNEWCGIPSN

SEQ ID NO: 7909 - protein, 37 aa, Anaeromyces robustus; identical to SEQ ID NO: 5263
  Dockerin_dom_fun

SEQ ID NO: 7910 - protein, 39 aa, Anaeromyces robustus; identical to SEQ ID NO: 5264
  Dockerin_dom_fun

SEQ ID NO: 7911 - protein, 37 aa, Anaeromyces robustus
  Dockerin_dom_fun
CFAEDLGFKCCSYSTMEVYSDSNGKWSVESGEWCGID

SEQ ID NO: 7912 - protein, 37 aa, Anaeromyces robustus
  Dockerin_dom_fun
KCWAEKLGYSCCQGCHVIYVDNDGEWGVENNAWCGIN

SEQ ID NO: 7913 - protein, 39 aa, Anaeromyces robustus
  Dockerin_dom_fun
NCTGKLQGYQCCLTCNVVTTDADGRWGIENGNWCGIKNS

SEQ ID NO: 7914 - protein, 38 aa, Anaeromyces robustus; identical to SEQ ID NO: 5267
  Dockerin_dom_fun

SEQ ID NO: 7915 - protein, 40 aa, Anaeromyces robustus; identical to SEQ ID NO: 5269
  Dockerin_dom_fun

SEQ ID NO: 7916 - protein, 41 aa, Anaeromyces robustus
  Dockerin_dom_fun
KCWSKKYGYECCQGCTAYEVDEFGKWGYEKNHWCGIIEENC

SEQ ID NO: 7917 - protein, 41 aa, Anaeromyces robustus; identical to SEQ ID NO: 5272
  Dockerin_dom_fun

SEQ ID NO: 7918 - protein, 31 aa, Anaeromyces robustus
  Dockerin_dom_fun
FPCCSPDNTYIFFSDNNGDWGIENGDWCGII

SEQ ID NO: 7919 - protein, 39 aa, Anaeromyces robustus; identical to SEQ ID NO: 5271
  Dockerin_dom_fun

SEQ ID NO: 7920 - protein, 20 aa, Anaeromyces robustus
  Dockerin_dom_fun
FTDDNGKWSVENDEWCGIVE

SEQ ID NO: 7921 - protein, 40 aa, Anaeromyces robustus
  Dockerin_dom_fun
NCWSAVFGYPCCKYTKVVRSTDENGDWGIEYDHWCGIPKS

SEQ ID NO: 7922 - protein, 40 aa, Anaeromyces robustus
  Dockerin_dom_fun
ECWSLKQGYSCCQNKNTKVSYISKNGDEWGVENNEWCGIT

SEQ ID NO: 7923 - protein, 38 aa, Anaeromyces robustus
  Dockerin_dom_fun
CPKYKLGKYKCCQQCKVRYTDDYEWGVEDGEWCSIPYS

SEQ ID NO: 7924 - protein, 39 aa, Anaeromyces robustus
  Dockerin_dom_fun
GCWSEKFNIPCCQSTSEVVRKTYDGEWGIEDGKWCSIGE

SEQ ID NO: 7925 - protein, 30 aa, Anaeromyces robustus
  Dockerin_dom_fun
YKCCESCNVVYTDFQKWGYEDNEWCSIPYS

SEQ ID NO: 7926 - protein, 39 aa, Anaeromyces robustus; identical to SEQ ID NO: 5280
  Dockerin_dom_fun

SEQ ID NO: 7927 - protein, 38 aa, Anaeromyces robustus; identical to SEQ ID NO: 5282
  Dockerin_dom_fun

SEQ ID NO: 7928 - protein, 32 aa, Anaeromyces robustus
  Dockerin_dom_fun
YACCKDPNTYISTTDKTGDWGIEGNYWCLIDK

SEQ ID NO: 7929 - protein, 39 aa, Anaeromyces robustus
  Dockerin_dom_fun
SCWSKKLGYECCAGCSVAYTDSDGEWGLENDQWCGIPDT

SEQ ID NO: 7930 - protein, 35 aa, Anaeromyces robustus
  Dockerin_dom_fun
KSSGYPCCENCEVIYDDGNTKWGLLNNDWCALSDA

SEQ ID NO: 7931 - protein, 32 aa, Anaeromyces robustus
  Dockerin_dom_fun
YDCCSGCTVVDQGDGKIKWGVENNQWCIIKST

SEQ ID NO: 7932 - protein, 34 aa, Anaeromyces robustus
  Dockerin_dom_fun
NGYPCCKDQRPEKKTYLDMDGDWTIEDGKWCGFY

SEQ ID NO: 7933 - protein, 41 aa, Anaeromyces robustus
  Dockerin_dom_fun
DCWATKINTSYACCPEDEVKFEDKYGYWSVNQSGKFCGIKR

SEQ ID NO: 7934 - protein, 41 aa, Anaeromyces robustus
  Dockerin_dom_fun
ECWADSYGYPCCSEGILALPFYTDEKGNKWGRENDDYCGII

SEQ ID NO: 7935 - protein, 40 aa, Anaeromyces robustus; identical to SEQ ID NO: 5286
  Dockerin_dom_fun

SEQ ID NO: 7936 - protein, 32 aa, Anaeromyces robustus
  Dockerin_dom_fun
YMCCKGCDVVEDDGETTKWGIENNEWCGLKES

SEQ ID NO: 7937 - protein, 32 aa, Anaeromyces robustus
  Dockerin_dom_fun
AYSNCQGCRVILEENGVKWGVENNDWCIVSSS

SEQ ID NO: 7938 - protein, 39 aa, Anaeromyces robustus; identical to SEQ ID NO: 5291
  Dockerin_dom_fun

SEQ ID NO: 7939 - protein, 39 aa, Anaeromyces robustus; identical to SEQ ID NO: 5292
  Dockerin_dom_fun

SEQ ID NO: 7940 - protein, 36 aa, Anaeromyces robustus; identical to SEQ ID NO: 5294
  Dockerin_dom_fun

SEQ ID NO: 7941 - protein, 36 aa, Anaeromyces robustus
  Dockerin_dom_fun
CFALSDGYECCFDNEVVYEDETGKWGINENGEWCGV

SEQ ID NO: 7942 - protein, 41 aa, Anaeromyces robustus
  Dockerin_dom_fun
NTCWAEPLGFKCCTGTDPKIVYSDEDGDWAIENGQWCGVVK

SEQ ID NO: 7943 - protein, 41 aa, Anaeromyces robustus; identical to SEQ ID NO: 5293
  Dockerin_dom_fun

SEQ ID NO: 7944 - protein, 32 aa, Anaeromyces robustus
  Dockerin_dom_fun
YRCCTECNVSYTGSDGHTWGIEYGQWCSIPYT

SEQ ID NO: 7945 - protein, 41 aa, Anaeromyces robustus
  Dockerin_dom_fun
ECWASFEGYPCCEDPKTPVSYVNKQTRVEYGFEHGEWCGIS

SEQ ID NO: 7946 - protein, 40 aa, Anaeromyces robustus; identical to SEQ ID NO: 5300
  Dockerin_dom_fun

SEQ ID NO: 7947 - protein, 39 aa, Anaeromyces robustus
  Dockerin_dom_fun
QCFSQSLGFPCCNNCNVVYTDESGSWGVENNDWCGIKSS

SEQ ID NO: 7948 - protein, 40 aa, Anaeromyces robustus; identical to SEQ ID NO: 5299
  Dockerin_dom_fun

SEQ ID NO: 7949 - protein, 40 aa, Anaeromyces robustus; identical to SEQ ID NO: 5305
  Dockerin_dom_fun

SEQ ID NO: 7950 - protein, 28 aa, Anaeromyces robustus
  Dockerin_dom_fun
YQCCKDKKSIYTDDDGDWAYTNGEWCGV

SEQ ID NO: 7951 - protein, 37 aa, Anaeromyces robustus; identical to SEQ ID NO: 2772
  Dockerin_dom_fun

SEQ ID NO: 7952 - protein, 38 aa, Anaeromyces robustus
  Dockerin_dom_fun
TCWAEALSYKCCSNPNTPVVLTDKSGEWGIENGNWCGI

SEQ ID NO: 7953 - protein, 38 aa, Anaeromyces robustus
  Dockerin_dom_fun
HCWSLDHGYKCCKGENVEVEYTDSKGQWGKENGEWCGI

SEQ ID NO: 7954 - protein, 40 aa, Anaeromyces robustus; identical to SEQ ID NO: 5308
  Dockerin_dom_fun

SEQ ID NO: 7955 - protein, 38 aa, Anaeromyces robustus
  Dockerin_dom_fun
HCWSLNYGYKCCKDENVEVITTDIYGQWGKEDGKWCGI

SEQ ID NO: 7956 - protein, 39 aa, Anaeromyces robustus; identical to SEQ ID NO: 5309
  Dockerin_dom_fun

SEQ ID NO: 7957 - protein, 36 aa, Anaeromyces robustus; identical to SEQ ID NO: 5310
  Dockerin_dom_fun

SEQ ID NO: 7958 - protein, 37 aa, Anaeromyces robustus
  Dockerin_dom_fun
CFSKTLTPSYPCCKGDKVIYTDKNGDWGVENGEWCGI

SEQ ID NO: 7959 - protein, 39 aa, Anaeromyces robustus; identical to SEQ ID NO: 5311
  Dockerin_dom_fun

SEQ ID NO: 7960 - protein, 40 aa, Anaeromyces robustus
  Dockerin_dom_fun
CWSESLGVRCCKGAENIVEYMDQEGWWGVTEEDQWCGIVK

SEQ ID NO: 7961 - protein, 36 aa, Anaeromyces robustus; identical to SEQ ID NO: 5314
  Dockerin_dom_fun

SEQ ID NO: 7962 - protein, 29 aa, Anaeromyces robustus
  Dockerin_dom_fun
YPCCKGNVVYYTDEQGAWGVENGNWCGIS

SEQ ID NO: 7963 - protein, 35 aa, Anaeromyces robustus
  Dockerin_dom_fun
LYGYPCCSECSTVYYQDKNGEWGIENGDWCGMPYK

SEQ ID NO: 7964 - protein, 34 aa, Anaeromyces robustus
  Dockerin_dom_fun
IIQEGYECCPIGCKIYYTDSSGDWGIYNNDWCGC

SEQ ID NO: 7965 - protein, 38 aa, Anaeromyces robustus
  Dockerin_dom_fun
CNCWAQKLGYPCCTEKVIYYSDGDGDWGFENNQWCGIM

SEQ ID NO: 7966 - protein, 33 aa, Anaeromyces robustus
  Dockerin_dom_fun
YSYPYCKTTKDVAFDDGTLQWGVENDNWCIIKG

SEQ ID NO: 7967 - protein, 38 aa, Anaeromyces robustus; identical to SEQ ID NO: 5321
  Dockerin_dom_fun

SEQ ID NO: 7968 - protein, 41 aa, Anaeromyces robustus
  Dockerin_dom_fun
CPSSITNQGYPCCSSCSTVYYVDNDGKWGVENNDWCGIPTN

SEQ ID NO: 7969 - protein, 38 aa, Anaeromyces robustus; identical to SEQ ID NO: 2789
  Dockerin_dom_fun

SEQ ID NO: 7970 - protein, 34 aa, Anaeromyces robustus
  Dockerin_dom_fun
TGYPCCIFDTTKAVLHDDDGDWGIEGDYCLIVNN

SEQ ID NO: 7971 - protein, 38 aa, Anaeromyces robustus; identical to SEQ ID NO: 5325
  Dockerin_dom_fun

SEQ ID NO: 7972 - protein, 27 aa, Anaeromyces robustus
  Dockerin_dom_fun
YPVCKTTSEIVFTDTEKWGIENNEWCI

SEQ ID NO: 7973 - protein, 38 aa, Anaeromyces robustus
  Dockerin_dom_fun
TCKAEEIGYSCCKKQKEVIYTDDLGEWGIENGDWCGIS

SEQ ID NO: 7974 - protein, 35 aa, Anaeromyces robustus
  Dockerin_dom_fun
NGYKCCSNINAEVQYHDKDGDWSIENNEWCIIKKD

SEQ ID NO: 7975 - protein, 41 aa, Anaeromyces robustus; identical to SEQ ID NO: 5329
  Dockerin_dom_fun

SEQ ID NO: 7976 - protein, 40 aa, Anaeromyces robustus; identical to SEQ ID NO: 5330
  Dockerin_dom_fun

SEQ ID NO: 7977 - protein, 41 aa, Anaeromyces robustus
  Dockerin_dom_fun
PATITAQNYPCCSDNNCDVYAVDESGKWGLENNQWCGISNK

SEQ ID NO: 7978 - protein, 40 aa, Anaeromyces robustus
  Dockerin_dom_fun
CSANITKQGYKCCPSGCIVIYTDDDGTWGINNGEWCGCNA

SEQ ID NO: 7979 - protein, 35 aa, Anaeromyces robustus
  Dockerin_dom_fun
NILNKGYSCCPYKCEVIYTDEDGTWGIYDNEWCGC

SEQ ID NO: 7980 - protein, 38 aa, Anaeromyces robustus; identical to SEQ ID NO: 5335
  Dockerin_dom_fun

SEQ ID NO: 7981 - protein, 37 aa, Anaeromyces robustus; identical to SEQ ID NO: 5334
  Dockerin_dom_fun

SEQ ID NO: 7982 - protein, 41 aa, Anaeromyces robustus
  Dockerin_dom_fun
SCWSTEYGYPCCVLKSTVIEYDDVENGRKYGIEDNKICGIS

SEQ ID NO: 7983 - protein, 31 aa, Anaeromyces robustus
  Dockerin_dom_fun
TYKCCKSCDIVYTDTTNWGVENNEWCSIPYK

SEQ ID NO: 7984 - protein, 40 aa, Anaeromyces robustus
  Dockerin_dom_fun
SCWSSAEGYPCCQDKKTKVSYVSKLTGKKYGIENNKKCGI

SEQ ID NO: 7985 - protein, 32 aa, Anaeromyces robustus
  Dockerin_dom_fun
YECCVYPDTQLVYYTNVGPWGIENNSWCLINK

SEQ ID NO: 7986 - protein, 32 aa, Anaeromyces robustus; identical to SEQ ID NO: 5338
  Dockerin_dom_fun

SEQ ID NO: 7987 - protein, 39 aa, Anaeromyces robustus; identical to SEQ ID NO: 5340
  Dockerin_dom_fun

SEQ ID NO: 7988 - protein, 35 aa, Anaeromyces robustus
  Dockerin_dom_fun
DGYKCCKESCAYYDKDSKGYWGLENKEWCYIDTAK

SEQ ID NO: 7989 - protein, 37 aa, Anaeromyces robustus
  Dockerin_dom_fun
CWSASLPCCKECNVVDASDKSRQYGWENDQWCAIPDK

SEQ ID NO: 7990 - protein, 35 aa, Anaeromyces robustus
  Dockerin_dom_fun
KAYQYPSCPDEEWTYTDKDGIWHQNSDGSWCLISK

SEQ ID NO: 7991 - protein, 41 aa, Anaeromyces robustus
  Dockerin_dom_fun
QCFAQVLGYSCCKEATGPITNSNGDGDWYEDENGKWCGYSS

SEQ ID NO: 7992 - protein, 40 aa, Anaeromyces robustus; identical to SEQ ID NO: 5342
  Dockerin_dom_fun

SEQ ID NO: 7993 - protein, 38 aa, Anaeromyces robustus
  Dockerin_dom_fun
ECWATKLGYPCCTGKYPGISYTDKDGSWSIENGQWCGV

SEQ ID NO: 7994 - protein, 32 aa, Anaeromyces robustus
  Dockerin_dom_fun
TGYPCCILESTAFRTYDRSGYWGLEGGNYCLI

SEQ ID NO: 7995 - protein, 40 aa, Anaeromyces robustus
  Dockerin_dom_fun
TCWSEALGYPCCRDPRTTIYKTEKDGKEWGIESNQWCGIN

SEQ ID NO: 7996 - protein, 42 aa, Anaeromyces robustus; identical to SEQ ID NO: 5346
  Dockerin_dom_fun

SEQ ID NO: 7997 - protein, 38 aa, Anaeromyces robustus
  Dockerin_dom_fun
KCWSNELGYPCCKSTTEIVFTDDRGNWGVEDKKWCGVI

SEQ ID NO: 7998 - protein, 35 aa, Anaeromyces robustus; identical to SEQ ID NO: 5347
  Dockerin_dom_fun

SEQ ID NO: 7999 - protein, 39 aa, Anaeromyces robustus
  Dockerin_dom_fun
CWSEKLGYKCCNTCFPVYYTDNDGQWGIVNGEWCGIAKT

SEQ ID NO: 8000 - protein, 36 aa, Anaeromyces robustus
  Dockerin_dom_fun
CSSKSLGYPCCKSSNNVVSTDELGKWGVENGDWCYI

SEQ ID NO: 8001 - protein, 37 aa, Anaeromyces robustus
  Dockerin_dom_fun
CWALKLGSPCCTFNKDVYAIDENGKWSVENGIWCGII

SEQ ID NO: 8002 - protein, 40 aa, Anaeromyces robustus
  Dockerin_dom_fun
NECWSLKLGSPCCTTTKEIIYTDDDGNWGIENNDWCGIID

SEQ ID NO: 8003 - protein, 39 aa, Anaeromyces robustus; identical to SEQ ID NO: 5351
  Dockerin_dom_fun

SEQ ID NO: 8004 - protein, 39 aa, Anaeromyces robustus; identical to SEQ ID NO: 5355
  Dockerin_dom_fun

SEQ ID NO: 8005 - protein, 39 aa, Anaeromyces robustus; identical to SEQ ID NO: 5354
  Dockerin_dom_fun

SEQ ID NO: 8006 - protein, 34 aa, Anaeromyces robustus
  Dockerin_dom_fun
VEGYKCCKSTCTVSYTDSNKWGVENNEWCIIPYE

SEQ ID NO: 8007 - protein, 32 aa, Anaeromyces robustus
  Dockerin_dom_fun
TGYACCIMNNGYIDSTDSDGTWGIEGGRYCLY

SEQ ID NO: 8008 - protein, 42 aa, Anaeromyces robustus; identical to SEQ ID NO: 5358
  Dockerin_dom_fun

SEQ ID NO: 8009 - protein, 37 aa, Anaeromyces robustus
  Dockerin_dom_fun
ECWSLKQGYPCCVKTEIVVIEDENGKWGVENDDWCGI

SEQ ID NO: 8010 - protein, 39 aa, Anaeromyces robustus; identical to SEQ ID NO: 5361
  Dockerin_dom_fun

SEQ ID NO: 8011 - protein, 34 aa, Anaeromyces robustus; identical to SEQ ID NO: 5359
  Dockerin_dom_fun

SEQ ID NO: 8012 - protein, 32 aa, Anaeromyces robustus
  Dockerin_dom_fun
TYPCCSPDNKKIKYVDQHGQWGFENGDWCGMP

SEQ ID NO: 8013 - protein, 39 aa, Anaeromyces robustus
  Dockerin_dom_fun
TCWSEKYGYPCCNGCYVFETDDDGQWGYENNQWCGIQSY

SEQ ID NO: 8014 - protein, 39 aa, Anaeromyces robustus
  Dockerin_dom_fun
KCLSELVGYPCCAKGIKAVYAKDEYGEWGYDFKKNEWCG

SEQ ID NO: 8015 - protein, 37 aa, Anaeromyces robustus
  Dockerin_dom_fun
DCWAEKLGYPCCKGNEPKVEFTDEHGDWSIENGQKCG

SEQ ID NO: 8016 - protein, 33 aa, Anaeromyces robustus
  Dockerin_dom_fun
SQLYEICKEQHDVVFKDNEGVWSVENGNWCSIQ

SEQ ID NO: 8017 - protein, 39 aa, Anaeromyces robustus; identical to SEQ ID NO: 5365
  Dockerin_dom_fun

SEQ ID NO: 8018 - protein, 39 aa, Anaeromyces robustus; identical to SEQ ID NO: 5369
  Dockerin_dom_fun

SEQ ID NO: 8019 - protein, 40 aa, Anaeromyces robustus; identical to SEQ ID NO: 5368
  Dockerin_dom_fun

SEQ ID NO: 8020 - protein, 39 aa, Anaeromyces robustus; identical to SEQ ID NO: 5371
  Dockerin_dom_fun

SEQ ID NO: 8021 - protein, 38 aa, Anaeromyces robustus; identical to SEQ ID NO: 5370
  Dockerin_dom_fun

SEQ ID NO: 8022 - protein, 38 aa, Anaeromyces robustus; identical to SEQ ID NO: 5373
  Dockerin_dom_fun

SEQ ID NO: 8023 - protein, 35 aa, Anaeromyces robustus
  Dockerin_dom_fun
YPCCSNCDVEIIWNDENKGQSWSIENNNWCGILQS

SEQ ID NO: 8024 - protein, 32 aa, Anaeromyces robustus
  Dockerin_dom_fun
YECCAYKNTEYQYSTDVGPWGLQDGAWCLMDE

SEQ ID NO: 8025 - protein, 32 aa, Anaeromyces robustus; identical to SEQ ID NO: 5374
  Dockerin_dom_fun

SEQ ID NO: 8026 - protein, 41 aa, Anaeromyces robustus; identical to SEQ ID NO: 5375
  Dockerin_dom_fun

SEQ ID NO: 8027 - protein, 41 aa, Anaeromyces robustus; identical to SEQ ID NO: 5376
  Dockerin_dom_fun

SEQ ID NO: 8028 - protein, 39 aa, Anaeromyces robustus
  Dockerin_dom_fun
KCLSELVGYPCCAKGIKVVYAKDEYGEWGYDFKKNEWCG

SEQ ID NO: 8029 - protein, 39 aa, Anaeromyces robustus
  Dockerin_dom_fun
ECWSEKYGYPCCNGCYVFETDDDGQWGYENNQWCGIQSF

SEQ ID NO: 8030 - protein, 32 aa, Anaeromyces robustus; identical to SEQ ID NO: 5380
  Dockerin_dom_fun

SEQ ID NO: 8031 - protein, 30 aa, Anaeromyces robustus; identical to SEQ ID NO: 5381
  Dockerin_dom_fun

SEQ ID NO: 8032 - protein, 38 aa, Anaeromyces robustus; identical to SEQ ID NO: 5379
  Dockerin_dom_fun

SEQ ID NO: 8033 - protein, 39 aa, Anaeromyces robustus; identical to SEQ ID NO: 5382
  Dockerin_dom_fun

SEQ ID NO: 8034 - protein, 36 aa, Anaeromyces robustus; identical to SEQ ID NO: 2846
  Dockerin_dom_fun

SEQ ID NO: 8035 - protein, 41 aa, Anaeromyces robustus
  Dockerin_dom_fun
YCWAKAKGYPCCDNDEGYLQSYDMDGKWGYENNAWCGYKSS

SEQ ID NO: 8036 - protein, 36 aa, Anaeromyces robustus; identical to SEQ ID NO: 5386
  Dockerin_dom_fun

SEQ ID NO: 8037 - protein, 39 aa, Anaeromyces robustus; identical to SEQ ID NO: 5384
  Dockerin_dom_fun

SEQ ID NO: 8038 - protein, 39 aa, Anaeromyces robustus; identical to SEQ ID NO: 5388
  Dockerin_dom_fun

SEQ ID NO: 8039 - protein, 33 aa, Anaeromyces robustus
  Dockerin_dom_fun
VGYACCKSSDVKIYETDEYGKWGVEDNKWCLLD

SEQ ID NO: 8040 - protein, 39 aa, Anaeromyces robustus
  Dockerin_dom_fun
SCFSEALGYPCCTSCNVIFTDSDGKWGVENNSWCGIKDS

SEQ ID NO: 8041 - protein, 37 aa, Anaeromyces robustus; identical to SEQ ID NO: 5389
  Dockerin_dom_fun

SEQ ID NO: 8042 - protein, 29 aa, Anaeromyces robustus
  Dockerin_dom_fun
YKCCTTTCEVHFTDDIKWGLEKTGEFCSL

SEQ ID NO: 8043 - protein, 30 aa, Anaeromyces robustus
  Dockerin_dom_fun
SYSCCVFRDTAVYSTDETGTWGIEGNRWCL

SEQ ID NO: 8044 - protein, 44 aa, Anaeromyces robustus; identical to SEQ ID NO: 5392
  Dockerin_dom_fun

SEQ ID NO: 8045 - protein, 34 aa, Anaeromyces robustus
  Dockerin_dom_fun
QCVKNKNGLKCCSTCEIALTDATGRYGYENGEWC

SEQ ID NO: 8046 - protein, 40 aa, Anaeromyces robustus
  Dockerin_dom_fun
CWSRSIGFVCCDKCNVLYVDEQGKWGIEDEYWCGINPDKC

SEQ ID NO: 8047 - protein, 37 aa, Anaeromyces robustus
  Dockerin_dom_fun
CNSEKYGYSCCKTEQKVVYTDSQGDWGIEDGNWCGIY

SEQ ID NO: 8048 - protein, 36 aa, Anaeromyces robustus
  Dockerin_dom_fun
ASSGYPCCTDPHTKVVYHDDEGDWGVENKEWCFIPV

SEQ ID NO: 8049 - protein, 27 aa, Anaeromyces robustus
  Dockerin_dom_fun
YPVCKETTKVMYTDTEKWGVEHGEWCV

SEQ ID NO: 8050 - protein, 40 aa, Anaeromyces robustus; identical to SEQ ID NO: 5399
  Dockerin_dom_fun

SEQ ID NO: 8051 - protein, 39 aa, Anaeromyces robustus
  Dockerin_dom_fun
MQRQGYPCCEENNCNIYFKDGDGDWGISSKSNWCGIRFT

SEQ ID NO: 8052 - protein, 42 aa, Anaeromyces robustus; identical to SEQ ID NO: 5400
  Dockerin_dom_fun

SEQ ID NO: 8053 - protein, 38 aa, Anaeromyces robustus
  Dockerin_dom_fun
CSSRILNQGYKCCSDNCKVVYTDEDGTWGYENNQWCGC

SEQ ID NO: 8054 - protein, 39 aa, Anaeromyces robustus
  Dockerin_dom_fun
ECWSKIYGYSCCKRCMVYETDENGKWGFESNQWCGIPAS

SEQ ID NO: 8055 - protein, 39 aa, Anaeromyces robustus
  Dockerin_dom_fun
KCLAELIGYPCCPSIIKTIYAQDEYGDWGFDFKKQEWCG

SEQ ID NO: 8056 - protein, 38 aa, Anaeromyces robustus; identical to SEQ ID NO: 5405
  Dockerin_dom_fun

SEQ ID NO: 8057 - protein, 37 aa, Anaeromyces robustus; identical to SEQ ID NO: 2869
  Dockerin_dom_fun

SEQ ID NO: 8058 - protein, 38 aa, Anaeromyces robustus
  Dockerin_dom_fun
NCWAYQYGFQCCFYYTKPYLVDERGSWSFERGNWCGIV

SEQ ID NO: 8059 - protein, 29 aa, Anaeromyces robustus
  Dockerin_dom_fun
PCCKNDNTPVVYFNMDGRLGMEDGHYCGI

SEQ ID NO: 8060 - protein, 42 aa, Anaeromyces robustus; identical to SEQ ID NO: 5408
  Dockerin_dom_fun

SEQ ID NO: 8061 - protein, 42 aa, Anaeromyces robustus; identical to SEQ ID NO: 5409
  Dockerin_dom_fun

SEQ ID NO: 8062 - protein, 42 aa, Anaeromyces robustus; identical to SEQ ID NO: 5411
  Dockerin_dom_fun

SEQ ID NO: 8063 - protein, 36 aa, Anaeromyces robustus
  Dockerin_dom_fun
SLLGYPCCKRCDSFLLTDDDANWGVENSEWCIIKSN

SEQ ID NO: 8064 - protein, 40 aa, Anaeromyces robustus; identical to SEQ ID NO: 5412
  Dockerin_dom_fun

SEQ ID NO: 8065 - protein, 39 aa, Anaeromyces robustus
  Dockerin_dom_fun
NCLAELLGYSCCSPENTNIYLQDENGDWGFDFEKNEWCG

SEQ ID NO: 8066 - protein, 39 aa, Anaeromyces robustus
  Dockerin_dom_fun
CWSEALGFPCCSTNGCQVVYYTDTDGKWGVENNNWCGIT

SEQ ID NO: 8067 - protein, 38 aa, Anaeromyces robustus; identical to SEQ ID NO: 5415
  Dockerin_dom_fun

SEQ ID NO: 8068 - protein, 41 aa, Anaeromyces robustus; identical to SEQ ID NO: 5417
  Dockerin_dom_fun

SEQ ID NO: 8069 - protein, 40 aa, Anaeromyces robustus
  Dockerin_dom_fun
KCNTYNNKYPCCSHCNVYHTDTDGSRWGIENDNWCSINYS

SEQ ID NO: 8070 - protein, 37 aa, Anaeromyces robustus
  Dockerin_dom_fun
NWSFLLGYDTCKEQHEYIYKDNEGLWSIEGGKWCGIQ

SEQ ID NO: 8071 - protein, 37 aa, Anaeromyces robustus
  Dockerin_dom_fun
DCWAEKLGYPCCKGNEPKVEFTDEYGDWSTEDGQKCG

SEQ ID NO: 8072 - protein, 39 aa, Anaeromyces robustus; identical to SEQ ID NO: 5420
  Dockerin_dom_fun

SEQ ID NO: 8073 - protein, 32 aa, Anaeromyces robustus
  Dockerin_dom_fun
YPYCDGCETNYTDKDGGWYYTNKTWCKVNEKK

SEQ ID NO: 8074 - protein, 37 aa, Anaeromyces robustus
  Dockerin_dom_fun
DCYARSLGLPCCNENEIIETNEYGNWGKIEGTDFYCG

SEQ ID NO: 8075 - protein, 31 aa, Anaeromyces robustus
  Dockerin_dom_fun
GYQCCKDSSTKVISEDNDGTWGIENKKWCLI

SEQ ID NO: 8076 - protein, 39 aa, Anaeromyces robustus; identical to SEQ ID NO: 5424
  Dockerin_dom_fun

SEQ ID NO: 8077 - protein, 41 aa, Anaeromyces robustus
  Dockerin_dom_fun
ECWSEVFGYPCCQSCYVYEEDENGKWGYDFNESTWCGIQSY

SEQ ID NO: 8078 - protein, 32 aa, Anaeromyces robustus
  Dockerin_dom_fun
PCCQDPRTKIKKIDEKGKEWGEENNEKCGITK

SEQ ID NO: 8079 - protein, 38 aa, Anaeromyces robustus
  Dockerin_dom_fun
QCPDYATGYSCCYECNIVYNDGHDWGIENGKWCSIPYS

SEQ ID NO: 8080 - protein, 32 aa, Anaeromyces robustus
  Dockerin_dom_fun
AYDECKSCLTYYIEDGVKWGVENNDWCLIPSK

SEQ ID NO: 8081 - protein, 37 aa, Anaeromyces robustus
  Dockerin_dom_fun
CFSYPQYPCCEGCTVIEETAEGKWGIENSQWCGIKDS

SEQ ID NO: 8082 - protein, 38 aa, Anaeromyces robustus
  Dockerin_dom_fun
CWAGQLGYPYCTSTTREVYKDNDGKWGIENNNWCCLSS

SEQ ID NO: 8083 - protein, 39 aa, Anaeromyces robustus; identical to SEQ ID NO: 5429
  Dockerin_dom_fun

SEQ ID NO: 8084 - protein, 37 aa, Anaeromyces robustus
  Dockerin_dom_fun
SCFATRLGYECCNYNEILYSDDDGDWGVNDNRWCGIG

SEQ ID NO: 8085 - protein, 31 aa, Anaeromyces robustus
  Dockerin_dom_fun
YKCCQKCEIVYEDKEGKWGVENDEWCVIGRN

SEQ ID NO: 8086 - protein, 41 aa, Anaeromyces robustus
  Dockerin_dom_fun
CWSLKYGYPCCKENATTIRKDKNGEWGFDFQKFRWCGIQKK

SEQ ID NO: 8087 - protein, 38 aa, Anaeromyces robustus; identical to SEQ ID NO: 5434
  Dockerin_dom_fun

SEQ ID NO: 8088 - protein, 39 aa, Anaeromyces robustus; identical to SEQ ID NO: 5433
  Dockerin_dom_fun

SEQ ID NO: 8089 - protein, 40 aa, Anaeromyces robustus
  Dockerin_dom_fun
ECFSIKLGYPCCKKTTEVAHIDKNGKWGIEDNHWCGLKDK

SEQ ID NO: 8090 - protein, 37 aa, Anaeromyces robustus
  Dockerin_dom_fun
KFEDLGFKCCSHCVHIYDDKTGLWGVEANEWCGISDE

SEQ ID NO: 8091 - protein, 37 aa, Anaeromyces robustus; identical to SEQ ID NO: 5436
  Dockerin_dom_fun

SEQ ID NO: 8092 - protein, 40 aa, Anaeromyces robustus; identical to SEQ ID NO: 5438
  Dockerin_dom_fun

SEQ ID NO: 8093 - protein, 40 aa, Anaeromyces robustus; identical to SEQ ID NO: 5439
  Dockerin_dom_fun

SEQ ID NO: 8094 - protein, 34 aa, Anaeromyces robustus
  Dockerin_dom_fun
NSGYSCCVSTTKVLSGDGTGDWGVEFNDWCLFDE

SEQ ID NO: 8095 - protein, 31 aa, Anaeromyces robustus
  Dockerin_dom_fun
YKCCKSSCSVYYVDTEEWGYEHGEWCLIPYK

SEQ ID NO: 8096 - protein, 40 aa, Anaeromyces robustus; identical to SEQ ID NO: 5442
  Dockerin_dom_fun

SEQ ID NO: 8097 - protein, 30 aa, Anaeromyces robustus
  Dockerin_dom_fun
YPCCKGCDVYYTDDVEWGIENGDWCSIPYE

SEQ ID NO: 8098 - protein, 40 aa, Anaeromyces robustus
  Dockerin_dom_fun
ECWSLSQGYPCCVNKNTKIKSTSSNGDEWGVENNEWCGIT

SEQ ID NO: 8099 - protein, 38 aa, Anaeromyces robustus
  Dockerin_dom_fun
ECWSEIYGYSCCKGCIIYESDENGKWGYKNGKWCGIPS

SEQ ID NO: 8100 - protein, 40 aa, Anaeromyces robustus; identical to SEQ ID NO: 5445
  Dockerin_dom_fun

SEQ ID NO: 8101 - protein, 38 aa, Anaeromyces robustus; identical to SEQ ID NO: 5447
  Dockerin_dom_fun

SEQ ID NO: 8102 - protein, 41 aa, Anaeromyces robustus
  Dockerin_dom_fun
QCFSQALNPSYPCCKSNKVVYTDKSGDWGVENDQWCGIGNS

SEQ ID NO: 8103 - protein, 41 aa, Anaeromyces robustus
  Dockerin_dom_fun
KCWSEEQGFPCCKGCVVIYTENNEKWGIENDEWCGINKTTC

SEQ ID NO: 8104 - protein, 31 aa, Anaeromyces robustus
  Dockerin_dom_fun
YECCETCTEYFSDNTGRYGYENEKWCLLKDS

SEQ ID NO: 8105 - protein, 39 aa, Anaeromyces robustus
  Dockerin_dom_fun
PSHILDQGYNCCIHDCIYITSDENRNWSVENGEWCWCIM

SEQ ID NO: 8106 - protein, 42 aa, Anaeromyces robustus
  Dockerin_dom_fun
NTCWSIQYGYECCKDPETPVYSKDSTGEWGIENNNWCGIVKN

SEQ ID NO: 8107 - protein, 31 aa, Anaeromyces robustus
  Dockerin_dom_fun
YDCCPKNQPVYEENSLGKWGKINGNYCGIKT

SEQ ID NO: 8108 - protein, 39 aa, Anaeromyces robustus; identical to SEQ ID NO: 5453
  Dockerin_dom_fun

SEQ ID NO: 8109 - protein, 36 aa, Anaeromyces robustus
  Dockerin_dom_fun
DCWSIPLGYPCCSNSYLPTLFTDDNGEWSVENDNWC

SEQ ID NO: 8110 - protein, 39 aa, Anaeromyces robustus
  Dockerin_dom_fun
DCFSVKLGYPCCQYTDEVVYVDDDGDWGVENNDWCGIGE

SEQ ID NO: 8111 - protein, 33 aa, Anaeromyces robustus
  Dockerin_dom_fun
EGYECCEGCTVESEEDNIKWGYENRNWCVIPYS

SEQ ID NO: 8112 - protein, 35 aa, Anaeromyces robustus; identical to SEQ ID NO: 5459
  Dockerin_dom_fun

SEQ ID NO: 8113 - protein, 37 aa, Anaeromyces robustus; identical to SEQ ID NO: 5458
  Dockerin_dom_fun

SEQ ID NO: 8114 - protein, 37 aa, Anaeromyces robustus; identical to SEQ ID NO: 5461
  Dockerin_dom_fun

SEQ ID NO: 8115 - protein, 39 aa, Anaeromyces robustus
  Dockerin_dom_fun
KCWAEFIGYPCCSEKDTYVYDTDSYGDWSYDFDNNEWCG

SEQ ID NO: 8116 - protein, 39 aa, Anaeromyces robustus; identical to SEQ ID NO: 5462
  Dockerin_dom_fun

SEQ ID NO: 8117 - protein, 40 aa, Anaeromyces robustus
  Dockerin_dom_fun
DCWATRLGFPCCEYSAQVFYTDNDGKWSIENGEWCGIIEN

SEQ ID NO: 8118 - protein, 41 aa, Anaeromyces robustus
  Dockerin_dom_fun
NCWATSIGYGCCNHCNSIYTDGTYRWGVQNNQWCGIIESNC

SEQ ID NO: 8119 - protein, 40 aa, Anaeromyces robustus; identical to SEQ ID NO: 5465
  Dockerin_dom_fun

SEQ ID NO: 8120 - protein, 36 aa, Anaeromyces robustus
  Dockerin_dom_fun
ATKLGYSCCKTCMVALTDKDGKWGVENKNWCGIDSV

SEQ ID NO: 8121 - protein, 32 aa, Anaeromyces robustus
  Dockerin_dom_fun
DNCCKTNTEILYSDDEGAWGYENDAWCIVRKF

SEQ ID NO: 8122 - protein, 41 aa, Anaeromyces robustus
  Dockerin_dom_fun
ECWAEKYGRPCCKNSSTKNVYTDNEGMWGVENDEWCGITEE

SEQ ID NO: 8123 - protein, 40 aa, Anaeromyces robustus
  Dockerin_dom_fun
CWAKKYGRPCCLNNLTEYVYADDEGMWGVENGDWCGINEH

SEQ ID NO: 8124 - protein, 39 aa, Anaeromyces robustus
  Dockerin_dom_fun
CWAQKLGFKCCKNPNATVINIDEDGTKWGIENDEWCGIL

SEQ ID NO: 8125 - protein, 40 aa, Anaeromyces robustus
  Dockerin_dom_fun
CKSEKLGIECCKDISTENVYTDDEGIKFGVEKDDWCGIKD

SEQ ID NO: 8126 - protein, 33 aa, Anaeromyces robustus
  Dockerin_dom_fun
YPCCNGCDVKYTDNSGKWGVENNNWCKIDNNKC

SEQ ID NO: 8127 - protein, 39 aa, Anaeromyces robustus; identical to SEQ ID NO: 5473
  Dockerin_dom_fun

SEQ ID NO: 8128 - protein, 41 aa, Anaeromyces robustus; identical to SEQ ID NO: 5474
  Dockerin_dom_fun

SEQ ID NO: 8129 - protein, 40 aa, Anaeromyces robustus; identical to SEQ ID NO: 5475
  Dockerin_dom_fun

SEQ ID NO: 8130 - protein, 38 aa, Anaeromyces robustus
  Dockerin_dom_fun
CWSKELGFPCCKGCLVIDKDEFGSWGFELDHWCGIQSY

SEQ ID NO: 8131 - protein, 40 aa, Anaeromyces robustus; identical to SEQ ID NO: 5477
  Dockerin_dom_fun

SEQ ID NO: 8132 - protein, 40 aa, Anaeromyces robustus
  Dockerin_dom_fun
TCWAELLGYNCCKSKNPIIIQTDEYGDWAIEKNNWCGIPG

SEQ ID NO: 8133 - protein, 39 aa, Anaeromyces robustus; identical to SEQ ID NO: 5478
  Dockerin_dom_fun

SEQ ID NO: 8134 - protein, 38 aa, Anaeromyces robustus; identical to SEQ ID NO: 5481
  Dockerin_dom_fun

SEQ ID NO: 8135 - protein, 39 aa, Anaeromyces robustus; identical to SEQ ID NO: 5484
  Dockerin_dom_fun

SEQ ID NO: 8136 - protein, 36 aa, Anaeromyces robustus; identical to SEQ ID NO: 5482
  Dockerin_dom_fun

SEQ ID NO: 8137 - protein, 30 aa, Anaeromyces robustus
  Dockerin_dom_fun
YPCCKNSKAKMQAFEMDGFLGVENNSYCGI

SEQ ID NO: 8138 - protein, 40 aa, Anaeromyces robustus; identical to SEQ ID NO: 5483
  Dockerin_dom_fun

SEQ ID NO: 8139 - protein, 40 aa, Anaeromyces robustus; identical to SEQ ID NO: 5480
  Dockerin_dom_fun

SEQ ID NO: 8140 - protein, 39 aa, Anaeromyces robustus
  Dockerin_dom_fun
KCWAELAGYPCCSERIKIVYEHDEFGDWGYDYSIKQWCG

SEQ ID NO: 8141 - protein, 38 aa, Anaeromyces robustus
  Dockerin_dom_fun
CWSEVFGYPCCESCYVFETDDYGKWGYENNHWCGIQSY

SEQ ID NO: 8142 - protein, 39 aa, Anaeromyces robustus; identical to SEQ ID NO: 5488
  Dockerin_dom_fun

SEQ ID NO: 8143 - protein, 38 aa, Anaeromyces robustus
  Dockerin_dom_fun
KCLSELIGYACCSLELTSIYTDEYGDWGYDYNKKEWCG

SEQ ID NO: 8144 - protein, 39 aa, Anaeromyces robustus; identical to SEQ ID NO: 5490
  Dockerin_dom_fun

SEQ ID NO: 8145 - protein, 39 aa, Anaeromyces robustus; identical to SEQ ID NO: 5489
  Dockerin_dom_fun

SEQ ID NO: 8146 - protein, 39 aa, Anaeromyces robustus; identical to SEQ ID NO: 5491
  Dockerin_dom_fun

SEQ ID NO: 8147 - protein, 39 aa, Anaeromyces robustus
  Dockerin_dom_fun
ECWSEALGYKCCSKGCDAVVLAIDNSGNWGAENGEWCGI

SEQ ID NO: 8148 - protein, 40 aa, Anaeromyces robustus; identical to SEQ ID NO: 5493
  Dockerin_dom_fun

SEQ ID NO: 8149 - protein, 38 aa, Anaeromyces robustus; identical to SEQ ID NO: 5494
  Dockerin_dom_fun

SEQ ID NO: 8150 - protein, 39 aa, Anaeromyces robustus; identical to SEQ ID NO: 5496
  Dockerin_dom_fun

SEQ ID NO: 8151 - protein, 37 aa, Anaeromyces robustus
  Dockerin_dom_fun
NCWANNLGYPCCSSNTQVIYTDNNGQWGVENNNWCGI

SEQ ID NO: 8152 - protein, 40 aa, Anaeromyces robustus; identical to SEQ ID NO: 5497
  Dockerin_dom_fun

SEQ ID NO: 8153 - protein, 41 aa, Anaeromyces robustus
  Dockerin_dom_fun
NTCWSSGYGYPCCTTCKVYYEDYSGEWGVENGDWCGIVSQY

SEQ ID NO: 8154 - protein, 18 aa, Anaeromyces robustus
  Dockerin_dom_fun
TCWAEKLGYSCCTSTSQV

SEQ ID NO: 8155 - protein, 37 aa, Anaeromyces robustus; identical to SEQ ID NO: 7348
  Dockerin_dom_fun

SEQ ID NO: 8156 - protein, 41 aa, Anaeromyces robustus; identical to SEQ ID NO: 5500
  Dockerin_dom_fun

SEQ ID NO: 8157 - protein, 33 aa, Anaeromyces robustus
  Dockerin_dom_fun
NLGYPCCNDCRVVYQDEYNWGVLNNQWCVTPYS

SEQ ID NO: 8158 - protein, 41 aa, Anaeromyces robustus; identical to SEQ ID NO: 5502
  Dockerin_dom_fun

SEQ ID NO: 8159 - protein, 38 aa, Anaeromyces robustus; identical to SEQ ID NO: 5503
  Dockerin_dom_fun

SEQ ID NO: 8160 - protein, 39 aa, Anaeromyces robustus; identical to SEQ ID NO: 5504
  Dockerin_dom_fun

SEQ ID NO: 8161 - protein, 42 aa, Anaeromyces robustus
  Dockerin_dom_fun
PCWAEVLGFPCCSTDKCRTVYFTDDDGEWDVENNNWCGITAS

SEQ ID NO: 8162 - protein, 40 aa, Anaeromyces robustus; identical to SEQ ID NO: 5507
  Dockerin_dom_fun

SEQ ID NO: 8163 - protein, 27 aa, Anaeromyces robustus
  Dockerin_dom_fun
YKCCKSCDIFYVDNYKWGVENNEWCSI

SEQ ID NO: 8164 - protein, 30 aa, Anaeromyces robustus
  Dockerin_dom_fun
SYPCCENTCAVQYTDADGQWGIENGNWCGM

SEQ ID NO: 8165 - protein, 30 aa, Anaeromyces robustus; identical to SEQ ID NO: 8164
  Dockerin_dom_fun

SEQ ID NO: 8166 - protein, 37 aa, Anaeromyces robustus; identical to SEQ ID NO: 5511
  Dockerin_dom_fun

SEQ ID NO: 8167 - protein, 37 aa, Anaeromyces robustus; identical to SEQ ID NO: 5510
  Dockerin_dom_fun

SEQ ID NO: 8168 - protein, 36 aa, Anaeromyces robustus; identical to SEQ ID NO: 2975
  Dockerin_dom_fun

SEQ ID NO: 8169 - protein, 35 aa, Anaeromyces robustus
  Dockerin_dom_fun
VEDMGYTICPVGTKITYANTQATWGKNNDDWCVIL

SEQ ID NO: 8170 - protein, 39 aa, Anaeromyces robustus
  Dockerin_dom_fun
TCWSEIFGYSCCKGCTIYEVDNDGSWGYENGEWCGIQSY

SEQ ID NO: 8171 - protein, 38 aa, Anaeromyces robustus
  Dockerin_dom_fun
CIAELIGYKCCSPNNTKVYAHDENGDWGYDFKKGEWCG

SEQ ID NO: 8172 - protein, 34 aa, Anaeromyces robustus; identical to SEQ ID NO: 5516
  Dockerin_dom_fun

SEQ ID NO: 8173 - protein, 38 aa, Anaeromyces robustus; identical to SEQ ID NO: 5517
  Dockerin_dom_fun

SEQ ID NO: 8174 - protein, 40 aa, Anaeromyces robustus
  Dockerin_dom_fun
ECWSLILGYKCCSSCLPIVETDSSGNWSIEDNQWCGLEER

SEQ ID NO: 8175 - protein, 39 aa, Anaeromyces robustus; identical to SEQ ID NO: 5518
  Dockerin_dom_fun

SEQ ID NO: 8176 - protein, 38 aa, Anaeromyces robustus
  Dockerin_dom_fun
CFSERLGFPCCPPGTKVEYSDEEGDWGIINEEWCGISD

SEQ ID NO: 8177 - protein, 38 aa, Anaeromyces robustus
  Dockerin_dom_fun
CWAEEFGYPCCSNLNNKIVYYIDEYGNKWGVENDDWCG

SEQ ID NO: 8178 - protein, 14 aa, Anaeromyces robustus
  Dockerin_dom_fun
GQWSVENDNWCGIP

SEQ ID NO: 8179 - protein, 38 aa, Anaeromyces robustus; identical to SEQ ID NO: 5522
  Dockerin_dom_fun

SEQ ID NO: 8180 - protein, 38 aa, Anaeromyces robustus
  Dockerin_dom_fun
CWSEALGYPCCSTCSSPVYSDNDGNWGVENGDWCGITK

SEQ ID NO: 8181 - protein, 12 aa, Anaeromyces robustus
  Dockerin_dom_fun
CWSEALGYPCCS

SEQ ID NO: 8182 - protein, 12 aa, Anaeromyces robustus
  Dockerin_dom_fun
GVENGDWCGITK

SEQ ID NO: 8183 - protein, 24 aa, Anaeromyces robustus
  Dockerin_dom_fun
YPCCSHCDVLFTDRTARWGIENND

SEQ ID NO: 8184 - protein, 41 aa, Anaeromyces robustus; identical to SEQ ID NO: 5524
  Dockerin_dom_fun

SEQ ID NO: 8185 - protein, 37 aa, Anaeromyces robustus; identical to SEQ ID NO: 5526
  Dockerin_dom_fun

SEQ ID NO: 8186 - protein, 37 aa, Anaeromyces robustus; identical to SEQ ID NO: 5526
  Dockerin_dom_fun

SEQ ID NO: 8187 - protein, 31 aa, Anaeromyces robustus
  Dockerin_dom_fun
AYKCCSSCIVYFEDNYKWGTMNGEWCSLTYD

SEQ ID NO: 8188 - protein, 39 aa, Anaeromyces robustus
  Dockerin_dom_fun
NQCWAEAYGYSCCSKCVKVIDTSYNKKWGLENGKWCGLP

SEQ ID NO: 8189 - protein, 30 aa, Anaeromyces robustus; identical to SEQ ID NO: 5530
  Dockerin_dom_fun

SEQ ID NO: 8190 - protein, 39 aa, Anaeromyces robustus
  Dockerin_dom_fun
TCFSLAQGYPCCQSCKVLYTDKSGKWGVENGKWCGIKDN

SEQ ID NO: 8191 - protein, 35 aa, Anaeromyces robustus; identical to SEQ ID NO: 5532
  Dockerin_dom_fun

SEQ ID NO: 8192 - protein, 38 aa, Anaeromyces robustus; identical to SEQ ID NO: 5531
  Dockerin_dom_fun

SEQ ID NO: 8193 - protein, 37 aa, Anaeromyces robustus; identical to SEQ ID NO: 5533
  Dockerin_dom_fun

SEQ ID NO: 8194 - protein, 18 aa, Anaeromyces robustus
  Dockerin_dom_fun
DESGDWSADNGEWCGVIK

SEQ ID NO: 8195 - protein, 40 aa, Anaeromyces robustus; identical to SEQ ID NO: 5536
  Dockerin_dom_fun

SEQ ID NO: 8196 - protein, 38 aa, Anaeromyces robustus
  Dockerin_dom_fun
CWSETLGYPCCNTNGCQTIYFIDSNGMWSVENDNWCGI

SEQ ID NO: 8197 - protein, 40 aa, Anaeromyces robustus; identical to SEQ ID NO: 5538
  Dockerin_dom_fun

SEQ ID NO: 8198 - protein, 35 aa, Anaeromyces robustus; identical to SEQ ID NO: 5537
  Dockerin_dom_fun

SEQ ID NO: 8199 - protein, 40 aa, Anaeromyces robustus; identical to SEQ ID NO: 5538
  Dockerin_dom_fun

SEQ ID NO: 8200 - protein, 35 aa, Anaeromyces robustus; identical to SEQ ID NO: 5537
  Dockerin_dom_fun

SEQ ID NO: 8201 - protein, 42 aa, Anaeromyces robustus
  Dockerin_dom_fun
CFSKFLGSPYPCCSPDNQKIEFIDHDGLWGRENGKWCGIMNS

SEQ ID NO: 8202 - protein, 34 aa, Anaeromyces robustus; identical to SEQ ID NO: 5541
  Dockerin_dom_fun

SEQ ID NO: 8203 - protein, 19 aa, Anaeromyces robustus
  Dockerin_dom_fun
CWSTKLGYPCCSAGNKDVY

SEQ ID NO: 8204 - protein, 42 aa, Anaeromyces robustus
  Dockerin_dom_fun
NSCWSTKLGYPCCSAGNKDVYYNDDDGLWGVENNNWCGIPSN

SEQ ID NO: 8205 - protein, 32 aa, Anaeromyces robustus
  Dockerin_dom_fun
YPYCDGCDANYVDKDGRWNLVDKTWCKVKEKK

SEQ ID NO: 8206 - protein, 31 aa, Anaeromyces robustus
  Dockerin_dom_fun
GYQCCKDSSTQVILTDDDGTWGIENNHWCHI

SEQ ID NO: 8207 - protein, 39 aa, Anaeromyces robustus; identical to SEQ ID NO: 4975
  Dockerin_dom_fun

SEQ ID NO: 8208 - protein, 13 aa, Anaeromyces robustus
  Dockerin_dom_fun
GIENNQWCGIPSS

SEQ ID NO: 8209 - protein, 39 aa, Anaeromyces robustus; identical to SEQ ID NO: 5548
  Dockerin_dom_fun

SEQ ID NO: 8210 - protein, 38 aa, Anaeromyces robustus
  Dockerin_dom_fun
ECWSLKHGYPCCQKTKVVTLEDENGKWGVENDDWCGII

SEQ ID NO: 8211 - protein, 40 aa, Anaeromyces robustus; identical to SEQ ID NO: 5549
  Dockerin_dom_fun

SEQ ID NO: 8212 - protein, 15 aa, Anaeromyces robustus
  Dockerin_dom_fun
WGVENNEWCLIKKSK

SEQ ID NO: 8213 - protein, 41 aa, Anaeromyces robustus; identical to SEQ ID NO: 5550
  Dockerin_dom_fun

SEQ ID NO: 8214 - protein, 40 aa, Anaeromyces robustus
  Dockerin_dom_fun
ECWSEVFGFPCCTSSCHVYEIDDSGEWGYEDNHWCGIPST

SEQ ID NO: 8215 - protein, 36 aa, Anaeromyces robustus
  Dockerin_dom_fun
NECWANELGYKCCPKGCDATVVVEDDLGKWGILGGE

SEQ ID NO: 8216 - protein, 42 aa, Anaeromyces robustus; identical to SEQ ID NO: 5553
  Dockerin_dom_fun

SEQ ID NO: 8217 - protein, 42 aa, Anaeromyces robustus
  Dockerin_dom_fun
NKCWSELIGYPCCDSSVTTVFVQDDYGDWGYDFNKNEWCGIT

SEQ ID NO: 8218 - protein, 34 aa, Anaeromyces robustus
  Dockerin_dom_fun
SGYACCKFNTTTVTTTDYTGKWGIEGLRYCLIDE

SEQ ID NO: 8219 - protein, 37 aa, Anaeromyces robustus
  Dockerin_dom_fun
RKGYPCCTKKTSNVNYISKNGDQYGYENNKWCGITTI

SEQ ID NO: 8220 - protein, 40 aa, Anaeromyces robustus
  Dockerin_dom_fun
DCWSKEYGISCCEDKATQVEYIETNSGREFGVENGHICGI

SEQ ID NO: 8221 - protein, 30 aa, Anaeromyces robustus
  Dockerin_dom_fun
YKCCNSCKVRYTDDYEWGVEGGEWCSIPYS

SEQ ID NO: 8222 - protein, 30 aa, Anaeromyces robustus
  Dockerin_dom_fun
YKCCNSCKVRYTDNYEWGVEDGEWCSIPYS

SEQ ID NO: 8223 - protein, 40 aa, Anaeromyces robustus
  Dockerin_dom_fun
KCWSELIGYKCCAPNVTAIYASDEYGYWGYDFENNEWCGI

SEQ ID NO: 8224 - protein, 23 aa, Anaeromyces robustus
  Dockerin_dom_fun
NCWSQKYGYPCCQTCIVYHNDNE

SEQ ID NO: 8225 - protein, 40 aa, Anaeromyces robustus; identical to SEQ ID NO: 8223
  Dockerin_dom_fun

SEQ ID NO: 8226 - protein, 39 aa, Anaeromyces robustus; identical to SEQ ID NO: 5560
  Dockerin_dom_fun

SEQ ID NO: 8227 - protein, 38 aa, Anaeromyces robustus
  Dockerin_dom_fun
KCWSEKIGYKCCTDAEIYLTDTFGHWSIEDGEWCLVKR

SEQ ID NO: 8228 - protein, 41 aa, Anaeromyces robustus; identical to SEQ ID NO: 5563
  Dockerin_dom_fun

SEQ ID NO: 8229 - protein, 40 aa, Anaeromyces robustus; identical to SEQ ID NO: 5566
  Dockerin_dom_fun

SEQ ID NO: 8230 - protein, 38 aa, Anaeromyces robustus
  Dockerin_dom_fun
CFAEKLGYSCCISPSSAVLHEDKDGKWGIEYGKWCGLP

SEQ ID NO: 8231 - protein, 38 aa, Anaeromyces robustus
  Dockerin_dom_fun
RCFSEKLGFPCCSDPSTVVVFVDESSEWGVENDGWCGF

SEQ ID NO: 8232 - protein, 37 aa, Anaeromyces robustus
  Dockerin_dom_fun
CFSEKLGFPCCSDPSTVIVFVDESGEWGVENDGWCGF

SEQ ID NO: 8233 - protein, 39 aa, Anaeromyces robustus; identical to SEQ ID NO: 5568
  Dockerin_dom_fun

SEQ ID NO: 8234 - protein, 37 aa, Anaeromyces robustus
  Dockerin_dom_fun
CFSEPYFPCCKENKVVLVDEEGEWGIENKKWCGISSS

SEQ ID NO: 8235 - protein, 42 aa, Anaeromyces robustus
  Dockerin_dom_fun
ECWSEEQGYSCCQGCNILLVEEGQQKWGFENNKWCGIVESVC

SEQ ID NO: 8236 - protein, 20 aa, Anaeromyces robustus
  Dockerin_dom_fun
KCWSMPLGYPCCVGNDVYKK

SEQ ID NO: 8237 - protein, 39 aa, Anaeromyces robustus; identical to SEQ ID NO: 5571
  Dockerin_dom_fun

SEQ ID NO: 8238 - protein, 37 aa, Anaeromyces robustus
  Dockerin_dom_fun
ESILSQGYKCCSDNCLVVYTDDDGTWGYENDKWCGCE

SEQ ID NO: 8239 - protein, 35 aa, Anaeromyces robustus
  Dockerin_dom_fun
KGYSCCSENNCKIRYVDEDGNWGAENGQWCGISNK

SEQ ID NO: 8240 - protein, 38 aa, Anaeromyces robustus
  Dockerin_dom_fun
CWSNEYNYPCCKTCIVYEIDDKGSWGYENNEWCGIPSH

SEQ ID NO: 8241 - protein, 41 aa, Anaeromyces robustus; identical to SEQ ID NO: 5574
  Dockerin_dom_fun

SEQ ID NO: 8242 - protein, 34 aa, Anaeromyces robustus
  Dockerin_dom_fun
PSTITNKGYSCCSTCSKVRYVDEDGKWGVENHQW

SEQ ID NO: 8243 - protein, 41 aa, Anaeromyces robustus; identical to SEQ ID NO: 5576
  Dockerin_dom_fun

SEQ ID NO: 8244 - protein, 40 aa, Anaeromyces robustus; identical to SEQ ID NO: 5578
  Dockerin_dom_fun

SEQ ID NO: 8245 - protein, 39 aa, Anaeromyces robustus; identical to SEQ ID NO: 5580
  Dockerin_dom_fun

SEQ ID NO: 8246 - protein, 39 aa, Anaeromyces robustus; identical to SEQ ID NO: 5579
  Dockerin_dom_fun

SEQ ID NO: 8247 - protein, 34 aa, Anaeromyces robustus
  Dockerin_dom_fun
AITSQGYKCCSKDCFIVFTDDDGTWGIENDQWCG

SEQ ID NO: 8248 - protein, 21 aa, Anaeromyces robustus
  Dockerin_dom_fun
IVFTDDDGTWGIENDQWCGCD

SEQ ID NO: 8249 - protein, 38 aa, Anaeromyces robustus; identical to SEQ ID NO: 5583
  Dockerin_dom_fun

SEQ ID NO: 8250 - protein, 24 aa, Anaeromyces robustus
  Dockerin_dom_fun
CFSINFGFPCCSSCVYYYEDDDGK

SEQ ID NO: 8251 - protein, 39 aa, Anaeromyces robustus; identical to SEQ ID NO: 5584
  Dockerin_dom_fun

SEQ ID NO: 8252 - protein, 39 aa, Anaeromyces robustus; identical to SEQ ID NO: 5586
  Dockerin_dom_fun

SEQ ID NO: 8253 - protein, 39 aa, Anaeromyces robustus
  Dockerin_dom_fun
ECFSVKLGYPCCTKTNEVIYTDEQGQWGVEDYHWCGIDN

SEQ ID NO: 8254 - protein, 43 aa, Anaeromyces robustus
  Dockerin_dom_fun
ECWSLKLQPAYPCCYMRNKEVVSIDSNGKWSTEHGTWCGIIEE

SEQ ID NO: 8255 - protein, 24 aa, Anaeromyces robustus
  Dockerin_dom_fun
TCWSTRLGYPCCEDSNVVYAVDEN

SEQ ID NO: 8256 - protein, 39 aa, Anaeromyces robustus; identical to SEQ ID NO: 5589
  Dockerin_dom_fun

SEQ ID NO: 8257 - protein, 40 aa, Anaeromyces robustus; identical to SEQ ID NO: 5591
  Dockerin_dom_fun

SEQ ID NO: 8258 - protein, 35 aa, Anaeromyces robustus; identical to SEQ ID NO: 2465
  Dockerin_dom_fun

SEQ ID NO: 8259 - protein, 22 aa, Anaeromyces robustus
  Dockerin_dom_fun
CNVYYTDNDGEWGVENGNWCGI

SEQ ID NO: 8260 - protein, 12 aa, Anaeromyces robustus
  Dockerin_dom_fun
CWATKLGYKCCT

SEQ ID NO: 8261 - protein, 41 aa, Anaeromyces robustus
  Dockerin_dom_fun
SCWATKLGYKCCTAKCPEVSYVDQDGAWGIENGNWCGIIES

SEQ ID NO: 8262 - protein, 34 aa, Anaeromyces robustus; identical to SEQ ID NO: 5595
  Dockerin_dom_fun

SEQ ID NO: 8263 - protein, 36 aa, Anaeromyces robustus
  Dockerin_dom_fun
ANAYNNCTHTCRVLVTEDGVEWGAENNDWCIIDQSL

SEQ ID NO: 8264 - protein, 31 aa, Anaeromyces robustus
  Dockerin_dom_fun
YLCCNECNVVLEDEEGKWGYENNRWCGIKDT

SEQ ID NO: 8265 - protein, 36 aa, Anaeromyces robustus; identical to SEQ ID NO: 8263
  Dockerin_dom_fun

SEQ ID NO: 8266 - protein, 31 aa, Anaeromyces robustus; identical to SEQ ID NO: 8264
  Dockerin_dom_fun

SEQ ID NO: 8267 - protein, 35 aa, Anaeromyces robustus; identical to SEQ ID NO: 3069
  Dockerin_dom_fun

SEQ ID NO: 8268 - protein, 35 aa, Anaeromyces robustus
  Dockerin_dom_fun
KFLYNCCKNTCKLVAIQDKIQLGIENGEYCSIPYS

SEQ ID NO: 8269 - protein, 22 aa, Anaeromyces robustus
  Dockerin_dom_fun
ECFSVKLGYPCCTKTNEVIYTD

SEQ ID NO: 8270 - protein, 41 aa, Anaeromyces robustus
  Dockerin_dom_fun
CIGEVAGYPCCSEGVNKVYEHDINGEWGYDFSKKQWCSLTP

SEQ ID NO: 8271 - protein, 37 aa, Anaeromyces robustus; identical to SEQ ID NO: 5603
  Dockerin_dom_fun

SEQ ID NO: 8272 - protein, 32 aa, Anaeromyces robustus
  Dockerin_dom_fun
YPCCTSTKTVMYTDEKGPWGIENGNWCGIKDS

SEQ ID NO: 8273 - protein, 23 aa, Anaeromyces robustus
  Dockerin_dom_fun
TVIFTDSNGQWGIENGNWCGKPN

SEQ ID NO: 8274 - protein, 31 aa, Anaeromyces robustus; identical to SEQ ID NO: 5606
  Dockerin_dom_fun

SEQ ID NO: 8275 - protein, 35 aa, Anaeromyces robustus; identical to SEQ ID NO: 2465
  Dockerin_dom_fun

SEQ ID NO: 8276 - protein, 15 aa, Anaeromyces robustus
  Dockerin_dom_fun
DWGVEDGQWCGITKN

SEQ ID NO: 8277 - protein, 30 aa, Anaeromyces robustus; identical to SEQ ID NO: 3077
  Dockerin_dom_fun

SEQ ID NO: 8278 - protein, 32 aa, Anaeromyces robustus
  Dockerin_dom_fun
AITSQGYKCCKEDNCSVFETDDDGTWGIENDQ

SEQ ID NO: 8279 - protein, 27 aa, Anaeromyces robustus
  Dockerin_dom_fun
QAVIYHDNDGDWGVENNQWCLIKSSKC

SEQ ID NO: 8280 - protein, 32 aa, Piromyces finnis
  Dockerin_dom_fun
CWAEALGYKCCSAGNYMVLLTDESGAWGAENG

SEQ ID NO: 8281 - protein, 27 aa, Piromyces finnis
  Dockerin_dom_fun
CFAENLGYQCCSDPETIVITTDEYGEW

SEQ ID NO: 8282 - protein, 36 aa, Piromyces finnis; identical to SEQ ID NO: 5615
  Dockerin_dom_fun

SEQ ID NO: 8283 - protein, 30 aa, Piromyces finnis
  Dockerin_dom_fun
NCCTKTDTHVSFIDDEKSLWGIESGSWCKI

SEQ ID NO: 8284 - protein, 39 aa, Piromyces finnis; identical to SEQ ID NO: 5616
  Dockerin_dom_fun

SEQ ID NO: 8285 - protein, 39 aa, Piromyces finnis
  Dockerin_dom_fun
RCSFEVLGYHCCSSINPKVVKEDSYGKWGEEDGELCGIG

SEQ ID NO: 8286 - protein, 30 aa, Piromyces finnis; identical to SEQ ID NO: 3084
  Dockerin_dom_fun

SEQ ID NO: 8287 - protein, 38 aa, Piromyces finnis
  Dockerin_dom_fun
SCWSEPEYPCCKESCTVYYVDDHQWGIENGEWCGIPDS

SEQ ID NO: 8288 - protein, 39 aa, Piromyces finnis
  Dockerin_dom_fun
ETKQGFPICKECIITATGSDGISLWGWENSESCRIDNDI

SEQ ID NO: 8289 - protein, 41 aa, Piromyces finnis
  Dockerin_dom_fun
SCWSEELGYSCCSHCTVLLKDESGLWGAEDGKWCGIPNESC

SEQ ID NO: 8290 - protein, 40 aa, Piromyces finnis; identical to SEQ ID NO: 5621
  Dockerin_dom_fun

SEQ ID NO: 8291 - protein, 41 aa, Piromyces finnis
  Dockerin_dom_fun
CSSGVKAQGYPCCKSCGQVVYVDEDGKWGVENNDWCGIPTN

SEQ ID NO: 8292 - protein, 16 aa, Piromyces finnis
  Dockerin_dom_fun
SGNWGVENNKWCGCGN

SEQ ID NO: 8293 - protein, 38 aa, Piromyces finnis
  Dockerin_dom_fun
CSEKIINQGYPCCSKETQVYYTDESGEWGVENNNWCGI

SEQ ID NO: 8294 - protein, 40 aa, Piromyces finnis; identical to SEQ ID NO: 5624
  Dockerin_dom_fun

SEQ ID NO: 8295 - protein, 24 aa, Piromyces finnis
  Dockerin_dom_fun
YKCCKKCNIYVNELGQDWGIENND

SEQ ID NO: 8296 - protein, 38 aa, Piromyces finnis
  Dockerin_dom_fun
YGYPCCENKNTVVEINDSEYNLQFGIENGKLCGISSIQ

SEQ ID NO: 8297 - protein, 37 aa, Piromyces finnis; identical to SEQ ID NO: 5628
  Dockerin_dom_fun

SEQ ID NO: 8298 - protein, 33 aa, Piromyces finnis
  Dockerin_dom_fun
EGYDCCEGCTIETEEDGIKWGYENRNWCVIPYT

SEQ ID NO: 8299 - protein, 35 aa, Piromyces finnis; identical to SEQ ID NO: 5627
  Dockerin_dom_fun

SEQ ID NO: 8300 - protein, 36 aa, Piromyces finnis; identical to SEQ ID NO: 5630
  Dockerin_dom_fun

SEQ ID NO: 8301 - protein, 35 aa, Piromyces finnis; identical to SEQ ID NO: 3098
  Dockerin_dom_fun

SEQ ID NO: 8302 - protein, 39 aa, Piromyces finnis; identical to SEQ ID NO: 5632
  Dockerin_dom_fun

SEQ ID NO: 8303 - protein, 39 aa, Piromyces finnis; identical to SEQ ID NO: 5634
  Dockerin_dom_fun

SEQ ID NO: 8304 - protein, 37 aa, Piromyces finnis
  Dockerin_dom_fun
YIDQGYGCCLNDNGKREIINMDGEWGLENDNWCGFRN

SEQ ID NO: 8305 - protein, 39 aa, Piromyces finnis
  Dockerin_dom_fun
ECAKNKNNLPCCSTCEIALIDGSGRYGYENGQWCNIPFN

SEQ ID NO: 8306 - protein, 40 aa, Piromyces finnis
  Dockerin_dom_fun
CWSRAIGFVCCDKCNVLFVDEQGKWSVEDGYWCGINPSKC

SEQ ID NO: 8307 - protein, 33 aa, Piromyces finnis
  Dockerin_dom_fun
NKCFSENLGYSCCEECNVVYTDNDGKWGYENNE

SEQ ID NO: 8308 - protein, 41 aa, Piromyces finnis
  Dockerin_dom_fun
KCFSEVLGYPCCNECSIIYSDADGDWGYENGMWCGINTSQC

SEQ ID NO: 8309 - protein, 39 aa, Piromyces finnis
  Dockerin_dom_fun
ECWSEKFGIPCCKEALMPLRTTYDGGWSQENGEWCGLGE

SEQ ID NO: 8310 - protein, 33 aa, Piromyces finnis
  Dockerin_dom_fun
YACCKGCDVVSVTSNGNSKWGVENKKWCSIPYS

SEQ ID NO: 8311 - protein, 41 aa, Piromyces finnis
  Dockerin_dom_fun
ECWAKAQGYNCCEKRTTAVTYVDKKTGEEWGYEGGKWCGIT

SEQ ID NO: 8312 - protein, 34 aa, Piromyces finnis
  Dockerin_dom_fun
SYSCCIFDDTLIITSDSTGNWGFEGDRWCLIKNN

SEQ ID NO: 8313 - protein, 39 aa, Piromyces finnis; identical to SEQ ID NO: 5643
  Dockerin_dom_fun

SEQ ID NO: 8314 - protein, 39 aa, Piromyces finnis; identical to SEQ ID NO: 5644
  Dockerin_dom_fun

SEQ ID NO: 8315 - protein, 32 aa, Piromyces finnis; identical to SEQ ID NO: 5645
  Dockerin_dom_fun

SEQ ID NO: 8316 - protein, 31 aa, Piromyces finnis
  Dockerin_dom_fun
YMCCEGCEVVEETAEGKWGIEKNNWCGIKDS

SEQ ID NO: 8317 - protein, 39 aa, Piromyces finnis; identical to SEQ ID NO: 5647
  Dockerin_dom_fun

SEQ ID NO: 8318 - protein, 42 aa, Piromyces finnis; identical to SEQ ID NO: 5648
  Dockerin_dom_fun

SEQ ID NO: 8319 - protein, 42 aa, Piromyces finnis
  Dockerin_dom_fun
CWSEELGYRCCNNGESIVEYIDESGWWGVTKDTKEWCGIIKN

SEQ ID NO: 8320 - protein, 24 aa, Piromyces finnis
  Dockerin_dom_fun
SCWSLALGYSCCKSCIGTVYTDES

SEQ ID NO: 8321 - protein, 20 aa, Piromyces finnis
  Dockerin_dom_fun
TDESGNWGIEKDDWCGIPKS

SEQ ID NO: 8322 - protein, 39 aa, Piromyces finnis; identical to SEQ ID NO: 5650
  Dockerin_dom_fun

SEQ ID NO: 8323 - protein, 31 aa, Piromyces finnis
  Dockerin_dom_fun
YSCCEGCEVIEETEEGKWGIENYAWCGIKDS

SEQ ID NO: 8324 - protein, 30 aa, Piromyces finnis
  Dockerin_dom_fun
PASITKQGYKCCKAGCEVIYTDADGDWGVE

SEQ ID NO: 8325 - protein, 28 aa, Piromyces finnis
  Dockerin_dom_fun
ACWADAIGYPCCKGCDVITTDDDGDWGV

SEQ ID NO: 8326 - protein, 33 aa, Piromyces finnis
  Dockerin_dom_fun
YDVCEGCEVLVTDLEGKWGAQDGKWCHIDEVKC

SEQ ID NO: 8327 - protein, 33 aa, Piromyces finnis
  Dockerin_dom_fun
YECCTGCKPIVADDEGRWGAQNGEWCLIDEERC

SEQ ID NO: 8328 - protein, 33 aa, Piromyces finnis; identical to SEQ ID NO: 5657
  Dockerin_dom_fun

SEQ ID NO: 8329 - protein, 34 aa, Piromyces finnis
  Dockerin_dom_fun
AAYPKCSDCIVFATGKDGSLWGWENESFCRISKK

SEQ ID NO: 8330 - protein, 34 aa, Piromyces finnis; identical to SEQ ID NO: 8329
  Dockerin_dom_fun

SEQ ID NO: 8331 - protein, 37 aa, Piromyces finnis
  Dockerin_dom_fun
EEKKLGYPCCKYCTIIESDSYGDYGVENNAWCSISYA

SEQ ID NO: 8332 - protein, 38 aa, Piromyces finnis
  Dockerin_dom_fun
CSCWSESLGYPCCHHQDIIYTDESGPWGLENNQWCGIQ

SEQ ID NO: 8333 - protein, 29 aa, Piromyces finnis
  Dockerin_dom_fun
GYPCCKTNKTVVFTDEYGKWSVENNDWCL

SEQ ID NO: 8334 - protein, 38 aa, Piromyces finnis
  Dockerin_dom_fun
CSSKITQQGYKCCSKNCVVYYTDSDGNWGYENDWCGCA

SEQ ID NO: 8335 - protein, 38 aa, Piromyces finnis; identical to SEQ ID NO: 8334
  Dockerin_dom_fun

SEQ ID NO: 8336 - protein, 29 aa, Piromyces finnis
  Dockerin_dom_fun
GYPCCKTNKTVVFTDEYGKWSVENNDWCL

SEQ ID NO: 8337 - protein, 26 aa, Piromyces finnis
  Dockerin_dom_fun
DYTYPYCKTTSDVVYTDTMEWGVENN

SEQ ID NO: 8338 - protein, 39 aa, Piromyces finnis; identical to SEQ ID NO: 5664
  Dockerin_dom_fun

SEQ ID NO: 8339 - protein, 40 aa, Piromyces finnis; identical to SEQ ID NO: 5665
  Dockerin_dom_fun

SEQ ID NO: 8340 - protein, 40 aa, Piromyces finnis; identical to SEQ ID NO: 5665
  Dockerin_dom_fun

SEQ ID NO: 8341 - protein, 39 aa, Piromyces finnis; identical to SEQ ID NO: 5664
  Dockerin_dom_fun

SEQ ID NO: 8342 - protein, 39 aa, Piromyces finnis
  Dockerin_dom_fun
GCWSLKEGYNCCIGCAVYAITDEGSWGVENGKWCGIPSY

SEQ ID NO: 8343 - protein, 41 aa, Piromyces finnis; identical to SEQ ID NO: 5668
  Dockerin_dom_fun

SEQ ID NO: 8344 - protein, 42 aa, Piromyces finnis
  Dockerin_dom_fun
KCWSLSQGYPCCDPDAETIYSDESGDWGLALNSNNELDWCGI

SEQ ID NO: 8345 - protein, 45 aa, Piromyces finnis; identical to SEQ ID NO: 5671
  Dockerin_dom_fun

SEQ ID NO: 8346 - protein, 36 aa, Piromyces finnis; identical to SEQ ID NO: 5672
  Dockerin_dom_fun

SEQ ID NO: 8347 - protein, 31 aa, Piromyces finnis; identical to SEQ ID NO: 3149
  Dockerin_dom_fun

SEQ ID NO: 8348 - protein, 23 aa, Piromyces finnis
  Dockerin_dom_fun
SCFSEALGYECCKGCTVITTDES

SEQ ID NO: 8349 - protein, 37 aa, Piromyces finnis
  Dockerin_dom_fun
SCFATKLGYPCCKNNQIVYTDSDGDWGFENNEWCGIG

SEQ ID NO: 8350 - protein, 37 aa, Piromyces finnis; identical to SEQ ID NO: 8349
  Dockerin_dom_fun

SEQ ID NO: 8351 - protein, 37 aa, Piromyces finnis; identical to SEQ ID NO: 8349
  Dockerin_dom_fun

SEQ ID NO: 8352 - protein, 39 aa, Piromyces finnis; identical to SEQ ID NO: 5678
  Dockerin_dom_fun

SEQ ID NO: 8353 - protein, 38 aa, Piromyces finnis; identical to SEQ ID NO: 5679
  Dockerin_dom_fun

SEQ ID NO: 8354 - protein, 34 aa, Piromyces finnis; identical to SEQ ID NO: 3157
  Dockerin_dom_fun

SEQ ID NO: 8355 - protein, 35 aa, Piromyces finnis; identical to SEQ ID NO: 3158
  Dockerin_dom_fun

SEQ ID NO: 8356 - protein, 37 aa, Piromyces finnis
  Dockerin_dom_fun
VCWSEALGYKCCSSGCNSIVIFTDENGSWSAENNEWC

SEQ ID NO: 8357 - protein, 23 aa, Piromyces finnis
  Dockerin_dom_fun
DVIRLGYLCCSLPCTVIYTDDDG

SEQ ID NO: 8358 - protein, 17 aa, Piromyces finnis
  Dockerin_dom_fun
TDDDGDWAFQNNEWCGC

SEQ ID NO: 8359 - protein, 26 aa, Piromyces finnis
  Dockerin_dom_fun
KCWSTEFGFPCCKGNTIVFTDENGDW

SEQ ID NO: 8360 - protein, 39 aa, Piromyces finnis
  Dockerin_dom_fun
ECFSINLGYPCCSTCTLYFENSIGRWGIENNEWCGLKSS

SEQ ID NO: 8361 - protein, 39 aa, Piromyces finnis
  Dockerin_dom_fun
SCWAEEQGYQCCSDCDVIYEDNNGLWGIENGTWCGINST

SEQ ID NO: 8362 - protein, 20 aa, Piromyces finnis
  Dockerin_dom_fun
YACCSGCESVYVDNDGKWGV

SEQ ID NO: 8363 - protein, 37 aa, Piromyces finnis; identical to SEQ ID NO: 5687
  Dockerin_dom_fun

SEQ ID NO: 8364 - protein, 32 aa, Piromyces finnis; identical to SEQ ID NO: 3167
  Dockerin_dom_fun

SEQ ID NO: 8365 - protein, 39 aa, Piromyces finnis
  Dockerin_dom_fun
KCWSELLGSPCCPPKVTIVYSHDEYGDWGYDFKRKEWCG

SEQ ID NO: 8366 - protein, 38 aa, Piromyces finnis
  Dockerin_dom_fun
CQTNIVELGYKCCSSFIKIDHTDKIGTWGYENGELCGI

SEQ ID NO: 8367 - protein, 31 aa, Piromyces finnis
  Dockerin_dom_fun
YLCCDGCNVVEETAEGKWGVENNKWCGIPSN

SEQ ID NO: 8368 - protein, 25 aa, Piromyces finnis
  Dockerin_dom_fun
CGVVLEEDGIKWGVENNDWCIIPSK

SEQ ID NO: 8369 - protein, 41 aa, Piromyces finnis
  Dockerin_dom_fun
QCWSENIGYPCCQNKDTKVTYHSKSLNKDYGTENGEWCGIN

SEQ ID NO: 8370 - protein, 30 aa, Piromyces finnis
  Dockerin_dom_fun
SYNCCKIPANVDTVDDVGYWAIQNGQWCFI

SEQ ID NO: 8371 - protein, 28 aa, Piromyces finnis
  Dockerin_dom_fun
YKCCETCKVSYTDSTKWGVEHGKWCSIP

SEQ ID NO: 8372 - protein, 28 aa, Piromyces finnis
  Dockerin_dom_fun
SSGYDCCLSTKAIVTSDVVGDWGIENND

SEQ ID NO: 8373 - protein, 30 aa, Piromyces finnis; identical to SEQ ID NO: 5698
  Dockerin_dom_fun

SEQ ID NO: 8374 - protein, 43 aa, Piromyces finnis
  Dockerin_dom_fun
ECWSLSYGTGYPCCKDKNTKVNYVSKSTGKEWGVENGNWCGIT

SEQ ID NO: 8375 - protein, 32 aa, Piromyces finnis; identical to SEQ ID NO: 3178
  Dockerin_dom_fun

SEQ ID NO: 8376 - protein, 40 aa, Piromyces finnis
  Dockerin_dom_fun
NTCWSSSLGYPCCTNTNEVIYEDSDGKWGIENNNWCGIIN

SEQ ID NO: 8377 - protein, 40 aa, Piromyces finnis; identical to SEQ ID NO: 5701
  Dockerin_dom_fun

SEQ ID NO: 8378 - protein, 29 aa, Piromyces finnis
  Dockerin_dom_fun
DCVALYLGYPCCSPDNTYVVYQDESGDWG

SEQ ID NO: 8379 - protein, 29 aa, Piromyces finnis
  Dockerin_dom_fun
TCFSIKFGYNCCNECNVYYTDNDGKWGVE

SEQ ID NO: 8380 - protein, 44 aa, Piromyces finnis; identical to SEQ ID NO: 5705
  Dockerin_dom_fun

SEQ ID NO: 8381 - protein, 42 aa, Piromyces finnis
  Dockerin_dom_fun
CWSENLPDPYPCCSSDQVQRIDSTYDGDWGKENGKKCGIVYE

SEQ ID NO: 8382 - protein, 39 aa, Piromyces finnis; identical to SEQ ID NO: 5707
  Dockerin_dom_fun

SEQ ID NO: 8383 - protein, 24 aa, Piromyces finnis
  Dockerin_dom_fun
YPCCQPGAEVVYVDETGNWGVENG

SEQ ID NO: 8384 - protein, 39 aa, Piromyces finnis
  Dockerin_dom_fun
SCFSVALGYPCCSGNNVVYSDSDGKWGFENNSWCGIAEK

SEQ ID NO: 8385 - protein, 30 aa, Piromyces finnis; identical to SEQ ID NO: 5709
  Dockerin_dom_fun

SEQ ID NO: 8386 - protein, 39 aa, Piromyces finnis
  Dockerin_dom_fun
QSCFSIKLGYPCCNSNIVYYVDNDGQWGFENNNWCGIIS

SEQ ID NO: 8387 - protein, 39 aa, Piromyces finnis; identical to SEQ ID NO: 5712
  Dockerin_dom_fun

SEQ ID NO: 8388 - protein, 31 aa, Piromyces finnis
  Dockerin_dom_fun
YPCCQGCIVVTTDKNGRWGVENNAWCSISYS

SEQ ID NO: 8389 - protein, 39 aa, Piromyces finnis; identical to SEQ ID NO: 5714
  Dockerin_dom_fun

SEQ ID NO: 8390 - protein, 29 aa, Piromyces finnis
  Dockerin_dom_fun
YSCCSSCIDIVEQDDDSSWGIENGQWCSI

SEQ ID NO: 8391 - protein, 39 aa, Piromyces finnis; identical to SEQ ID NO: 5715
  Dockerin_dom_fun

SEQ ID NO: 8392 - protein, 30 aa, Piromyces finnis
  Dockerin_dom_fun
TFDCCPDGTEVAYVDEYGEWGIINGEWCGF

SEQ ID NO: 8393 - protein, 38 aa, Piromyces finnis
  Dockerin_dom_fun
NSCFSMALGFSCCEGNKIVYTDDDGDWGYENGEWCGII

SEQ ID NO: 8394 - protein, 41 aa, Piromyces finnis
  Dockerin_dom_fun
NECFSTKLGYKCCSSCTDVIYIDNDGQWGLENDNWCGIADK

SEQ ID NO: 8395 - protein, 32 aa, Piromyces finnis; identical to SEQ ID NO: 5718
  Dockerin_dom_fun

SEQ ID NO: 8396 - protein, 31 aa, Piromyces finnis; identical to SEQ ID NO: 5721
  Dockerin_dom_fun

SEQ ID NO: 8397 - protein, 36 aa, Piromyces finnis; identical to SEQ ID NO: 3200
  Dockerin_dom_fun

SEQ ID NO: 8398 - protein, 30 aa, Piromyces finnis
  Dockerin_dom_fun
GYECCFDNEVVYEDESGKWGINEKGEWCGV

SEQ ID NO: 8399 - protein, 28 aa, Piromyces finnis
  Dockerin_dom_fun
YPCCQNTNFSYYTDSAGNEWGIENNNWC

SEQ ID NO: 8400 - protein, 39 aa, Piromyces finnis; identical to SEQ ID NO: 5725
  Dockerin_dom_fun

SEQ ID NO: 8401 - protein, 30 aa, Piromyces finnis; identical to SEQ ID NO: 5726
  Dockerin_dom_fun

SEQ ID NO: 8402 - protein, 39 aa, Piromyces finnis; identical to SEQ ID NO: 5730
  Dockerin_dom_fun

SEQ ID NO: 8403 - protein, 36 aa, Piromyces finnis; identical to SEQ ID NO: 5727
  Dockerin_dom_fun

SEQ ID NO: 8404 - protein, 43 aa, Piromyces finnis; identical to SEQ ID NO: 5728
  Dockerin_dom_fun

SEQ ID NO: 8405 - protein, 35 aa, Piromyces finnis
  Dockerin_dom_fun
DGYPCCSSVNPEVQYTDDNGNKWGVEDGEWCGIGE

SEQ ID NO: 8406 - protein, 36 aa, Piromyces finnis; identical to SEQ ID NO: 5727
  Dockerin_dom_fun

SEQ ID NO: 8407 - protein, 43 aa, Piromyces finnis; identical to SEQ ID NO: 5728
  Dockerin_dom_fun

SEQ ID NO: 8408 - protein, 39 aa, Piromyces finnis; identical to SEQ ID NO: 5730
  Dockerin_dom_fun

SEQ ID NO: 8409 - protein, 35 aa, Piromyces finnis; identical to SEQ ID NO: 8405
  Dockerin_dom_fun

SEQ ID NO: 8410 - protein, 35 aa, Piromyces finnis; identical to SEQ ID NO: 5735
  Dockerin_dom_fun

SEQ ID NO: 8411 - protein, 37 aa, Piromyces finnis; identical to SEQ ID NO: 5736
  Dockerin_dom_fun

SEQ ID NO: 8412 - protein, 35 aa, Piromyces finnis; identical to SEQ ID NO: 5735
  Dockerin_dom_fun

SEQ ID NO: 8413 - protein, 37 aa, Piromyces finnis; identical to SEQ ID NO: 5736
  Dockerin_dom_fun

SEQ ID NO: 8414 - protein, 42 aa, Piromyces finnis
  Dockerin_dom_fun
CSQTILDQGYSCCSYNCKVVHEENKGESKYYWGVEKDNWCGC

SEQ ID NO: 8415 - protein, 39 aa, Piromyces finnis; identical to SEQ ID NO: 5740
  Dockerin_dom_fun

SEQ ID NO: 8416 - protein, 29 aa, Piromyces finnis
  Dockerin_dom_fun
SKFILERGYKCCSDNCEVTHSDENGDWGY

SEQ ID NO: 8417 - protein, 29 aa, Piromyces finnis
  Dockerin_dom_fun
DCWSDVLGYSCCSKCLEAVYEDQDGKWGV

SEQ ID NO: 8418 - protein, 34 aa, Piromyces finnis
  Dockerin_dom_fun
GGLDYECCSSLNVKLQSIDADAKWGFENGKWCII

SEQ ID NO: 8419 - protein, 40 aa, Piromyces finnis; identical to SEQ ID NO: 5744
  Dockerin_dom_fun

SEQ ID NO: 8420 - protein, 32 aa, Piromyces finnis
  Dockerin_dom_fun
NYPCCVKTEKGTYSDGDGDWAQENGDWCTIRH

SEQ ID NO: 8421 - protein, 30 aa, Piromyces finnis; identical to SEQ ID NO: 3223
  Dockerin_dom_fun

SEQ ID NO: 8422 - protein, 18 aa, Piromyces finnis
  Dockerin_dom_fun
DGKWSVENGDWCLIDESK

SEQ ID NO: 8423 - protein, 33 aa, Piromyces finnis
  Dockerin_dom_fun
SYPCCNGCDVTYVDNEGEWGVQNNNWCFIDSGK

SEQ ID NO: 8424 - protein, 29 aa, Piromyces finnis
  Dockerin_dom_fun
SCKFEALGYSCCSNCGPVYFTDSDGKWGV

SEQ ID NO: 8425 - protein, 30 aa, Piromyces finnis; identical to SEQ ID NO: 5750
  Dockerin_dom_fun

SEQ ID NO: 8426 - protein, 38 aa, Piromyces finnis; identical to SEQ ID NO: 5751
  Dockerin_dom_fun

SEQ ID NO: 8427 - protein, 40 aa, Piromyces finnis; identical to SEQ ID NO: 5753
  Dockerin_dom_fun

SEQ ID NO: 8428 - protein, 41 aa, Piromyces finnis
  Dockerin_dom_fun
KCWSEDFGYPCCKGCIVYEEDEHGQWGYDFTEATWCGIQSF

SEQ ID NO: 8429 - protein, 30 aa, Piromyces finnis
  Dockerin_dom_fun
YECCNGCDVVYTDAEGKWGVENNNWCIINK

SEQ ID NO: 8430 - protein, 31 aa, Piromyces finnis
  Dockerin_dom_fun
YPWCNGCKVYYTDAEGNWGVENNDWCLIKSS

SEQ ID NO: 8431 - protein, 31 aa, Piromyces finnis; identical to SEQ ID NO: 8430
  Dockerin_dom_fun

SEQ ID NO: 8432 - protein, 30 aa, Piromyces finnis; identical to SEQ ID NO: 8429
  Dockerin_dom_fun

SEQ ID NO: 8433 - protein, 28 aa, Piromyces finnis
  Dockerin_dom_fun
SCWSLPDYPCCSTCDVVYTDDHNWGVEN

SEQ ID NO: 8434 - protein, 32 aa, Piromyces finnis
  Dockerin_dom_fun
KQSGFPCCLDLNGGIISVDGAGEWNIEGSIWC

SEQ ID NO: 8435 - protein, 34 aa, Piromyces finnis; identical to SEQ ID NO: 3236
  Dockerin_dom_fun

SEQ ID NO: 8436 - protein, 39 aa, Piromyces finnis
  Dockerin_dom_fun
ECPGIKYGYECCEKCDVVETDELGQWGAINGEWCSIKKS

SEQ ID NO: 8437 - protein, 38 aa, Piromyces finnis
  Dockerin_dom_fun
NSCWSQGLGFQCCSGCNVEYVDSDGEWGLENGEWCGIP

SEQ ID NO: 8438 - protein, 39 aa, Piromyces finnis; identical to SEQ ID NO: 5761
  Dockerin_dom_fun

SEQ ID NO: 8439 - protein, 39 aa, Piromyces finnis; identical to SEQ ID NO: 5761
  Dockerin_dom_fun

SEQ ID NO: 8440 - protein, 38 aa, Piromyces finnis; identical to SEQ ID NO: 8437
  Dockerin_dom_fun

SEQ ID NO: 8441 - protein, 37 aa, Piromyces finnis; identical to SEQ ID NO: 3242
  Dockerin_dom_fun

SEQ ID NO: 8442 - protein, 39 aa, Piromyces finnis; identical to SEQ ID NO: 5766
  Dockerin_dom_fun

SEQ ID NO: 8443 - protein, 31 aa, Piromyces finnis
  Dockerin_dom_fun
NSCWSEKLGYRCCKSSYPVYYTDADGQWGIE

SEQ ID NO: 8444 - protein, 40 aa, Piromyces finnis
  Dockerin_dom_fun
DCWSTNLGFPCCQLKTTKVQYGDNTNSQFGIENGQLCGIN

SEQ ID NO: 8445 - protein, 37 aa, Piromyces finnis; identical to SEQ ID NO: 5768
  Dockerin_dom_fun

SEQ ID NO: 8446 - protein, 37 aa, Piromyces finnis; identical to SEQ ID NO: 5770
  Dockerin_dom_fun

SEQ ID NO: 8447 - protein, 33 aa, Piromyces finnis
  Dockerin_dom_fun
NTGYPCCSDPKASIITNDISGDWGIEGNTWCLI

SEQ ID NO: 8448 - protein, 38 aa, Piromyces finnis
  Dockerin_dom_fun
CWSLERGYPCCETNTEVFYTSSNGKTWSIENNDWCGIN

SEQ ID NO: 8449 - protein, 20 aa, Piromyces finnis
  Dockerin_dom_fun
YPCCSGCDAIYEDDDGKWGV

SEQ ID NO: 8450 - protein, 34 aa, Piromyces finnis
  Dockerin_dom_fun
AYSDCKNCRVVTVEDGVSWGVENNDWCVIKSSIC

SEQ ID NO: 8451 - protein, 41 aa, Piromyces finnis; identical to SEQ ID NO: 5775
  Dockerin_dom_fun

SEQ ID NO: 8452 - protein, 13 aa, Piromyces finnis
  Dockerin_dom_fun
KWGIENGQWCGIV

SEQ ID NO: 8453 - protein, 31 aa, Piromyces finnis; identical to SEQ ID NO: 3255
  Dockerin_dom_fun

SEQ ID NO: 8454 - protein, 41 aa, Piromyces finnis; identical to SEQ ID NO: 5777
  Dockerin_dom_fun

SEQ ID NO: 8455 - protein, 37 aa, Piromyces finnis; identical to SEQ ID NO: 5778
  Dockerin_dom_fun

SEQ ID NO: 8456 - protein, 38 aa, Piromyces finnis; identical to SEQ ID NO: 5779
  Dockerin_dom_fun

SEQ ID NO: 8457 - protein, 38 aa, Piromyces finnis
  Dockerin_dom_fun
DCWSLAEGYKCCSEGTPVVLTDSKGKWGIENNDWCGIV

SEQ ID NO: 8458 - protein, 32 aa, Piromyces finnis; identical to SEQ ID NO: 3260
  Dockerin_dom_fun

SEQ ID NO: 8459 - protein, 30 aa, Piromyces finnis; identical to SEQ ID NO: 3261
  Dockerin_dom_fun

SEQ ID NO: 8460 - protein, 31 aa, Piromyces finnis; identical to SEQ ID NO: 5784
  Dockerin_dom_fun

SEQ ID NO: 8461 - protein, 35 aa, Piromyces finnis; identical to SEQ ID NO: 5783
  Dockerin_dom_fun

SEQ ID NO: 8462 - protein, 27 aa, Piromyces finnis
  Dockerin_dom_fun
TCWSRPLGYECCETCSYIVLSDADGDW

SEQ ID NO: 8463 - protein, 36 aa, Piromyces finnis
  Dockerin_dom_fun
CFAKSDGYECCFDNEVVYEDESGKWGINEKGEWCGV

SEQ ID NO: 8464 - protein, 39 aa, Piromyces finnis
  Dockerin_dom_fun
CWAEALGYKCCSAGNYMVLLTDESGAWGAENGEWCGIVK

SEQ ID NO: 8465 - protein, 27 aa, Piromyces finnis
  Dockerin_dom_fun
TCWSRPLGYECCETCSYIVLSDADGDW

SEQ ID NO: 8466 - protein, 36 aa, Piromyces finnis; identical to SEQ ID NO: 8463
  Dockerin_dom_fun

SEQ ID NO: 8467 - protein, 39 aa, Piromyces finnis; identical to SEQ ID NO: 8464
  Dockerin_dom_fun

SEQ ID NO: 8468 - protein, 35 aa, Piromyces finnis
  Dockerin_dom_fun
QSCSFESIGYSCCKLNCDVIYTDESGDWSVENDEW

SEQ ID NO: 8469 - protein, 31 aa, Piromyces finnis
  Dockerin_dom_fun
YQCCADGTEVIYTDESGDWGVINDEWCGIKK

SEQ ID NO: 8470 - protein, 41 aa, Piromyces finnis
  Dockerin_dom_fun
DCFSTSMGYPCCSGCEDIYEDDDGKWGVENDDWCGIDEAKC

SEQ ID NO: 8471 - protein, 38 aa, Piromyces finnis
  Dockerin_dom_fun
SCWSLPDYPCCEGDTVIYSDESGDWGVENDEWCGIVKS

SEQ ID NO: 8472 - protein, 34 aa, Piromyces finnis; identical to SEQ ID NO: 3274
  Dockerin_dom_fun

SEQ ID NO: 8473 - protein, 39 aa, Piromyces finnis; identical to SEQ ID NO: 5796
  Dockerin_dom_fun

SEQ ID NO: 8474 - protein, 22 aa, Piromyces finnis
  Dockerin_dom_fun
EAIFTDGEKKWGVENGQWCGMP

SEQ ID NO: 8475 - protein, 26 aa, Piromyces finnis
  Dockerin_dom_fun
EAIFTDGEKKWGVENGQWCGIIESQC

SEQ ID NO: 8476 - protein, 34 aa, Piromyces finnis
  Dockerin_dom_fun
ALGYPCCQSTSSVVFTDNTGKWGIENNDWCEIKE

SEQ ID NO: 8477 - protein, 15 aa, Piromyces finnis
  Dockerin_dom_fun
DGKWGVENGQWCGMP

SEQ ID NO: 8478 - protein, 39 aa, Piromyces finnis; identical to SEQ ID NO: 5796
  Dockerin_dom_fun

SEQ ID NO: 8479 - protein, 33 aa, Piromyces finnis
  Dockerin_dom_fun
ADYPCCEQCNIVSEEEGDFWGVENNEWCSIKFK

SEQ ID NO: 8480 - protein, 38 aa, Piromyces finnis; identical to SEQ ID NO: 8287
  Dockerin_dom_fun

SEQ ID NO: 8481 - protein, 33 aa, Piromyces finnis; identical to SEQ ID NO: 8479
  Dockerin_dom_fun

SEQ ID NO: 8482 - protein, 38 aa, Piromyces finnis; identical to SEQ ID NO: 5804
  Dockerin_dom_fun

SEQ ID NO: 8483 - protein, 38 aa, Piromyces finnis; identical to SEQ ID NO: 8287
  Dockerin_dom_fun

SEQ ID NO: 8484 - protein, 41 aa, Piromyces finnis
  Dockerin_dom_fun
ECWSLKYGYECCSPNNTRVVVTDESGKWGVENSDWCGIVDS

SEQ ID NO: 8485 - protein, 38 aa, Piromyces finnis; identical to SEQ ID NO: 5804
  Dockerin_dom_fun

SEQ ID NO: 8486 - protein, 41 aa, Piromyces finnis
  Dockerin_dom_fun
KCWSIPFGYKCCDHCKVLLTDESGKWGELNGEWCGIDTTKC

SEQ ID NO: 8487 - protein, 41 aa, Piromyces finnis; identical to SEQ ID NO: 8486
  Dockerin_dom_fun

SEQ ID NO: 8488 - protein, 41 aa, Piromyces finnis; identical to SEQ ID NO: 8484
  Dockerin_dom_fun

SEQ ID NO: 8489 - protein, 38 aa, Piromyces finnis; identical to SEQ ID NO: 8287
  Dockerin_dom_fun

SEQ ID NO: 8490 - protein, 33 aa, Piromyces finnis; identical to SEQ ID NO: 8479
  Dockerin_dom_fun

SEQ ID NO: 8491 - protein, 33 aa, Piromyces finnis; identical to SEQ ID NO: 3292
  Dockerin_dom_fun

SEQ ID NO: 8492 - protein, 33 aa, Piromyces finnis; identical to SEQ ID NO: 3292
  Dockerin_dom_fun

SEQ ID NO: 8493 - protein, 40 aa, Piromyces finnis; identical to SEQ ID NO: 5815
  Dockerin_dom_fun

SEQ ID NO: 8494 - protein, 39 aa, Piromyces finnis
  Dockerin_dom_fun
SITSQGYSCCAGNNCSVVLTDESGRWGVENNQWCGISND

SEQ ID NO: 8495 - protein, 31 aa, Piromyces finnis
  Dockerin_dom_fun
YLCCDGCNVVEETAEGKWGIENNYWCGIKNS

SEQ ID NO: 8496 - protein, 32 aa, Piromyces finnis
  Dockerin_dom_fun
AYDYCNACGVVLEEDGVKWGVENNDWCIIPSK

SEQ ID NO: 8497 - protein, 39 aa, Piromyces finnis; identical to SEQ ID NO: 5820
  Dockerin_dom_fun

SEQ ID NO: 8498 - protein, 40 aa, Piromyces finnis; identical to SEQ ID NO: 5819
  Dockerin_dom_fun

SEQ ID NO: 8499 - protein, 41 aa, Piromyces finnis
  Dockerin_dom_fun
ECWSEELGYPCCKDCTVYETDESGEWGYDFKNMQWCGIQSY

SEQ ID NO: 8500 - protein, 40 aa, Piromyces finnis; identical to SEQ ID NO: 5821
  Dockerin_dom_fun

SEQ ID NO: 8501 - protein, 35 aa, Piromyces finnis; identical to SEQ ID NO: 3303
  Dockerin_dom_fun

SEQ ID NO: 8502 - protein, 35 aa, Piromyces finnis; identical to SEQ ID NO: 3303
  Dockerin_dom_fun

SEQ ID NO: 8503 - protein, 20 aa, Piromyces finnis
  Dockerin_dom_fun
AYPCCKGNTVVYTDNEGSWG

SEQ ID NO: 8504 - protein, 20 aa, Piromyces finnis
  Dockerin_dom_fun
AYPCCKGNTVVYTDNEGSWG

SEQ ID NO: 8505 - protein, 42 aa, Piromyces finnis; identical to SEQ ID NO: 5827
  Dockerin_dom_fun

SEQ ID NO: 8506 - protein, 42 aa, Piromyces finnis; identical to SEQ ID NO: 5828
  Dockerin_dom_fun

SEQ ID NO: 8507 - protein, 38 aa, Piromyces finnis; identical to SEQ ID NO: 5829
  Dockerin_dom_fun

SEQ ID NO: 8508 - protein, 42 aa, Piromyces finnis; identical to SEQ ID NO: 5828
  Dockerin_dom_fun

SEQ ID NO: 8509 - protein, 42 aa, Piromyces finnis; identical to SEQ ID NO: 5831
  Dockerin_dom_fun

SEQ ID NO: 8510 - protein, 39 aa, Piromyces finnis
  Dockerin_dom_fun
QCWSKPLGYDCCVDPYIQIAYSDDDGDWGYENDEWCGII

SEQ ID NO: 8511 - protein, 34 aa, Piromyces finnis
  Dockerin_dom_fun
GYPCCKRSCIVVEENASGKWSLEKHDWCLIDLEV

SEQ ID NO: 8512 - protein, 39 aa, Piromyces finnis; identical to SEQ ID NO: 5834
  Dockerin_dom_fun

SEQ ID NO: 8513 - protein, 42 aa, Piromyces finnis; identical to SEQ ID NO: 5828
  Dockerin_dom_fun

SEQ ID NO: 8514 - protein, 39 aa, Piromyces finnis
  Dockerin_dom_fun
ECWAEKLGYKCCPDDVCTTLHSDANGEWSIVNDEWCGII

SEQ ID NO: 8515 - protein, 29 aa, Piromyces finnis
  Dockerin_dom_fun
ECWSEVQGYPCCTQTTEVAYTDSDGDWGV

SEQ ID NO: 8516 - protein, 45 aa, Piromyces finnis
  Dockerin_dom_fun
ECWSLALSIPCCNKNKEIYSKDQDGNWGITTDENGNSIWCGIRKS

SEQ ID NO: 8517 - protein, 39 aa, Piromyces finnis; identical to SEQ ID NO: 5838
  Dockerin_dom_fun

SEQ ID NO: 8518 - protein, 39 aa, Piromyces finnis
  Dockerin_dom_fun
CWSRAGGYPCCEGGESIALIDQDGIWGQNANGNWCGFRE

SEQ ID NO: 8519 - protein, 41 aa, Piromyces finnis
  Dockerin_dom_fun
CWSEKLGYPCCPEEITQPNYKDSEGDWVFNSNGEWCGIRNG

SEQ ID NO: 8520 - protein, 40 aa, Piromyces finnis
  Dockerin_dom_fun
RCWSRAGGYPCCEGGESIALIDQDGIWGQNANGNWCGFRE

SEQ ID NO: 8521 - protein, 30 aa, Piromyces finnis
  Dockerin_dom_fun
NKCWASLLGYKCCVGTNPAVVFVDDDGKWG

SEQ ID NO: 8522 - protein, 39 aa, Piromyces finnis
  Dockerin_dom_fun
CWSEKLGYPCCPEEITQPNYKDSEGDWVFNSNGEWCGIR

SEQ ID NO: 8523 - protein, 36 aa, Piromyces finnis
  Dockerin_dom_fun
CWSLPHYQCCKGNVVVQSDSNGDWGYEDGQWCGIIK

SEQ ID NO: 8524 - protein, 38 aa, Piromyces finnis
  Dockerin_dom_fun
SCWSLPDYPCCKTTSLVVSSDAEGDWGYEDNQWCGIVK

SEQ ID NO: 8525 - protein, 40 aa, Piromyces finnis; identical to SEQ ID NO: 5846
  Dockerin_dom_fun

SEQ ID NO: 8526 - protein, 36 aa, Piromyces finnis; identical to SEQ ID NO: 8523
  Dockerin_dom_fun

SEQ ID NO: 8527 - protein, 38 aa, Piromyces finnis; identical to SEQ ID NO: 8524
  Dockerin_dom_fun

SEQ ID NO: 8528 - protein, 40 aa, Piromyces finnis; identical to SEQ ID NO: 5848
  Dockerin_dom_fun

SEQ ID NO: 8529 - protein, 36 aa, Piromyces finnis
  Dockerin_dom_fun
CWSLPHYQCCKGNEVVFTDHNGDWGFENNQWCGIVK

SEQ ID NO: 8530 - protein, 31 aa, Piromyces finnis
  Dockerin_dom_fun
YPCCKNTSLVVASDAQGDWGYEDNQWCGIVK

SEQ ID NO: 8531 - protein, 32 aa, Piromyces finnis
  Dockerin_dom_fun
YPCCPTCDVFLTEEDGNRWGVLYDNWCSIKNS

SEQ ID NO: 8532 - protein, 40 aa, Piromyces finnis; identical to SEQ ID NO: 5854
  Dockerin_dom_fun

SEQ ID NO: 8533 - protein, 36 aa, Piromyces finnis
  Dockerin_dom_fun
IKKQGYPCCSSCIVYFSDKDGQWGVENGKWCGIQDY

SEQ ID NO: 8534 - protein, 38 aa, Piromyces finnis
  Dockerin_dom_fun
DCFSTKLGYPCCTSTTQVVFTDNDGNWGVENNDWCGLT

SEQ ID NO: 8535 - protein, 38 aa, Piromyces finnis; identical to SEQ ID NO: 8534
  Dockerin_dom_fun

SEQ ID NO: 8536 - protein, 41 aa, Piromyces finnis; identical to SEQ ID NO: 5858
  Dockerin_dom_fun

SEQ ID NO: 8537 - protein, 22 aa, Piromyces finnis
  Dockerin_dom_fun
YPCCEDCVVVYEDNQKWGILNN

SEQ ID NO: 8538 - protein, 23 aa, Piromyces finnis
  Dockerin_dom_fun
YPCCEDCVVVYEDNQKWGILNND

SEQ ID NO: 8539 - protein, 41 aa, Piromyces finnis; identical to SEQ ID NO: 5859
  Dockerin_dom_fun

SEQ ID NO: 8540 - protein, 40 aa, Piromyces finnis
  Dockerin_dom_fun
DCAAASQGYPCCKNQNAEVYYQDETGDWGIENGEWCGITK

SEQ ID NO: 8541 - protein, 30 aa, Piromyces finnis
  Dockerin_dom_fun
YPCCEDCVVVYEDNQKWGILNNDWCSTPYS

SEQ ID NO: 8542 - protein, 33 aa, Piromyces finnis; identical to SEQ ID NO: 3345
  Dockerin_dom_fun

SEQ ID NO: 8543 - protein, 34 aa, Piromyces finnis; identical to SEQ ID NO: 3347
  Dockerin_dom_fun

SEQ ID NO: 8544 - protein, 39 aa, Piromyces finnis; identical to SEQ ID NO: 5865
  Dockerin_dom_fun

SEQ ID NO: 8545 - protein, 39 aa, Piromyces finnis; identical to SEQ ID NO: 5864
  Dockerin_dom_fun

SEQ ID NO: 8546 - protein, 39 aa, Piromyces finnis; identical to SEQ ID NO: 5866
  Dockerin_dom_fun

SEQ ID NO: 8547 - protein, 31 aa, Piromyces finnis
  Dockerin_dom_fun
YPCCDSCDVVFSDTLGDWGVQNDQWCGIKAS

SEQ ID NO: 8548 - protein, 40 aa, Piromyces finnis; identical to SEQ ID NO: 5867
  Dockerin_dom_fun

SEQ ID NO: 8549 - protein, 25 aa, Piromyces finnis
  Dockerin_dom_fun
DYPCCKSTCNVVDTDANGKWGVENG

SEQ ID NO: 8550 - protein, 33 aa, Piromyces finnis
  Dockerin_dom_fun
GNYPCCPEGTPIQYSDDEGDWGVYMDNWCGIVK

SEQ ID NO: 8551 - protein, 40 aa, Piromyces finnis; identical to SEQ ID NO: 5869
  Dockerin_dom_fun

SEQ ID NO: 8552 - protein, 40 aa, Piromyces finnis; identical to SEQ ID NO: 5869
  Dockerin_dom_fun

SEQ ID NO: 8553 - protein, 33 aa, Piromyces finnis; identical to SEQ ID NO: 8550
  Dockerin_dom_fun

SEQ ID NO: 8554 - protein, 37 aa, Piromyces finnis
  Dockerin_dom_fun
QCWSKRLGYECCKQKFEVVETDENGSWSIENNEWCGI

SEQ ID NO: 8555 - protein, 38 aa, Piromyces finnis; identical to SEQ ID NO: 5875
  Dockerin_dom_fun

SEQ ID NO: 8556 - protein, 38 aa, Piromyces finnis
  Dockerin_dom_fun
NCWSEPKYPCCSEGVKVYSKTSSGEWGIENGNWCGIPR

SEQ ID NO: 8557 - protein, 41 aa, Piromyces finnis
  Dockerin_dom_fun
DCWSLAISNYPCCSSFNTVVTYTDQDGNWGFENDDWCGMRD

SEQ ID NO: 8558 - protein, 41 aa, Piromyces finnis; identical to SEQ ID NO: 8557
  Dockerin_dom_fun

SEQ ID NO: 8559 - protein, 39 aa, Piromyces finnis
  Dockerin_dom_fun
NTCWASSLGYDCCEGCDIITTDEYGEWGIENGNWCGIPR

SEQ ID NO: 8560 - protein, 39 aa, Piromyces finnis
  Dockerin_dom_fun
PCWAKPLGYNCCHGETQVIYTDNDGQWGSEDGKWCGIIS

SEQ ID NO: 8561 - protein, 41 aa, Piromyces finnis; identical to SEQ ID NO: 8557
  Dockerin_dom_fun

SEQ ID NO: 8562 - protein, 39 aa, Piromyces finnis; identical to SEQ ID NO: 8560
  Dockerin_dom_fun

SEQ ID NO: 8563 - protein, 39 aa, Piromyces finnis; identical to SEQ ID NO: 8559
  Dockerin_dom_fun

SEQ ID NO: 8564 - protein, 38 aa, Piromyces finnis
  Dockerin_dom_fun
CPVESKGYKCCNDPNLQSMFEDEDGQWYYENDEWCLIV

SEQ ID NO: 8565 - protein, 39 aa, Piromyces finnis; identical to SEQ ID NO: 8560
  Dockerin_dom_fun

SEQ ID NO: 8566 - protein, 38 aa, Piromyces finnis; identical to SEQ ID NO: 8556
  Dockerin_dom_fun

SEQ ID NO: 8567 - protein, 41 aa, Piromyces finnis; identical to SEQ ID NO: 8557
  Dockerin_dom_fun

SEQ ID NO: 8568 - protein, 39 aa, Piromyces finnis; identical to SEQ ID NO: 8560
  Dockerin_dom_fun

SEQ ID NO: 8569 - protein, 38 aa, Piromyces finnis; identical to SEQ ID NO: 8556
  Dockerin_dom_fun

SEQ ID NO: 8570 - protein, 41 aa, Piromyces finnis; identical to SEQ ID NO: 8557
  Dockerin_dom_fun

SEQ ID NO: 8571 - protein, 38 aa, Piromyces finnis; identical to SEQ ID NO: 8564
  Dockerin_dom_fun

SEQ ID NO: 8572 - protein, 37 aa, Piromyces finnis; identical to SEQ ID NO: 5892
  Dockerin_dom_fun

SEQ ID NO: 8573 - protein, 35 aa, Piromyces finnis
  Dockerin_dom_fun
NTGYSCCSNPNAYVYTTDITGNWSIEGNYWCLIVK

SEQ ID NO: 8574 - protein, 24 aa, Piromyces finnis
  Dockerin_dom_fun
QYSTCKNTCSVEYEDDSKWGIENN

SEQ ID NO: 8575 - protein, 40 aa, Piromyces finnis; identical to SEQ ID NO: 5894
  Dockerin_dom_fun

SEQ ID NO: 8576 - protein, 30 aa, Piromyces finnis
  Dockerin_dom_fun
YKCCKKCKVVYTDNYLWGAEHNEWCSIPYS

SEQ ID NO: 8577 - protein, 32 aa, Piromyces finnis; identical to SEQ ID NO: 5896
  Dockerin_dom_fun

SEQ ID NO: 8578 - protein, 41 aa, Piromyces finnis
  Dockerin_dom_fun
CNAEFIKQGYKCCSGCRTVYYTDDLGDWGVEDGDWCGIPTN

SEQ ID NO: 8579 - protein, 32 aa, Piromyces finnis
  Dockerin_dom_fun
YECCNNCQVIETDDEGRWGSLNGEWCFIDESK

SEQ ID NO: 8580 - protein, 41 aa, Piromyces finnis; identical to SEQ ID NO: 8578
  Dockerin_dom_fun

SEQ ID NO: 8581 - protein, 39 aa, Piromyces finnis; identical to SEQ ID NO: 5899
  Dockerin_dom_fun

SEQ ID NO: 8582 - protein, 32 aa, Piromyces finnis; identical to SEQ ID NO: 8579
  Dockerin_dom_fun

SEQ ID NO: 8583 - protein, 39 aa, Piromyces finnis; identical to SEQ ID NO: 5899
  Dockerin_dom_fun

SEQ ID NO: 8584 - protein, 41 aa, Piromyces finnis; identical to SEQ ID NO: 8578
  Dockerin_dom_fun

SEQ ID NO: 8585 - protein, 38 aa, Piromyces finnis
  Dockerin_dom_fun
CWSLKEGYQCCQDEKTTIIPTKDGKEWGIENNEWCGIT

SEQ ID NO: 8586 - protein, 30 aa, Piromyces finnis
  Dockerin_dom_fun
YKCCKNTCTITFEDNYLWGFEDDWCLIPYS

SEQ ID NO: 8587 - protein, 34 aa, Piromyces finnis
  Dockerin_dom_fun
NSGYPCCVFTTTVIMSDRSGNWGIEYGQWCYIKE

SEQ ID NO: 8588 - protein, 31 aa, Piromyces finnis
  Dockerin_dom_fun
NSGYPCCVKTKTLVSSDAVGDWGIENNDWCL

SEQ ID NO: 8589 - protein, 30 aa, Piromyces finnis
  Dockerin_dom_fun
YKCCEKCKVVYSDGEDWGVEHGNWCSIPYS

SEQ ID NO: 8590 - protein, 39 aa, Piromyces finnis
  Dockerin_dom_fun
ECWSEVLGYSCCKDKKTKVSYVDASGEWGAEHGQWCGIT

SEQ ID NO: 8591 - protein, 20 aa, Piromyces finnis
  Dockerin_dom_fun
YKCCKKCEVIMTDDDGDWGI

SEQ ID NO: 8592 - protein, 33 aa, Piromyces finnis
  Dockerin_dom_fun
NTGYNCCLSDKTPSSTTDNIGKWGIEGGDWCLI

SEQ ID NO: 8593 - protein, 39 aa, Piromyces finnis; identical to SEQ ID NO: 5911
  Dockerin_dom_fun

SEQ ID NO: 8594 - protein, 20 aa, Piromyces finnis
  Dockerin_dom_fun
YKCCKKCEVIMTDDDGDWGI

SEQ ID NO: 8595 - protein, 39 aa, Piromyces finnis; identical to SEQ ID NO: 5911
  Dockerin_dom_fun

SEQ ID NO: 8596 - protein, 33 aa, Piromyces finnis; identical to SEQ ID NO: 8592
  Dockerin_dom_fun

SEQ ID NO: 8597 - protein, 31 aa, Piromyces finnis; identical to SEQ ID NO: 8588
  Dockerin_dom_fun

SEQ ID NO: 8598 - protein, 30 aa, Piromyces finnis; identical to SEQ ID NO: 8589
  Dockerin_dom_fun

SEQ ID NO: 8599 - protein, 39 aa, Piromyces finnis; identical to SEQ ID NO: 8590
  Dockerin_dom_fun

SEQ ID NO: 8600 - protein, 31 aa, Piromyces finnis; identical to SEQ ID NO: 8588
  Dockerin_dom_fun

SEQ ID NO: 8601 - protein, 30 aa, Piromyces finnis; identical to SEQ ID NO: 8589
  Dockerin_dom_fun

SEQ ID NO: 8602 - protein, 39 aa, Piromyces finnis; identical to SEQ ID NO: 8590
  Dockerin_dom_fun

SEQ ID NO: 8603 - protein, 39 aa, Piromyces finnis; identical to SEQ ID NO: 5911
  Dockerin_dom_fun

SEQ ID NO: 8604 - protein, 33 aa, Piromyces finnis; identical to SEQ ID NO: 8592
  Dockerin_dom_fun

SEQ ID NO: 8605 - protein, 20 aa, Piromyces finnis
  Dockerin_dom_fun
YKCCKKCEVIMTDDDGDWGI

SEQ ID NO: 8606 - protein, 20 aa, Piromyces finnis
  Dockerin_dom_fun
YKCCKKCEVIMTDDDGDWGI

SEQ ID NO: 8607 - protein, 39 aa, Piromyces finnis; identical to SEQ ID NO: 5911
  Dockerin_dom_fun

SEQ ID NO: 8608 - protein, 33 aa, Piromyces finnis; identical to SEQ ID NO: 8592
  Dockerin_dom_fun

SEQ ID NO: 8609 - protein, 42 aa, Piromyces finnis; identical to SEQ ID NO: 5927
  Dockerin_dom_fun

SEQ ID NO: 8610 - protein, 22 aa, Piromyces finnis
  Dockerin_dom_fun
YKCCQECNISYTDTEDWGIENG

SEQ ID NO: 8611 - protein, 35 aa, Piromyces finnis
  Dockerin_dom_fun
NSGYSCCSLSNTEVRTTDAVGKWGIEGEEWCLIDE

SEQ ID NO: 8612 - protein, 20 aa, Piromyces finnis
  Dockerin_dom_fun
YKCCKKCEVIMTDDDGDWGI

SEQ ID NO: 8613 - protein, 39 aa, Piromyces finnis; identical to SEQ ID NO: 5911
  Dockerin_dom_fun

SEQ ID NO: 8614 - protein, 33 aa, Piromyces finnis; identical to SEQ ID NO: 8592
  Dockerin_dom_fun

SEQ ID NO: 8615 - protein, 30 aa, Piromyces finnis; identical to SEQ ID NO: 8589
  Dockerin_dom_fun

SEQ ID NO: 8616 - protein, 31 aa, Piromyces finnis; identical to SEQ ID NO: 8588
  Dockerin_dom_fun

SEQ ID NO: 8617 - protein, 39 aa, Piromyces finnis; identical to SEQ ID NO: 8590
  Dockerin_dom_fun

SEQ ID NO: 8618 - protein, 39 aa, Piromyces finnis; identical to SEQ ID NO: 8590
  Dockerin_dom_fun

SEQ ID NO: 8619 - protein, 30 aa, Piromyces finnis; identical to SEQ ID NO: 8589
  Dockerin_dom_fun

SEQ ID NO: 8620 - protein, 31 aa, Piromyces finnis; identical to SEQ ID NO: 8588
  Dockerin_dom_fun

SEQ ID NO: 8621 - protein, 43 aa, Piromyces finnis
  Dockerin_dom_fun
ECWSLAEGYPCCKNQNTPVKYESKSRGVKYGIENGDWCGLIES

SEQ ID NO: 8622 - protein, 34 aa, Piromyces finnis; identical to SEQ ID NO: 3426
  Dockerin_dom_fun

SEQ ID NO: 8623 - protein, 38 aa, Piromyces finnis
  Dockerin_dom_fun
TCWSSKIGYPCCKENNVIYAIDSQGSWGYENDSWCGIS

SEQ ID NO: 8624 - protein, 39 aa, Piromyces finnis; identical to SEQ ID NO: 5940
  Dockerin_dom_fun

SEQ ID NO: 8625 - protein, 41 aa, Piromyces finnis
  Dockerin_dom_fun
SSCSGALGYPCCKSACTVYDTDSNGKWSIENNDWCLIDNSK

SEQ ID NO: 8626 - protein, 39 aa, Piromyces finnis; identical to SEQ ID NO: 5942
  Dockerin_dom_fun

SEQ ID NO: 8627 - protein, 32 aa, Piromyces finnis
  Dockerin_dom_fun
AYPCCNECEVIYTDNDGDWGVENNEWCLINKL

SEQ ID NO: 8628 - protein, 36 aa, Piromyces finnis; identical to SEQ ID NO: 5946
  Dockerin_dom_fun

SEQ ID NO: 8629 - protein, 32 aa, Piromyces finnis; identical to SEQ ID NO: 3430
  Dockerin_dom_fun

SEQ ID NO: 8630 - protein, 38 aa, Piromyces finnis
  Dockerin_dom_fun
CTGMNSGYQCCDTCNVVYTDNDGKWGIMNGEWCGIKSS

SEQ ID NO: 8631 - protein, 41 aa, Piromyces finnis; identical to SEQ ID NO: 5948
  Dockerin_dom_fun

SEQ ID NO: 8632 - protein, 38 aa, Piromyces finnis; identical to SEQ ID NO: 8630
  Dockerin_dom_fun

SEQ ID NO: 8633 - protein, 37 aa, Piromyces finnis; identical to SEQ ID NO: 5687
  Dockerin_dom_fun

SEQ ID NO: 8634 - protein, 32 aa, Piromyces finnis
  Dockerin_dom_fun
YACCSGCESVYVDNDGKWGVENGNWCLIKESK

SEQ ID NO: 8635 - protein, 32 aa, Piromyces finnis; identical to SEQ ID NO: 8627
  Dockerin_dom_fun

SEQ ID NO: 8636 - protein, 36 aa, Piromyces finnis; identical to SEQ ID NO: 5946
  Dockerin_dom_fun

SEQ ID NO: 8637 - protein, 32 aa, Piromyces finnis; identical to SEQ ID NO: 3430
  Dockerin_dom_fun

SEQ ID NO: 8638 - protein, 38 aa, Piromyces finnis; identical to SEQ ID NO: 8630
  Dockerin_dom_fun

SEQ ID NO: 8639 - protein, 37 aa, Piromyces finnis; identical to SEQ ID NO: 5687
  Dockerin_dom_fun

SEQ ID NO: 8640 - protein, 32 aa, Piromyces finnis; identical to SEQ ID NO: 8634
  Dockerin_dom_fun

SEQ ID NO: 8641 - protein, 36 aa, Piromyces finnis; identical to SEQ ID NO: 5946
  Dockerin_dom_fun

SEQ ID NO: 8642 - protein, 32 aa, Piromyces finnis; identical to SEQ ID NO: 8627
  Dockerin_dom_fun

SEQ ID NO: 8643 - protein, 32 aa, Piromyces finnis; identical to SEQ ID NO: 3430
  Dockerin_dom_fun

SEQ ID NO: 8644 - protein, 38 aa, Piromyces finnis; identical to SEQ ID NO: 8630
  Dockerin_dom_fun

SEQ ID NO: 8645 - protein, 37 aa, Piromyces finnis; identical to SEQ ID NO: 5687
  Dockerin_dom_fun

SEQ ID NO: 8646 - protein, 32 aa, Piromyces finnis; identical to SEQ ID NO: 8634
  Dockerin_dom_fun

SEQ ID NO: 8647 - protein, 41 aa, Piromyces finnis; identical to SEQ ID NO: 8625
  Dockerin_dom_fun

SEQ ID NO: 8648 - protein, 38 aa, Piromyces finnis
  Dockerin_dom_fun
CFSEKLGYKCCKACDTIYTDESGDWGFENNDWCGIASS

SEQ ID NO: 8649 - protein, 39 aa, Piromyces finnis
  Dockerin_dom_fun
CWASKLGFKCCTSQCPQEVYVDTDGSWGVENNNWCGIVS

SEQ ID NO: 8650 - protein, 34 aa, Piromyces finnis
  Dockerin_dom_fun
ESGYPYCKTTTDVVYTDSVKWGIENNDWCGIVDS

SEQ ID NO: 8651 - protein, 40 aa, Piromyces finnis; identical to SEQ ID NO: 5968
  Dockerin_dom_fun

SEQ ID NO: 8652 - protein, 41 aa, Piromyces finnis
  Dockerin_dom_fun
ACWAELLGYSCCSTKTCRNAVYTDDDGQWDVENGNWCGIGG

SEQ ID NO: 8653 - protein, 39 aa, Piromyces finnis; identical to SEQ ID NO: 5970
  Dockerin_dom_fun

SEQ ID NO: 8654 - protein, 39 aa, Piromyces finnis; identical to SEQ ID NO: 8649
  Dockerin_dom_fun

SEQ ID NO: 8655 - protein, 19 aa, Piromyces finnis
  Dockerin_dom_fun
DASGRWGIENNDWCGIVDS

SEQ ID NO: 8656 - protein, 41 aa, Piromyces finnis; identical to SEQ ID NO: 8652
  Dockerin_dom_fun

SEQ ID NO: 8657 - protein, 39 aa, Piromyces finnis; identical to SEQ ID NO: 8649
  Dockerin_dom_fun

SEQ ID NO: 8658 - protein, 41 aa, Piromyces finnis; identical to SEQ ID NO: 8652
  Dockerin_dom_fun

SEQ ID NO: 8659 - protein, 34 aa, Piromyces finnis; identical to SEQ ID NO: 8650
  Dockerin_dom_fun

SEQ ID NO: 8660 - protein, 39 aa, Piromyces finnis; identical to SEQ ID NO: 8649
  Dockerin_dom_fun

SEQ ID NO: 8661 - protein, 40 aa, Piromyces finnis; identical to SEQ ID NO: 5968
  Dockerin_dom_fun

SEQ ID NO: 8662 - protein, 19 aa, Piromyces finnis
  Dockerin_dom_fun
DASGRWGIENNDWCGIVDS

SEQ ID NO: 8663 - protein, 38 aa, Piromyces finnis
  Dockerin_dom_fun
SCWSEELGYPCCTSTTKVVYTDESGSWGIENGDWCGIK

SEQ ID NO: 8664 - protein, 40 aa, Piromyces finnis; identical to SEQ ID NO: 5968
  Dockerin_dom_fun

SEQ ID NO: 8665 - protein, 39 aa, Piromyces finnis; identical to SEQ ID NO: 5970
  Dockerin_dom_fun

SEQ ID NO: 8666 - protein, 15 aa, Piromyces finnis
  Dockerin_dom_fun
KWGVENNKWCGIPSN

SEQ ID NO: 8667 - protein, 39 aa, Piromyces finnis; identical to SEQ ID NO: 5983
  Dockerin_dom_fun

SEQ ID NO: 8668 - protein, 32 aa, Piromyces finnis
  Dockerin_dom_fun
MGYPCCTNPSTTVFYVDEDGNWGLENDNWCIM

SEQ ID NO: 8669 - protein, 33 aa, Piromyces finnis
  Dockerin_dom_fun
YPYCSGCESNYQDADGEWYFVDNKWCKVNEKKC

SEQ ID NO: 8670 - protein, 39 aa, Piromyces finnis; identical to SEQ ID NO: 5984
  Dockerin_dom_fun

SEQ ID NO: 8671 - protein, 31 aa, Piromyces finnis
  Dockerin_dom_fun
QCWSKELGFECCKSCVTQYTDEDGQWGYEDD

SEQ ID NO: 8672 - protein, 25 aa, Piromyces finnis
  Dockerin_dom_fun
YPCCSSGTSVVYTDASGSWGVENNE

SEQ ID NO: 8673 - protein, 38 aa, Piromyces finnis; identical to SEQ ID NO: 5989
  Dockerin_dom_fun

SEQ ID NO: 8674 - protein, 39 aa, Piromyces finnis; identical to SEQ ID NO: 5988
  Dockerin_dom_fun

SEQ ID NO: 8675 - protein, 38 aa, Piromyces finnis; identical to SEQ ID NO: 5993
  Dockerin_dom_fun

SEQ ID NO: 8676 - protein, 25 aa, Piromyces finnis
  Dockerin_dom_fun
YPCCSSGTSVAYTDASGSWGVENNE

SEQ ID NO: 8677 - protein, 39 aa, Piromyces finnis; identical to SEQ ID NO: 5988
  Dockerin_dom_fun

SEQ ID NO: 8678 - protein, 31 aa, Piromyces finnis
  Dockerin_dom_fun
YPCCSKCNIVFTDEEGDWGYEKGDWCGIRDN

SEQ ID NO: 8679 - protein, 40 aa, Piromyces finnis; identical to SEQ ID NO: 5995
  Dockerin_dom_fun

SEQ ID NO: 8680 - protein, 39 aa, Piromyces finnis; identical to SEQ ID NO: 5996
  Dockerin_dom_fun

SEQ ID NO: 8681 - protein, 32 aa, Piromyces finnis; identical to SEQ ID NO: 3483
  Dockerin_dom_fun

SEQ ID NO: 8682 - protein, 32 aa, Piromyces finnis; identical to SEQ ID NO: 3484
  Dockerin_dom_fun

SEQ ID NO: 8683 - protein, 37 aa, Piromyces finnis
  Dockerin_dom_fun
SCWAKPLGYNCCTSTTQAVYTDSDGKWGVENGDWCGI

SEQ ID NO: 8684 - protein, 39 aa, Piromyces finnis
  Dockerin_dom_fun
ACWSQSLGYPCCSSASAKVEYTDADGKWGIENGNWCGIP

SEQ ID NO: 8685 - protein, 38 aa, Piromyces finnis
  Dockerin_dom_fun
ACWSQKLGYPCCSSSSAQVWFTDNDGEWGVENGDWCGI

SEQ ID NO: 8686 - protein, 38 aa, Piromyces finnis; identical to SEQ ID NO: 8685
  Dockerin_dom_fun

SEQ ID NO: 8687 - protein, 39 aa, Piromyces finnis; identical to SEQ ID NO: 6003
  Dockerin_dom_fun

SEQ ID NO: 8688 - protein, 39 aa, Piromyces finnis; identical to SEQ ID NO: 8684
  Dockerin_dom_fun

SEQ ID NO: 8689 - protein, 39 aa, Piromyces finnis
  Dockerin_dom_fun
SCWAKPLGYNCCTSTTQAVYTDSDGKWGVENGDWCGIPK

SEQ ID NO: 8690 - protein, 39 aa, Piromyces finnis; identical to SEQ ID NO: 6003
  Dockerin_dom_fun

SEQ ID NO: 8691 - protein, 40 aa, Piromyces finnis
  Dockerin_dom_fun
ACWSQKLGYPCCSSSSAQVWFTDNDGEWGVENGDWCGIPK

SEQ ID NO: 8692 - protein, 37 aa, Piromyces finnis; identical to SEQ ID NO: 8683
  Dockerin_dom_fun

SEQ ID NO: 8693 - protein, 39 aa, Piromyces finnis; identical to SEQ ID NO: 8684
  Dockerin_dom_fun

SEQ ID NO: 8694 - protein, 39 aa, Piromyces finnis; identical to SEQ ID NO: 6003
  Dockerin_dom_fun

SEQ ID NO: 8695 - protein, 40 aa, Piromyces finnis; identical to SEQ ID NO: 8691
  Dockerin_dom_fun

SEQ ID NO: 8696 - protein, 38 aa, Piromyces finnis; identical to SEQ ID NO: 8685
  Dockerin_dom_fun

SEQ ID NO: 8697 - protein, 37 aa, Piromyces finnis; identical to SEQ ID NO: 8683
  Dockerin_dom_fun

SEQ ID NO: 8698 - protein, 39 aa, Piromyces finnis; identical to SEQ ID NO: 8684
  Dockerin_dom_fun

SEQ ID NO: 8699 - protein, 38 aa, Piromyces finnis; identical to SEQ ID NO: 8685
  Dockerin_dom_fun

SEQ ID NO: 8700 - protein, 37 aa, Piromyces finnis; identical to SEQ ID NO: 8683
  Dockerin_dom_fun

SEQ ID NO: 8701 - protein, 39 aa, Piromyces finnis; identical to SEQ ID NO: 8684
  Dockerin_dom_fun

SEQ ID NO: 8702 - protein, 37 aa, Piromyces finnis; identical to SEQ ID NO: 8683
  Dockerin_dom_fun

SEQ ID NO: 8703 - protein, 39 aa, Piromyces finnis; identical to SEQ ID NO: 8684
  Dockerin_dom_fun

SEQ ID NO: 8704 - protein, 39 aa, Piromyces finnis; identical to SEQ ID NO: 8684
  Dockerin_dom_fun

SEQ ID NO: 8705 - protein, 39 aa, Piromyces finnis; identical to SEQ ID NO: 6003
  Dockerin_dom_fun

SEQ ID NO: 8706 - protein, 39 aa, Piromyces finnis; identical to SEQ ID NO: 8689
  Dockerin_dom_fun

SEQ ID NO: 8707 - protein, 38 aa, Piromyces finnis; identical to SEQ ID NO: 8685
  Dockerin_dom_fun

SEQ ID NO: 8708 - protein, 39 aa, Piromyces finnis; identical to SEQ ID NO: 6003
  Dockerin_dom_fun

SEQ ID NO: 8709 - protein, 39 aa, Piromyces finnis; identical to SEQ ID NO: 8684
  Dockerin_dom_fun

SEQ ID NO: 8710 - protein, 39 aa, Piromyces finnis; identical to SEQ ID NO: 8689
  Dockerin_dom_fun

SEQ ID NO: 8711 - protein, 37 aa, Piromyces finnis; identical to SEQ ID NO: 8683
  Dockerin_dom_fun

SEQ ID NO: 8712 - protein, 39 aa, Piromyces finnis; identical to SEQ ID NO: 8684
  Dockerin_dom_fun

SEQ ID NO: 8713 - protein, 38 aa, Piromyces finnis; identical to SEQ ID NO: 8685
  Dockerin_dom_fun

SEQ ID NO: 8714 - protein, 39 aa, Piromyces finnis; identical to SEQ ID NO: 6003
  Dockerin_dom_fun

SEQ ID NO: 8715 - protein, 40 aa, Piromyces finnis; identical to SEQ ID NO: 8691
  Dockerin_dom_fun

SEQ ID NO: 8716 - protein, 39 aa, Piromyces finnis
  Dockerin_dom_fun
CWSTAFGYSCCKSCGPVYFTDESGNWGIENGDWCGLLSS

SEQ ID NO: 8717 - protein, 39 aa, Piromyces finnis; identical to SEQ ID NO: 5647
  Dockerin_dom_fun

SEQ ID NO: 8718 - protein, 39 aa, Piromyces finnis; identical to SEQ ID NO: 8716
  Dockerin_dom_fun

SEQ ID NO: 8719 - protein, 28 aa, Piromyces finnis
  Dockerin_dom_fun
CWSEPLGYPCCTGCAYSWYSDDDGEWGV

SEQ ID NO: 8720 - protein, 39 aa, Piromyces finnis; identical to SEQ ID NO: 8716
  Dockerin_dom_fun

SEQ ID NO: 8721 - protein, 28 aa, Piromyces finnis
  Dockerin_dom_fun
CWSEPLGYPCCTGCAYSWYSDDDGEWGV

SEQ ID NO: 8722 - protein, 28 aa, Piromyces finnis
  Dockerin_dom_fun
CWSEPLGYPCCTGCAYSWYSDDDGEWGV

SEQ ID NO: 8723 - protein, 39 aa, Piromyces finnis; identical to SEQ ID NO: 8716
  Dockerin_dom_fun

SEQ ID NO: 8724 - protein, 35 aa, Piromyces finnis; identical to SEQ ID NO: 6041
  Dockerin_dom_fun

SEQ ID NO: 8725 - protein, 40 aa, Piromyces finnis; identical to SEQ ID NO: 6040
  Dockerin_dom_fun

SEQ ID NO: 8726 - protein, 28 aa, Piromyces finnis
  Dockerin_dom_fun
CWSEPLGYPCCTGCAYSWYSDDDGEWGV

SEQ ID NO: 8727 - protein, 39 aa, Piromyces finnis; identical to SEQ ID NO: 5647
  Dockerin_dom_fun

SEQ ID NO: 8728 - protein, 39 aa, Piromyces finnis; identical to SEQ ID NO: 5647
  Dockerin_dom_fun

SEQ ID NO: 8729 - protein, 35 aa, Piromyces finnis; identical to SEQ ID NO: 6041
  Dockerin_dom_fun

SEQ ID NO: 8730 - protein, 40 aa, Piromyces finnis; identical to SEQ ID NO: 6040
  Dockerin_dom_fun

SEQ ID NO: 8731 - protein, 28 aa, Piromyces finnis
  Dockerin_dom_fun
PATFTSLGYSCCKSENCMVYYQDESGDW

SEQ ID NO: 8732 - protein, 36 aa, Piromyces finnis; identical to SEQ ID NO: 3534
  Dockerin_dom_fun

SEQ ID NO: 8733 - protein, 36 aa, Piromyces finnis; identical to SEQ ID NO: 3535
  Dockerin_dom_fun

SEQ ID NO: 8734 - protein, 37 aa, Piromyces finnis; identical to SEQ ID NO: 6050
  Dockerin_dom_fun

SEQ ID NO: 8735 - protein, 40 aa, Piromyces finnis
  Dockerin_dom_fun
CSAKITSQGYKCCSSSCVPSYTDGDGDWAIENGEWCGITK

SEQ ID NO: 8736 - protein, 37 aa, Piromyces finnis; identical to SEQ ID NO: 6050
  Dockerin_dom_fun

SEQ ID NO: 8737 - protein, 40 aa, Piromyces finnis
  Dockerin_dom_fun
CSSKITSQGYKCCSSSCVPSYTDGDGDWAIENGEWCGITK

SEQ ID NO: 8738 - protein, 39 aa, Piromyces finnis; identical to SEQ ID NO: 6054
  Dockerin_dom_fun

SEQ ID NO: 8739 - protein, 40 aa, Piromyces finnis; identical to SEQ ID NO: 6055
  Dockerin_dom_fun

SEQ ID NO: 8740 - protein, 40 aa, Piromyces finnis; identical to SEQ ID NO: 8540
  Dockerin_dom_fun

SEQ ID NO: 8741 - protein, 37 aa, Piromyces finnis; identical to SEQ ID NO: 6050
  Dockerin_dom_fun

SEQ ID NO: 8742 - protein, 39 aa, Piromyces finnis; identical to SEQ ID NO: 6059
  Dockerin_dom_fun

SEQ ID NO: 8743 - protein, 40 aa, Piromyces finnis; identical to SEQ ID NO: 6055
  Dockerin_dom_fun

SEQ ID NO: 8744 - protein, 41 aa, Piromyces finnis; identical to SEQ ID NO: 6060
  Dockerin_dom_fun

SEQ ID NO: 8745 - protein, 39 aa, Piromyces finnis; identical to SEQ ID NO: 6061
  Dockerin_dom_fun

SEQ ID NO: 8746 - protein, 40 aa, Piromyces finnis; identical to SEQ ID NO: 6055
  Dockerin_dom_fun

SEQ ID NO: 8747 - protein, 35 aa, Piromyces finnis
  Dockerin_dom_fun
LALGYPCCSKTNCVAVYTDETGDWDVENNDWCWCR

SEQ ID NO: 8748 - protein, 38 aa, Piromyces finnis
  Dockerin_dom_fun
TSITNQGYKCCSAEKCEVVYTDESGDWGVEDGDWCGCT

SEQ ID NO: 8749 - protein, 38 aa, Piromyces finnis; identical to SEQ ID NO: 8748
  Dockerin_dom_fun

SEQ ID NO: 8750 - protein, 35 aa, Piromyces finnis; identical to SEQ ID NO: 8747
  Dockerin_dom_fun

SEQ ID NO: 8751 - protein, 30 aa, Piromyces finnis; identical to SEQ ID NO: 8324
  Dockerin_dom_fun

SEQ ID NO: 8752 - protein, 30 aa, Piromyces finnis; identical to SEQ ID NO: 8324
  Dockerin_dom_fun

SEQ ID NO: 8753 - protein, 30 aa, Piromyces finnis; identical to SEQ ID NO: 8324
  Dockerin_dom_fun

SEQ ID NO: 8754 - protein, 30 aa, Piromyces finnis; identical to SEQ ID NO: 8324
  Dockerin_dom_fun

SEQ ID NO: 8755 - protein, 32 aa, Piromyces finnis
  Dockerin_dom_fun
YNCCNNCDVYYTDNEGKWGVQNNDWCFIDNNR

SEQ ID NO: 8756 - protein, 38 aa, Piromyces finnis
  Dockerin_dom_fun
CKFESLGYRCCNGCDVVYTDSDGNWGVENGNWCGIRDN

SEQ ID NO: 8757 - protein, 22 aa, Piromyces finnis
  Dockerin_dom_fun
NANVIAQGYKCCSSCSDVWYTD

SEQ ID NO: 8758 - protein, 38 aa, Piromyces finnis; identical to SEQ ID NO: 6073
  Dockerin_dom_fun

SEQ ID NO: 8759 - protein, 32 aa, Piromyces finnis; identical to SEQ ID NO: 8755
  Dockerin_dom_fun

SEQ ID NO: 8760 - protein, 36 aa, Piromyces finnis
  Dockerin_dom_fun
CKFESLGYRCCNGCDVVYTDSDGNWGVENGNWCGIQ

SEQ ID NO: 8761 - protein, 38 aa, Piromyces finnis; identical to SEQ ID NO: 6073
  Dockerin_dom_fun

SEQ ID NO: 8762 - protein, 38 aa, Piromyces finnis
  Dockerin_dom_fun
AITNQGYPCCKSCGTVYYTDADGEWGVENGDWCGMPTK

SEQ ID NO: 8763 - protein, 38 aa, Piromyces finnis; identical to SEQ ID NO: 6078
  Dockerin_dom_fun

SEQ ID NO: 8764 - protein, 38 aa, Piromyces finnis; identical to SEQ ID NO: 8762
  Dockerin_dom_fun

SEQ ID NO: 8765 - protein, 38 aa, Piromyces finnis; identical to SEQ ID NO: 6078
  Dockerin_dom_fun

SEQ ID NO: 8766 - protein, 39 aa, Piromyces finnis; identical to SEQ ID NO: 6081
  Dockerin_dom_fun

SEQ ID NO: 8767 - protein, 22 aa, Piromyces finnis
  Dockerin_dom_fun
NANVIAQGYKCCSSCSDVWYTD

SEQ ID NO: 8768 - protein, 38 aa, Piromyces finnis; identical to SEQ ID NO: 6082
  Dockerin_dom_fun

SEQ ID NO: 8769 - protein, 38 aa, Piromyces finnis; identical to SEQ ID NO: 6082
  Dockerin_dom_fun

SEQ ID NO: 8770 - protein, 38 aa, Piromyces finnis; identical to SEQ ID NO: 6084
  Dockerin_dom_fun

SEQ ID NO: 8771 - protein, 22 aa, Piromyces finnis
  Dockerin_dom_fun
NANVIAQGYKCCSSCSDVWYTD

SEQ ID NO: 8772 - protein, 40 aa, Piromyces finnis; identical to SEQ ID NO: 6086
  Dockerin_dom_fun

SEQ ID NO: 8773 - protein, 33 aa, Piromyces finnis; identical to SEQ ID NO: 6085
  Dockerin_dom_fun

SEQ ID NO: 8774 - protein, 38 aa, Piromyces finnis
  Dockerin_dom_fun
CKFESLGYRCCNGCDVVYTDSDGNWGVENGNWCGIKPS

SEQ ID NO: 8775 - protein, 32 aa, Piromyces finnis; identical to SEQ ID NO: 8755
  Dockerin_dom_fun

SEQ ID NO: 8776 - protein, 38 aa, Piromyces finnis; identical to SEQ ID NO: 8762
  Dockerin_dom_fun

SEQ ID NO: 8777 - protein, 38 aa, Piromyces finnis; identical to SEQ ID NO: 6078
  Dockerin_dom_fun

SEQ ID NO: 8778 - protein, 38 aa, Piromyces finnis; identical to SEQ ID NO: 8762
  Dockerin_dom_fun

SEQ ID NO: 8779 - protein, 38 aa, Piromyces finnis; identical to SEQ ID NO: 6078
  Dockerin_dom_fun

SEQ ID NO: 8780 - protein, 33 aa, Piromyces finnis; identical to SEQ ID NO: 6093
  Dockerin_dom_fun

SEQ ID NO: 8781 - protein, 40 aa, Piromyces finnis
  Dockerin_dom_fun
CSAKITSQGYKCCSAGCVIYYTDADGDWGVENNEWCGCGN

SEQ ID NO: 8782 - protein, 40 aa, Piromyces finnis
  Dockerin_dom_fun
DCFSTKLGYPCCKAGTQAVYTDADGDWGVENGDWCGIKDS

SEQ ID NO: 8783 - protein, 35 aa, Piromyces finnis; identical to SEQ ID NO: 3581
  Dockerin_dom_fun

SEQ ID NO: 8784 - protein, 32 aa, Piromyces finnis; identical to SEQ ID NO: 3584
  Dockerin_dom_fun

SEQ ID NO: 8785 - protein, 39 aa, Piromyces finnis
  Dockerin_dom_fun
SCWSKSLGFECCTGSAYVLYTDENGQWGVENGDWCGIGG

SEQ ID NO: 8786 - protein, 32 aa, Piromyces finnis
  Dockerin_dom_fun
LGYPLCKEKHEDDLVRDEDGYWAIEDGNWCGV

SEQ ID NO: 8787 - protein, 37 aa, Piromyces finnis; identical to SEQ ID NO: 6099
  Dockerin_dom_fun

SEQ ID NO: 8788 - protein, 32 aa, Piromyces finnis; identical to SEQ ID NO: 3586
  Dockerin_dom_fun

SEQ ID NO: 8789 - protein, 39 aa, Piromyces finnis
  Dockerin_dom_fun
DCFSTKLGYPCCKAGTQAVYTDADGDWGVENGDWCGIGG

SEQ ID NO: 8790 - protein, 32 aa, Piromyces finnis; identical to SEQ ID NO: 3584
  Dockerin_dom_fun

SEQ ID NO: 8791 - protein, 35 aa, Piromyces finnis; identical to SEQ ID NO: 3581
  Dockerin_dom_fun

SEQ ID NO: 8792 - protein, 40 aa, Piromyces finnis
  Dockerin_dom_fun
SCWSKSLGFECCTGSAYVLYTDENGQWGVENGDWCGIKDS

SEQ ID NO: 8793 - protein, 37 aa, Piromyces finnis; identical to SEQ ID NO: 8683
  Dockerin_dom_fun

SEQ ID NO: 8794 - protein, 37 aa, Piromyces finnis
  Dockerin_dom_fun
SCWAKALGYNCCTSTTQAIYTDSDGKWGVENGDWCGI

SEQ ID NO: 8795 - protein, 37 aa, Piromyces finnis; identical to SEQ ID NO: 8794
  Dockerin_dom_fun

SEQ ID NO: 8796 - protein, 37 aa, Piromyces finnis; identical to SEQ ID NO: 8794
  Dockerin_dom_fun

SEQ ID NO: 8797 - protein, 37 aa, Piromyces finnis; identical to SEQ ID NO: 8794
  Dockerin_dom_fun

SEQ ID NO: 8798 - protein, 37 aa, Piromyces finnis; identical to SEQ ID NO: 8794
  Dockerin_dom_fun

SEQ ID NO: 8799 - protein, 40 aa, Piromyces finnis
  Dockerin_dom_fun
TCFAEKLGYSCCPDGTTVSYTDGDGKWGVVNGDWCGIAEE

SEQ ID NO: 8800 - protein, 38 aa, Piromyces finnis; identical to SEQ ID NO: 6113
  Dockerin_dom_fun

SEQ ID NO: 8801 - protein, 37 aa, Piromyces finnis; identical to SEQ ID NO: 8683
  Dockerin_dom_fun

SEQ ID NO: 8802 - protein, 41 aa, Piromyces finnis
  Dockerin_dom_fun
SCWAQALGYPCCKNTKDVVTTDSDGDWGIENGDWCGIVDNR

SEQ ID NO: 8803 - protein, 37 aa, Piromyces finnis; identical to SEQ ID NO: 8683
  Dockerin_dom_fun

SEQ ID NO: 8804 - protein, 37 aa, Piromyces finnis; identical to SEQ ID NO: 8794
  Dockerin_dom_fun

SEQ ID NO: 8805 - protein, 37 aa, Piromyces finnis; identical to SEQ ID NO: 8683
  Dockerin_dom_fun

SEQ ID NO: 8806 - protein, 37 aa, Piromyces finnis; identical to SEQ ID NO: 8683
  Dockerin_dom_fun

SEQ ID NO: 8807 - protein, 39 aa, Piromyces finnis; identical to SEQ ID NO: 6003
  Dockerin_dom_fun

SEQ ID NO: 8808 - protein, 37 aa, Piromyces finnis; identical to SEQ ID NO: 8683
  Dockerin_dom_fun

SEQ ID NO: 8809 - protein, 37 aa, Piromyces finnis; identical to SEQ ID NO: 8683
  Dockerin_dom_fun

SEQ ID NO: 8810 - protein, 37 aa, Piromyces finnis; identical to SEQ ID NO: 8683
  Dockerin_dom_fun

SEQ ID NO: 8811 - protein, 37 aa, Piromyces finnis; identical to SEQ ID NO: 8794
  Dockerin_dom_fun

SEQ ID NO: 8812 - protein, 37 aa, Piromyces finnis; identical to SEQ ID NO: 8794
  Dockerin_dom_fun

SEQ ID NO: 8813 - protein, 31 aa, Piromyces finnis; identical to SEQ ID NO: 3612
  Dockerin_dom_fun

SEQ ID NO: 8814 - protein, 32 aa, Piromyces finnis
  Dockerin_dom_fun
KGYKCCKTTSQVYEVDSDGKWGIENNDWCFIK

SEQ ID NO: 8815 - protein, 40 aa, Piromyces finnis
  Dockerin_dom_fun
CSSKITSQGYKCCASNCDVVYVDNDGNWGVENDEWCGCGT

SEQ ID NO: 8816 - protein, 31 aa, Piromyces finnis
  Dockerin_dom_fun
LGYNCCRNTCDIQYKDDDGNWGVENNDWCGL

SEQ ID NO: 8817 - protein, 18 aa, Piromyces finnis
  Dockerin_dom_fun
SCWANALGYPCCTSTTQV

SEQ ID NO: 8818 - protein, 18 aa, Piromyces finnis
  Dockerin_dom_fun
SCWANALGYPCCTSTTQV

SEQ ID NO: 8819 - protein, 38 aa, Piromyces finnis; identical to SEQ ID NO: 6130
  Dockerin_dom_fun

SEQ ID NO: 8820 - protein, 39 aa, Piromyces finnis
  Dockerin_dom_fun
CSSKITSQGYKCCASNCDVVYVDNDGNWGVENNDWCGLT

SEQ ID NO: 8821 - protein, 32 aa, Piromyces finnis
  Dockerin_dom_fun
LGYNCCRNTCDIQYKDDDGNWGVENNDWCGLT

SEQ ID NO: 8822 - protein, 13 aa, Piromyces finnis
  Dockerin_dom_fun
DWGVENNNWCGIN

SEQ ID NO: 8823 - protein, 40 aa, Piromyces finnis; identical to SEQ ID NO: 8781
  Dockerin_dom_fun

SEQ ID NO: 8824 - protein, 23 aa, Piromyces finnis
  Dockerin_dom_fun
CSAKITSQGYKCCSAGCVIYYTD

SEQ ID NO: 8825 - protein, 38 aa, Piromyces finnis
  Dockerin_dom_fun
SCWSEALGYPCCEGNVVITSDENGDWGVENNEWCGCGN

SEQ ID NO: 8826 - protein, 20 aa, Piromyces finnis
  Dockerin_dom_fun
TIYTDADGNWGVENNQWCGC

SEQ ID NO: 8827 - protein, 41 aa, Piromyces finnis; identical to SEQ ID NO: 6136
  Dockerin_dom_fun

SEQ ID NO: 8828 - protein, 41 aa, Piromyces finnis; identical to SEQ ID NO: 6136
  Dockerin_dom_fun

SEQ ID NO: 8829 - protein, 41 aa, Piromyces finnis; identical to SEQ ID NO: 6138
  Dockerin_dom_fun

SEQ ID NO: 8830 - protein, 41 aa, Piromyces finnis; identical to SEQ ID NO: 6138
  Dockerin_dom_fun

SEQ ID NO: 8831 - protein, 35 aa, Piromyces finnis; identical to SEQ ID NO: 6140
  Dockerin_dom_fun

SEQ ID NO: 8832 - protein, 31 aa, Piromyces finnis; identical to SEQ ID NO: 6141
  Dockerin_dom_fun

SEQ ID NO: 8833 - protein, 39 aa, Piromyces finnis; identical to SEQ ID NO: 6142
  Dockerin_dom_fun

SEQ ID NO: 8834 - protein, 29 aa, Piromyces finnis
  Dockerin_dom_fun
TCWAEALGYKCCQTTSNVEFIDTDGKWGF

SEQ ID NO: 8835 - protein, 40 aa, Piromyces finnis; identical to SEQ ID NO: 8799
  Dockerin_dom_fun

SEQ ID NO: 8836 - protein, 27 aa, Piromyces finnis
  Dockerin_dom_fun
SCWASSLGYPCCKSTKVVIDTDASGRW

SEQ ID NO: 8837 - protein, 31 aa, Piromyces finnis; identical to SEQ ID NO: 3633
  Dockerin_dom_fun

SEQ ID NO: 8838 - protein, 35 aa, Piromyces finnis; identical to SEQ ID NO: 6149
  Dockerin_dom_fun

SEQ ID NO: 8839 - protein, 31 aa, Piromyces finnis
  Dockerin_dom_fun
YECCNGCNVVDQSDGLKWGVENNNWCIIKSS

SEQ ID NO: 8840 - protein, 38 aa, Piromyces finnis; identical to SEQ ID NO: 6147
  Dockerin_dom_fun

SEQ ID NO: 8841 - protein, 34 aa, Piromyces finnis; identical to SEQ ID NO: 6150
  Dockerin_dom_fun

SEQ ID NO: 8842 - protein, 32 aa, Piromyces finnis; identical to SEQ ID NO: 8668
  Dockerin_dom_fun

SEQ ID NO: 8843 - protein, 39 aa, Piromyces finnis; identical to SEQ ID NO: 5984
  Dockerin_dom_fun

SEQ ID NO: 8844 - protein, 33 aa, Piromyces finnis; identical to SEQ ID NO: 8669
  Dockerin_dom_fun

SEQ ID NO: 8845 - protein, 33 aa, Piromyces finnis
  Dockerin_dom_fun
YPCCSSENAEIVYTDSEGDWGLEKGDWCLIKKN

SEQ ID NO: 8846 - protein, 32 aa, Piromyces finnis; identical to SEQ ID NO: 3641
  Dockerin_dom_fun

SEQ ID NO: 8847 - protein, 31 aa, Piromyces finnis; identical to SEQ ID NO: 6156
  Dockerin_dom_fun

SEQ ID NO: 8848 - protein, 26 aa, Piromyces finnis
  Dockerin_dom_fun
KCWSTEFGFPCCKGNTIVFTDENGDW

SEQ ID NO: 8849 - protein, 33 aa, Piromyces finnis; identical to SEQ ID NO: 8326
  Dockerin_dom_fun

SEQ ID NO: 8850 - protein, 33 aa, Piromyces finnis; identical to SEQ ID NO: 8327
  Dockerin_dom_fun

SEQ ID NO: 8851 - protein, 33 aa, Piromyces finnis; identical to SEQ ID NO: 8326
  Dockerin_dom_fun

SEQ ID NO: 8852 - protein, 33 aa, Piromyces finnis; identical to SEQ ID NO: 8327
  Dockerin_dom_fun

SEQ ID NO: 8853 - protein, 40 aa, Piromyces finnis; identical to SEQ ID NO: 6163
  Dockerin_dom_fun

SEQ ID NO: 8854 - protein, 31 aa, Piromyces finnis; identical to SEQ ID NO: 6162
  Dockerin_dom_fun

SEQ ID NO: 8855 - protein, 29 aa, Piromyces finnis
  Dockerin_dom_fun
NCIAKSLGYQCCPKNISEVYYHDENGDWG

SEQ ID NO: 8856 - protein, 40 aa, Piromyces finnis; identical to SEQ ID NO: 6165
  Dockerin_dom_fun

SEQ ID NO: 8857 - protein, 40 aa, Piromyces finnis
  Dockerin_dom_fun
CASVFNQMGYKCCRSCNVVLTDSTGKWGVEDNEWCGIRKD

SEQ ID NO: 8858 - protein, 37 aa, Piromyces finnis
  Dockerin_dom_fun
IIRIGYVCCDHCQSNYEDEFGKWYHTNNHDWCALKPS

SEQ ID NO: 8859 - protein, 35 aa, Piromyces finnis; identical to SEQ ID NO: 6168
  Dockerin_dom_fun

SEQ ID NO: 8860 - protein, 40 aa, Piromyces finnis; identical to SEQ ID NO: 6170
  Dockerin_dom_fun

SEQ ID NO: 8861 - protein, 40 aa, Piromyces finnis
  Dockerin_dom_fun
ECWSEEFGYKCCKKSCTVFEIDNDGKWGYEDGNWCGIPSS

SEQ ID NO: 8862 - protein, 34 aa, Piromyces finnis
  Dockerin_dom_fun
NQCTFESIGYNCCTTTCNVIYTDENGDWGIENNE

SEQ ID NO: 8863 - protein, 34 aa, Piromyces finnis; identical to SEQ ID NO: 3659
  Dockerin_dom_fun

SEQ ID NO: 8864 - protein, 40 aa, Piromyces finnis
  Dockerin_dom_fun
CWSHKYGYPCCSEGTCHIFTSDENGDWGYENGRWCGILPS

SEQ ID NO: 8865 - protein, 31 aa, Piromyces finnis; identical to SEQ ID NO: 3662
  Dockerin_dom_fun

SEQ ID NO: 8866 - protein, 39 aa, Piromyces finnis; identical to SEQ ID NO: 6175
  Dockerin_dom_fun

SEQ ID NO: 8867 - protein, 34 aa, Piromyces finnis
  Dockerin_dom_fun
CWSEPLGYPCCSIEAKPSDEASIWGWENEEWCGM

SEQ ID NO: 8868 - protein, 38 aa, Piromyces finnis
  Dockerin_dom_fun
ECFAEKLGKPCCTETLDVVRVDENGQWGMENGQFCGLQ

SEQ ID NO: 8869 - protein, 20 aa, Piromyces finnis
  Dockerin_dom_fun
QDESGKWGIENNQWCGIKYS

SEQ ID NO: 8870 - protein, 40 aa, Piromyces finnis
  Dockerin_dom_fun
DCWSEELGYACCKKTCTIFEIDENGEWGFEDDKWCGIPSS

SEQ ID NO: 8871 - protein, 35 aa, Piromyces finnis
  Dockerin_dom_fun
ETIGYNCCPLEVSTVFYTDSYGNWSYNYKLKEWCG

SEQ ID NO: 8872 - protein, 41 aa, Piromyces finnis; identical to SEQ ID NO: 8308
  Dockerin_dom_fun

SEQ ID NO: 8873 - protein, 41 aa, Piromyces finnis
  Dockerin_dom_fun
NKCFSENLGYSCCEECNVVYTDNDGKWGYENNEWCGIIKSI

SEQ ID NO: 8874 - protein, 18 aa, Piromyces finnis
  Dockerin_dom_fun
GDWGYENGMWCGINTSQC

SEQ ID NO: 8875 - protein, 41 aa, Piromyces finnis; identical to SEQ ID NO: 8873
  Dockerin_dom_fun

SEQ ID NO: 8876 - protein, 21 aa, Piromyces finnis
  Dockerin_dom_fun
KCFSEVLGYPCCNECSIIYSD

SEQ ID NO: 8877 - protein, 36 aa, Piromyces finnis
  Dockerin_dom_fun
SCWSEVYGYSCCRETTTVITSDSKGNWGAENGEWCG

SEQ ID NO: 8878 - protein, 36 aa, Piromyces finnis; identical to SEQ ID NO: 6186
  Dockerin_dom_fun

SEQ ID NO: 8879 - protein, 38 aa, Piromyces finnis
  Dockerin_dom_fun
CFSRNLGFNCCENESTSVFFVDDNGSWGVENDEWCGLS

SEQ ID NO: 8880 - protein, 34 aa, Piromyces finnis; identical to SEQ ID NO: 8867
  Dockerin_dom_fun

SEQ ID NO: 8881 - protein, 39 aa, Piromyces finnis; identical to SEQ ID NO: 8365
  Dockerin_dom_fun

SEQ ID NO: 8882 - protein, 39 aa, Piromyces finnis; identical to SEQ ID NO: 5714
  Dockerin_dom_fun

SEQ ID NO: 8883 - protein, 23 aa, Piromyces finnis
  Dockerin_dom_fun
IYTEDDGNWGLENDQWCGIDEEK

SEQ ID NO: 8884 - protein, 31 aa, Piromyces finnis; identical to SEQ ID NO: 6141
  Dockerin_dom_fun

SEQ ID NO: 8885 - protein, 39 aa, Piromyces finnis; identical to SEQ ID NO: 6142
  Dockerin_dom_fun

SEQ ID NO: 8886 - protein, 40 aa, Piromyces finnis; identical to SEQ ID NO: 6194
  Dockerin_dom_fun

SEQ ID NO: 8887 - protein, 40 aa, Piromyces finnis
  Dockerin_dom_fun
SCWSSSLGFPCCSGKVVVEYTDASGRWGIQNNNWCGIVNS

SEQ ID NO: 8888 - protein, 29 aa, Piromyces finnis
  Dockerin_dom_fun
DCWSDVLGYSCCSKCLEAVYEDQDGKWGV

SEQ ID NO: 8889 - protein, 36 aa, Piromyces finnis
  Dockerin_dom_fun
CWALAYGYPCCKETTTVLSTDESGTWGYENNTWCGI

SEQ ID NO: 8890 - protein, 38 aa, Piromyces finnis; identical to SEQ ID NO: 6197
  Dockerin_dom_fun

SEQ ID NO: 8891 - protein, 36 aa, Piromyces finnis
  Dockerin_dom_fun
DCWSVEYGFPCCFGSKVIATDYNGDWGYENNQWCGM

SEQ ID NO: 8892 - protein, 26 aa, Piromyces finnis
  Dockerin_dom_fun
SCWASSLGYPCCKSTKVVIDTDASGR

SEQ ID NO: 8893 - protein, 38 aa, Piromyces finnis; identical to SEQ ID NO: 8471
  Dockerin_dom_fun

SEQ ID NO: 8894 - protein, 31 aa, Piromyces finnis; identical to SEQ ID NO: 8443
  Dockerin_dom_fun

SEQ ID NO: 8895 - protein, 30 aa, Piromyces finnis; identical to SEQ ID NO: 3690
  Dockerin_dom_fun

SEQ ID NO: 8896 - protein, 37 aa, Piromyces finnis; identical to SEQ ID NO: 3391
  Dockerin_dom_fun

SEQ ID NO: 8897 - protein, 31 aa, Piromyces finnis; identical to SEQ ID NO: 8588
  Dockerin_dom_fun

SEQ ID NO: 8898 - protein, 38 aa, Piromyces finnis; identical to SEQ ID NO: 6197
  Dockerin_dom_fun

SEQ ID NO: 8899 - protein, 36 aa, Piromyces finnis; identical to SEQ ID NO: 8889
  Dockerin_dom_fun

SEQ ID NO: 8900 - protein, 38 aa, Piromyces finnis; identical to SEQ ID NO: 3696
  Dockerin_dom_fun

SEQ ID NO: 8901 - protein, 32 aa, Piromyces finnis
  Dockerin_dom_fun
FPCCSDNTEIIYTDEEGNWGLENDEWCFINKS

SEQ ID NO: 8902 - protein, 32 aa, Piromyces finnis; identical to SEQ ID NO: 8901
  Dockerin_dom_fun

SEQ ID NO: 8903 - protein, 41 aa, Piromyces finnis; identical to SEQ ID NO: 6209
  Dockerin_dom_fun

SEQ ID NO: 8904 - protein, 40 aa, Piromyces finnis; identical to SEQ ID NO: 6211
  Dockerin_dom_fun

SEQ ID NO: 8905 - protein, 23 aa, Piromyces finnis
  Dockerin_dom_fun
AYPCCNECEVIYTDNDGDWGVEN

SEQ ID NO: 8906 - protein, 36 aa, Piromyces finnis; identical to SEQ ID NO: 5946
  Dockerin_dom_fun

SEQ ID NO: 8907 - protein, 16 aa, Piromyces finnis
  Dockerin_dom_fun
GKWGVENSDWCGIVDS

SEQ ID NO: 8908 - protein, 41 aa, Piromyces finnis; identical to SEQ ID NO: 8486
  Dockerin_dom_fun

SEQ ID NO: 8909 - protein, 40 aa, Piromyces finnis; identical to SEQ ID NO: 6216
  Dockerin_dom_fun

SEQ ID NO: 8910 - protein, 31 aa, Piromyces finnis; identical to SEQ ID NO: 8323
  Dockerin_dom_fun

SEQ ID NO: 8911 - protein, 103 aa, Neocallimastix californiae
  DPBB_1
YDNYLSCGECYELEITQEDGSLYPEDNRRSENIIAQIVDSCPCSANAKWCCGSGIDHCNEIDFKYGCPIPEGSVHFDLSDIAMARLQTNDPNGGMVEGVIPIR

SEQ ID NO: 8912 - protein, 55 aa, Neocallimastix californiae
  DPBB_1
AAMNLPQYNISAGCGSCLILAQADKPERVIRVRVVDRCGECPKGDIDLSNTAWKA

SEQ ID NO: 8913 - protein, 67 aa, Neocallimastix californiae
  DPBB_1
AALNNKQYNTDMGCGLCAVVVSTSNPYKPIRVRIIDQCPECAHGSLDFSDKAFKALSNKTPDRIKIT

SEQ ID NO: 8914 - protein, 103 aa, Neocallimastix californiae
  DPBB_1
YDNYLSCGECYELEITQEDGSLYPEKQRRSENIIAQIVDSCPCSANAKWCCGSGIDHCNEIDFKYGCPIPEDSVHFDLSDIAMARLQTNDPNGGMVEGVIPIR

SEQ ID NO: 8915 - protein, 103 aa, Anaeromyces robustus; identical to SEQ ID NO: 8914
  DPBB_1

SEQ ID NO: 8916 - protein, 55 aa, Anaeromyces robustus
  DPBB_1
AAMNLPQYNISAGCGSCLILAQADKPDRVIRVRVVDRCGECPKGDIDLSNTAWKA

SEQ ID NO: 8917 - protein, 67 aa, Anaeromyces robustus
  DPBB_1
AALNNKQYNLDMGCGLCAVVVSTSNPYKAIRVRIIDQCPECEHGSLDFSDKAFKALSNMDPARIKIT

SEQ ID NO: 8918 - protein, 55 aa, Piromyces finnis; identical to SEQ ID NO: 8912
  DPBB_1

SEQ ID NO: 8919 - protein, 67 aa, Piromyces finnis
  DPBB_1
AALNNKQYNDDMGCGLCAVVVSTSNPYKAIRVRIIDQCPECEHGSLDFSDKAFKALSNKTPDRIKIT

SEQ ID NO: 8920 - protein, 56 aa, Neocallimastix californiae
  DUF1729
ICVLDEEFHVWLKRDSLWQAEDLDAVVDQDPQRVAILQGPVAIRHSKIANQPVKEI

SEQ ID NO: 8921 - protein, 56 aa, Neocallimastix californiae
  DUF1729
IPNMDKQFKYWFKKDSLWQSEHLEAVVGQDPGRVCVLQGPVAVRHSTKANEPISSI

SEQ ID NO: 8922 - protein, 56 aa, Neocallimastix californiae; identical to SEQ ID NO: 8921
  DUF1729

SEQ ID NO: 8923 - protein, 56 aa, Neocallimastix californiae; identical to SEQ ID NO: 8921
  DUF1729

SEQ ID NO: 8924 - protein, 56 aa, Neocallimastix californiae
  DUF1729
ICVLDDEFHVWLKRDSLWQAEDLDAVVDQDPQRVAILQGPVAIRHSKIANQPVKEI

SEQ ID NO: 8925 - protein, 56 aa, Anaeromyces robustus
  DUF1729
ICVLDEEFHVWLKRDSLWQAEDLDAVVDQDPQRVAILQGPVAIRHSKIANQPVKDI

SEQ ID NO: 8926 - protein, 56 aa, Anaeromyces robustus
  DUF1729
IPNMDKSFKYWFKKDSLWQSEHLEAVVGQDPGRVCVLQGPVAVRHSTKANEPISSI

SEQ ID NO: 8927 - protein, 56 aa, Piromyces finnis
  DUF1729
IPIMDKSFKYWFKKDSLWQSEHLDAVVGQDPGRVCILQGPVAVRHSTKANEPIGSI

SEQ ID NO: 8928 - protein, 56 aa, Piromyces finnis; identical to SEQ ID NO: 8927
  DUF1729

SEQ ID NO: 8929 - protein, 56 aa, Piromyces finnis; identical to SEQ ID NO: 8927
  DUF1729

SEQ ID NO: 8930 - protein, 56 aa, Piromyces finnis; identical to SEQ ID NO: 8927
  DUF1729

SEQ ID NO: 8931 - protein, 242 aa, Neocallimastix californiae
  DUF303
HIYLAFGQSNMEGQGPIGSQDRTVDKRFQMISTVSGCNGRQMGNWYDAIPPLANCDGKLGPVDYFGRTLVKNLPQEIKVGVAVVAVAGCDIQLFEKNNYRNYRLESYMQGRVNAYGGNPYGRLIEVAKKAQQVGVIKGILLHQGETNTGQQNWPNRVKAIYEDMLKDLGLNAKDVPLLAGEVVQSNQGGQCGSMNSIIQRLPSVIPTAHVISSQGLGQQGDGLHFSSQAYRTFGERYANEML

SEQ ID NO: 8932 - protein, 242 aa, Neocallimastix californiae
  DUF303
HIYLAFGQSNMEGQGPIEPQDRIPEKRYQVLSTFGNCDGREVGKWYDAVPPLARCFARVGPMDYFGRTLAKKLPEEIKIGAVIVAVGGCSIQLFEKDNYMNYKLENYMVDVVKNYGGNPYKRLIDVAKLAQKDGVIKGILLHQGESNNGQTNWPYRVKAVYENILNDLGLKAEEVPLLAGEVVQTSEGGQCGGMNKIINTLPNVIPTAHVVSSVGLKQQGDGYHFSTEAYREFGERYAEEML

SEQ ID NO: 8933 - protein, 242 aa, Neocallimastix californiae
  DUF303
HIYLAFGQSNMQGDGKIENQDRVVDKRFKMLATAGGCNNRRVGEWYDAIPPLANCAGGLGPVDYFGRTLLKKLPEQIKVGVAVVAVAGCDIQLFEKDNYRSYNMPDWMVGIVNGYNGNPYGRLIEMGKKAKEAGVIKGILLHQGETNTGQQDWPDRVKKIYQNIINDLSLNADEVPLLVGEVVNADSGGACAYHNEVIKRVPQLIKNSYVISSKGLPQKGDGLHFTSAGYRTFGERFADTML

SEQ ID NO: 8934 - protein, 242 aa, Neocallimastix californiae
  DUF303
HIYLAFGQSNMQGAGQIANQDKTVDKRFQMLATAGGCNNRQVGNWYDAIPPLAHCGGGLGPVDYFGRNLIKNLPSQIKVGVVVVAVAGCDIQLFEKDNYRSYNMADWMKSIVNSYGGNPYGRLVEMGKKAQQAGVIKGILFHQGETNSGQQNWPNRVKGIYDNLIKDLGLKASEVPLLAGELVSSAKGGVCGGHNSIIQRLPQVIPNAHVISSSGLDQQGDGLHFTSAAYRTFGQRFAETML

SEQ ID NO: 8935 - protein, 241 aa, Neocallimastix californiae
  DUF303
HIYLAFGQSNMEGAGPIENQDRQVDKRFKMLSTVSGCGRQLGNWYDATPPLAHCGGKLGPVDYFGRNLVKNLPEQIKVGVVVVAVAGCDIQLFEKNNYKSYNMPDWMRNTVQNYGGNPYGRLVDMAKKAQQEGVIKGILLHQGETNSGQQNWPNRVKDIYNNLIKDLGLNANDVPLLAGEVVSSEQGGSCGGHNSIIQKLPSVIPTAHVISSKGLGQQGDGLHFTSASYRTFGQRYADEML

SEQ ID NO: 8936 - protein, 244 aa, Neocallimastix californiae
  DUF303
HIYLAFGQSNMEGQGPIEAQDKTVDSRFKMLSTVDGCNNRSLGEWYEAIPPLANCDGRLGPVDYFGRTLVKKLPEQIKVGAVVVAVAGCDIQLFEKDNYIEYSKEQPDWMVGRINAYGGNPYGRLVDMAKKAQEVGVIKGILFHQGETNNGQVTWPSRVKAVYNDLLSDLGLKAENVPLLAGEVVPESVNGLCAAMNDIIKTLPETIPTAHVISSEGLEPQDDNLHFSSAAYRTFGERYAETML

SEQ ID NO: 8937 - protein, 242 aa, Neocallimastix californiae
  DUF303
HIYLAFGQSNMQGAGQIENQDKTVDKRFQMIATAAGCNNRRVGEWYDAIPPLAHCGGGLGPVDYFGRTLVKKLPEQIKVGVAVVAVAGCDIQLFEKNNYRSYNMADWMKGIVDSYGGNPYGRLIDMGKKAQQVGVIKGILLHQGETNNGQSDWPNRVKAIYEDILKDLSLKAEEVPLLVGETVDSDSGGVCGYHNSVIARIPQVIKNGHVISSKGLGQQGDGLHFTSAAYRTFGERYADTML

SEQ ID NO: 8938 - protein, 242 aa, Neocallimastix californiae
  DUF303
HIYLAFGQSNMEGNGPIESQDRTVDKRFKMLATVSGCNNRQAGNWYDATPPLANCNGKLGPVDYFGRTLVKKLPQEIRIGAVVVAVAGCDIQLFEKDKYRSYQQPDWMRGIVQQYGGNPYGRLIEMAKKAQQEGIIKGILLHQGETNTGQQDWPNRVKGIYENILNDLGLKAEDVPLLAGEVVSSAVGGQCGSHNAVIQRLPSVIKTAHVISSQGLQHQGDGLHFTSAAYRTFGERYAEEML

SEQ ID NO: 8939 - protein, 242 aa, Anaeromyces robustus; identical to SEQ ID NO: 8937
  DUF303

SEQ ID NO: 8940 - protein, 242 aa, Anaeromyces robustus; identical to SEQ ID NO: 8938
  DUF303

SEQ ID NO: 8941 - protein, 242 aa, Anaeromyces robustus
  DUF303
HIYLAFGQSNMYGSGDIEEQDKTVDSRFQMVSTVNDCGSRKLGTWYDAIPPLATCDAGLGPADYFGRTLVETLPKEIKVGIAVVAVPGCDIQLFEKDNYQNYFPDDWMYPFIDEYGGNPYGRLVEMGKQAKELGVIKGILLHQGETNNEQTDWPLRVKAIYENLLTDLELKAEEVPILIGELVQLSENGTCGAMNAIIQTVPSVIPTAHVISSEGLKQRGDGFHFTSPSYRVFGQRYAEVML

SEQ ID NO: 8942 - protein, 241 aa, Anaeromyces robustus
  DUF303
HIYLAFGQSNMEGAGPIEGQDKTVDKRFQMLSTTSCNGRQMGNWYDATPPLAHCGGKLGPVDYFGRTLVKKLPEQIKVGVVVVAVAGCDIQLFEKDNYKSYNMPDWMRNTVQNYGGNPYGRLVEMAKKAQQSGVIKGILLHQGETNSGQQNWPGRVKAIYNNLLTDLGLNANDVPLLAGEVVSSGQGGSCGGMNSIIQSLPQTIPTAHVVSSDGLGQQGDGLHFTSASYRTFGERYANEML

SEQ ID NO: 8943 - protein, 242 aa, Anaeromyces robustus
  DUF303
HIYLAFGQSNMEGQGPIGQQDRSVDKRFQMISTVNGCNGRRLGEWYDAVPPLSSCSGKLGPVDYFGRTLVKKLPQEIKVGVAVVAIAGCDIQLFEKNNYRNYQLQSYMVNTVNAYGGNPYGRLIEMGKKAQQVGVIKGILLHQGETNTGQQNWPNRVKAIYEDILKDLGLNAKDVPLLAGEVVSSQQGGQCGSMNSIIQSLPRTIPTAHVISSQGLGQQGDGLHFSSDAYRTFGQRYAEEML

SEQ ID NO: 8944 - protein, 241 aa, Anaeromyces robustus
  DUF303
HIYLAFGQSNMLSGDIESQDKNVDSRFKMISTVNDCGNRRQGEWYTAVPPLASCNAGLGPVPYFGNTLVEKLPKEITVGVAVVGIAGCDIQLFEKDRYQSYEHADWMTGYINEYGGNPYGRLVESGKIAQKSGVIKGILVHQGETNNGNQDWPKRLKGVYENLLKDLSLKAEEVPLLVGELVQSNKGGICGDMNSIIQRVPEVIPTAHVVSSEGLEQQGDGFHFTSASHRILGKRYAEVML

SEQ ID NO: 8945 - protein, 243 aa, Anaeromyces robustus
  DUF303
HIYLAFGQSNMEGRGKIYQEDKTVDSRFQMIATVDGCKGRKFGEWNDAIPPLSNCNMGQLGPADYFGRTLVKKLPHEIKIGIAVVAIGDCDIQLFEKTKNRNYRIPNEIKNTYEAYGRNSYSRLIEMGKKAQEVGVIRGILLHHGENNIGQTDWPNRVKAIYDNILNDLDLNSDDVPLLAGEVVSSEKGGKYGEMNPIIHNLAKICSTCHIISSQNLDSEDDGFHFTTNAYRTLGERYAEEML

SEQ ID NO: 8946 - protein, 134 aa, Piromyces finnis
  DUF303
TYYIDEYGGNPYGRLVDMGKIAQKSGVIKGILVHQGETNNGNQDWPKRLKGVYENLLTDLGLKAENVPLIVGELVQSDKGGICGGMNNIIQTVPEVIPTAHIVSSEGLEQQGDGFHFTSASHRILGKRYAEVML

SEQ ID NO: 8947 - protein, 242 aa, Neocallimastix californiae
  DUF4353
GATASNGVVTISAAGTYIVAGSLNGQLRIEATENDYIHIILNSATISSSSGPAIYGIAADKVTITLVGDSKLSDTTNYTVVDEEPDACLFIDADLAINGSGSVSVTGNYSDAIRCKKDLRLISGKITVPKATQRGIKAKNSICIKDATIDVTSSNSGIKVTRDDDAEKGYIVIDGGSTSVSTENDGIHAETHLTINGGYVDVKKSGEGLEGQMIDIIGGEVHVLSKDDGINASKIKDSTQTS

SEQ ID NO: 8948 - protein, 273 aa, Anaeromyces robustus
  DUF4353
ASASDGLVTIKAAGTYIVQGSLNGQLRIEATKDDYIHLILSDATITSSDGPAIYGVSASRVTLTLVGSNELIDSSNYTVVEDEPDACLFIGSDLSINGSGSLNVTGNYSDAIRCKKDLKFVSGNVIIPNAIQRGIKTKNYLCVKEANIDVNSKNTGIKVTRDDDPEKGFVSIEGGKVTVETDNDGIHAETHLTISGGYVDVKRCGEGLEGQMIDIIGGEVHIVSTDDGINASKIRDSTQTGNWGWGGPTGTDGSVYINIVGGKTYITVQGRDV

SEQ ID NO: 8949 - protein, 232 aa, Piromyces finnis
  DUF4353
GATASSGKVTITSAGTYIVQGSLNGQVLIEATKEDFIHLVLNSVTIKSTNGPAIYGTAASKVVITLVGDNTLSDSNNYSAVNGEPDACIFIDSDVSINGSGSINVTGNYNDAIRCKKDLKLISGKITIPKATQRGIKAKNSICILDADIDITSQNSAIKVTKDDDPEKGFVVIDGGKINISTGKDAIHAETHLTIRDGYINVKKCEEGIEGQMVDILGGEIHVFAYNDAINA

SEQ ID NO: 8950 - protein, 197 aa, Neocallimastix californiae
  ECH
TDRLVHVIFNRPEANNSFTEDMLIRLMEAYDPNKILFIESKGKNFSTGWDLNGGDFGSEAFEQSIEKYSQFVKQLEGAIQPIVVVCQGSCRGGSMLFPLMADYVIAYEDANFGFPEVRRGGIPALVSVAALKKFSRTIAKRMMLLGEPIQVEEAKKCNLVDYICHTKEQCNELIKKLFQQFITDRTNLINLREFEFD

SEQ ID NO: 8951 - protein, 201 aa, Neocallimastix californiae
  ECH
YDLEEGIAVIEMCSPQNFNGMNLDISRQLHAHVNTLKMRKDVKCVIVRGYRRHFCTGADPSWVANIEGKTHLRMALEVYEIYRDYASILELNVPVIGMLNGRIVGGGLALSLNCDWRVALKTSTIDFGNLPRGVCPGMMLSVNMESYVKRGRSFNMYLQPGSYGMTMEEALSIGIIQEIADSFEDLQEKAIRKAREIVQAS

SEQ ID NO: 8952 - protein, 197 aa, Neocallimastix californiae
  ECH
TDKIVILTLNRPESMNDLHTGMIKKIIQAIDVQKSLIIENAGDNFCMGWSSLNAETETIESVYHYYSELINKMNSVTQPIISICKGIVFGGGMIFPCMSDIVIADNNTTFSFYESTFKQMPFILTKAAQNRIKSSHIKKMFLIEKEANIEEAINMELVDIAVASNKLEMEKKSVIRRINTLDPSVLKITKENINDTE

SEQ ID NO: 8953 - protein, 203 aa, Neocallimastix californiae
  ECH
KTNIINLEVASQIGNSFEQMKEKNDAHVLIIKNASNDFCQGFDAEFLNSISGKSKSQLANEIYHIYKNYSKTYELTIPVLCCLSGSVMNAGLNLALTSDWRVASRESCLSFINKSNTVDSSVMMSHSLQDFVGRGKSFNILFNYDNKTSNAVEAYKQGIVQELVANPNQLMDIALTKARVIASAPLKGINHSLNLMRIPYENS

SEQ ID NO: 8954 - protein, 201 aa, Anaeromyces robustus
  ECH
YDLEEGIAVLEMCSLKNFNGMNLDISRQLHAHVNTLKTRKDIKCVILRGYKRHFCTGADPSWVANIEGKSHLRMALEVYEIYRDYASILELNVPVIGMLNGRIVGGGLALSLNCDWRVALKTSTIDFGNLPRGVCPGMMLSANMESFVKRGYSFNMYLQPGSYGMSMEEALELGIIQEIAESFEDLQEKALLKAREIVKAS

SEQ ID NO: 8955 - protein, 198 aa, Anaeromyces robustus
  ECH
DRLVHVVFNRPEANNSFNGDMLIKLMDAYDPNKILLIESQGKNFSTGWDLNNGGFNSQAFEDSINKYSEFVERLENAVQPIVVICQGSCRGGSMLFPLMADYVIAYKDASFGFPEVRRGGIPALVSVAAMKKLSRTMAKRMMLLGEPIQVEEAKNTNLVDYICNTKEECNQIVKNLFNQFITNHIHLLNLRETESSFN

SEQ ID NO: 8956 - protein, 201 aa, Anaeromyces robustus
  ECH
NTNIINLEVAAQIGHAIDIMKQKNDAHVLIIKSAAPDFCQGFDAEYLNSISGKSKSQLANEIYNIYKNYNKNSELTIPVLCCLSGSVMNAGLNLALSSDWRVASRESCLSFINKNNTVDSSVMMSHSLQEFIGRGKSFNMIFNYDNKKSNVLEAYKQGIVQELVANPGQLMDIALAKARIIASAPLKGINHSLNLMRIPYD

SEQ ID NO: 8957 - protein, 204 aa, Anaeromyces robustus
  ECH
TDKIVFITLNRSESMNDLNNKMIEKIIEAIDPQKSLIIDSTGDHLSMGWTSNESKSDTIENVYHIYGKLMDKMSEVTQPIVTICKGAVFGGGMIFPCMSDIVIADNNATFSFYETNFKQIPFILTKAAQNRIKNSQIMKMFLIEKEAEVNEARNMELVDIIVNSDKLDNEKKSVIRRINTLDSSVLKITKENIKDNGLTLESAL

SEQ ID NO: 8958 - protein, 201 aa, Piromyces finnis
  ECH
KTNIINPEIAAQIGNAFEQMKEKDDAHVLIVKCNGDDFCQGFDAEFLNSISNKTKGQLANEIYNIYKNYSKSSELTIPVLCCLNGSVMNAGLNFALTSDWRVATRETCLSFINKTKTVDSSVMMSHSLQDFIGRGKSFNMIFNYDNTTNNAIEAHKQGIIQELVANQSQLLDAALVKARIIASAPLKGINHSLNLMRIPYD

SEQ ID NO: 8959 - protein, 200 aa, Piromyces finnis
  ECH
EKVVFLTLNRPGSMNDLHANMMRKIISAIDTQKALVIEGSGDNFCMGWTSSSMNKHETTENIYQLYGELIKKMNKVTQPIVTICKGVVFGGGMIFPCMSDIVIAENNAVFSFYENRLKQIPFILSKAAQNRIKHSQIKKMFLIEKEADIEEAINMELVDISVPADKLEMEKKSVLRRINTLDPTVLKITKENIKDAELSL

SEQ ID NO: 8960 - protein, 15 aa, Anaeromyces robustus
  EGGSHELL
FGGGGFDMGGFGGGF

SEQ ID NO: 8961 - protein, 10 aa, Anaeromyces robustus
  EGGSHELL
FDMGGFGGGF

SEQ ID NO: 8962 - protein, 9 aa, Anaeromyces robustus
  EGGSHELL
MKALSVLTL

SEQ ID NO: 8963 - protein, 11 aa, Anaeromyces robustus
  EGGSHELL
GGFGGGFGGDM

SEQ ID NO: 8964 - protein, 75 aa, Neocallimastix californiae
  Endo-1-4-beta-glucanase_dom2
MHWIIDGDNWYGYGQQADGKSKPSFINTFQRGSSESTWKTVPHPCWEEFKWGGRNGFLDLFTGDNNYAKQWRYTA

SEQ ID NO: 8965 - protein, 478 aa, Neocallimastix californiae
  ENDO-1,4-BETA-GLUCANASE
FSSVIATIAALVAPMTAVAKSQDYARHIELSLLFYEAQRSGKLPEDNRIYWRHDSELEAGADHGVDLTGGYYDAGDNAKFNFPAASTMTLLAWSGIDYAEGYKNAGQWKYILDAVRWGADYFIKCHTGKTELYAQVGDGNTDHSFWYPPEYVQYDYPSFKVTAQEPGSEVAGETAAFLAAASILFKDEDPSYSATLLKHSKEIYDFADKYRGDYTVAVPAVSFYNTYSGYMDELAWGAAWLLRATGDESYLDKYNVIANKKYESYDPKKFTGATGPISWDDKRPGCYILMAMITGDEKRINEAYSYCDAVLTQPRTKGGLWYDDGLSIWGSNRYASNAASMLGMFANYLPKSDPKRAKYVEFVKQQTDYILGDNPAKINYVVGAEANSPKAVHHRGASGVFDSQDKAAKPDENIYTLWGALAGGPDKNDKFVDSRKDYQMSEVALDYNAAFQMNLAFLTKEGLSKPDPDSVKIHERSY

SEQ ID NO: 8966 - protein, 479 aa, Neocallimastix californiae
  ENDO-1,4-BETA-GLUCANASE
ISIISAIAALVAPMSVVAKSQDYARHIELSLLFYEAQRSGKLPENNRIYWRHDSLLDAGADNKVDLTGGYYDAGDNVKFNFPAAAALTLLAWSGIDYADGYKKAGQWDYLLDAVKWGADYFLKCHTGKNELYVQVGKGATDHGFWYPPEYVQYEYPSYKITSSAPGSEVAGDTASFLAASSILFKDVDSSYSATLLKHAKEIYDFADTYRGEYIKAVPDAQGFYSNWSGCDDELAFGALWLYRATKDESYMNKFKKIADASYGEQDTKAYGTCSGPISWDDKRPGAYILAAMLTGDEKRKSKAYSYCDAILTQPKTPGGLWYDANLSKWGSNRYASNAAAMVAMFANSLPASDSKRSKYVDFVQKQTDYILGNNPAKVNYVVGAEANSPKAVHHRAASGTYDSQDKNAKPTDYNVFTLWGALAGGPGSKDEYTDTRKNYEMNEVALDYNAAFQMNLAFLTKEGLSKPDPDSVKNHDRSF

SEQ ID NO: 8967 - protein, 477 aa, Neocallimastix californiae
  ENDO-1,4-BETA-GLUCANASE
IIAAIAALASPIAVVAKSQDYARHIELSLLFYEAQRSGKLPENNRIYWRHDSMLDAGADNGVDLTGGYYDAGDNVKFNFPAAAALTLLAWSGVDYADGYKKAGQWDYLLDAVRWGADYFIKCHTGKNELYAQVGRGTTDHGYWYPPEYIQYDHPSYKVTASSPGSEVAGDTASFLAATSILFKDEDPSYSKKCLQHATEIYDFADTYRGDYTGSIPDVSGFYSTWSGYNDELAFGALWLYRATGDESYYEKFKKIADAEYGAQDSKAYGTCTGPISWDDKRPGAYVLAAIITGDEDRLKQAYWYCDNVLTQPRTKGGLWYDSNLSKWASNRYASNAAAMLAMMANYLPKGDARRAKYVDFVKSQTDYILGDNPAGVNFVVGAEANSPKAVHHRGASGTYDSQDVHARPTDYNIFTLWGALAGGPSKDDTYSDTRKDYEMNEVALDYNAAFQTNLAFLVKEGLNVPDSDEVKNHDRAF

SEQ ID NO: 8968 - protein, 183 aa, Neocallimastix californiae
  ENDO-1,4-BETA-GLUCANASE
MVTGEDKYKEQAFNHSDLMVNYKTTPGGLWFDTNLSAWGSNRYASNAAYTVAMVASTMDASDAKRKQYVKFIQKQIDYIQGDNPAKVDYVVGADPSSPKSVHHRGSSGTMNAMAEPPFNVFPLYGALAGGPDGNDKYTDDRTNYNSNEVALDYNAAYTGLLAFLIQEGLNVPDPEQTWEGAWP

SEQ ID NO: 8969 - protein, 450 aa, Neocallimastix californiae
  ENDO-1,4-BETA-GLUCANASE
DYARILNLNLRFYECNWSGKAPEHKQVYWRYDSALEDGADVGLDLTGGYYDAGDHVKFNLPMSYAMTMLAWGGIDLYDNYVAAGQIDYLVQIVNHGADYFVKCHPEKEVIYAQVGLGDVDHCFWVPPELMTMERPAVCKLTPENGASDVTAQMAAALASASILNKMVGNTEKSELYLKHAIEIYDFADKYRDVYGNPCPEGASFYPSASYKDELVWGAAWVYRASGDEKYYEKADSYYDSLGLSGRVLIGPISWDDASSGIIFLMSKPGFGSNWKRYLGEAQTYVDQYLNDKSARTDAGMLWYSAVSGWGSARHAMAGVFLYCIFNTYHKPTDPKYFNFIQQQADYILGNNPFNRSLVVGSIPGHDPLNVHHRGSHGGYSPISLPEHNMYTLYGALAGGPLQDDSWDDDRNNYITNEVSCDYNAGVTGVMAYLTPWTVPDNFEIDESEPE

SEQ ID NO: 8970 - protein, 476 aa, Neocallimastix californiae
  ENDO-1,4-BETA-GLUCANASE
SIIATIAALVAPMTVVAKSQDYARHIELSLLFYEAQRSGKLPENNRIYWRHDSELEAGADNGVDLTGGYYDAGDNAKFNFPGAATMTLLAWSGVDYAEGYKNAGQWEYLLDAVRWGADYFMKCHTGKTELYAQVGDGNTDHSFWYPPEYVQYEYPSFKVTADAPGSEVAGETAAFLAAASILFKDEDPTYSATLLKHSKEIYDFADKYRGDYTVAVPAVSFYNTYSGYMDELAWGAAWLLRATGDESYLEKYNVIANKKYESYDPKKFTGSTGPISWDDKRPGCYILIAMITGDEKRINEAYNYCDAVLTQPRTAGGLWYDDGLSIWGSNRYASNAASMVAMFANYLPESDPKRAKYVEFVKQQTDYILGDNPAKINYVVGAEANSPKSVHHRGASGVFDSQDKAAKPDENIYTLWGALAGGPDKNDKFVDSRKDYQMSEVALDYNAAFQMNLAFLTKEGLSIPDPDSVKVHERSY

SEQ ID NO: 8971 - protein, 481 aa, Neocallimastix californiae
  ENDO-1,4-BETA-GLUCANASE
DYARILNLNLRFYECQWSGKAPEHKQVYWRYDSALEDGADVGLDLTGGFYDAGDHVKFNLPMSYAMTMLAWGGIDLYDNYVAAGQIDYLLQMVNHGADYFVRCHPEKEVIYAQVGVGDVDHCFWVPPELMTMERPTVCKLTPENGASDVTGQMAAALASASILNKKYGNTEKAELYLKHAIEIFDFADKYRDVYNNPCPEGASFYPSASYKDELVWGAAWVYRASGDEKYYQKADEYYDSLALSGRNLIGPITWDDASSGIVFLMSKPGFGSNWERYLGEAQHYVDQYLNDKGARTDGGMLWYSSVSGWGSARHAMAGTFLYCIFNTYHKPTDPKYFNFIQEQADYILGNNPFNRSLVVGSIPGYEPLNVHHRGSHGGYSPLSPPEHNMYPLYGALAGGPLQNDFWDDDRNNYVTNEVACDYNAGITGVMAYLTPWTVSDNFDIDDSEPEADAHLIIAIEKTWEDVYRLVANISTNLPTPA

SEQ ID NO: 8972 - protein, 470 aa, Neocallimastix californiae
  ENDO-1,4-BETA-GLUCANASE
ILTIFVSVPALIKAASQDYARHLELSILFYEAQRSGKLPDNNRIYWRGDSMLEAGSDNKVDLTGGYYDAGDNIKFNFPQASSLTLLSWSAVEWKDGYKQAGQWEYMKDLIKWGMDYFIKCHTDKYVLYGQVGNAKLDHNSWVSPENISYDYPSYKITDSSPGSDLAAETSAALVAASMVFRDEDPNYADLLLKHGKELYEFADKYRGSYDESIPEANDYYHSNSYNDELVWGAAWLFRATGEEYYKSKVDAIWDYPYDENDSNKFLDSKNPISWDDKKASSYTLMAMITGDQKYLKEATTHSDLMVNHTTTPGGLWYNENLSVWGSNRYASNAAFTVAMMTSIMNDDDSKRQEYIDFVKKQTDYILGDNPAKIDYVVGAAPNSPKAVHHRGASGTKDVYENPDENTYVLYGALAGGPGPKDEYKDIREDYQKNEVALDYNAAFQGLLAFLIQEGYNLPDPKQTWEGAWPP

SEQ ID NO: 8973 - protein, 464 aa, Neocallimastix californiae
  ENDO-1,4-BETA-GLUCANASE
ILSIAAAAGSAFAASQDYARHLELNFLFYEAQRSGPLPSTNRIPWRGDSGLDHGSDVGVDLTGGYYDAGDNVKFNFPQAFSMTAISWMGIEFAKGVEMANQTEYLKDTVKWGCDYLLKCHEKGTDVFYMQVGDGDIDHQYWKAYENIDYPTPTFFVDSKNPGTEVTGETAAAFAAASILFKDSDPEYSATLLDQAKEWYEFADKYQFDYSQSVPAAGSYYKSYNGYNDELAWAAIWLYRALGDEAYLEKAKSLVANYKLSEVGIDWDSKYQGVIVILAQLGVKEYVEKVEAWVKDICTNGKFSPGGLYINKDSEWGSNRRATAMAASLIYYTHNLPEGNELREMAKKFAKSQADYIQGANPLGIDYVVGADETSPRSVHHRTASGAACIECDPVQNVHIIYGALAGGPDVEDNYLDDRADYKKNEVALDYNVCYAAVLAYLVEEGLNVEDPIPAWEYDYRITKG

SEQ ID NO: 8974 - protein, 474 aa, Neocallimastix californiae
  ENDO-1,4-BETA-GLUCANASE
FSKILTTILTCAPALIKAASQDYARHLELSILFYEAQRSGKLPANNRIFWRHDSMVDAGKDNNVDLTGGYYDAGDNVKFNFPQASALTLLAWSAVDWKDGYKEAGQWGYMKDLLKWGMDYFIKCHTSKYELYGQVGNGSLDHGAWVPPEEIDYEYPSYKITASAPGSDLAAETSASMVAASMAFRDDDPEYADILLKHGKELYDFAEKYQGTYDKSITDAKGYYRSYSGFNDELVWGAAWLYRATGDKTYKDKVDKIWDTPYGDLDPDKFLGSGGPISWDDKKAAAYALMALTTGESKYVDESTKHSELMVNYKTTPGGLWYDTNLSMWGSNRYASNAAFTVAMLATSMDANDAKRKEYVKFIKKQIDYIIGDNPAKVDYVVGADPSSPKAVHHRGASGSKGADKGPSENVFVLYGALAGGPGANDNFKDARDNYEMNEVALDYNAAFQGLLAFLIQEGYNVPDPKQTWDGAWP

SEQ ID NO: 8975 - protein, 474 aa, Neocallimastix californiae; identical to SEQ ID NO: 8974
  ENDO-1,4-BETA-GLUCANASE

SEQ ID NO: 8976 - protein, 477 aa, Neocallimastix californiae
  ENDO-1,4-BETA-GLUCANASE
IISAVAALVAPMAVVAKSQDYARHIELSLLFYEAQRSGKLPENNRIYWRHDSMLDAGSDHGVDLTGGYYDAGDNVKFNFPGAASLTLLAWSAIDYADGYKKADQWKYILDAVRWGADYFVKCHTGKNELYVQVGDGQIDHGYWYPPEYIQYKHSSYKITASAPGSEVAGDTASFLAASSILFKEENPTYSATLLKHAIEIYDFADKYRGEYTKAVPDAQGFYANWSGFLDELAFGALWLYRATGDESYMQKFSTIADAKYGEQDSKAYGISTGPISWDDKRPGAYILAAMVTGEEKRLQQAYWYCDSILTQPKTRGGLWYDASLSQWGSNRYASNAAAMLAMFANYLPKSDPKRSKYVDFVKKQTDYILGDNPAKINYVVGAEASSPKAVHHRAASGTYDSQDTNAKPTDYNIFTLWGALAGGPGPKDEYTDSRKNYQMNEVALDYNAGFQMNLAFLTKEGLSKPDSDSVKNHDRAF

SEQ ID NO: 8977 - protein, 194 aa, Neocallimastix californiae
  ENDO-1,4-BETA-GLUCANASE
RDYARILNLNLRFYECQWSGKAPEHKQVYWRYDSALDDGADVGLDLTGGFYDAGDHVKFNLPMSYAMTMLAWGGIDLYDNYVAAGQLDYLLQMVNHGADYFVRCHPEKEVIYAQVGLGAIDHCFWVPPELMTMERPAACKLTPDNGASDVTAQMAAALASASILNKMYGNKEKAELYLKHAIEIYDFADKYRDV

SEQ ID NO: 8978 - protein, 123 aa, Anaeromyces robustus
  ENDO-1,4-BETA-GLUCANASE
SKYVDFVKKQTDYILGDNPAKINYVVGAEASSPKAVHHRAASGTYDSQDTNAKPTDYNIFTLWGALAGGPGPKDEYTDSRKNYQMNEVALDYNAGFQMNLAFLTKEGLSKPDSDSVKNHDRAF

SEQ ID NO: 8979 - protein, 55 aa, Anaeromyces robustus
  ENDO-1,4-BETA-GLUCANASE
GGPGARDDYKDDRTNYNSNEVALDYNAAYTGLLAFLIQEGLNVPDPEQTWDGAWP

SEQ ID NO: 8980 - protein, 474 aa, Anaeromyces robustus
  ENDO-1,4-BETA-GLUCANASE
FSKIIATIAACAPALIKAASQDYARHLELSILFYEAQRSGKLPANNRIFWRHDSMVDAGKDNNVDLTGGYYDAGDNVKFNFPQASALTLLAWSAVEWKDGYKEAGQWEYMKDLLKWGMDYFVKCHTGKTELYGQVGNGSLDHGAWVPPEDIDYKYPSYKITASAPGSDLAGETAAALVASSLAFREDDPEYADLLLKHGKEIYDFADKYRGSYDKSIEDAKGYYRSYSGYMDELVWGAAWLYKATGDETYKKKVDAIWDYPYGDLDPDKFLGSTGPISWDDKKASSYALMAMITGEDKYVKESTTHSDLMVNYKTTPGGLWYDTNLSMWGSNRYASNAAFTVAMLASSMDPNDSKRKQYVKFVQKQIDYIIGNNPAKVDYVVGADPSSPKAVHHRGASGSKGADKGPDENVFVLYGALAGGPGARDDYKDTRNNYEMNEVALDYNAAFQGLLAFLVKEGLNVPDPKQTWDGAWP

SEQ ID NO: 8981 - protein, 477 aa, Anaeromyces robustus
  ENDO-1,4-BETA-GLUCANASE
IITLLSALAAPMAVVAKSQDYARHIELSLLFYEAQRSGKLPENNRIYWRHDSLLDAGADNGVDLTGGYYDAGDNVKFNFPAAATLTLLAWSGIDYAQGYKEAGQWDYLLDAVRWGADYFMKCHTGKNELYVQVGSGRVDHAYWYPPEYVNYDHPSFKITASAPGSEVAGDTASFLAAASILFKDVDSSYSQKCLKHAKEIYDFADTYRGEYTKAVEDAQQFYANWSGFLDELAFGALWLYRATGDESYHNKFKKIADDSYGEQDTKAYGICTGPISWDDKRPGSYILAAMITGEEKRLQQAYWYCDEVLTQPKTPGGLWYNDNLSKWGSNRYASNAAAMLGMFANYLPKSDPKRSKYIDFVKSQTNYILGDNPAKVNYVVGAEANSPKAVHHRGSSGTYDSQDNNAKPTDYNIYTLWGALAGGPGKSDDYSDTRKNYEMNEVALDYNAAFQMNLALLVKEGLSVPDPDSVKNHDRSF

SEQ ID NO: 8982 - protein, 317 aa, Anaeromyces robustus
  ENDO-1,4-BETA-GLUCANASE
RDYARILNLNLRFYECQWSGKAPEHKQVYWRYDSALDDGADVGLDLTGGFYDAGDHVKFNLPMSYAMTMLAWGGIDLYDNYVAAGQLDYLLQMVNHGADYFVRCHPEKEVIYAQVGLGAIDHCFWVPPELMTMERPAACKLTPDNGASDVTAQMAAALASASILNKMYGNKEKAELYLKHAIEIYDFADKYRDVYNNPCPEGASFYPSASYKDELVWGAAWVYRASGDEKYYKKADEYYDSLALSGRNLIGPITWDDASSGIVFLMSKPGFGSNWERYLGEAQHYVDQYLNDMGARTDGGMLWYSSVSGWGSARHAM

SEQ ID NO: 8983 - protein, 479 aa, Anaeromyces robustus
  ENDO-1,4-BETA-GLUCANASE
SILATIAVLASPMAVIAKSQDYARHIELSLLFYEAQRSGKLPENNRIYWRFDSQLDAGADHGVDLTGGYYDAGDNVKFNFPAAAALTLLAWSGVDYADGYKKAGQWDYFLDAIRWGADYFMKCHTGKNELYFQVGDGKIDHTYWYPPEYTVYEHPSLKLTTSKPGSEVASDTASFLAATYMIFKDIDPTYAKKCLQHSKEIYEFADKYRGDYSKSFGNYVNDFYKNWGTINDELAFGALWLYRATGDESYLAKYKVIADASYDSRDESAYPNCSGPISWDDKRPGAYVLGAIVTGEDKYLDKAISYCDAVLTQPKTRGGLWYNNNLSKWGSNRYASNAASMLGMLANYLPKDHPKRSKYIDFVKSQTNYILGDNPAKVNFVVGAEKNSPKAVHHRGASGTYDSQDTNAKPTDHNVYTIWGALAGGPGKDDSYTDTRKNYEMNEVALDYNAAFQMNLALLVKEGLSVPDPDSVKIHDRSF

SEQ ID NO: 8984 - protein, 55 aa, Anaeromyces robustus
  ENDO-1,4-BETA-GLUCANASE
PGARDDYKDDRTNYNSNEVALDYNAAYTGLLAFLIQEGLNVPDPKQTWDGAWPPK

SEQ ID NO: 8985 - protein, 450 aa, Anaeromyces robustus
  ENDO-1,4-BETA-GLUCANASE
DYARILNLNLRFYECNWSGKAPEHKQVYWRYDSALEDGADVGLDLTGGFYDAGDHVKFNLPMSYAMTMLAWGGIDLYENYVAAGQIDYLVQIVNHGADYFVKCHPEKEVIYAQVGLGDVDHCFWVPPELMEMERPAVCKLTPENGASDVTAQMAAALASASILNKKVGNTEKAELYLKHAIEIYDFADKYRDVYGNPCPEGASFYPSASYKDELVWGAAWVYRASGDEKYYDKADEYYDSLGLSGRVLIGPISWDDASSGIIFLMSKPGFGKNWERYLNEAQIYVDQYLNDKGSRTDAGMLWYSSVSGWGSARHAMAGVFLYCIFNTYHKPEDPKYFNFIQQQADYILGNNPFNRSLVVGSIPGHDPLNVHHRGSHGGYSPISPPEHNMYTLYGALAGGPLQDDSWDDDRNNYITNEVSCDYNAGITGVMAYLTPWTVPDNFEIDESEPE

SEQ ID NO: 8986 - protein, 449 aa, Anaeromyces robustus
  ENDO-1,4-BETA-GLUCANASE
ASQDYARHLELNFLFYEAQRSGHLPANNRIPWRSDSGLDHGADNGVDLTGGYYDAGDNVKFNFPQAFSMTAIAWYGLEFAKGVEMAGQTEYLKDTVKWGCDYLLKCHKKGTDVFYMQVGDGDIDHLYWKAVEDIDYPTPSFYVDSKNPGTEVTGETAAAFAAASLLFKESDPEYSATLLDQAVEWFNFANTYRFDYSVSVPKVASYYKSWGGYKDELAWAAIWLYKALGEEKYLELAKDLVKDYKLGELGFDWDSKYQSTIVILAQLGVKEYVEKVENWVREICTKGKLSPGGLYINKDSEWGSCRRATSMAASLIFYTHTLPEGNELREMAKKFAQSQADYVQGNNPLGIDFVVGADASSPRSVHHRTASGADCIECDPVENAHIIYGALAGGPDENDQYEDIRADYQKNEVALDYNVCYAAVCAYLIEEGLNVEDPIPAWEYDYRLI

SEQ ID NO: 8987 - protein, 480 aa, Piromyces finnis
  ENDO-1,4-BETA-GLUCANASE
FSTIITAIAALVAPMTAVAKSQDYARHLELSLLFYEAQRSGKLPENNRIYWRHDSLVDAGADNGVDLSGGYYDAGDNAKFNFPGAATMTLLAWSGIDYAEGYKEAGQWKYLLDAVRWGADYFMKCHTGKNELYAQVGKGTTDHSYWYPPEYASYDHPSFKLTASAPGTEVSADTASFLAASYLLFKDEDPSYASKCLQHSKEIYDFADTYRGDYIGSIPDVSGFYSTWSGYNDELAFGALWLYRATGSESYMKKFEAIADAVYGAQDTKAYGTCTGPISWDDKRPGAYILAAIITGDEKRMKQASWYCDNVLTQPKTPGGLWYDANLSKWASNRYASNAAAMVAMYANYLPSSDSKRSKYVDFVKKQTDYILGDNPAKINYVVGAEANSPKAVHHRGASGTYDSQDTNAKPTDYNIFTLWGALAGGPGPDDEYTDSRKNYEMNEVALDYNAAFQMNLAFLTQEGLSKPDPDSVKIHERSW

SEQ ID NO: 8988 - protein, 479 aa, Piromyces finnis
  ENDO-1,4-BETA-GLUCANASE
FSTIITAIAALVAPMTAVAKSQDYARHLELSLLFYEAQRSGKLPENNRIYWRHDSLVDAGADNGVDLSGGYYDAGDNAKFNFPGAATMTLLAWSGIDYAEGYKSAGQWEYILDAVRWGADYFMKCHTGKNELYAQVGDGNTDHAFWYPPEYVKYDYPSFKVTAEKPGSEVAGETAAFLAAASILFKDEDSSYSAKLLKHAKEIYEFADTYRGDYTGAIPGVVSFYSTYSGYNDELAWGAAWLLRATGDESYLNKYNVIANKKYESYDPKKFSGATGPISWDDKRPGCYILIAMVTGDENRIKEAYNYCDAVLTQPKTPGGLWYDDGLSMWGSNRYASNAASMLAMFANYLPKSDPKRAKYVEFVQQQTNYILGDNPAKINYVVGAEANSPKAVHHRGSSGVFDSQDKAAKPDENIYTLWGALAGGPDETDSYIDTRSNFRTNEVALDYNAAFQMNLAFLVKEGFNKPDPDSVKIHDRSF

SEQ ID NO: 8989 - protein, 477 aa, Piromyces finnis
  ENDO-1,4-BETA-GLUCANASE
IVSAIAALVAPMAVVAKSQDYARHIELSLLFYEAQRSGKLPENNRVYWRHDSLLDAGADNGVDLTGGYYDAGDNVKFNFPGAAALTLLAWSGIDYADGYKEAGQWDYILDAVRWGADYFVKCHTGKNELYVQVGKGATDHGFWYPPEYVQYDHPSYKITAAAPGSEVAGDTASFLAAASILFKDIDSSYSSNLLKHAIEIYDFADSYRGEYIKAVPDAQGFYSNWSGYNDELAFGALWLYRATGESKYMDKFSKIADASYGEQDTKAYGTCTGPISWDDKRPGAYILAAIITGDEKRMKQASWYCDNVLTQPKTPGGLWYDANLSKWASNRYASNAAAMVAMYANYLPSSDSKRSKYVDFVKKQTDYILGDNPAKINYVVGAEANSPKAVHHRGASGTYDSQDTNAKPTDYNIFTLWGALAGGPGPDDEYTDSRKNYEMNEVALDYNAAFQMNLAFLTQEGLSKPDPDSVKIHERSW

SEQ ID NO: 8990 - protein, 480 aa, Piromyces finnis
  ENDO-1,4-BETA-GLUCANASE
FSTIITAIAALVAPMTAVAKSQDYARHLELSLLFYEAQRSGKLPENNRIYWRHDSLVDAGADNGVDLSGGYYDAGDNAKFNFPGAATMTLLAWSGIDYAEGYKEAGQWKYLLDAVRWGADYFMKCHTGKNELYAQVGKGTTDHSYWYPPEYASYDHPSFKLTASAPGTEVSADTASFLAASYLLFKDEDPSYASKCLQHSKEIYDFADTYRGDYIGSIPDVSGFYSTWSGYNDELAFGALWLYRATGSESYMKKFEAIADAVYGAQDTKAYGTCTGPISWDDKRPGAYILAAIITGDEKRMKQASWYCDNVLTQPKTPGGLWYDANLSKWASNRYASNAAAMVAMYANYLPSSDSKRSKYVDFVKKQTDYILGDNPAKINYVVGAEANSPKAVHHRGASGTYDSQDTNAKPTDYNIFTLWGALAGGPGPDDEYTDSRKNYEMNEVALDYNAAFQMNLAFLVKEGFNKPDPDSVKIHDRSF

SEQ ID NO: 8991 - protein, 479 aa, Piromyces finnis
  ENDO-1,4-BETA-GLUCANASE
FSTIITAIAALVAPMTAVAKSQDYARHLELSLLFYEAQRSGKLPENNRIYWRHDSLVDAGADNGVDLSGGYYDAGDNAKFNFPGAATMTLLAWSGIDYAEGYKSAGQWEYILDAVRWGADYFMKCHTGKNELYAQVGDGNTDHAFWYPPEYVKYDYPSFKVTAEKPGSEVAGETAAFLAAASILFKDEDSSYSAKLLKHAKEIYEFADTYRGDYTGAIPGVVSFYSTYSGYNDELAWGAAWLLRATGDESYLNKYNVIANKKYESYDPKKFSGATGPISWDDKRPGCYILIAMVTGDENRIKEAYNYCDAVLTQPKTPGGLWYDDGLSMWGSNRYASNAASMLAMFANYLPKSDPKRAKYVEFVQQQTNYILGDNPAKINYVVGAEANSPKAVHHRGSSGVFDSQDKAAKPDENIYTLWGALAGGPDETDSYIDTRSNFRTNEVALDYNAAFQMNLAFLTQEGLSKPDPDSVKIHERSW

SEQ ID NO: 8992 - protein, 477 aa, Piromyces finnis
  ENDO-1,4-BETA-GLUCANASE
IVSAIAALVAPMAVVAKSQDYARHIELSLLFYEAQRSGKLPENNRVYWRHDSLLDAGADNGVDLTGGYYDAGDNVKFNFPGAAALTLLAWSGIDYADGYKEAGQWDYILDAVRWGADYFVKCHTGKNELYVQVGKGATDHGFWYPPEYVQYDHPSYKITAAAPGSEVAGDTASFLAAASILFKDIDSSYSSNLLKHAIEIYDFADSYRGEYIKAVPDAQGFYSNWSGYNDELAFGALWLYRATGESKYMDKFSKIADASYGEQDTKAYGTCTGPISWDDKRPGAYILAAIITGDEKRMKQASWYCDNVLTQPKTPGGLWYDANLSKWASNRYASNAAAMVAMYANYLPSSDSKRSKYVDFVKKQTDYILGDNPAKINYVVGAEANSPKAVHHRGASGTYDSQDTNAKPTDYNIFTLWGALAGGPGPDDEYTDSRKNYEMNEVALDYNAAFQMNLAFLVKEGFNKPDPDSVKIHDRSF

SEQ ID NO: 8993 - protein, 474 aa, Piromyces finnis
  ENDO-1,4-BETA-GLUCANASE
FSKILTALLTCGPALIKAASQDYARHLELSILFYEAQRSGKLPANNRIFWRHDSMVDAGKDNKVDLTGGYYDAGDNVKFNFPQASALTLLAWGAYKWKDGYKEAGQWDYMKDLLKWGMDYFIRCHTDKYVLYGQVGNGSLDHGAWVAPEDIDYEYPSYKITASAPGSDLAAETSASMVAASLAFRDEDPTYADTLLKHGRELYEFAEKYQGTYDKSITDAKGYYRSYSGFNDELVWGAAMLYAATGEQTYKDKVDKIWNTPYGELDPDRFLGSTGPISWDDKKAAAYALMAITTGESKYIEESTRHSDLMVNYPTTPGGLWYDTNLSMWASNRYAANAAFTVAMLATSMDANDSKRKEYVAFVKKQIDYILGDNPAKVDYVVGADPSSPKAVHHRGASGSKGADKGPDENVFILYGALAGGPGAKDNYKDARNNYEMNEVALDYNAAFQGLLAFLITEGLNVPDPKQTWDGAWP

SEQ ID NO: 8994 - protein, 325 aa, Piromyces finnis
  ENDO-1,4-BETA-GLUCANASE
PSLKLTTGAPGSEVAGDTASFLAATYIIFKDIDPSYAKKCLQHSKEIYEFADTYRGDYSKSFGDYVNSFYKNWGTIYDELAFGALWLYRATNDESYLKKYKAIADASYDTRDENAYGNCKGPISWDDKRPGGYVLGAIVTGEEKYIEKALSYCDMVLTQPRTPGGLWYDSNLSKWGSNRYASNAASMVAMMADFLPKDDARRAKYVDFVKSQTDYILGDNPAGVNYVVGAEENSPKAVHHRAASGTYDSQDRNAKPNDHNVYTIWGALAGGPAKDDSYEDTRKNYEMNEVALDYNAAFQMNLAFLVKEGLSIPDPDSVKNHERSF

SEQ ID NO: 8995 - protein, 60 aa, Piromyces finnis
  ENDO-1,4-BETA-GLUCANASE
GALAGGPDANDKYTDDRTNYNSNEVALDYNAAYTGLLAFLIQEGLNVSDPAQTWEGAWPP

SEQ ID NO: 8996 - protein, 61 aa, Piromyces finnis
  ENDO-1,4-BETA-GLUCANASE
GALAGGPDGNDKYTDDRTNYNSNEVALDYNAAYTGLLAFLIQEGLNVPDPAQTWEGAWPPK

SEQ ID NO: 8997 - protein, 398 aa, Piromyces finnis; identical to SEQ ID NO: 286
  ENDO-1,4-BETA-GLUCANASE

SEQ ID NO: 8998 - protein, 397 aa, Piromyces finnis
  ENDO-1,4-BETA-GLUCANASE
DYARILNLNLRFYECNWSGKAPEHKQVYWRYDSALEDGADVGLDLTGGYYDAGDHVKFNLPMSYAMTMLAWGGIDLYDNYVAAGQIDYLVQIVNHGADYFVKCHPEKEVIYAQVGLGDVDHCFWVPPELMEMERPAVCKLTPENGASDVTAQMAAALASASILNKKYGNEEKAELYLKHAIEIYDFADKYRDVYGNPCPEGASFYPSASYKDELVWGAAWVYRASGDEKYYEKADSYYDSLGLSGRVLIGPISWDDASSGIIFLMSKPGFGSNWKRYLGEAQTYVDQYLNDKSARTDAGMLWYSAVSGWGSARHAMAGTFLYCIFNTYHNPTDPKYFNFIQQQADYILGNNPFDRSLVVGSIPGHDPLNVHHRGSHGGYSPISPPEHNMYTLYGALA

SEQ ID NO: 8999 - protein, 478 aa, Neocallimastix californiae; identical to SEQ ID NO: 8965
  ENDOGLUCANASE

SEQ ID NO: 9000 - protein, 479 aa, Neocallimastix californiae; identical to SEQ ID NO: 8966
  ENDOGLUCANASE

SEQ ID NO: 9001 - protein, 477 aa, Neocallimastix californiae; identical to SEQ ID NO: 8967
  ENDOGLUCANASE

SEQ ID NO: 9002 - protein, 183 aa, Neocallimastix californiae; identical to SEQ ID NO: 8968
  ENDOGLUCANASE

SEQ ID NO: 9003 - protein, 476 aa, Neocallimastix californiae; identical to SEQ ID NO: 8970
  ENDOGLUCANASE

SEQ ID NO: 9004 - protein, 470 aa, Neocallimastix californiae; identical to SEQ ID NO: 8972
  ENDOGLUCANASE

SEQ ID NO: 9005 - protein, 474 aa, Neocallimastix californiae; identical to SEQ ID NO: 8974
  ENDOGLUCANASE

SEQ ID NO: 9006 - protein, 474 aa, Neocallimastix californiae; identical to SEQ ID NO: 8974
  ENDOGLUCANASE

SEQ ID NO: 9007 - protein, 477 aa, Neocallimastix californiae; identical to SEQ ID NO: 8976
  ENDOGLUCANASE

SEQ ID NO: 9008 - protein, 194 aa, Neocallimastix californiae; identical to SEQ ID NO: 8977
  ENDOGLUCANASE

SEQ ID NO: 9009 - protein, 474 aa, Anaeromyces robustus; identical to SEQ ID NO: 8980
  ENDOGLUCANASE

SEQ ID NO: 9010 - protein, 477 aa, Anaeromyces robustus; identical to SEQ ID NO: 8981
  ENDOGLUCANASE

SEQ ID NO: 9011 - protein, 317 aa, Anaeromyces robustus; identical to SEQ ID NO: 8982
  ENDOGLUCANASE

SEQ ID NO: 9012 - protein, 479 aa, Anaeromyces robustus; identical to SEQ ID NO: 8983
  ENDOGLUCANASE

SEQ ID NO: 9013 - protein, 449 aa, Anaeromyces robustus; identical to SEQ ID NO: 8986
  ENDOGLUCANASE

SEQ ID NO: 9014 - protein, 480 aa, Piromyces finnis; identical to SEQ ID NO: 8987
  ENDOGLUCANASE

SEQ ID NO: 9015 - protein, 479 aa, Piromyces finnis; identical to SEQ ID NO: 8988
  ENDOGLUCANASE

SEQ ID NO: 9016 - protein, 477 aa, Piromyces finnis; identical to SEQ ID NO: 8989
  ENDOGLUCANASE

SEQ ID NO: 9017 - protein, 480 aa, Piromyces finnis; identical to SEQ ID NO: 8990
  ENDOGLUCANASE

SEQ ID NO: 9018 - protein, 479 aa, Piromyces finnis; identical to SEQ ID NO: 8991
  ENDOGLUCANASE

SEQ ID NO: 9019 - protein, 477 aa, Piromyces finnis; identical to SEQ ID NO: 8992
  ENDOGLUCANASE

SEQ ID NO: 9020 - protein, 474 aa, Piromyces finnis; identical to SEQ ID NO: 8993
  ENDOGLUCANASE

SEQ ID NO: 9021 - protein, 325 aa, Piromyces finnis; identical to SEQ ID NO: 8994
  ENDOGLUCANASE

SEQ ID NO: 9022 - protein, 398 aa, Piromyces finnis; identical to SEQ ID NO: 286
  ENDOGLUCANASE

SEQ ID NO: 9023 - protein, 63 aa, Neocallimastix californiae
  Endoglucanase_F_dom3
EEAREDYIKFNEDVYIPSGWTGKNAQGANIRSGVKFIDIRPKYKEDPDWAQVEDFLNGGSAPR

SEQ ID NO: 9024 - protein, 63 aa, Neocallimastix californiae
  Endoglucanase_F_dom3
EEAREDYIKFNEEVYIPSGWSGKNAQGAQLKSGIKFIDIRPKYKEDPDWAQVEDFLNGGSAPR

SEQ ID NO: 9025 - protein, 63 aa, Neocallimastix californiae; identical to SEQ ID NO: 9023
  Endoglucanase_F_dom3

SEQ ID NO: 9026 - protein, 63 aa, Neocallimastix californiae
  Endoglucanase_F_dom3
EEAREDYIKFNEEVYIPSGWSGKNAQGANIKSGVKFIDIRPKYKEDKDWAQVEDFLNGGSAPR

SEQ ID NO: 9027 - protein, 63 aa, Neocallimastix californiae; identical to SEQ ID NO: 9023
  Endoglucanase_F_dom3

SEQ ID NO: 9028 - protein, 63 aa, Neocallimastix californiae
  Endoglucanase_F_dom3
TEARGDYDKFGGEVYIPRGWSGKNAQGANIRNGVTFIDIRPKYKQDPDWEQVEAYLNGGEPPV

SEQ ID NO: 9029 - protein, 62 aa, Neocallimastix californiae
  Endoglucanase_F_dom3
EAREDYAKFSSEVYIPSGWSGKNAQGANIKNGVTFIDIRPKYKQDPDWAQVENFINGGEPPR

SEQ ID NO: 9030 - protein, 63 aa, Neocallimastix californiae
  Endoglucanase_F_dom3
EEAREDYNKFEENVYIPSGWTGKNAQGANIRSGVKFIDIRPKYKQDKDWAQVEDYLNGGNPPK

SEQ ID NO: 9031 - protein, 63 aa, Neocallimastix californiae
  Endoglucanase_F_dom3
EEAREDYIKFNEDVYIPSGWTGKNAQGANIRSGVKFIDIRPKYKQDKDWAQVEDFLNGGSAPR

SEQ ID NO: 9032 - protein, 63 aa, Neocallimastix californiae
  Endoglucanase_F_dom3
EEAREDYIKFNEEVYIPSGWTGKNAQGANIRNGVKFIDIRPKYKEDPDWAQVENFLNGGEAPR

SEQ ID NO: 9033 - protein, 63 aa, Neocallimastix californiae
  Endoglucanase_F_dom3
EEAREDYIKFNEEVYIPYGWTGKNAQGATLEHGVKFIDIRPKYKQDKDWAQVENFLNGGEAPR

SEQ ID NO: 9034 - protein, 63 aa, Neocallimastix californiae
  Endoglucanase_F_dom3
EEPRGDYSKFGEEVYIPSGWTGKNAQGANIRSGVTFIDIRPKYKQDPDWAQVENYLNGGSEPR

SEQ ID NO: 9035 - protein, 63 aa, Neocallimastix californiae
  Endoglucanase_F_dom3
EEARADYSKFGDEVYIPSGWTGKNAQGANLKSGVTFIDIRPKYKQDPDWAQVENYLNGGSEPT

SEQ ID NO: 9036 - protein, 63 aa, Neocallimastix californiae
  Endoglucanase_F_dom3
EEARADYDKFGGEVYIPSGWTGKNAQGANLKSGVTFIDIRPKYKQDPDWAQVENYLNGGSAPT

SEQ ID NO: 9037 - protein, 63 aa, Neocallimastix californiae; identical to SEQ ID NO: 9036
  Endoglucanase_F_dom3

SEQ ID NO: 9038 - protein, 57 aa, Neocallimastix californiae
  Endoglucanase_F_dom3
KFYQYRLFNKKLPIQKDFKGVYGRSTKINDKSSFLSIRPYYKRDKNWKKIQTFLDKG

SEQ ID NO: 9039 - protein, 63 aa, Neocallimastix californiae
  Endoglucanase_F_dom3
EEAREDYIKFNEEVYIPSGWTGKNAQGANIRSGVKFIDIRPKYKEDPDWAQVENFLNGGEAPR

SEQ ID NO: 9040 - protein, 63 aa, Anaeromyces robustus; identical to SEQ ID NO: 9034
  Endoglucanase_F_dom3

SEQ ID NO: 9041 - protein, 63 aa, Anaeromyces robustus; identical to SEQ ID NO: 9035
  Endoglucanase_F_dom3

SEQ ID NO: 9042 - protein, 63 aa, Anaeromyces robustus
  Endoglucanase_F_dom3
KEAREDYAKFGGEVYVPSGWTGKNAQGANIKNGVTFIDIRPKYKQDPDWAQVENFLNGGDPPE

SEQ ID NO: 9043 - protein, 60 aa, Anaeromyces robustus
  Endoglucanase_F_dom3
EFHDNYSKFANPVYFPNDWKGRNPQGAYLKRGACFLDIRPKYKEDPDWYQVEYYLNGYEN

SEQ ID NO: 9044 - protein, 53 aa, Anaeromyces robustus
  Endoglucanase_F_dom3
YRLFNKKLPIQKDFKGVYGQSAKINDKSTFISIRPYYKKDKNWKIIKSYLNDG

SEQ ID NO: 9045 - protein, 57 aa, Piromyces finnis
  Endoglucanase_F_dom3
FYQYRRFNKKLPIPEGFKGMYGRSSKINDKSTFISIRPYYKKDKDWKIINTFLNKGT

SEQ ID NO: 9046 - protein, 62 aa, Piromyces finnis
  Endoglucanase_F_dom3
EERLDYANFGQETYIPSGWSGKNAQGANIKSGATFIDIRPKYKEDPDWAQVEDFLNGGNPPA

SEQ ID NO: 9047 - protein, 62 aa, Piromyces finnis; identical to SEQ ID NO: 9046
  Endoglucanase_F_dom3

SEQ ID NO: 9048 - protein, 63 aa, Piromyces finnis
  Endoglucanase_F_dom3
EEQRLDYEKFGGEVYIPSGWTGKNAQGANIKSGVTFIDIRPKYKQDPDWAQVEEYLNGGNPPE

SEQ ID NO: 9049 - protein, 63 aa, Piromyces finnis; identical to SEQ ID NO: 9048
  Endoglucanase_F_dom3

SEQ ID NO: 9050 - protein, 62 aa, Piromyces finnis; identical to SEQ ID NO: 9046
  Endoglucanase_F_dom3

SEQ ID NO: 9051 - protein, 62 aa, Piromyces finnis; identical to SEQ ID NO: 9046
  Endoglucanase_F_dom3

SEQ ID NO: 9052 - protein, 62 aa, Piromyces finnis
  Endoglucanase_F_dom3
EARGDYDKFGGEVYIPSGWTGKNAQGANIKSGVTFIDIRPKYKQDPDWAQVEEYLNGGNPPE

SEQ ID NO: 9053 - protein, 62 aa, Piromyces finnis; identical to SEQ ID NO: 9052
  Endoglucanase_F_dom3

SEQ ID NO: 9054 - protein, 62 aa, Piromyces finnis; identical to SEQ ID NO: 9052
  Endoglucanase_F_dom3

SEQ ID NO: 9055 - protein, 62 aa, Piromyces finnis; identical to SEQ ID NO: 9052
  Endoglucanase_F_dom3

SEQ ID NO: 9056 - protein, 1840 aa, Anaeromyces robustus
  ENTEROBACTIN SYNTHASE COMPONENT F
SDDLCYVFFTSGTTGKPKGTMMTHNNMTNFCLYSQHFNGNENIYDYGFENALAFSKFTFDMSLIEIYYPLYKRCRVVLCNDEEFNNSEMLSDLIIKYNVNYICSVQSRIKNYIKDEGFKKALKNVKWIGLGGEKLNSDIIQDIKNCSKATLINYYGPTETTVCCTLKKFENNELNNFENNNTSITIGKPLCNCKIYILDKYLKPVPIGVEGEIFIGGNCVGKGYLNREDLTKEKFVNCPYYNSINGSSNKMYRTGDLGKWTKEGEIICLGRADFQVKINGQRIELSEIENTMKEINGIDYAIVIDNNKENGNKYLTGYYISKNNITGKDIRKSLKLKLPSFMIPNYFIRIYNLPITSSGKLDKKSLPIPNINDLINEQYVAPETETEKLICNVYSKTLNIDESKIGKMSDFFELGGDSLNAIRIISMIEKELNIKLYIKDILSHPLVSEISEYIEDILTNNKNSYQMEVIKKYNSKEFPITSQQLGVYIDSIKNPDSIMYNIPSVFKLKKDIDINKIKMALNKIFKCQEILRSKYYEKEVNGKTEIFGYIDDECLLLFEEYTYENAKSFIRPFKLSEAPLIRIGFIKNEILLIDMHHIISDGSSMLIIKNELNSYFYNNEIIQELEIQFSDYSIYMNEKKSEEYYDKEIEFYKKMFSCEYELLSIPMKGKILDENKTIESSSKNCYKSIDKSTTSLINEYIKKHGISKAAFFITIYGYVLSKYSGQNIVYSSIVNANRNNHYTENMIGMFVSTQPILLKYDDEESSLLEIIKQNMNNLMEMYNNQDISFSELLKLLKLKKINNSFVFQPKVMFNNNNSENSIFSDDNNENMFTLYESSNELLNKENSKFDITFNVVENEENYLISIIYNDHLYESKIINNIIDSYLEVAKNINEYNNNIHNIEYIPKIEKERIIETFNNNEYNYDRNKFYHEEFSKVAKEIPNKCAIVCNNNEITFKKLDEMSNSLAHYLRKENIGRGDIVPIISERSHYFVIATLAIMKSGAAFLPIDPDFPKERIEYMINEVNAKFILKYITNIETERKIKFDNVIEYELQKHNYKDNVFEITNINNSDDLCYVLFTSGTTGKPKGTMMTHNNLINYSLYSQTYNGKEIYTNDFNNALSAAKFTFDMSLCEILYPLIKGKCVFICDDNEYNNPQLIGEKILKYNIDYIFSTPSRIENYMKNKTYMKALKNLKCILIGGEGCNIKTVENIIKNTNANIYNLYGPTETTIMCTVSELSNLYKQNKLNVITIGKPLCNCKLYILDEYLKPVPIGVEGEIYIGGYGVGKGYLNREQLTREKFVDCPFNIKNGLPNQMYSTGDLGKWTEKGEIICSGRADFQVKIRGQRIELTEIENTIKKIKGIKYSIVIDKIKENNDKYLMCYYITDENINSGDIRNYLKNKLPIYMIPSYFKKIDNIPVTSNGKLNRKALPEPNIDDLIKENYIAPISKVEKIICKIYSNVFNINENSVGLMNEFYELGGDSLIVISILSLIEKELKIKLNVKDILSHPLIKDLCDYIETILSNNENSYEIKSIKKHSAKEFPVTTQQLGVYVDTIKNPDAIVYNTPLIFKLTKNIDINKIKEAFNKLFKNQEILRSKYYEKEINGKTEIYGFIDDECLLLFEEYTYENAKTFVRPFELSKAPLIRVGFIKNEILLIDMHHIISDGSTMLIIKKELNNYYNNNEIKELEIQFSDYAIDLNENKNNEYYNKQIEFYKEMFSCEYEKLNIPIRNNNLLSPEERNKNDMKCNICVNIIDEFTSEKINEYVKNNKISKTAFFLSIYGYILSKYSRQDIIYSSVMSTNRNNNYIQDMIGMFVSTQPILLKYSNKEMNSFTDIIKQ

SEQ ID NO: 9057 - protein, 150 aa, Neocallimastix californiae
  Esterase
SENTKSNRPMNILLPPNYNPEKKYPILYLLHGILSDQNSLIKSKYGTPNIAGYLMNKGMAKEMIIAYPYTYAPKDGIEVEPGFTKEHAAGYDNFINELLFNIMPYMEKNYPILTGRDNTAIAGFSMGGRNSLYIGYSKPELFGYIGAFSP

SEQ ID NO: 9058 - protein, 177 aa, Neocallimastix californiae
  Esterase
STTTQSERPLVVVLPPNYNEKKKYPVVYILHGIMTDGSFMLQEGFGTVTIPGNLFHKHMAKEFIMVLPNQYAPAPGTEVEPNLNEEYFAGYNNFINDLVNDIMPYMKKHYSIATGKKNTAICGYSFGGRNSLYIGLKRPDLFGYVGSFSPAPGILPGDDVFTGHHNGLFKEEKDVVF

SEQ ID NO: 9059 - protein, 171 aa, Neocallimastix californiae
  Esterase
STTTKSERPLHVLLPPSYDGKKKFPVVYLLHGVMTNGEFMLQEGFGTIAIPGNLFHKHMAKEFIMVLPDQYAPAPGTEVEPNLNEEYFAGYNNFINDLVNDIMPYMKKNYRIFTGKKNTAICGYSFGGRNSLYIGLMRPDLFGFVGAFSPAPGILPAEDMFTHHNGLFKEE

SEQ ID NO: 9060 - protein, 151 aa, Neocallimastix californiae
  Esterase
SSNTKTDRPMNILLPPNYDPENKKYPVLYLLHGILSDQNSLIKPKYSTPNIAGYLMHEGLAKEMIIVFPYTYAPKDGIEVEPGFTEEHYAGYNNFINELLDVIMPYMNENYPILTGRDNTAIAGFSMGGRNSLYIGYTKPELFGYIGAFSP

SEQ ID NO: 9061 - protein, 134 aa, Neocallimastix californiae
  Esterase
AWVYLPAGYDPEDKDTKYPLFILMHGFGQTEDNWGLTDQGSGGKIKGMMDRGMAKPKDEEGSVEKFILVVPTGMATRNYRENGNYDYTEPYYRFGGELRNDLIPYMKKNYNIKEGRENMAMAGLSMGGFQTLYI

SEQ ID NO: 9062 - protein, 199 aa, Neocallimastix californiae
  Esterase
INGSNSLNVYLPYGYNSNQQYNIFYLMHGGGENENTIFGSDVYLQYIIDHLIMNGELEPLIIVTPTFNKCEAQTFYKEFRSSVIPFVEGKYSTYAKSTSESDIRASRMHRAYGGFSMGSVSTWAVLINCLDIVGYFMPLSGDCWEANDAYGKAKAVADAINRSGLRSNEYFIFCATGSDDIAYPNVTPQIEQMKKMSQF

SEQ ID NO: 9063 - protein, 148 aa, Neocallimastix californiae
  Esterase
SNTTGTDRQMNIILPVDYDGTKKYPVVYYLHGIFGNEDSMLDETAIALPVNLYNEGKAKEAIFVLPNTYAPPPGKEVVPDFNQDYFDGYDNFINELIDDIMPYVEQNYSVLTGKENTGLCGFSMGGRNSLYIGYKRPDLFGYVGAFSP

SEQ ID NO: 9064 - protein, 150 aa, Neocallimastix californiae
  Esterase
STTTESKRPLIVVLPPNYSKSKKYPVLYLLHGIMTDGSFMLQEGFGTITIPGNLIHEHKAKELIMVLPNQYAPAPGTEVEPALNEKYFAGYNNFINDLINDIMPYMKKNYSIATGKENTAIAGYSFGGRNSLYIALQRPDLFGFVGAFSP

SEQ ID NO: 9065 - protein, 149 aa, Neocallimastix californiae
  Esterase
TTAQMDRKMNVILPAGYTEDKKYPVLYYLHGLSGNEDSLLAKERATIEIYGNLVSEGKAKEMIIVLPDCYVPLDGVFDRPQFSPEYLKAYDNFLYELIDDVMPYIESHYSVALGRENTALAGFSQGGRNTIYIGYKHPELFGYLGAFSP

SEQ ID NO: 9066 - protein, 154 aa, Neocallimastix californiae
  Esterase
SNTTHTERQMNIILPPDYSKEKKYPVLYYLHDLLSDENGLLEKSIGTLEIYSNLVNLGKAKDMIIVLPNCIVPADGAKIEPGNSEEYNAAYDNFINELLQDVMPFIESNYSVDSGRENTAIAGFGQGGRSSLYIGYKHPELFGYLGAFSPTQGL

SEQ ID NO: 9067 - protein, 135 aa, Neocallimastix californiae
  Esterase
AWVYLPAGYDPEDKNTKYPLVILMHGFGQNEDNWGLTDQGTGGKIKGMMDRGMAKAKDEEGSVEKFVLIVPTGMASKDFRDNNNYGNTEPWYKFGNEIRNDIIPYMRSHYNIKEGRENVAMAGLSMGGMQTLNLG

SEQ ID NO: 9068 - protein, 219 aa, Neocallimastix californiae
  Esterase
GNTLNVYLPYGYDKNKQYNIFYLMHGGGENENTIFSNDVNLHNILDNMIMKGELEPLIVVTPNFNKCDARTFYKELRESVIPFVEGKYSTYAKSTSPADIKASRMHRAFGGFSMGSASTWAVLINCLDIVAYYMPLSGDNWEANGGYAKAKSVADAIDKSGLQKNQYFIFCATGSEDIAYNNMNPQIDEMKKMSQFVYTSDFSKGNFYYLVAQGKTHWW

SEQ ID NO: 9069 - protein, 155 aa, Neocallimastix californiae
  Esterase
SNITKGYRKLNVVLPPNYSTEKKYPVLYLLHGIYGDEDSMLNNGMGTLNVPANLAKENKAKEMIIVLPNEVALLPGTDPNITKNFSLEHLKVYDNFINELLNNIMPFIEYEYSVATGRDNTAIAGFSMGGRTALYIGYTRPDLFGYVAGFSPAWG

SEQ ID NO: 9070 - protein, 134 aa, Anaeromyces robustus
  Esterase
NKHGWVYLPAGYDADDKNTQYPLFVLLHGFGQNENTWGLSNKGRGGKIKGFMDRGMASGDVGRFILVCVTGVASRNWGPNGAGNDVNGFNAFKGELRDDIIPYMRSKFNIKSGRDNVALAGLSMGGGQTFNIGI

SEQ ID NO: 9071 - protein, 150 aa, Anaeromyces robustus
  Esterase
SKTTNNDRKMNVILPIGYTESKKYPVLYLLHGIMGNEDSMLSTNMGSITIPTNLLREGKAKEMIIVLPNEYAPEGGKEVPAGINQAYFEGYDNFINDLIGSIMPYMEKNYSVATGRENTAIAGFSMGGRNSLYIGYKRSDLFGYIGAFSP

SEQ ID NO: 9072 - protein, 149 aa, Anaeromyces robustus
  Esterase
SKVTESERKMNVILPVGYDENKKYPVVYFLHGLMSDEDGMLGDESTIAIPTNLIKEGKAKEMIMVLPDIYAPVPGTAVEPNYDPEYYKGYDNFINELTEVIMPYMEEHYPILTGRENTAICGFSMGARTSLYIGYMKSDLIGYTGAFAP

SEQ ID NO: 9073 - protein, 110 aa, Anaeromyces robustus
  Esterase
SKVTESERKMNVILPVGYDENKKYPVVYFLHGLMSDEDGMLGDESTIAIPTNLIKEGKAKEMIMVLPDIYAPVPGTAVEPNYDPEYYKGYDNFINELTEVIMPYMEEHYP

SEQ ID NO: 9074 - protein, 151 aa, Anaeromyces robustus
  Esterase
SENTKSDRPMNILLPPNYDPDNKKYPVLYLLHGILSDQNSLIKPKYSTPNIAGYLMNEGLAKEMIIVYPYTYAPKDGIEVEPGFSEEHAAGYNNFINELLYNIMPYMEKNYPILTGRDNTAIAGFSMGGRNSFYIGLNKPELFGYIGAFSP

SEQ ID NO: 9075 - protein, 148 aa, Anaeromyces robustus
  Esterase
SSNTNSERKMNIILPVGYDESKKYPIVYFLHGIFGDEDSMLDESTIAIPTNLLKEGKAKEFIMVLPSEYAPTPGNEVEPGFSQKYFDGYDNFINELVDVIMPYMEQNYPILTGKDNTALCGFSMGGRNSLYIAYKRSDLFGYVGAFSP

SEQ ID NO: 9076 - protein, 150 aa, Anaeromyces robustus
  Esterase
STTTESERPLIVLLPPNYTETKKYPVLYLLHGIMGTGMFMLQEGFGTVAIPGNLYAKNMAKEMIIVLPDQYAPAPGTEVEPDLNEEYFAGYNNFINDLINDIMPFLEKNYSIATGRENTALCGYSFGGRNSLYIGLKRPDLFGYIGAFSP

SEQ ID NO: 9077 - protein, 150 aa, Piromyces finnis
  Esterase
SKITQSYRPLNVILPVGYTESKQYPVLYLLHGIMCNEDSMLEAEMGSLTIPTNLFNDGRAKEMIIVLPYEYAPEAGKEVEAAFNQAYFDGYDNFINELTDVIMPYVKANYSIKTGRENTAICGFSMGGRNSLYIGFKRSDLFGYVGAFSP

SEQ ID NO: 9078 - protein, 148 aa, Piromyces finnis
  Esterase
QSQRPLNVILPPNYSTDKKYPVLYLLHGVAANEDIMVEEYNGALNIPPNLAKQGKAKEMIIVSPRVNIYPPGVDEVEFAFSTEYLSGFDNFINDLIDSIMPFIETHYSVLTGRNNTAIAGFSMGGRTALYIGYSKPELFGYVCGLSPA

SEQ ID NO: 9079 - protein, 150 aa, Piromyces finnis
  Esterase
STTTETNRTLTVLVPPNYSPKKKYPVLYLLHGIMTDGAWMIQDGFGTIAIPGNLAHQKKAKEMFIVLPDQYAPSPGTEVEPALNQEFFNGYDNFINDLVNDIMPFMKKQYSIKTDRKNTAISGYSFGGRNSLYIGITRSDLFGYVGSFSP

SEQ ID NO: 9080 - protein, 62 aa, Piromyces finnis
  Esterase
QSQRPLNVILPPNYSTDKKYPVLYLLHGVAANEDIMVEEYNGALNIPPNLAKQGKAKEMIIV

SEQ ID NO: 9081 - protein, 109 aa, Neocallimastix californiae
  Expansin_CBD
CPVKGNIYIRILPGANQWYFAINVVNVANMGSLVAVEVLRNGKWAPLVRDPNYSSTRPQERYGSWVVPPLKEGEQSEPFTTPLTLRFTDSAFNTLTAPDAIKEWPTSDD

SEQ ID NO: 9082 - protein, 99 aa, Neocallimastix californiae
  Expansin_CBD
CPVKGNIHVWLRPGAGPWYFALTVVNVANMGSLVAVEVQQADGIWVPLVRDPNYSSTRPQERYGSWTVKQGTGPFSVPMNMRFTDSAFNTLTAEGAIKD

SEQ ID NO: 9083 - protein, 79 aa, Neocallimastix californiae
  EXPANSIN_CBD
WYFALTVVNVANMGSLVAVEVQQADGIWVPLVRDPNYSSTRPQERYGSWTVKQGTGPFSVPMNMRFTDSAFNTLTAEGA

SEQ ID NO: 9084 - protein, 99 aa, Neocallimastix californiae
  Expansin_CBD
VPCPRLGNMYIWLRKDAGPYWFAFSVVNSAGFGAIAVLEAKNDEGKWVKMIRDPNYTMSRPQERYGVWVTPQDTGPYNLPVDIRLTDGSGVTIVAEKAI

SEQ ID NO: 9085 - protein, 91 aa, Neocallimastix californiae
  EXPANSIN_CBD
YWFAFSVVNSAGFGAIAVLEAKNDEGKWVKMIRDPNYTMSRPQERYGVWVTPQDTGPYNLPVDIRLTDGSGVTIVAEKAIKSFTPPADAIK

SEQ ID NO: 9086 - protein, 99 aa, Neocallimastix californiae
  Expansin_CBD
VPCPKLGNMYIWLREDAGPYWFAFSVVNSAGFGAIAVLEAKNDEGKWVKMIRDPNYTMSRPQERYGVWVTPQDTGPYNLPIDIRLTDGSGVTVVAEEAI

SEQ ID NO: 9087 - protein, 91 aa, Neocallimastix californiae
  EXPANSIN_CBD
YWFAFSVVNSAGFGAIAVLEAKNDEGKWVKMIRDPNYTMSRPQERYGVWVTPQDTGPYNLPIDIRLTDGSGVTVVAEEAIKSFDPPADAIK

SEQ ID NO: 9088 - protein, 99 aa, Neocallimastix californiae
  Expansin_CBD
CPVKGNIHVWLRPGAGPWYFALTVVNVANMGSLVAVEVQQADGVWVPLVRDPNYSSTRPQERYGSWTVKQGTGPFTVPMNMRFTDSAFNTLTAEGAIKD

SEQ ID NO: 9089 - protein, 79 aa, Neocallimastix californiae
  EXPANSIN_CBD
WYFALTVVNVANMGSLVAVEVQQADGVWVPLVRDPNYSSTRPQERYGSWTVKQGTGPFTVPMNMRFTDSAFNTLTAEGA

SEQ ID NO: 9090 - protein, 99 aa, Neocallimastix californiae
  Expansin_CBD
VPCPRLGNMYIWLREDAGPYWFAFSVVNSAGFGAIAVLEAKNDEGKWVKMIRDPNYTMSRPQERYGVWVTPQDTGPYNLPIDIRLTDGSGVTIVAEKAI

SEQ ID NO: 9091 - protein, 91 aa, Neocallimastix californiae
  EXPANSIN_CBD
YWFAFSVVNSAGFGAIAVLEAKNDEGKWVKMIRDPNYTMSRPQERYGVWVTPQDTGPYNLPIDIRLTDGSGVTIVAEKAIKSFDPPADAIK

SEQ ID NO: 9092 - protein, 99 aa, Neocallimastix californiae
  Expansin_CBD
VPCPRLGNMYIWLRQNASPYWFSFTVVNSAGFGGIAILEAKNDEGKWVKLIRDPNYTMARPQERFGTWATPQDSGPYNLPIDIRLTDGSGITIVAEEAI

SEQ ID NO: 9093 - protein, 91 aa, Neocallimastix californiae
  EXPANSIN_CBD
YWFSFTVVNSAGFGGIAILEAKNDEGKWVKLIRDPNYTMARPQERFGTWATPQDSGPYNLPIDIRLTDGSGITIVAEEAIKSFTPPADALR

SEQ ID NO: 9094 - protein, 82 aa, Neocallimastix californiae
  Expansin_CBD
AIKFQFKSGSTQFWGEVQVFNTRYPVAKVEFLSGGKYVGLYRRAYNYWALNSGGFGAGPYTFRVTLADSTVIEAKNVKMVIP

SEQ ID NO: 9095 - protein, 107 aa, Neocallimastix californiae
  Expansin_CBD
CPVKGNIYIRILPGANQWYFAINVVNVANMGSLVAVEVLRNGKWAPLARDPNYSSTRPQERYGSWVVPPLKKGEQSEPFETPLTLRFTDSAFNTLTAPDAIKEWPET

SEQ ID NO: 9096 - protein, 93 aa, Neocallimastix californiae
  Expansin_CBD
CPVKGNIHVWLRPGAGPWYFALTVVNVANMGSLVAVEVQQEDGVWVPLVRDPNYSSTRPQERYGSWTVKQGTGPFTVPMNMRFTDSAFNTLTA

SEQ ID NO: 9097 - protein, 77 aa, Neocallimastix californiae
  EXPANSIN_CBD
WYFALTVVNVANMGSLVAVEVQQEDGVWVPLVRDPNYSSTRPQERYGSWTVKQGTGPFTVPMNMRFTDSAFNTLTAN

SEQ ID NO: 9098 - protein, 107 aa, Anaeromyces robustus; identical to SEQ ID NO: 9095
  Expansin_CBD

SEQ ID NO: 9099 - protein, 99 aa, Anaeromyces robustus
  Expansin_CBD
CPVKGNIHVWLRPGAGPWYFALTVVNVANMGSLVAVEVQQEDGVWVPLVRDPNYSSTRPQERYGSWTVKQGTGPFTVPMNMRFTDSAFNTLTANGAIKD

SEQ ID NO: 9100 - protein, 79 aa, Anaeromyces robustus
  EXPANSIN_CBD
WYFALTVVNVANMGSLVAVEVQQEDGVWVPLVRDPNYSSTRPQERYGSWTVKQGTGPFTVPMNMRFTDSAFNTLTANGA

SEQ ID NO: 9101 - protein, 99 aa, Anaeromyces robustus
  Expansin_CBD
VPCPRLGNMYIWLRKDAGPYWFSFSVVNSAGYGAIAVLEAKDDEGNWIKMQRDPNYTMARPQERYGVWATPQGAGPFNLPVDIRLTDGSGVVVVAEKAI

SEQ ID NO: 9102 - protein, 91 aa, Anaeromyces robustus
  EXPANSIN_CBD
YWFSFSVVNSAGYGAIAVLEAKDDEGNWIKMQRDPNYTMARPQERYGVWATPQGAGPFNLPVDIRLTDGSGVVVVAEKAIKSFTPPADSIE

SEQ ID NO: 9103 - protein, 85 aa, Anaeromyces robustus
  Expansin_CBD
NSPIKFQFKSGSTQFWGEVEVFNTRYPVAKVEFLSNGKYESLYRRAYNYWALNSGGFGAGPYTFRVTLADDTVIEAKGVEMVIPG

SEQ ID NO: 9104 - protein, 96 aa, Piromyces finnis
  Expansin_CBD
CPVKGNIHVWLRPGAGQWYFALTVVNVANMGSLVAVEVQQSDGQWVPLVRDPNYSTTRPQERYGSWTVKQGTGPFTTPMNMRFTDSAFNTLTAEGA

SEQ ID NO: 9105 - protein, 79 aa, Piromyces finnis
  EXPANSIN_CBD
WYFALTVVNVANMGSLVAVEVQQSDGQWVPLVRDPNYSTTRPQERYGSWTVKQGTGPFTTPMNMRFTDSAFNTLTAEGA

SEQ ID NO: 9106 - protein, 95 aa, Piromyces finnis
  Expansin_CBD
APLKFQFKSGSTQFWGEVEVFNTRYPVAKVELLLNGKYQSLYRRAYNYWALSSGGFGAGPYTFRVTLADNTVIQATNVEMVIPANDEGDSYSSGT

SEQ ID NO: 9107 - protein, 181 aa, Neocallimastix californiae
  EXPANSIN_EG45
AGACAFGVYGLCSFKSNVTMESPICQTFCKNYPDLCEDPVDTKLSLRGNFIAPNGNYYTQFWPSLQGDYDNYLSCGECYELEITQEDGSLYPEDNRRSENIIAQIVDSCPCSANAKWCCGSGIDHCNEIDFKYGCPIPEGSVHFDLSDIAMARLQTNDPNGGMVEGVIPIRYKRVPCPVKG

SEQ ID NO: 9108 - protein, 176 aa, Neocallimastix californiae
  EXPANSIN_EG45
GGACGFGLYGLCTTKFNETGELCVRFCEHYPDLCKDPDDITLRGNFCAPNGNYYTQFWSSLPGDYDNYLSCGECYEVERTLPDGSSYPAGEGTDHILLQVVDSCPCTANAKWCCGSGVDHCNEIDFKYGCPIPEGSWHVDLSDIAMSRLQTNDPYGVMVDGVIPIKYRRVPCPVKG

SEQ ID NO: 9109 - protein, 126 aa, Neocallimastix californiae
  EXPANSIN_EG45
NLACNCVPNAMVVGPTVALAEVAYGAFDHFGSGPACGLCYRLSPYATADGTPLSPIPEPIVFRVTDECPHQSNAEWCPGPEGGKNAHGFEDHFDVNIDSWGGKLRDWFQGGHMQAKYELVSCEEWP

SEQ ID NO: 9110 - protein, 140 aa, Neocallimastix californiae
  EXPANSIN_EG45
GGSCNVSAMGNAAGPTAAISGLSYGSWSGLGGGPACGLCYALTVYGSYDGQADPALFPKCSIVVRITDQCPYPDNKEWCPGPEQPESEGFLNPRGMRYHFDVNISSGQGEAREWFPRDASGNLLGTGKVYFEMVSCREWS

SEQ ID NO: 9111 - protein, 181 aa, Neocallimastix californiae
  EXPANSIN_EG45
GGACGFGLYQVCGSDHNYTGEFRTLCDAFCKAYPTLCKDPAGRTYRGNFAAPQGNYYTQFWGALEGDQDNYLSCGECFEVYKTKPDGSDYKPGEDGYQPPVLLSVIDSCPCNANGKWCCGSEWDQCQEIDFKYGCPVPKDSIHLDLSDIAMARLQSGSSNGHMEAGVIPNKYRRVPCPRLG

SEQ ID NO: 9112 - protein, 140 aa, Neocallimastix californiae
  EXPANSIN_EG45
GGSCNVSAMGNAAGPTAAISGLSYGSWSGLGGGPACGLCYALTVYGSYDGQADPALFPKCSLVVRVTDQCPYPDNKEWCPGPEQPESEGFLNPRGMRYHFDINISSGQGEAREWFPRDASGNLLGTGKVYFEMVSCREWS

SEQ ID NO: 9113 - protein, 181 aa, Neocallimastix californiae
  EXPANSIN_EG45
GGACGFGLYQVCGSDHNYTGEFATLCDAFCKAYPTLCKDPADRTYRGNFAAPQGNYYTQFWGALEGDQDNYLSCGECFEVYKTKPDGSDYKPGEDGYQPPVLLSVIDSCPCNANGKWCCGSEWDQCQEIDFKYGCPVPKDSIHLDLSDIAMARLQSGSSNGHMEAGVIPNKYRRVPCPKLG

SEQ ID NO: 9114 - protein, 176 aa, Neocallimastix californiae
  EXPANSIN_EG45
GGACGFGLYGLCTTKFNETGELCVRFCEHYPDLCKDPDDITLRGNFCAPNGNYYTQFWSSLPGDYDNYLSCGECYEVERTLPDGSSYPAGEGTDHIILQVVDSCPCTANAKWCCGSGVDHCNEIDFKYGCPIPEGSWHVDLSDIAMSRLQTNDPYGVMVDGVIPIKYKRVPCPVKG

SEQ ID NO: 9115 - protein, 181 aa, Neocallimastix californiae
  EXPANSIN_EG45
GGACGFGLYQVCGSDHNYTGEFATMCSAFCKAYPTLCKDPEGYTYRGNFAAPQGNYYTQFWGSLEGDQDNYLSCGECFEVYKTKPDGSDYQPGEEGYQPPVLLSVIDSCPCNANGKWCCGSEWDQCQEIDFKYGCPVPKDSIHLDLSDIAMARLQSGSSNGHMEAGVIPNKYRRVPCPRLG

SEQ ID NO: 9116 - protein, 126 aa, Neocallimastix californiae
  EXPANSIN_EG45
NLACNCVPNAMVVGPTVALAEVAYGAFDHFGSGPACGLCYRLSPYATADGTPLSPIPEPIVFRVTDECPHQSNTEWCPGPEGGKNAHGFEDHFDVNIDSWGGKLRDWFQGGHMQAKYELVSCEEWP

SEQ ID NO: 9117 - protein, 182 aa, Neocallimastix californiae
  EXPANSIN_EG45
AGACGFGLYQVCGKNLKYTGEFAKLCDAFCKAYPSLCQDPEGLTYRGNFAAPQGNYYTQFWGILEGDQDNYLSCGECFEVYKTKEDGTDYKPGEEGYTPPVLLSVIDSCPCSANGKWCCGSEWDQCQEVNNFKYGCPVPKDSIHLDLSDVAMARLQSGTPDGHMPAGVIPNKYRRVPCPRLG

SEQ ID NO: 9118 - protein, 181 aa, Neocallimastix californiae
  EXPANSIN_EG45
AGACAFGVYGLCSFKSNVTMESEICQKFCKNYPDLCEDPVDTKLSLRGNFIAPNGNYYTQFWSSLPGDYDNYLSCGECYELEITQEDGSLYPEKQRRSENIIAQIVDSCPCSANAKWCCGSGIDHCNEIDFKYGCPIPEDSVHFDLSDIAMARLQTNDPNGGMVEGVIPIRYKRVPCPVKG

SEQ ID NO: 9119 - protein, 176 aa, Neocallimastix californiae
  EXPANSIN_EG45
GGACGFGLYGLCTTKYNETGALCQKFCKNYPDLCKDPDNISLRGNFCAPNGNYYTQFWSSLPGDYDNYLSCGECYEVERTQPDGSSYPKDTKTDNILLQVVDSCPCTANAKWCCGSGVDHCNEIDFKYGCPIPEGSWHVDLSDIAMSRLQTNDPYGTMFDGVIPIRYKRVPCPVKG

SEQ ID NO: 9120 - protein, 181 aa, Anaeromyces robustus; identical to SEQ ID NO: 9118
  EXPANSIN_EG45

SEQ ID NO: 9121 - protein, 176 aa, Anaeromyces robustus; identical to SEQ ID NO: 9119
  EXPANSIN_EG45

SEQ ID NO: 9122 - protein, 182 aa, Anaeromyces robustus
  EXPANSIN_EG45
GGACGFGLYQVCGSDHNYTGEFATLCTAFCRAYPTLCKDPVGRSYRGNFAAPQGNYYTQFWGSLEGDQDNYLSCGECFEVYKTKEDGSDYKPGEEGYQPPVLLSVIDSCPCSANGKWCCGSEWDQCQEVNNFKYGCPVPKDSIHLDLSDIAMARLQSGSSNGHMEAGVIPNKYRRVPCPRLG

SEQ ID NO: 9123 - protein, 140 aa, Anaeromyces robustus
  EXPANSIN_EG45
GGSCNVSAMGNAAGPTAAISGLSYGSWSGLGGGPACGLCYALTVYGSYDGQADPALFPKCSIVVRITDQCPYPDNKEWCPGPEQPESEKFLNPRGMRYHFDINISSGQGEAREWFPRDASGNLLGTGKVYFQMVSCREWS

SEQ ID NO: 9124 - protein, 126 aa, Anaeromyces robustus
  EXPANSIN_EG45
NLACNCVPNAMVVGPTVALAEVAYGAFDHFGSGPACGLCYRLSPFATADGTPLNPKPEPIVFRVTDECPHQSNAEWCPGPEGGKNAHGFEHHFDVNIDSWEGKLRDWFQGGHMQANFELVSCEEWP

SEQ ID NO: 9125 - protein, 140 aa, Piromyces finnis
  EXPANSIN_EG45
GGSCNVSAMGNAAGPTAAISGLSYGSWSGLGGGPACGLCYALTVFGSYDGQADPELFPKCSIVVRITDQCPYPDNKEWCPGPEQPESEGFLNPRGMRYHFDINISSGQGEAREWFPRDASGNLLGTGKVYFEMVSCREWS

SEQ ID NO: 9126 - protein, 176 aa, Piromyces finnis
  EXPANSIN_EG45
GGACGFGLYGLCTTKYNETGELCMRFCDKYPDLCADPPNISLRGNFCAPNGNYYTQFWSSLPGDYDNYLSCGECYEVERTQPDGSSYPEGEGTDNILLQVVDSCPCTANAKWCCGSGVDHCNEIDFKYGCPIPEGSWHVDLSDIAMSRLQTNDPYGGMVDGVIPIRYKRVPCPVKG

SEQ ID NO: 9127 - protein, 126 aa, Piromyces finnis
  EXPANSIN_EG45
NLACNCVPNAMVVGPTVALAEVAYGAFDHFGSGPACGLCYRLSPFATADGKPLSPIPEPIVFRVTDECPHQSNMEWCPGPEGGLNDHGFANHFDVNIDSWGGKLRDWFQGGHMQANFELVSCEEWP

SEQ ID NO: 9128 - protein, 810 aa, Neocallimastix californiae
  EXTRACELLULAR MATRIX GLYCOPROTEIN RELATED
TPNEQSDYPNCKNKDTEILYSSDDTKKEWGEENDDWCIITDLQRCPNSSDGYPCCPDCNVVYTDENNQVWGNLNDEWCSIPYRCSSNSTEVLKSDDYSSTTSSSGISNTSEVILNEYGLRWTDESWGNTNCRFQNGEMVCSFKGSNGEWPAFSFSNYQDYTGGRIVIRMRAARPNQDVYILTFDRSGNYKVRFNFKATSYYADYTYDIPEDGTYYRFAIQEGSGNDNTFYIKSILYYPKDYSGNNNNNYNNNNNNNYYSNQSVAIVDGNGLHWEDASWGNTNCNFQYYNGMVCSFVGEMNEYPAFSFKTDNSFKKGTLVINMKVLKPDLDVHLMAYDVNENYYSIKSFKATSYYADYTFDIPALSNSLSYYRFAIQEISNQDNTFYIKSVTFYPQDAQVPKTTTTTTVSKTPTPSVTYLDHPDAIIDGSGLHWEDASWGRTSCRFQRSNGMVCSFVGENNAWPAFSFKTNNHYNKGTLVINMKVSNPDLSINILAYDLNDNYYSIGNFKATTEYEDYTIEVPARINSLIYRFAIQEVSNQDNTYYIKSVTYYPPNVKVPTTTKKTTTTTAKRTTTTTTTTTTKRTTKRTTTTTTTTTVSKTPTPTVTYLDHADVIIDESGLHWEDASWGRTSCRFQRSNGMVCSFVGENNAWPAFSFKTDNHYSKGTLVINMKVSNPDLLINILAYDINENYYSIGNFRATTEYEDYTIEVPARINSLIYRFAIQEVSNQDNTYYIKKIVYYPPNVKIPTTTQKTTTTTTTTTTTVKKTTTTTTTTTTTTIKKTTTTKAQPKPTTTTTTTTTTTSSTGPT

SEQ ID NO: 9129 - protein, 759 aa, Neocallimastix californiae
  EXTRACELLULAR MATRIX GLYCOPROTEIN RELATED
PDQNLDEMLPQFHIDEEGYAKINDAEVLSGKYITEDIYKNIKDIDEYEFYERVLSNDPNFNITSITKAIDRMTEEGPQFKIFNDVDKIFRKNIIYDIIDDDDTEEFKTKNGTMSVEINGERKEFSKLTLKLGGRSSRSYGKPCYNIKIRNKDDLYGRTQFKIRSGSRDATFLRNKLACDIHNALGIPSISANYITLYINEDYLGFYIIMDAIKLSWVEFLYNDKNSTFLYKCDDVHNGISKKTAVKGCTNENENFTDKKDWEEFLTSIDEAESANNLEDILDIDQYLTEIALEYLFGSWDHYPVHSHNFYFYKANSVDKKWKYLIYDFDGEFGQDINSHFISQIEFPSSKSFFISNSTLYSSLLRRTDSSLNETEINQNNKTIASNNIEELFIDHEDKKYEFAAYSFTEWYNGQDHLIKILILNHPTRFVDTLKKIITKVFNPTILFPHIDEIKKFITPYVKKEKYPDENGKYPGNLDKSLEIYSLEQWDANSEFTAIADPIGRYKSYGIKYWILVKYRYLCQILSLECDSKYMDENFEYPININVDYDTIFSNNDNDNEDNDFDNEDNDFDNDFDNDTDNNNNDDVGNIGNDENGDNTENNKNIENDNNTEDVKDNSNNTNISDNSTIISSINPSTTTAILSSTTTSTTSSTSLIIPSTTTSDSSLTTSITITSSSITTTSSSSSTSLTSSTSISAEISPSSISSSTTSNVETTSTSITETTTSNVETTSTTITETTTSSVETTSNSITETTTSKETP

SEQ ID NO: 9130 - protein, 127 aa, Neocallimastix californiae
  FabD/lysophospholipase-like
GMSFTGQGSIKPGVGKELFRTQPVFRAAMEKCDAVVKKSTGISILDALYDQNQGHHLKKAQIAQPALFAYEYAMYMLWKSWGIKPVIVNGHSLGEIVAAAATGAIDIDLAIDFIIERARCMGEYGEK

SEQ ID NO: 9131 - protein, 102 aa, Neocallimastix californiae
  FabD/lysophospholipase-like
DAFHSPLMDPAIEELNGWIEEKNDAQFRQTLKVKFISNVDSTIKPVGDRLEKDYWGKHARNAVRFVDGVKSMIESEKKLLAVIEVGPAATLTNMSSRFVRET

SEQ ID NO: 9132 - protein, 136 aa, Neocallimastix californiae
  FabD/lysophospholipase-like
TAFAFTGQGVAKVGMGKHFYQTQPVFREAMDRCDAVTRRLLGVSIVEVLYNVSNIPNGTEEGEKALKKSSVAQPALFAYEYAMSQLWISWGIKPSMVLGHSLGEIVATTIAGGIDFELAMEFIVERASCMEKYGIK

SEQ ID NO: 9133 - protein, 103 aa, Neocallimastix californiae
  FabD/lysophospholipase-like
EAFHSALMDPAIEKLYEWIDSKPDEKFRQPLKYGLISNVTGKLIPAGERLPKNYWGEHARNAVQFVKAVETLLANSETLLNVIEVGPASVLTNMSSRILREKK

SEQ ID NO: 9134 - protein, 133 aa, Neocallimastix californiae
  FabD/lysophospholipase-like
KLAFTFSGQGTQYPDMGRQLYHSNPYFANIIDYCNEIVLSISKKDLLKETGLFGDLPVNEENLMDPQYSFLAIGIIQLALVEFWKAYGVEPSLVFGHSMGEVAAAYAAGILTLEDAILLLYHYGLISQNLEEN

SEQ ID NO: 9135 - protein, 92 aa, Neocallimastix californiae
  FabD/lysophospholipase-like
KAFHTPFILSAKEKFLKGIEGIHLRVQPPKIPFISSTHGNEYQGPFDANYWWSNIINPVNFSQAVKIAHTKVDKVLEISSTPVLGIYISSVF

SEQ ID NO: 9136 - protein, 104 aa, Neocallimastix californiae
  FabD/lysophospholipase-like
YVSDLYHRLPSFRQAIKECDKEIKKLTQYKYSLIKDLASLGEESKKSNLSYLGNVLVLALHYAFYKVIRSIHPVEGTLLVGYGYGELAAILNAGGISFGKAAQF

SEQ ID NO: 9137 - protein, 93 aa, Neocallimastix californiae
  FabD/lysophospholipase-like
QAFHSPYVEGAEQAFKESIRGISERTSAPKCKFISACFGQEYEGPFDENYWWANIRNPVSFYAAASIGTQFSKRVLEIGAHPVLSVYLKEIYG

SEQ ID NO: 9138 - protein, 134 aa, Neocallimastix californiae
  FabD/lysophospholipase-like
NFAFSGQGSQFINMGRRMYQVNGLFKRIVDYCAAVLVTYNGGEDIFEKYHIFKGDVSQISEADLSLPQYSILAIGVAQIALTEIWKAMGVTPEAVFGHSMGEVAAAYAAGILTLEDAILLLYMRGHILAQLDGT

SEQ ID NO: 9139 - protein, 76 aa, Neocallimastix californiae
  FabD/lysophospholipase-like
GLLNATQFTQPAITLTEKAAFEDMYEKGYICDDAVYAGHSLGEYAALSCVANTLSIESMAEIVFYRGLVMQSSVER

SEQ ID NO: 9140 - protein, 21 aa, Neocallimastix californiae
  FabD/lysophospholipase-like
VPFHSSYLLWGVPTFRELLHQ

SEQ ID NO: 9141 - protein, 77 aa, Neocallimastix californiae
  FabD/lysophospholipase-like
TNSAYLEKIIEEWDQHLFEIPYIIMVELLSYQLASAVQWIKTQEFLFSSQKKGGADIERLIEFGPTPTLVGMAKRTL

SEQ ID NO: 9142 - protein, 53 aa, Neocallimastix californiae
  FabD/lysophospholipase-like
TAYVFTGQGAQEVGMGQDLYNKSAVAKAVWDRADAYLMKKYGYSILEIVRTNP

SEQ ID NO: 9143 - protein, 156 aa, Neocallimastix californiae
  FabD/lysophospholipase-like
AVFGGQGYPGFNEILQAYTMYGAIVRDYIAELSTILKELASKPEFQRTYKQGLDILKWLRNPESLPEDAYLDSAPVSFPLIGIVQLVQYLILFRTFRKTPDWARHLFAGTTGHSQGLVTSVVIASSGTEEEYLENSKKAVSLLFLIGARSQQIFAI

SEQ ID NO: 9144 - protein, 105 aa, Neocallimastix californiae
  FabD/lysophospholipase-like
IPAHNEILKEAAELVVEDAAKLNITFPTKNLAIPVYRTDNGVDMKEESDITDVVEPVVNQICILPVDWVKATNVPGLTHVLDFGPGGASGIGSLIQKNKEGTGVQ

SEQ ID NO: 9145 - protein, 94 aa, Neocallimastix californiae
  FabD/lysophospholipase-like
ICTPYLNDFKDEFFASLKGIGNNCKTPVIKFISTTLGQPFNGPLNEYYWWANLSSTVNFSHALSLAMNEQQKGSGYILDVGSGYANAALFTNYF

SEQ ID NO: 9146 - protein, 134 aa, Neocallimastix californiae
  FabD/lysophospholipase-like
ITFVFRGMSQLNSNIGYSLYQYNQKFAEIVDYCDKVLEKVSGGVCSLKREFGLFQSENLNFLSLQNPKMSIIGNGMIQLALGHLLKSYGIKPSSVVGYNSGEIAAAYTAGIISLEDAILVLYQYSTILEKVPNK

SEQ ID NO: 9147 - protein, 21 aa, Neocallimastix californiae
  FabD/lysophospholipase-like
VPFHSSFLLRGVAPFRQYLMS

SEQ ID NO: 9148 - protein, 53 aa, Neocallimastix californiae
  FabD/lysophospholipase-like
TAYVFTGQGAQEVGMGMDLYEKSPVAREIWDRADAHLMENYGFSIIDIVKNNP

SEQ ID NO: 9149 - protein, 76 aa, Neocallimastix californiae
  FabD/lysophospholipase-like
GLLSATQFTQPSLVLMEKAAFEEMRSRGFIQQNSAFAGHSLGEYAALTAIGDVLSIETLVDVVFYRGMTMQRAVQR

SEQ ID NO: 9150 - protein, 79 aa, Neocallimastix californiae
  FabD/lysophospholipase-like
TNSSRIKNVLKGWTDDKYASPRLQQKLGYILLIELLAYQFASAVRWIETQDRLFVDIGVERLIEIGPGPTLSGMAQKTL

SEQ ID NO: 9151 - protein, 91 aa, Neocallimastix californiae
  FabD/lysophospholipase-like
VPFHCDYLKDVNDIIMKDVERDHLILGKGELVIPILSTETGEDLRGHPQFTYELIKQICTLPVHWEKATSVTNATHVLEFGPSGAGVGLLT

SEQ ID NO: 9152 - protein, 158 aa, Neocallimastix californiae
  FabD/lysophospholipase-like
FAVFGGQGSEDYFNEIKEIYSTYEVIIKSYLERMSCMLEELASKPELLQFFPKGLHVLKWLEEPETLPDTKYLVNAPISLPLVGLCQLLHYSVLYKILGKTPDEMRRCFVGTTGHSQGIISSVVVSSSGTEEEFIENSQKALSLLFWIGVRSQMAYPE

SEQ ID NO: 9153 - protein, 79 aa, Neocallimastix californiae; identical to SEQ ID NO: 9150
  FabD/lysophospholipase-like

SEQ ID NO: 9154 - protein, 76 aa, Neocallimastix californiae; identical to SEQ ID NO: 9149
  FabD/lysophospholipase-like

SEQ ID NO: 9155 - protein, 21 aa, Neocallimastix californiae
  FabD/lysophospholipase-like
VPFHSSFLLRGVAPFRQYLMS

SEQ ID NO: 9156 - protein, 53 aa, Neocallimastix californiae; identical to SEQ ID NO: 9148
  FabD/lysophospholipase-like

SEQ ID NO: 9157 - protein, 136 aa, Neocallimastix californiae
  FabD/lysophospholipase-like
ATFYDTCRDFYCNNSYFADCIDYCDQVLKMISGRSLLEDYGLFQSVKEEEKEKEKEKKNKLREDLLKDPTTTLLINGIIQLGLVALYRYYGISPNAVIGYGAGEIAAAYAAEKIDLKSAVQILYHYGRVLSMVKKD

SEQ ID NO: 9158 - protein, 85 aa, Neocallimastix californiae
  FabD/lysophospholipase-like
FAIHTKKISEAMKEELVKRLTNIKSKPSSIAMFSTTKFSKEGKPYTDALDGQYWWMNMRNPVLYAHSLSQTANFLPTDGKNILEI

SEQ ID NO: 9159 - protein, 118 aa, Neocallimastix californiae
  FabD/lysophospholipase-like
FACYLYRTYPVYAKALEECDRIISELSNFKVLLVNLIICMGELVQPDLLKEYKKQVDEDPCMAQFIILSMNYALTALLRHLNISINLVMGDGFGEVSAALACQKITLRNAFILIQYLC

SEQ ID NO: 9160 - protein, 158 aa, Neocallimastix californiae
  FabD/lysophospholipase-like
FAVFGGQGSEDYFNEIKEIYSTYEVIIKSYLERMSCMLEELASKPELLQFFPKGLHVLKWLEEPETLPDTKYLINAPISLPLVGLCQLLHYSVLYKSLGKTPDEMRRCFVGTTGHSQGIISSVVVSSSGTEEEFIDNSEKALSLLFWIGVRSQMAYPE

SEQ ID NO: 9161 - protein, 91 aa, Neocallimastix californiae
  FabD/lysophospholipase-like
VPFHCDYLKDVNDIVMKDVERDNLTLGKGELAIPILSTETGEDLRGHPQFTYELIKQICTLPVYWEKATSITNATHILEFGPSGAGVGLLT

SEQ ID NO: 9162 - protein, 79 aa, Neocallimastix californiae; identical to SEQ ID NO: 9150
  FabD/lysophospholipase-like

SEQ ID NO: 9163 - protein, 76 aa, Neocallimastix californiae
  FabD/lysophospholipase-like
GLLSATQFTQPSLVLMEKAAFEEMRTRGFIQQNSAFAGHSLGEYAALTAIGDVLSIETLVDVVFYRGMTMQRAVQR

SEQ ID NO: 9164 - protein, 21 aa, Neocallimastix californiae
  FabD/lysophospholipase-like
VPFHSSFLLRGVAPFRQYLMS

SEQ ID NO: 9165 - protein, 53 aa, Neocallimastix californiae
  FabD/lysophospholipase-like
TAYVFTGQGAQEVGMGMDLYEKSPVAREIWDRADAHLMESYGFSIIDIVKNNP

SEQ ID NO: 9166 - protein, 156 aa, Neocallimastix californiae
  FabD/lysophospholipase-like
AVFGGQGYPGFNEILQAYTIYGAIVRDYIAELSTVLKELAAKPEFERTYKQGLDILKWLRNPESLPEDAYLDSAPVSFPLIGIVQLVQYLILFRSFRKTPDWARRLFAGTTGHSQGLVTSVVIASSGTEEEYLENSKKAVSLLFLIGARSQQIFAI

SEQ ID NO: 9167 - protein, 105 aa, Neocallimastix californiae
  FabD/lysophospholipase-like
IPAHNEILKDAAELVVDDAAKLNITFPTKNLAIPVYRTDNGVDMKEEAEVTDVVESVVNQICILPVDWVKATNVPGLTHVLDFGPGGASGIGSLIQKNKEGTGVQ

SEQ ID NO: 9168 - protein, 76 aa, Neocallimastix californiae
  FabD/lysophospholipase-like
TNSTYLEKIIEEWDDHLFEIPYIIMVELLAYQLASAVQWIKTQEFLFSSKNKGGADVERLIEFGPTPTLVGMAKRT

SEQ ID NO: 9169 - protein, 53 aa, Neocallimastix californiae
  FabD/lysophospholipase-like
TAYVFTGQGAQEVGMGQELYNKSAVAKAVWDRADAYLMKKYGYSILEIVRTNP

SEQ ID NO: 9170 - protein, 21 aa, Neocallimastix californiae
  FabD/lysophospholipase-like
VPFHSSYLLWGVPTFRELLHQ

SEQ ID NO: 9171 - protein, 76 aa, Neocallimastix californiae
  FabD/lysophospholipase-like
GLLNATQFTQPAITLTEKAAFEDMLENGYICDDAVYAGHSLGEYAALSCVANTLSIESMAEIVFYRGLVMQSSVER

SEQ ID NO: 9172 - protein, 68 aa, Neocallimastix californiae
  FabD/lysophospholipase-like
DAFHSPLMDPAIEELNNWIEEKDDAKFRQSLKVKFISNLDGTIKPVGDRLEEDYWAKHARNAVRFVDG

SEQ ID NO: 9173 - protein, 127 aa, Neocallimastix californiae
  FabD/lysophospholipase-like
GMSFTGQGSIKPGVGQELFRSQPVFHAAMEKCDAVVKKVTGVSIIDALYDQSQAHHLKKAQIAQPALFAYEYAMCMLWKSWGVEPVIVNGHSLGEIVAAAVTGAIDIDLAIDFIIERARCMGEYGEK

SEQ ID NO: 9174 - protein, 167 aa, Neocallimastix californiae
  FabD/lysophospholipase-like
SIKDVYQNYDYYKECFIYCEQKIQKLGGDKKYPMFDVVFEHDKINIDTLDPIVKRLIIFSHFYSLHKLFLNFNISINAISGKGIGEYFTLAISYALSLEDSLRLLINYYNNTTVDSDKIEKEVKLIMSIQKPLRCYFYSNATKRLLKTNEYLDETYWKTLLSNVVFQ

SEQ ID NO: 9175 - protein, 168 aa, Neocallimastix californiae
  FabD/lysophospholipase-like
SIKDVYQNYDYYKECFIYCEQKIQKLGGDKKYPMFDVVFEHDKINIDTLDPIVKRLIIFSHFYSLHKLFLNFNISINAISGKGIGEYFTLAISYALSLEDSLRLLINYYNNTTVDSDKIEKEVKLIMSIQKPLRCYFYSNATKRLLKTNEYLDETYWKTLLSNVVFQE

SEQ ID NO: 9176 - protein, 155 aa, Neocallimastix californiae
  FabD/lysophospholipase-like
SIKEIYQYYDYYKECFIYCEQKIQSLGGNKKHPMFDVVFDSNYSDIKNLDPIVKRLIIFSHFYSLHKLFLNFNVSINSIGGEGIGEYFALAISGVLSLEESLKLLINYHNIIVDKNKIEKEVKSLLSIQKPLRCHFYSSATKRLMKTSQYLDDSY

SEQ ID NO: 9177 - protein, 72 aa, Neocallimastix californiae
  FabD/lysophospholipase-like
FGIHSKIITEAMKDELTKRLENISSHSSSIAMFSTAKFNEKSEPYTGALDGSYWWMNMRNPVLYAHTLSQTV

SEQ ID NO: 9178 - protein, 74 aa, Neocallimastix californiae
  FabD/lysophospholipase-like
EDLLKDPSTALLISGIVQFSLVSLYKYYGITPSVVIGYGAGEITAAYAAEKIDLKDAVQILYHYGQVLSMANNS

SEQ ID NO: 9179 - protein, 156 aa, Anaeromyces robustus
  FabD/lysophospholipase-like
AVFGGQGYPGFNEILQAYTIYGAIVRDYIDELSTVLKDLASKPEFERTYKQGLDILKWLRHPDSLPEDAYLDSAPVSFPLIGIVQLVQYLILFRTFRKTPDWARHLFAGTTGHSQGLVTSVVIASSGTEEEYLENSKKAVSLLFLIGARSQQKFAI

SEQ ID NO: 9180 - protein, 105 aa, Anaeromyces robustus
  FabD/lysophospholipase-like
IPAHNEILKEAADLIIEDAAKLNITFPTQDLAIPVYRTDNGVDMKEEVDVPDVVESVVKQICILPVDWVKATNVPGLTHVLDFGPGGASGIGSLIQKNKEGTGVQ

SEQ ID NO: 9181 - protein, 78 aa, Anaeromyces robustus
  FabD/lysophospholipase-like
TNSTYLEKIIEEWDQHLFEIPYIIMIELLAYQLASAVQWIKTQEFLFSSEKKGGVDIERLIEFGPTPTLVGMAKRTLA

SEQ ID NO: 9182 - protein, 76 aa, Anaeromyces robustus; identical to SEQ ID NO: 9171
  FabD/lysophospholipase-like

SEQ ID NO: 9183 - protein, 21 aa, Anaeromyces robustus
  FabD/lysophospholipase-like
VPFHSSYLLWGVPTFRELLHQ

SEQ ID NO: 9184 - protein, 53 aa, Anaeromyces robustus
  FabD/lysophospholipase-like
TAYVFTGQGAQEVGMGQELYNKSAVAKSVWDRADAYLMKKYGYSILEIVRTNP

SEQ ID NO: 9185 - protein, 133 aa, Anaeromyces robustus
  FabD/lysophospholipase-like
KLAFTFSGQATQYPDMGRQLYHSNPYFASIINYCNEIIIRLSQKDLIKDTGLFSDTPVDEEKLIDPQYSFLAIGIIQLALVEFWKLYGVEPALVFGHSMGEVAAAYAAGILTIEDAILLLYNYGLISQNVDDI

SEQ ID NO: 9186 - protein, 95 aa, Anaeromyces robustus
  FabD/lysophospholipase-like
KAFHTPYIITAKQKFIQGIQGIGSRVNSPKIPFISSTYGKEYQGPFDEEYWWTNIINPVNFSQATKVARTKVEKVLEIGSTPVLGIYMSKIFNPD

SEQ ID NO: 9187 - protein, 103 aa, Anaeromyces robustus
  FabD/lysophospholipase-like
EAFHSALMNPAIEKLYEWIETKPDDKFRKPLKYGLISNVTGELIPAGERLPKNYWGEHARNAVQFVKAVETLLANSETLLNVIEVGPSNVLTNMSARILREKK

SEQ ID NO: 9188 - protein, 135 aa, Anaeromyces robustus
  FabD/lysophospholipase-like
AFAFTGQGVAKVGMGKHFYQTQPVFRKAMDKCDEVTRRLLNVSIVEVLYNISNAPNGIEKGENALKKSSVAQPALFAYEYAMSQLWISWGVEPSMVLGHSLGEIVATTIAGGIDFELAMEFIVQRASCMEKYGIK

SEQ ID NO: 9189 - protein, 103 aa, Anaeromyces robustus
  FabD/lysophospholipase-like
DAFHSPLMEPAIEELDKWIEGKDDEKFRQPLKVRFISNVDGKIKEVGERLDENYWAEHARSTVRFVDGVKSMIESENNNILAVIEVGPAATLSHMSARYVREN

SEQ ID NO: 9190 - protein, 127 aa, Anaeromyces robustus
  FabD/lysophospholipase-like
GMSFTGQGSIKPGVGQELYRSQPVFRDAIDKCDTVLKKVTGISLVDVLYNPQQAHHLKKAQIAQPALFAFEYAMCMLWKSWGVEPTIVNGHSLGEIVAAAVTGAMDIDLAIDFIVERARCIGEYGEK

SEQ ID NO: 9191 - protein, 21 aa, Anaeromyces robustus
  FabD/lysophospholipase-like
VPFHSSFLLRGVAPFRQYLMS

SEQ ID NO: 9192 - protein, 76 aa, Anaeromyces robustus; identical to SEQ ID NO: 9149
  FabD/lysophospholipase-like

SEQ ID NO: 9193 - protein, 53 aa, Anaeromyces robustus
  FabD/lysophospholipase-like
TAYVFTGQGAQEVGMGMDLYEKSAVAREIWDRADAHLMETYGFSIIDIVKNNP

SEQ ID NO: 9194 - protein, 79 aa, Anaeromyces robustus; identical to SEQ ID NO: 9150
  FabD/lysophospholipase-like

SEQ ID NO: 9195 - protein, 158 aa, Anaeromyces robustus
  FabD/lysophospholipase-like
FAVFGGQGSEDYFDEIKEIYNTYEVLIKSYLERMACVLEELASKPELLQFFPKGLHVLKWLEEPETLPDTKYMINAPISLPLVGLCQLLHYCVLYKSLGKTPDEMRSSFVGTTGHSQGIISSVVVSSSGTEEEFIENSIKALSLLFWIGVRSQMAYPE

SEQ ID NO: 9196 - protein, 92 aa, Anaeromyces robustus
  FabD/lysophospholipase-like
VPFHCDYLKDVNDTIMKDVERDHLILGKGELAIPIYSTETGEDLRGHPQFTYELIKQICTLPVHWEKATSITNATHILEFGPSGAGVGLLTH

SEQ ID NO: 9197 - protein, 133 aa, Anaeromyces robustus
  FabD/lysophospholipase-like
ITFVFRGISELNSNFSYSLYKYNQKFAKIVDYCDKVLEKVSQGLSLKRDYGLFQKENFDETTLRDPKISVIGSGIIQLTMAHLLKSYAIIPSSVVGYSIGEISAAYAAGIISLEDAVLILYQYSSILEKVPGK

SEQ ID NO: 9198 - protein, 83 aa, Anaeromyces robustus
  FabD/lysophospholipase-like
ICTPYLNDFKDEFYESLRDIGSRCKDPVIPFISTTLGQPFNGPLNEFYWWANLTSTVNFSSALSLAMNEQPNGSGYILDVGSG

SEQ ID NO: 9199 - protein, 102 aa, Piromyces finnis
  FabD/lysophospholipase-like
DAFHSPLMDPAVSELNKWIERKDDSKFRQDLKVKFISNVDGNIKPVGSRLEEDYWGKHARNAVRFVDGVKSMIESEKKLLAVIEVGPAATLTNMSSRFVRET

SEQ ID NO: 9200 - protein, 127 aa, Piromyces finnis
  FabD/lysophospholipase-like
GMSFTGQGSIKSGVGLELYRTQPVFRDALNKCDVVVKKATGISLIDALYNPSQSHHLNKAQIAQPALFAYEYAMCMLWKSWGINPTIVNGHSLGEIVAAASTGAMDIDLAIDFIIERARCMGEYGEK

SEQ ID NO: 9201 - protein, 103 aa, Piromyces finnis
  FabD/lysophospholipase-like
VSELYNSQPVFRKVIKNCDKEIMEITHQQYSLVKDIASLGKEEKKDMPYINNIITLAIHHAYYKLMKSVYSVDNSLFIGYGYGELSAILNAGGISFKAASQLL

SEQ ID NO: 9202 - protein, 107 aa, Piromyces finnis
  FabD/lysophospholipase-like
KLLVELYISRPEFKQAIEECDAIITTISNNVYSLVDDITSKGMNINESKDAFKNIKILSFYYALSKVIDNELNVKQSIFGGYGLGEIISILINNGISIEKAIRFLKL

SEQ ID NO: 9203 - protein, 80 aa, Piromyces finnis
  FabD/lysophospholipase-like
TPFLNNFKNEFHEALKDIGSRCKAPATPFISTTLSQPFNGPLNEYYWWANFTSTVNFNVALSLAMNEQQKGSGYILDVGC

SEQ ID NO: 9204 - protein, 133 aa, Piromyces finnis
  FabD/lysophospholipase-like
ITFVFRGISELKTNLGYSLYQNNKMFADVVDYCDKILEKISQGYSVKKNTGLFLKENLDAATLQSPKISVVGSGMIQLAMAHLLKTYGIVPSSVVGYNTGEIAAAYATGIISLEDAILILYQFSNILEKVPGK

SEQ ID NO: 9205 - protein, 103 aa, Piromyces finnis
  FabD/lysophospholipase-like
EAFHSALMDPAIEKLYEWINTKPDEKFRQPLKYGLISNVTGELIEAGERLPKNYWGEHARNAVQFVKAVETLLANSETLLNVIEVGPANVLTNMSSRILREKR

SEQ ID NO: 9206 - protein, 135 aa, Piromyces finnis
  FabD/lysophospholipase-like
AFAFTGQGVAKVGMGKHFYQTQPVFRKAMDKCDEVTRRLLDVSIVEVLYNISNSPNGVEEGEKALKKSSVAQPALFAYEYAMSQLWISWGVEPSMVLGHSLGEIVATTIAGGIDFELAMEFIVQRASCMEKYGVK

SEQ ID NO: 9207 - protein, 103 aa, Piromyces finnis; identical to SEQ ID NO: 9205
  FabD/lysophospholipase-like

SEQ ID NO: 9208 - protein, 135 aa, Piromyces finnis; identical to SEQ ID NO: 9206
  FabD/lysophospholipase-like

SEQ ID NO: 9209 - protein, 131 aa, Piromyces finnis
  FabD/lysophospholipase-like
STYYNCCRNLYCNNKYFSDCIDYCDGIFKALSQRSLLQDYGLFTTEMMDNNKFKKFNSDLRKDPLVMIMFGGMVQLTLSALLKYYGLFPNAVIGYGAGEIVAAYVADKMDLKTTVKVLYHYGRVLSHAYSQ

SEQ ID NO: 9210 - protein, 85 aa, Piromyces finnis
  FabD/lysophospholipase-like
YGLHSMMINDKMKEDLVNSLKDIPLQTSDIAFFTTTKLNKDGKPYEGKLDGEYWWMNMRNPVLYAHALSQTVAFLPIDGKNIIEI

SEQ ID NO: 9211 - protein, 158 aa, Piromyces finnis
  FabD/lysophospholipase-like
FAVFGGQGSEDYFDEINEIYSTYEAMVKSYLERMACILEELASKPELLQFFPKGLHVLKWLEEPETLPDKKYLVNAPISLPLVGLCQLLHYTVLYKSLGKTPDEMRRSFIGTTGHSQGIISSVVVSSSGTEEEFIENSEKALSLLFWIGVRSQMAYPE

SEQ ID NO: 9212 - protein, 91 aa, Piromyces finnis
  FabD/lysophospholipase-like
VPFHCDYLKDVNDIIMKDVERDHLILGKGELAIPIYSTENGEDLRGHPQFTYELIKQICTLPVHWEKATSVTNATHILEFGPVGAGVGLLT

SEQ ID NO: 9213 - protein, 53 aa, Piromyces finnis
  FabD/lysophospholipase-like
TAYVFTGQGAQEVGMGMDLYEKSPVAREIWDRADKHLMENYGFSIIDIVKNNP

SEQ ID NO: 9214 - protein, 75 aa, Piromyces finnis
  FabD/lysophospholipase-like
RIKNVLKGWTDDKYASPLLQQKLGYILLIELLAYQFASAVRWIETQDRLFVDIGVERLIEIGPGPTLSGMAQKTL

SEQ ID NO: 9215 - protein, 21 aa, Piromyces finnis
  FabD/lysophospholipase-like
VPFHSSFLLRGVAPFRQYLMS

SEQ ID NO: 9216 - protein, 76 aa, Piromyces finnis
  FabD/lysophospholipase-like
GLLSATQFTQPSLVLMEKAAFEEMRSRGYIQQNSAFAGHSLGEYAALTAIGDVLSIETLVDVVFYRGMTMQRAVQR

SEQ ID NO: 9217 - protein, 158 aa, Piromyces finnis; identical to SEQ ID NO: 9211
  FabD/lysophospholipase-like

SEQ ID NO: 9218 - protein, 91 aa, Piromyces finnis; identical to SEQ ID NO: 9212
  FabD/lysophospholipase-like

SEQ ID NO: 9219 - protein, 53 aa, Piromyces finnis; identical to SEQ ID NO: 9213
  FabD/lysophospholipase-like

SEQ ID NO: 9220 - protein, 75 aa, Piromyces finnis; identical to SEQ ID NO: 9214
  FabD/lysophospholipase-like

SEQ ID NO: 9221 - protein, 21 aa, Piromyces finnis
  FabD/lysophospholipase-like
VPFHSSFLLRGVAPFRQYLMS

SEQ ID NO: 9222 - protein, 76 aa, Piromyces finnis; identical to SEQ ID NO: 9216
  FabD/lysophospholipase-like

SEQ ID NO: 9223 - protein, 53 aa, Piromyces finnis; identical to SEQ ID NO: 9213
  FabD/lysophospholipase-like

SEQ ID NO: 9224 - protein, 75 aa, Piromyces finnis; identical to SEQ ID NO: 9214
  FabD/lysophospholipase-like

SEQ ID NO: 9225 - protein, 21 aa, Piromyces finnis
  FabD/lysophospholipase-like
VPFHSSFLLRGVAPFRQYLMS

SEQ ID NO: 9226 - protein, 76 aa, Piromyces finnis; identical to SEQ ID NO: 9216
  FabD/lysophospholipase-like

SEQ ID NO: 9227 - protein, 158 aa, Piromyces finnis; identical to SEQ ID NO: 9211
  FabD/lysophospholipase-like

SEQ ID NO: 9228 - protein, 91 aa, Piromyces finnis; identical to SEQ ID NO: 9212
  FabD/lysophospholipase-like

SEQ ID NO: 9229 - protein, 158 aa, Piromyces finnis; identical to SEQ ID NO: 9211
  FabD/lysophospholipase-like

SEQ ID NO: 9230 - protein, 91 aa, Piromyces finnis; identical to SEQ ID NO: 9212
  FabD/lysophospholipase-like

SEQ ID NO: 9231 - protein, 53 aa, Piromyces finnis; identical to SEQ ID NO: 9213
  FabD/lysophospholipase-like

SEQ ID NO: 9232 - protein, 21 aa, Piromyces finnis
  FabD/lysophospholipase-like
VPFHSSFLLRGVAPFRQYLMS

SEQ ID NO: 9233 - protein, 75 aa, Piromyces finnis; identical to SEQ ID NO: 9214
  FabD/lysophospholipase-like

SEQ ID NO: 9234 - protein, 76 aa, Piromyces finnis; identical to SEQ ID NO: 9216
  FabD/lysophospholipase-like

SEQ ID NO: 9235 - protein, 91 aa, Piromyces finnis
  FabD/lysophospholipase-like
KAFHTSYIITAKDKFLQSIQGIGNRVKAPKIPFISSTYGREYQGPFDEEYWWTNIISPVNFSQATKIARSKIDKVLEIGSTPVLGIYMSND

SEQ ID NO: 9236 - protein, 133 aa, Piromyces finnis
  FabD/lysophospholipase-like
KVAFTFSGQGTQYPEMGLQLYNMNPYFASIIDYCNSIHTQISKKDLLKETGLFGKGPVNEEKLLDPQYSFPAIGIIELALVELWKRYGVEPALVFGHSMGEVAAAYAAGILTIEDAILLLYNYGQISENVVDA

SEQ ID NO: 9237 - protein, 96 aa, Piromyces finnis
  FabD/lysophospholipase-like
QAFHSPYVEGAEKAFKESIRGIGERTKAPNCKFVSACFGQEYEGPFDENYWWANIRNPVSFHAAASIATQFSKRVLEIGAHPVLGMYLKEIYGKDN

SEQ ID NO: 9238 - protein, 134 aa, Piromyces finnis
  FabD/lysophospholipase-like
NFAFSGQGSQFINMGRRMYQTNDLFKKVVDYCAAVLVTINGGEDIFEKYSIFKGDVAQISETDLSLPQFSVLAIGIAQIALIEVWKSMGVTPKAVYGHSMGEVAAAYAAGVLTIDDAVLLLYMRGHILAQLDGT

SEQ ID NO: 9239 - protein, 29 aa, Piromyces finnis
  FabD/lysophospholipase-like
RMEHSQSFYSSIHQQVFSKGQNLNGDYWV

SEQ ID NO: 9240 - protein, 125 aa, Piromyces finnis
  FabD/lysophospholipase-like
CYLYRTQPVYAKALEECDKIITELSNFKILLVNLVICMGELIQPELLQEYKKQVDEDPCMAQFIALSMNYALIKLLEHLSISPNLVVGYKFGEITAALACGKISLRNAFLIIHYICKIIRKNIQL

SEQ ID NO: 9241 - protein, 273 aa, Neocallimastix californiae; identical to SEQ ID NO: 323
  FAMILY NOT NAMED

SEQ ID NO: 9242 - protein, 195 aa, Neocallimastix californiae; identical to SEQ ID NO: 3963
  FAMILY NOT NAMED

SEQ ID NO: 9243 - protein, 316 aa, Neocallimastix californiae; identical to SEQ ID NO: 3964
  FAMILY NOT NAMED

SEQ ID NO: 9244 - protein, 316 aa, Neocallimastix californiae; identical to SEQ ID NO: 3965
  FAMILY NOT NAMED

SEQ ID NO: 9245 - protein, 494 aa, Neocallimastix californiae
  FAMILY NOT NAMED
KGASYRVEHVYAGDLDGDGTYDFVVKRMSDNRDPILLEAYKLDGTFLWRMNLGPNIETYTSSLTSPVLVYDFDGDGKAEVMVKTSEGTVFGDGTKIGDVNHDGRTDYCERNRTQYQVLTGPEFISMVDGMTGKEIDRVDFLERGNTNDWGDNYGNRMNFIFVTVAYLDGKEPSMVLTRGAGDLRNKRAITAYALKFQNRKFTVQWTFRILDYKNKIPAGHGMVEFHSIRGVDLDGDGFDEIHLGGFAIDHDGKLLYSTELGHGDRFIIADINPNRKGLEYFAIQQNHEGKLGTALLDAATGKTIWKQYLPQKEDVGRGDAASILDVYGMQCWSSSFPGFYDVNGKQLTNNRSFPSLSIWWDGDLKREFLDGIGKEGYNPAINKWNVAKDSNDRIFTIYNDGGNYSVISPYSGRVPLYGDLIGDWREEIVLETANHQELRVYTTTVGTEYSIYTLMHNPAYRNCVNVKGYLQSTEVDYYLGYGADVKNIPKPDIY

SEQ ID NO: 9246 - protein, 257 aa, Neocallimastix californiae; identical to SEQ ID NO: 324
  FAMILY NOT NAMED

SEQ ID NO: 9247 - protein, 313 aa, Neocallimastix californiae
  FAMILY NOT NAMED
ANGYELLKNYSKGFRIGAATNTIHYNNANYVNAMKAFNYMVAENACKFVSIQGTKGRFNFNDCDAHYNKAKELGMDFRGHALIWHSMAPKWLEYEDSNTMRNSIVNHITTVLKHYEGKIDTWDVVNEAIDDDSNGNGWKYRNSFLYQKNRDFIDLAFKTARQVAPKVKLFYNDYNTEGIWGKSESVYQFVADLKKRNIPIDGVGLQYHVSVQNQPQFNKINDLIGRYCKLGLEVHITELDVSCVNSCNAGDVESRQSQVFTNALKACLNNSCCTAFLVWGIGDPDSWLGNDKKGLLFNGNYQPKSQYNALLNV

SEQ ID NO: 9248 - protein, 321 aa, Neocallimastix californiae
  FAMILY NOT NAMED
DVIQQVRPDFYFGVSTASHFFANPKYNDIISTYNLQVAGNECKFYTFNGSQTFNTKPCDDTVAFAKKYGAKFRGHNLFWPAYSPQWFQDAHDGSDPEAVKEYILDYVAKVLDHYKDEEDIIYWDVINESVTDDSTAKNIKLRTGSDNSNEFEGWDTYTEDIFKVAREHTNENVKLFYNDYNAEANNGNFDGKTGAVFEYIRSMREKGVPIDGVGLQMHVSCNWTPNYEQLTKLISQYEEIGVEVHITEIDVKRTQCKSAEAQKEVFMNVFKACFDHENCKVFTVWGSYDEESWVGVENEPVLFDVDMYPKDIYFDMLDYVL

SEQ ID NO: 9249 - protein, 108 aa, Neocallimastix californiae
  FAMILY NOT NAMED
GGRMRTNVRYKSGKFEVRAKMPIASGLVPAIYFASTPDNTNGNQDEFDFELIGSNRMQTNLFIYGNGGREQVWNPPTDLSKDFHLYTFEWNSNSIVLKVDNQVIRTFN

SEQ ID NO: 9250 - protein, 211 aa, Neocallimastix californiae
  FAMILY NOT NAMED
AYTGDGTTYGDPLTGGYCMMPDSEAYTKDMMFAAMNLPQYNISAGCGSCLILAQADKPERVIRVRVVDRCGECPKGDIDLSNTAWKALTGDFIPGRVKIIWSIVPCTETWYDYPPLVEEDSPIKLKWKMASSVYWGGIQAFNTRYPVTSIERWDDASNDWVHLRRDDMFHYMWDTTIPGGPMKVRVTQGDGVQVVVDGLTIDGSWYDVDDN

SEQ ID NO: 9251 - protein, 316 aa, Neocallimastix californiae
  FAMILY NOT NAMED
AAYADAYDLLKDYSNGFRIGAATNTRFYNNGNYVNAMKAFNYMVAENACKFVSIQGTKGKFNFNDCDNHLKKAKELGMDFRGHALVWHSMAPDWLKNEDSKTMRQSIVNHITKVLQHYDGKIDTWDVVNEAIDDDSNGNGWKYRNSFLYQKNRDFIDLAFKTARQVAPKVKLFYNDYNTEGIWGKSESVYQFIADLKKRNIPIDGVGIQYHVSVKNQPQLNKITDLIGRYCKLGLEVHITEIDVSCEGACNNGDVQNRQAQVFTNALKACLANSCCTAYLVWGIGDNDSWLGADKKGLLFDGSYKPKAQYTALLNT

SEQ ID NO: 9252 - protein, 271 aa, Neocallimastix californiae
  FAMILY NOT NAMED
LEFCKENNIKMRGHTLVWHVQTPEWFFRTDFSDSGSYVNAAKMEKRMESYIKQMLEFVQYYYPGIVDVWDVVNEAVEIEGGSYDASTGWNTRTRYNGSPNPWYTTMGADYVIKAFRIARKYADKNVKLIYNDYNTFMSQKTTAICNLIKKLKAENLVDGVGLQSYLNADWPNRNDYKTAIQKFAALGVEVQATELTIRTDGTANKYNTQAKHYEEVFKIYKDLKKSGVNITSVTVFGLQDGYLFYNNDSTDTRLWDHNLKKKPVYNSIMKV

SEQ ID NO: 9253 - protein, 321 aa, Neocallimastix californiae
  FAMILY NOT NAMED
REIIKYQFNSVTFTNLMKAEFMLDKSASQANARNGNDMPVLKFDTIVDGLEFCKENNIKMRGHTLVWHTQAPEWFFRTGFNDNGSYVDKNKMEKRMESYIKQMLEFIQYYYPGVIDVWDVVNEAVEIANGSYDASSGWNTRTKFDNNKTNPWYATMGPDYVFKAFRFARKYADKNVKLIYNDFNTFQYPKTDNICNLVKKLKAENLIDGVGLQSYLGPSWPNRNDYKNAIQKFGALGVEVQITELTISVENGNNKFTTQANQYRDVFKIYKDLKKSGVNITSVTVFGLQDHYLFYDNDNTETRLWDGNLKKKPVYNAIMNV

SEQ ID NO: 9254 - protein, 347 aa, Neocallimastix californiae
  FAMILY NOT NAMED
REGFVQTDGTNFVVDGCKRYFSGSNTYYLMVSSHERVDLALEAYARHNLNVVRAWAFCDECEDATRLVDFSGPEVKLNSLNMEKVDYYLAAAAQRNIRVVLTLTNNWTDYGGMDVWVKKFGGKYHDEFYTNRKIIEGYKQYIKAMINRVNTYTGQLYKDDPTIFSWQLANEARCNNGPHGLPVKNCNTDTITKWMDEIATFIHKEDPNHLVSSGIEGIGLTPPAGVDPYTYVYTYTEGTDYEAISALDSIDYNTVHMYPVGWGLKDYAKDGVTWIQAHADVDKKFNKPTVVEEWGLSTSVDNVPIKERDPIYTQWMNAVLANDNIGMNMFWYVCGEDYYGTDGYLLE

SEQ ID NO: 9255 - protein, 277 aa, Neocallimastix californiae; identical to SEQ ID NO: 325
  FAMILY NOT NAMED

SEQ ID NO: 9256 - protein, 314 aa, Neocallimastix californiae
  FAMILY NOT NAMED
ANGYELLRDAAKGFRIGAATNTIHYNNPNYINAMKAFNYMVAENACKFVSIQYTKGKFNFDDCDNHLKKAKELGMAFRGHALIWHAMAPGWLEREDGNTMKQSIINHITTVLKHYEGKIDTWDVVNEALDDSSNGNGWKLRNSFLYQKVPDFIDIAFQTARKVSPNTKLFYNDYNTEGIWGKSESCYQFIADMKKRNIPIDGVGIQYHVGINVQPKFEKINNLISRYCKLGVEVHITELDVSCDDNCRDADGGESKQGQVYTNALKACLNNSCCTGFLVWGIGDKDSWRGVESKPLLFDANYQPKGQYTAILNT

SEQ ID NO: 9257 - protein, 230 aa, Neocallimastix californiae
  FAMILY NOT NAMED
HAMAPGWLEREDGNTMKQSIINHITTVLKHYEGKIDTWDVVNEAIDDGSNGNGWKLRNSFLYQKVPDFIDIAFQTARKVSPNTKLFYNDYNTEGIWGKSESCYQFIADMKKRNIPIDGVGIQYHVGINVQPKFEKINDLISRYCKLGVEVHITELDVSCDDNCRDADGGDSKQGQVYTNALKACLNNSCCTGFLVWGIGDNDSWRGAENKPLLFNTNYQPKGQYTAVLNT

SEQ ID NO: 9258 - protein, 317 aa, Neocallimastix californiae
  FAMILY NOT NAMED
AAAANGYELLRDAANGFRIGAATNTIHYNNPNYINAMKAFNYMVAENACKFVSIQYNKGRYNFDDCDNHLKKAQELGMAFRGHALIWHAMAPGWLEREDGNTMKQSIIDHITTVLKHYEGKIDTWDVVNEAIDDGSNGNGWKLRNSFLYQKVPNFIDIAFQTARKVSPKTKLFYNDYNTEGIWAKSESVYQFVADMKRRNIPIDGVGIQYHVGINVQPQFQKINDLIGRYCKLGVEVHITELDVSCDDNCRDWDGGESKQGQVYTNALKACLGNSCCTGFLVWGIGDKDSWRGEENKPLLFNSNYQPKGQYTAILNT

SEQ ID NO: 9259 - protein, 315 aa, Neocallimastix californiae
  FAMILY NOT NAMED
NSSSTLLRDHANGFRIGAAANTMYFNNQSYINALKSFNYMVAENGCKLSGIQQQKGVYNFNDCDNHLKKAQELGMDFRGHCLIWHAYQPSWFENADANTLKNAIVDHITKTLQHYEGKIDTWDVVNEAIDDSSNGNGWKMRNSFLYQKVPNFIDLAFQTARKVSPNTKLFYNDYNTEGIYGKSESVYQFVKDLVSRNIPIDGVGIQYHVSVQSQPQYNKINDLISRYCKLGLEVHITELDVKCDNQCYSGNVEQQQATVFTNALKACLSNSCCTGYLVWGVGDNNSWLGSDKKGLLFDGNYRPKSQYTAVLNMLK

SEQ ID NO: 9260 - protein, 277 aa, Neocallimastix californiae; identical to SEQ ID NO: 326
  FAMILY NOT NAMED

SEQ ID NO: 9261 - protein, 792 aa, Neocallimastix californiae; identical to SEQ ID NO: 871
  FAMILY NOT NAMED

SEQ ID NO: 9262 - protein, 302 aa, Neocallimastix californiae; identical to SEQ ID NO: 3966
  FAMILY NOT NAMED

SEQ ID NO: 9263 - protein, 718 aa, Neocallimastix californiae
  FAMILY NOT NAMED
IGLILLCIPACFSVEYNWYNTKIGGGGFVTNLIYNPGEEGLLYLRTDMGGSYRYDQTNKSWIPIQDVFGGSEWWLFGCESLGVDTKEPNRVYIAAGTYMSYGENGAIISSDDYGKTWKHRWDAPFHFGANDDGRGRGERLAVNPVDNNIIFFGTRKNGLYKSTNYGESFEPVKGFPADHDIPFILFVPGSKGKTVIVATDDTKAPLYISKDGGSSFDKISGQPNIGYFPQHGAFSADGKYLYVTYANSIGPNGATQGDVYRISLPDFTFKEITPVHGSYETQQFGYTGVQTSGTNAGVVIVSTLNLWWPSDEVYMSTDYGETWSEGVASHAELDISEYPWLDFGKEDNLKFGWWIAALAMDPFNDDNVSYGTGATVYTTTEFTKAMKNESTHWAPNVVGFEETAINDIEAPPSGPGIPKLLTALGDLGGFTQDDINEAVEMWVNPTYTTGNSVEYAVSNPKIVVSCGTDNAAYSTDGGYTWTPMKTLPYEKATGGHITISGDGKVVTWIPNQSQIPYYTTDNGATWTAVDTCKNCNQVRPDGKNPKLMYGFDYQTLYISEDGGKTYIKQGGNMGAGQLMSPYNVEGHLWLACTYWGGVQFSSDMGKTFKEVDPKFKSADSVGFGKAAPGSDAPYTVYIVGKYDDYYGVYRSTDLGSTWELLNDDSHQWGVYNSKVIGDPDIFGRVYIATNGRGVVVGDDTSVVSDGGHSSGSKSSSNN

SEQ ID NO: 9264 - protein, 237 aa, Neocallimastix californiae
  FAMILY NOT NAMED
EAIDYFIAAASQRNIRLVLGFTNNWTDYGGMDEWVKGFGGKYHDDFYTNKEIRNAFKRYIKTVITRINRHTNIRYRDDPTIFSWQLANEPRCGNGPSGLPQSGKCTPEVITEWADDISSYIKELDPNHLVSVGVEGFGLEAPKGSKGLYAYKYDEGTDFEALTALPNVDYNTYHYYPIPWGMTDLISHTKDWIESHQAVGKKLNKPVVFEEWGLEVPTDCSKEERIQYYKTWTKQIL

SEQ ID NO: 9265 - protein, 316 aa, Neocallimastix californiae
  FAMILY NOT NAMED
ASGSYELLKDYANGFRIGVAANTMKFNNQAYNEALKAFNYMVAENGCKLSGIQQQKGVYNFSDCDNHLKKAKELGMDFRGHCLIWHSYQPSWFENADANTLKNAIVDHITKTLQHYEGKIDTWDVVNEAIDDSSNGNGWKMRNSFLYQKVPNFVDLAFQTARKVSPNTKLFYNDYNTEGIYGKSESVYQFVKDMISRNIPIDGVGIQYHVSVSSQPKYEKINDLISRYCKLGIEVHITELDVKCDNQCNSNNVEQQQATVFTNALKACFSNSCCTGYLVWGVGDNDSWLGSDKKGLLFNSNYKPKSQYTAILNFLK

SEQ ID NO: 9266 - protein, 337 aa, Neocallimastix californiae
  FAMILY NOT NAMED
GASIENSTVSSKTMREVIKHQFNSVTYSNLMKSLFILNQEGSIKNLKEGKQDPALDFSGIVDGLDFCQKNGIHMRGHVLVWHNQVPRWFFTKDYSEDGEFVDPETMEYRLDSFIRQYLGFVQYYYPGVVDVWDVVNEAVEVVGEQYDNSTGWYTRTLYDEVKPNMWYDMFGPDYVVKTFRIARKYALPNVKLVYNDYCTYVTKPISKRDAIVKLLGILQKEDLVDAIGMQSYINPEEDVNDHLAAIEVYQQTGLEIQITELTIRVKNTDDWEEYNIQQYSQLFEGIMKYVRKGYNIGSVTVFGLQDGYRFYENDSTKTRLFDHDLQKKKVYRAIMDI

SEQ ID NO: 9267 - protein, 274 aa, Neocallimastix californiae
  FAMILY NOT NAMED
LDFALKNNIHVRGHVLVWHTQTPDWFFRKGFNSENEFADVETIYQRLESYIRQYLGFVQHNYPGVIDVWDVVNEAIEINDGYFDNSTGWYTRVSTQTEESLWYKIVGPDYVKKTFEIARKYALPNVKLVYNDYNTFQTYPHDKTQAIIDLMNILRKDNLVDALGMQSYIGETWPKIEEYVRAIERFTEAGLELQITELTITPPSGEGWLEKQAQQYREFFEKVMEQINKGANITSVTVFGIQDGYRFYTSDSTKTRLLDHDLQKKPNYEAIMEV

SEQ ID NO: 9268 - protein, 321 aa, Neocallimastix californiae
  FAMILY NOT NAMED
RDVIAYQFNSVTFTNLMKADQMLDKAASQANARSGNDMPVLKFDSIVDGLEYCKANNIKMRGHTLVWHVQAPEWFFRTGFNDNGNYVDKNKMEKRMESYIKQMFEFVQHYYPGVVDVWDVVNEAVEITNGSFDASSGWNTRTKYDNNKTNPWYATMGPDYVFKAFRFARKYANKDVKLVYNDFNTFMSQKTNAICNLVKKLKAENLIDGVGLQSYLGPSWPNRNDYKNAIQKFSALGVEIQITELTISVEESNNKFNAQANHYRDVFKIYKDLKKSGVNITSVTVFGLQDHYLFYDNDKTETRLWDRNLKKKQAYNSVMSV

SEQ ID NO: 9269 - protein, 321 aa, Neocallimastix californiae
  FAMILY NOT NAMED
DVIQQVRPDFYFGVATQKTFFANPKYKDIMSTFNLEVGGNECKFYTINGSETFNTKACDESIAFAKKQGAKYRGHNLFWPANSPSWFKSAYDGKDPEEVKEYILDYITKVLDHYKDEEDIIYWDVINESVTDDSTPENIKLRTGSDTSNEFKGWDTYTEDIFKLAREHTNENVKLIYNDYNAEANGGNFGGKTGAVFQYIKSMKENGVPIDGVGLQMHISCNWTPNYEELTKLISQYEEIGVEVHVTEIDVKMENCKTHDDQRKVYMNIFKACFDHENCKVFTVWGAYDSESWVGAENEPLIFDEDMYPKDIYFDMLDYVI

SEQ ID NO: 9270 - protein, 316 aa, Neocallimastix californiae; identical to SEQ ID NO: 3967
  FAMILY NOT NAMED

SEQ ID NO: 9271 - protein, 723 aa, Neocallimastix californiae
  FAMILY NOT NAMED
SLSYKWKNAEIVGGGFVPGIVFSEAEKDLVYARTDIGGLYRLNKSTKRWENLSEWVGVDNWGYAGIDTMCADPVDANRVYAAVGMYTNDWDPNNGAIISSTDRGDNWSISELPFKVGGNDPGRGMGERIAVDPNNNKILFFGARAGKGLWKSTDYAKTWSQVKSFTNVGKYAADNQYFTEAIGISFVTFDRYSGKKGSPTPNIYVGVADNSTSTVYVSKDAGVSWTAIPDQPAHYFPHKGKITEDGMLYVTYTDGCGPYDGQAGAIYRYNTKTGEWKDISPHQEPYFGYGGLAIDAQNQKTLVVATLNSWWPDAILFRSTDGGDTWSHIWEWDGYPQRKLKYEIDPSISPWIEDDMKQIPEPTTKLGWMIESLEIDPFNSDRIMWGTGATIWGSEDLTNWDSGKKFHISVMASGIEETSVQDLVSPATGDAHLLSVMGDIGGFRHTDLDKCPEINFRSPTFTTGYSIDYAENVPNFWVRVGTEPYIAISWGNGESWYSGQAPGGVTEGGIVAVGADGDVVWAPKPYDLGVFYGKESFKSSKGIPGGARICSDRVNGKIFYGYLGDTFYRSTDTGVTFSKVYTGLPEIEPGYAKNIKAVAGHEGDVWLAGNKGGLYHTEDGGETFTSIDGVEIANTIGFGKAAEGSDYPALYITGKIGNVNGIFRSDDKGKNWVRINDDDHQYGTINFCITGDPRIYGRVYVCTNGYGIVYGDIDGDSGTPVSG

SEQ ID NO: 9272 - protein, 347 aa, Neocallimastix californiae
  FAMILY NOT NAMED
REGFVQTDGTNFVVDGCKRYFSGSNTYYLMVSNHERVDLALEAYARHNLNVVRAWAFCDECEDATRLVDFSGPEVTLNSENMEKVDYYLAAAAQRNIRVVLTLTNNWTDYGGMDVWVKQFGGKYHDEFYTNRKIVEGYKQYIKAMINRVNTYTGQLYKDDPTIFSWQLANEARCNNGPHGLPVKNCNTDTITNWMDEIASFIHQEDPNHLVSSGIEGIGLTPPSGVDPNTYVYRYDEGTDYEAISALDSIDYNTVHMYPVGWGLKDYSKDGVTWIKAHADVDKKFNKPTVVEEWGLSTSADNVPLEERDPIYTKWMDAVLANDNIGMNMFWYVCGEDYYGTDGYLLE

SEQ ID NO: 9273 - protein, 735 aa, Neocallimastix californiae
  FAMILY NOT NAMED
MKTLALTLLGLITLCIPACFSVEYNWYNTNIGGGGFVTNLIYNPAEEGLLYLRTDMGGSYRYDQANKSWIPIQDVFSGSEWWLFGCESIGIDTKEPNRVYIAAGTYMSYGENGAIISSDDYGKTWKHRWDAPFHFGANDDGRGRGERLAVNPVDNNIIYFGTRKSGLYKSSNYGESFEQVKGFPTNHDIPFILFVPGSKGKTIIVATDDTKAPLYISNDGGSSFKQISGQPNIGYYPQHGAFSADGKYLYVTYANSIGPNGATQGDVYRISLPDYKFKEVTPVHGSYETQQFGYTGVQTSGTNPGVVIVSTLNLWWPSDELYMSSDYGETWSEGVASHAELDISEYPWLDFGKADNLKFGWWIAALAMDPFNDNNVSYGTGATVYTTTDFTNAKKNAVTHWAPNVRGFEETAINDIEAPPAGPGIPQLLTALGDLGGFTQDDIHETVEMWVNPTYTTGNSVEYAVSNPKIVVSCGTDNAAYSTDGGHSWTPMKSLPYEKATGGHITISGDGKVVTWIPNQSQKPYYTTNYGASWTAVNSCNNCIQIRPDGKNPTLMYGYDHQDLYISEDGGKTYKKQASNMSSGQLMSPYEVEGHLWLACTYWGGVQISTDKGKTFKEVDPKFKTADSVGFGKAAPGSSAPYTVYVVGKYDGYYGVYRSTDLGSTWELLNDDSHQWGVYNSKVIGDPNIFGRVYVATNGRGVIVGDDTSVTGNGGSKTKTSSKTTTTKRPSSTSI

SEQ ID NO: 9274 - protein, 215 aa, Neocallimastix californiae
  FAMILY NOT NAMED
KYTFVDGPIYSGDGTAYGDATSGGNCLFPKKEYYNDMMYAALNNKQYNTDMGCGLCAVVVSTSNPYKPIRVRIIDQCPECAHGSLDFSDKAFKALSNKTPDRIKITWALIPCDVDVNEFPALVKPNSAIKFQFKSGSTQFWGEVQVFNTRYPVAKVEFLSGGKYVGLYRRAYNYWALNSGGFGAGPYTFRVTLADSTVIEAKNVKMVIPGNDEGD

SEQ ID NO: 9275 - protein, 337 aa, Neocallimastix californiae
  FAMILY NOT NAMED
GGAIENSTTSSKTMREVIKHQFNSVTYSNLMKAVFVLNQEGSIKNLKKGKQDPVLDFSTFVDGLDFCQKNGIHMRGHVLVWHNQAPRWFFTKNYEEDGEYVDAKTMEYRLESYIKQYLSFVQFNYPGVVDVWDVVNEAIEVVDNQYDKSTGWYTRTLYGNNSPNMWYDIFGPDYVVKTFRIARKYALPNVKLVYNDYSTFVTKPVSKRDAIIKLLGILKKEDLVDAIGMQSYINPDEDINEYLAAVDEYQKTGLEIQITELTIRVKSTDDWEEYNIQQYSQLFEGLMKRVKKGYNIGSVTVFGLQDGYRFYENDTQKFRLFDHDLKKKKVYHAIMKI

SEQ ID NO: 9276 - protein, 494 aa, Neocallimastix californiae
  FAMILY NOT NAMED
KGASYRVEHVYAGDLDGDGTYDFVVKRMSDNRDPILLEAYKLDGTFLWRINLGPNIETYTSSLTSPVLVYDFDGDGKAEVMVKTGEGTVFGDGTKIGDVNRDGKTDYRERNRTQYQVLTGPEFISMVDGMTGKEIDRVNFIERGNTNDWGDNYGNRMNFIFVTVAYLDGKEPSMVLSRGAGDLKNRKAITAYALKFQNKKFTVQWTFRILDYKNKIPAGHGMVEFHSIRALDLDGDGFDEIHLGGFAIDHNGKLLYSTELGHGDRFIIADIDPNRKGLEYFAVQQNRDDLLGTALLDAATGKTIWKQYLPSKADVGRGDAASILDTYGMQCWSSSFPGYYDANRKQLTTTRSFPSLSIWWDGDLKREFLDGIGKEGYNPAINKWNASNGSNDRLFTIYNDGGNYSVISPYSGRVPLYGDLIGDWREEVVLETANHKEIRIYTTTIGTDYTIYTLMHNPAYRNCVNVKGYLQSTEVDYYLGYGADIKKIPKPDIY

SEQ ID NO: 9277 - protein, 368 aa, Neocallimastix californiae
  FAMILY NOT NAMED
SKPIAFPGADGGGKFATGGRGGEVYYVTNLNDSGAGSFRDAVSRSNRIVVFKVSGTIELKSDVVVKGNITVAGQTAPGGHGVVLKNFKIGLGGTNIILRFIGSRPGERGSNADYDAFGGAEGSNSIVDHCSIGWANDEQWGLYSKSDDMTVQYSVIGPSNSFSYHSKGIHGFAIMLGRKNVSYHHNLIAHNVSRNFRGKVPDKNACDFTNNVIYNWGSQTTYGTIGHLNYVGNTLKMGPSTKGGRNYVSVADSGTKPENYLIYLTGNRFLNSNNTPYNDFSNNNWKGITYKNNSKNEGNTKSNSPFVMNNGSDNSSTIAHVESAEKAYDNVLAHAGNGISPDKRIAIDKQCAAETKNGTGSLVGARPY

SEQ ID NO: 9278 - protein, 342 aa, Neocallimastix californiae
  FAMILY NOT NAMED
GVDINNYTPSSKKMMELIKYQFNSMTYSNGMKSIKIMDEEGSRKNIAEGREEVAVDFSGIIDGLEFAKKNGIHIRGHVLVWHKQTPDWFFRKDFDTEKEYADVETIFVRLESYMKAFFDFLNFNYPGVVDVFDVVNEAIEVREGKFDNSTGWYTRTESLEGDDNIWNTLVGPSYVVRAFRIARKYALPTTKLVYNDVDTFMTKPHDKTQAVIDLMNILRAEDLVDALGMESYIDQDLVNVDAPEDYARAIERFTEAGLEIQITEFTIYNDDREDWLETQTKRYRDFFQVVIDHVKKGYDNISSFTVFGLQDGYRFYDNDTQKTRLFDHDLQKKPNYYAIMEI

SEQ ID NO: 9279 - protein, 730 aa, Neocallimastix californiae
  FAMILY NOT NAMED
MLNIHFLILLSTLCITFSSAYQWKNAEIVGGGFIPGIIFSEAEKDLIYARTDIGGLYRMNKSTKRWENLLKWVGVDNWNYGGVDTMCADPIDSNRVYAAVGMYTNDWDQNNGAIISSNDHGDTWSITELPFKVGGNDPGRGMGERIAVDPNDNKILFFGARAGKGLWKSIDYAKTWSQVKSFTNVGKYSPSPEYFPAAIGISFVTFDKYSGNKGSPTPNIYVGVADNSTSTVYVSKDAGVSWTPIPDQPAHYFPHKGKITKDGMLYITYSDGCGPYDGQAGAIYRYNTKTGEWKDISPHQEPYFGYGGLAIDAQNQKNIVVATLNSWWPDAILFRSTDGGDTWSHIWEWDGYPNRKLKYEIDASISPWIEDDTKQIPEPTTKLGWMIESLEIDPFNSDRIMWGTGATIWGSEDLTNWDNGQTFHISVMASGIEETAILDLVSPATGEAHLMSVMYDIGGFMHTDLDTCPKTQFRTPNFSSGNSIDYAENVPNFWVRVGTEPYIAYSWGSGSSWYAGHAPNGVTEGGLVAVGAEGDVLWAPKPYELGVFYGKESFQSSKGIPGGARICSDRVNGKIFYGYLGDTFYRSTDTGATFTKMYTGLPEIETGFAKNIKAVADHEGDVWLAANKGGLFHTEDGGKTFTQINGITIANTIGFGKAADGSDYPALYITGKIGDVNGIFRSDDKGQNWVRINDDKNQYGTINFCITGDPRIYGRVYVCTNGFGIVYGDI

SEQ ID NO: 9280 - protein, 317 aa, Neocallimastix californiae
  FAMILY NOT NAMED
DVIQQVRPDFYFGVATSIAYSSNPKYKDIVSSFNLHVGGNECKFYTIQASKTRNFYQCDQSLSYAKKFGAKYRGHNLFWPANSPNWFKTYSDDIEVTKSYIIDYIKSVLNHYRDDDSIIYWDVINESVMDESTSNDIQLRTGSKTSDEFLGWDTYTEDIFKLARDNINENVKLIYNDYYCEANNGNFDGKTGAVFNYIKNMKEKEVPIDGVGLQMHVSCNDAPSYDDLYLLISRYEEIGVEVHVTEIDVTMARCNSLKDQKDVYMNIFKACFNHNNCKVFTVWGAYDTESWIGAENTPLIFDSDMYPKDIYFEMLDY

SEQ ID NO: 9281 - protein, 594 aa, Neocallimastix californiae
  FAMILY NOT NAMED
IVSGVSLTQNNNSYILKNNYATVVISKKDGYITSLKIAGDNQEFLNRAYIDANGSKAGFHAKKSTIIKNTNDHVEIAFTDNVLNMDWEVRYTMLNDTKGVYFSLKLDHKASYADTQFSEIRLVFRLKSNPFNWLQIEDNVGRYLPTAEEQKNCEVMGPKEACKVKTGEVLHKYDWSIDALKHDVHGFSTKNGLGCWFVLPSMEWKNGGAYNRDLACHNGENDSIQIMYMAGSHYGAGDEYPKKGENWSKVYGPYLIYVNKAGSPQASWKDAKAVAQAEKAKWPYSFVSQPGYVKQRGKVTGKLTIKNQLDNSVFKLDDAVVTLVQPESNSESIPNQQWRHYSFWTHSISGVSPNFTINNVIPGTYQLRAWSKGVVGEFILNKTITVTAGQTTNLGEIVFTEKRVGPIAWEIGIPDRTAMEYKHGDHFNQWGLPYKFPQEFPNGVNYYIGKSNYAKDWNYCHVSVPGNGGTYKSVPWNIYFNLNKKPTGTAVLRVSVAANTSTALSVSINGGKNSAEVSNFKDDACVRRDGIRGFYRELEFKFSPNDFKIGENKITLNARKTGGYTNSYQFDGIMYDHIRLETPGIGSNSSNNNN

SEQ ID NO: 9282 - protein, 316 aa, Neocallimastix californiae; identical to SEQ ID NO: 3968
  FAMILY NOT NAMED

SEQ ID NO: 9283 - protein, 271 aa, Neocallimastix californiae
  FAMILY NOT NAMED
LEFCKENNIKMRGHTLVWHVQTPEWFFRTNFSDSGSYVNAQKMEKRMESYIKQMLEFVQYYYPGVVDVWDVVNEAVEIEGGSYDSSTGWNTRTKYNGSANPWYATMGPDYVFKAFRFARKYADKNVKLIYNDYNTFMSQKTNAIYNLVKKLKSENLIDGVGLQSYLNADWPNRNDYKNAMQRFASLGVEIQATELTIKTDGSSNKFNNQAKHYQEVFKIYKDLKKSGVNITSVTVFGLQDGYLFYSNDSTDTRLWDHNLKKKPVYYSIMNA

SEQ ID NO: 9284 - protein, 351 aa, Neocallimastix californiae
  FAMILY NOT NAMED
LAKEAPFRFGVGLTGTNLQVSTTVSEKMRDIIKHQFNSMTYTNLMKPLYILDKEGSIQNIKNGIQDPKLNFTSIVDGLEFAYKNGIHIRGHVLIWHTQTPDWFFNEGYTDDGKKVSPEVMESRLDSYIKQYLSFVQFNYPGVVDVWDVVNEAIEITDGQYDANTGWYTRTMLNNTPNPYYDMFGPDYVIKAFRIARKYALPNVKLVYNDFNTFQVWPHNKTQAIMDLAGILQKEDLIDGIGLQSYLGVTWPSLDEYFRGVERLATTGLELQITELTITAPDGDNWLEAQAEQYRDFFERLMKHVEEGYNIGSVTVFGLQDGYLFYASDSTKTRLLDHDLQKKPNFEAIMSI

SEQ ID NO: 9285 - protein, 265 aa, Neocallimastix californiae
  FAMILY NOT NAMED
IKIEQPTTIETDEPTTILADQPTSIEASQPTNIEVVQPSNNEAVQQITTETDEPTTILADQSTAIEIAQPTNIEVVQSEITETDEPTTILADQSTTIEIAQPTNIEVVQSEITETDEPTTILADQTTTIEVAQPTNIEVVQSEITETDEPTTILADQTTTIEVAQPTNIEVVQSEITETDEPTTILADQTTTIEVAQPTNIEVVQSEITETDEPTTILADQTTTIEVAQPTNIEVVQSEITETDEPTTILADQTTTIEVAQPTTI

SEQ ID NO: 9286 - protein, 331 aa, Neocallimastix californiae
  FAMILY NOT NAMED
ANGYELLRDYSKGFRIGAATNTIHYSNSNYNNAMKAFNYMVAENACKFVSIQGTKGKFNFNDCDNHLKKAQELGMDFRGHALVWHSMAPKWLENEDANTMKNSIINHITTVLKHYEGKIDTWDVVNEAIDDSSNGNGWNMRKSFLYNKVPNFIDIAFQTARQVSPKTKLFYNDYNTEGIWGKSESVYQFVADLKKRNIPIDGVGIQYHVSLENNPRFDKINDLISRYCKLGVEVHITEMDVSCDKNCWASDVEQQQGKVFTNALQACLNNSCCTGFLVWGIGDNDSWIGGDKKGLLFNSNYQPKSQYTAVLNLLKSTTAASLGNGGGNTGN

SEQ ID NO: 9287 - protein, 351 aa, Neocallimastix californiae
  FAMILY NOT NAMED
LAKEAPFRFGVGLNGGALSTSTTTSKTMREVIKYQFNSMTYTNIMKPEYIFDKEGCLKNAENGSEEMALKFDDIVDGLDFALKNNIHIRGHVLVWHKQTPDWFFRKGFNSENEFADVDTIYYRLESFIKQYLGFIQFNYPGVIDVWDVVNEAVEINDGSFDNSTGWYTRTMTGDEESLWYKVVGPDYVKKTFEIARKYALPNVKLVYNDYNTFQTYPHDKTQAIIDLIDILRKDNLIDAIGMQSYIGVNWPSVDEYIRAIERFTEAGLEIQITELTITAPSGDDWLEKQAQQYGELFERIMEQIKKGANISSVTVFGLQDGYRFYSSDSTKTRLLDHDLQKKPNYEAIMKV

SEQ ID NO: 9288 - protein, 277 aa, Neocallimastix californiae; identical to SEQ ID NO: 327
  FAMILY NOT NAMED

SEQ ID NO: 9289 - protein, 108 aa, Neocallimastix californiae
  FAMILY NOT NAMED
GGRMRTNVRYKSGKFEVRAKMPIASGLVPAIYFASTPDNTNGDQDEFDFELIGSNRMQTNLFIHGNGGREQIWNPPTDLSKDFHLYTFEWSSNAIVLKVDNEVIRTFN

SEQ ID NO: 9290 - protein, 91 aa, Neocallimastix californiae
  FAMILY NOT NAMED
RYCKLGLEVHITELDVKCDNVCNSGNVEQQQATVFTNALKACLNNSCCTGYLVWGIGDNDSWLGGDKKGLLFNSQYKPKSQYTAVLNVLKE

SEQ ID NO: 9291 - protein, 277 aa, Neocallimastix californiae; identical to SEQ ID NO: 328
  FAMILY NOT NAMED

SEQ ID NO: 9292 - protein, 326 aa, Neocallimastix californiae
  FAMILY NOT NAMED
VDIINHQFNSVTLTNLMKPSYLLDQNGSQKNIMKGIQDPSVNFQSAIDTLEYCKKNNIKMRGHTLVWHTQTPSWFFKKDYDDKNDYVDSEVMELRIESYIKQVMQFVQYYYPGVVDVWDVVNEAVEIDEGYYDEKVSWKTRTKCNESSNPWYETMGPDYVIKAFRFARKYAAPGVKLIYNDYNTFMSEKTTAIINLLKILKEENLIDGIGMQSYLTPTFPERSTYANAIKKFGELGIEVQITELTISIDDKLSEEEMYEKQAEQYKEVFEIYLKAYHNGINIGSVTVFGLQDGYLFYTNDSTKTRLWDKDLQKKKNYYSILEVLKE

SEQ ID NO: 9293 - protein, 313 aa, Neocallimastix californiae
  FAMILY NOT NAMED
ANAYELLKDYSKGFRIGAATNTIHYNNANYVNAMKAFNYMVAENACKFVSIQGTKGKFNFNDCDAHLNKAKQLGMDFRGHALIWHSMAPKWLENEDSNSMKNSIVNHITNVLKHYEGKIDTWDVVNEAIDDSSNGNGWKMRNSFLYQKVPNFIDLSFQTARKVSPKTKLFYNDYNTEGIWGKSESVYQFIADLKKRNIPIDGVGLQYHVSVQHQPQFNKINDLIGRYCKLGVEVHITELDVSCVESCYAGDVEKKQSDVFTNALKACLGNSCCTGFLVWGIGDPDSWLGSDKKGLLFNSNYQPKSQYTAVLNV

SEQ ID NO: 9294 - protein, 230 aa, Neocallimastix californiae
  FAMILY NOT NAMED
SSDIEEVKEYYLDYVAKVLDHYKDEEDIIYWDVINESVTDDSTVDNIKLRYGSDDSNEFKGWDTYTEDIFKVAREHTNKNVKLFYNDYNAENNNGNYNGKTGAVFNYIKSMREKDVPIDGVGLQMHISCNYYPNYDQLYELISQYEEIGVEVHITEIDVSMKSCSTLEDQKKLYMDVFKACFDHSNCKVFTVWGAYDSESWVGAENVPLIFDEDMYPKDIYFDMLDYVMK

SEQ ID NO: 9295 - protein, 331 aa, Anaeromyces robustus; identical to SEQ ID NO: 9286
  FAMILY NOT NAMED

SEQ ID NO: 9296 - protein, 277 aa, Anaeromyces robustus; identical to SEQ ID NO: 327
  FAMILY NOT NAMED

SEQ ID NO: 9297 - protein, 321 aa, Anaeromyces robustus
  FAMILY NOT NAMED
ADVIQQVRPDFYFGVATTKSFFANPKYKDIMSTYNLQVGGNECKFYTFQGTETFNTKPCDDSIAFAKKLGAKFRGHNLFWPAYSPSWFKTYSSDIEEVKEYYLDYVAKVLDHYKDEEDIIYWDVINESVTDDSTVDNIKLRYGSDDSNEFKGWDTYTEDIFKVAREHTNKNVKLFYNDYNAENNNGNYNGKTGAVFNYIKSMREKDVPIDGVGLQMHISCNYYPNYDQLYELISQYEEIGVEVHITEIDVSMKSCSTLEDQKKLYMDVFKACFDHSNCKVFTVWGAYDSESWVGAENVPLIFDEDMYPKDIYFDMLDYVMK

SEQ ID NO: 9298 - protein, 321 aa, Anaeromyces robustus
  FAMILY NOT NAMED
SGGNSNSGSTLLRDYANGFRIGAATNTMHYNNQNYVNAMKSFNYMVAENACKLSGIQQQKGVYNFNDCDNHYKKAKELGMDFRGHCLIWHAYQPSWFQNADANTLKNAIVDHITKVLQHYDGKIDAWDVVNEAIDDSSNGNGWKMRNSFLYQKVPNFIDLAFQTARKVAPNVKLFYNDYNTEGVYAKTESVYQFIQDMIKRNIPIDGVGIQYHVAVNQQPSYQKINDLIGRYCKLGLEVHITELDVKCDNVCNSGNVEQQQATVFTNALKACLNNSCCTGYLVWGIGDNDSWLGGDKKGLLFNSQYKPKSQYTAVLNVLKE

SEQ ID NO: 9299 - protein, 277 aa, Anaeromyces robustus; identical to SEQ ID NO: 328
  FAMILY NOT NAMED

SEQ ID NO: 9300 - protein, 316 aa, Anaeromyces robustus; identical to SEQ ID NO: 3969
  FAMILY NOT NAMED

SEQ ID NO: 9301 - protein, 108 aa, Anaeromyces robustus
  FAMILY NOT NAMED
GGRMRTNVRYKSGKFEVRAKMPIASGLVPAIYFASTPDNTNGSQDEWDFELIGSNRMQTNLFINGQGGREEVWNPPYDLSRDFHTYTFEWTSNSIVLKVDNQVVRTFN

SEQ ID NO: 9302 - protein, 314 aa, Anaeromyces robustus
  FAMILY NOT NAMED
ANGFELLRDAANGFRIGAATNTIHYSNRNYIEAMKSFNYMVAENACKFVSIQGTKGRYNFDDCDNHLKKAQELKMDFRGHALIWHSMAPQWLEREDSNTMKQSIIDHITTVLKHYEGKIDTWDVVNEAIDDGSNGNGWKLRNSFLYQKVPNFIDIAFQTARKVSPNTKLFYNDYNTEGIWAKSESVYQFVADMKKRNIPIDGVGIQYHVGVNVQPQFDKINNLISRYCKLGVEVHITELDVSCDDNCNDRDGGEGKQSQVYINALKACLNNSCCTGFLVWGIGDSDSWRGAENKPLLFNSNYQPKGQYNAILET

SEQ ID NO: 9303 - protein, 271 aa, Anaeromyces robustus
  FAMILY NOT NAMED
LEFCQKNNVKMRGHTLVWHTQTPSWFFRTNFQDNGSFVNASKMEKRMESYIKQMLEFIQYYYPGVVDVWDVVNEAVEITNGSYDSSTGWNTRTKFDGGDNLWYKTMGADYVFKAFRFARKYADKNVKLIYNDYNTFMSQKTNAISNLIKKLKAENLVDGVGLQSYLNADWPNRNDYKSAIQKFSSLGVEIQITELTIKTDGSGNKFNNQATHYQQVFQIYKDLKKSGVNITSVTVFGLQDGYLFYSNDSTDTRLWDHNLKKKPVYNAIMKV

SEQ ID NO: 9304 - protein, 234 aa, Anaeromyces robustus
  FAMILY NOT NAMED
AYTGDGTTYGDPVTGGYCMMPDSEAYTKDMMFAAMNLPQYNISAGCGSCLILAQADKPDRVIRVRVVDRCGECPKGDIDLSNTAWKALTGDFIPSRVKIIWSIVPCTETWYDYPPLVEEGSPIKLKWKMASSVYWGGIQAYNTRYPVTSIERWDGNDWVHLRRDDMFHYMWDTTIPGGPMKVRVTQGDGVQVVVDGLTIDGTWYDVDDNYTIGTSQTTYIPERMTKTATATSSP

SEQ ID NO: 9305 - protein, 351 aa, Anaeromyces robustus; identical to SEQ ID NO: 3970
  FAMILY NOT NAMED

SEQ ID NO: 9306 - protein, 790 aa, Anaeromyces robustus; identical to SEQ ID NO: 872
  FAMILY NOT NAMED

SEQ ID NO: 9307 - protein, 259 aa, Anaeromyces robustus; identical to SEQ ID NO: 331
  FAMILY NOT NAMED

SEQ ID NO: 9308 - protein, 791 aa, Anaeromyces robustus; identical to SEQ ID NO: 873
  FAMILY NOT NAMED

SEQ ID NO: 9309 - protein, 286 aa, Anaeromyces robustus
  FAMILY NOT NAMED
NFSGVIDGLEFSAKNNLNIRGHVLVWHKQTPEWFWRKDFDETKEYVDRETIFKRLDSFMKNYFDFLNFNYPGVVDVVDVVNEAVEVLEGKYDNSTGWYTRTESYEGDENIWYNLVGPDYVKEAFRIARKYALPTTKLVYNDYDTWRTTPHDKTEAIINLMKILKAEDLVDVIGMESYITPGEPTPEEYGKAIERYAAEGLEIQITEFTIYVTDGDDWLEQQTIHYRDMFKAIMEAYKKGANITSFTVFGLQDGYRFYDSDSTRTRLYDHDLQKKPNFQAIMDILKE

SEQ ID NO: 9310 - protein, 611 aa, Anaeromyces robustus
  FAMILY NOT NAMED
LIGITLISIVSAKVNLTENNTSYILSNGLATFTIAKSSGFITSMKYKNNSQEFLNRSYIDANGGKVYFSVTSSSVVIRTDDLVEIVFYDDYSKHVGTGFAIDWEVRYTMRSGVSGLYFSLTQAHKSNYEEAQCSELRLVMRLKSDVFNWLQVDDFTKRVMPTAAQQNKCTTLSPQEACQLETGEVIHKYDWSIDVLEHKVHGFASISKNLGSWFVMPSMEWKNGGAVNRDLACHQGGADSLQILYLRGSHYGAGDAILKRGEVWSKMHGPILIYLNEGSDVNAIWDDANRQADAEKQLWPYDFVNHQSYVPKAKRGSVSGKLVIKDPLYGSLKISDATVTLVQPESSTEPIHPQQWHKMSHWVTHVTGDFKIENVVPGTYQLRAWSKGIVGEFYTTNTITVTSGQETKLGEVKFNAPRIGPTIFEVGVPDRTAEEYLHGDHFNQWGLYNKFAEEFPNSVNFYIGKSDWQFDWNYCQVSIPGGANGNYKACEPWKIHFNINKVPSGNILLRVSIAASSSTALSVSVNGRNQSSEVKDLIDDACIRRDGIRGIWSMKEFTFPASLLKQGENYVSLHTRAIGGYLTYYRFDGIMYDHIRLETSDSSYPGVAIPP

SEQ ID NO: 9311 - protein, 316 aa, Anaeromyces robustus
  FAMILY NOT NAMED
MVSNHERVDLALEAYAKHNLNVVRAWAFCDECEDATRLVDFSGPEVKLNSENMEKVDYYLAAAAQRNIRVVLTLTNNWTDYGGMDVWVKQFGGKYHDEFYTNRKLIEGYKQYIKAMINRVNTYTGQRYKDDPTIFSWQLANEARCNNGPHGLPVKDCNTDTITKWMDEIATFIHEEDPNHLVSSGIEGIGLTPPAGVDPNTYVYTYVEGTDYEAISALDSIDYNTVHMYPVGWGLKDYAKDGVKWIQAHADVDKKFNKPTVVEEWGLSTSADNVPLEERDPIYTQWMDAVLANDNIGMNMFWYVCGEDYYGTDGYI

SEQ ID NO: 9312 - protein, 207 aa, Anaeromyces robustus
  FAMILY NOT NAMED
IYSGDGTAYGDATSGGNCLFPKKEYYNDMMYAALNNKQYNLDMGCGLCAVVVSTSNPYKAIRVRIIDQCPECEHGSLDFSDKAFKALSNMDPARIKITWALIPCDVDVNEYPALVKSNSPIKFQFKSGSTQFWGEVEVFNTRYPVAKVEFLSNGKYESLYRRAYNYWALNSGGFGAGPYTFRVTLADDTVIEAKGVEMVIPGNDEGD

SEQ ID NO: 9313 - protein, 272 aa, Anaeromyces robustus; identical to SEQ ID NO: 332
  FAMILY NOT NAMED

SEQ ID NO: 9314 - protein, 364 aa, Anaeromyces robustus
  FAMILY NOT NAMED
AFPGADGGGKFATGGRGGEVIYVTNLNDSGAGSFRDAVSKPNRIVVFKVSGTIELKSDVVVKSNITIAGQTAPGGHGVVLKNFKLGFGGTNVICRFIGSRPGERGSNADYDAWGGAEGSNTIVDHCSIGWANDEQWGLYSKSDDLTVQYSVIGPSNSFSYHSKGIHGFGIMLGRKNVSYHHNLIAHNVSRNFRGKVPDKNTCDFTNNVIYNWGSQTTYGTIGHLNYVGNTLKKGPSTKGGNNYVSVADSGTKPENYSIYLTGNRFLNSNNTPYNDFSANNWRGITYKNNSKNEGNTKSNTPFAMTNGSDNSSTIAKVEPAEQAYNNVLAYAGNGITSDKRIAIDKQCAAETKNGTGNLVGARPY

SEQ ID NO: 9315 - protein, 316 aa, Anaeromyces robustus; identical to SEQ ID NO: 3971
  FAMILY NOT NAMED

SEQ ID NO: 9316 - protein, 261 aa, Anaeromyces robustus; identical to SEQ ID NO: 333
  FAMILY NOT NAMED

SEQ ID NO: 9317 - protein, 324 aa, Piromyces finnis
  FAMILY NOT NAMED
RKVIKYQFNSMTYTNLMNPSAILDQQASIDNIMNGNEDPILNFSNIVDGLDFAYKNGLNIRGHALVWHTQVPEWFFRDGYYSNTEFVSRDVMEYRLDSYIRKFLGFVQFNYPGTVDVWDVVNEAIEITDGQYDETTGWYTRTANNKTPNPWYEIFGPDYVAIAFRIARKYALPNVKLIYNDHNTFQIQPHDKTQAIIDLANILQQENLIDGIGMQSYIGVTWPNLDDYFNGLERLITSTGLEIQITELTITPPIGDNWLGAQAEQYYEYFNRLLSYIKNGYNISSVTVYGLQDGYRFYTKDSTKTRLLDHDLKKKPNFNAIINV

SEQ ID NO: 9318 - protein, 794 aa, Piromyces finnis; identical to SEQ ID NO: 874
  FAMILY NOT NAMED

SEQ ID NO: 9319 - protein, 716 aa, Piromyces finnis
  FAMILY NOT NAMED
YNWYNTKIGGGGFVTNLIYNPGEQGLLYLRTDMGGSYRYDQNNKSWTPIQDIFGGSEWWLFGCESLGVDTKEPNRVYIAAGTYMSYGENGAIIASDDYGQTWKTRWDAPFHFGANDDGRGRGERLAVHPEQNNIIYFGTRKNGLYKSTNYAESFSQVASFPTDYDIPFILFVPGTKGKTIIVATDNSKGPLYRSDDGGSTFKQISGQPNTGYYPHHGAFSADNKYLYVTYANSIGPNGATQGAVYRIKLADYSFKEITPVKGSYETQQFGYTGVQTSGTNPGVVIVSTLNLWWPSDEVYKSNDYGETWSEGVASHAELDISEYPWLDFGKEDGLKFGWWIASLAMDPFDDNNVSYGTGATVYTTTDFTNADKNAATHWAPNVHGFEECAINDIEAPPAGPGNPQLLTALGDLGGFTQDDINEAVEMWTNPTYTTGSSVEYAYSNPQIVVSCGTDNAAYSNDGGHTWTPMKSLPYENATGGHITISGDGKVVTWVPNQSNVPYWTTDHGATWTKVTTCPQCTQIRPDGKNLTLMYGYDYQSVYLSKDGGKTYSKLSSGLSAGQLNSPFDVEGHLWLACTYWGGVQMSTDYGKTFKEVDPLFKTADSVGFGKPDPNSNAPYTVYIVGKYDGYYGVYRSTDLGNTWTLLNDDNHQWGVYNSKVIGDPNIFGRVYIATNGRGVVVGDDTSVVSNSNNNTPHRQTTTKKKTTTKTISSSPT

SEQ ID NO: 9320 - protein, 341 aa, Piromyces finnis
  FAMILY NOT NAMED
MINLTILLNLFFLLLVPTYAILGGYVYTEGTNFYIDGYKIYFSGTNTYYLHSSQNERVDLALEVSAKHNIQVVRAWAFCDLKVCGDKQFVKFENGKAVFLEDNMEAIDYFIAAASQRNIRLVLGFTNNWTDYGGMDEWVKGYGGKYHDDFYTNTDIRKAFKSYIKLLITRINRHTNIRYSDDPTIFSWQLANEPRCGNGPSGLPQSGKCTPEVITEWANDISSYIKELDPNHLVSVGCEGFGLEAPEGSKGLYAYKYDEGTDFEALTALPNIDYNTYHYYPIPWGMKDLVSHTKDWIESHQAVGKKLNKPVVFEEWGLEIPTDCSKEERIQYYKTWTKQIL

SEQ ID NO: 9321 - protein, 347 aa, Piromyces finnis
  FAMILY NOT NAMED
REGFVQTDGTNFVVDGCKRYFSGSNTYYLMVSNHERVDLALETYARHNLNVVRAWAFCDECEDATRLVDFSGPEVTLNSENMEKVDYYLAAAAQRNIRVVLTLTNNWTDYGGMDVWVKQFGGKYHDEFYTNRDIVNGYKQYIKAMINRVNTYTGQYYKDDPTIFSWQLANEARCNNGPHGLPVKNCNTDTITKWMDEIASFIHEEDPNHLVSSGIEGIGLTPPAGVDPNTYVYSYIEGTDYEAISALDSIDYNTVHMYPVGWGLKDYTKDGMKWIQAHADVDKKFNKPTVVEEWGLSTSADNVPLEERDPIYTKWMETVLENDNIGMNMFWYVCGEDYYGTDGYLME

SEQ ID NO: 9322 - protein, 619 aa, Piromyces finnis
  FAMILY NOT NAMED
MNILNYFVLIGITLISIVSASVTLTENNTSYILSNGLATFTIAKSSGFITSMKYKNNSQEFLNRSYIDANGGKVYFSVTSSYVATKNSDLVEIVFVDDYSKHVGTGFAIDWEVRYTMKSNVSGIYFSLTQSHKSNYEEAQCSELRLVMRLKSDVFNWLQVDDFNKRVMPTASEQSKCVTLSPSEACRLESGEVIHKYDWSVDALEHKVHGFGSISKNLGSWYVIPSMEWKNGGAVNRDLACHQGGSDSLQILYFRGSHYGAGDAVLKKGEVWSKMHGPILIYLNEGSDVNALWADANRQADYEKQLWPYDFVKSDSYVPKNKRGSVSGKLVINDPLYGNLKLSDATVTLVQPESSNEPIHPQQWHKMSHWVTHITGDFKIENVVPGTYELRAWCKGIVGEFYTTNTITVTSGQETRLGDVKFTAPRIGPTVFEVGIPDRTAEEYLHGDHFNQWGLYNQFQDEFPNSVNFRIGESDWQFDWNYCQVSIPGGADGKYKAAEPWKIYFNLDKVPSGNILVRVSVAASSSTALSVSVNGKNQSAEVKDLVDDACIRRDGIRGIWSMKEFTFSSSLLKQGENYISLHARAIGGYLTYYRFDGIMYDHVRLEVSDQSYPGVAIPA

SEQ ID NO: 9323 - protein, 612 aa, Piromyces finnis
  FAMILY NOT NAMED
YIFTVLFTYISAVFAAVSLTDNGSSYILRNDYAIVTIAKNSGYITSLKLNGNNQEFLNRSYIDANGGKVYFSPQSSKVIKNTSSHVEVAFYDNYNSNSKLGLDWEVRYTMLSDTRGVYYSLTNTHKTNYPETSYSEIRLVLRLKADIFNHLQVEDDVYRDMPSAADQNKCVEMGPKEACQLPNGEVIHKYDWSVDMLKHHIHGFSSKSTGLGCWFVIPSLEWKNGGAYNRDLSCHQGGSDSLQIMYMNGSHYGGGDATIKSGEYFQKVYGPFLIYLNKASSVEASWNDAKNMLNTEGRKWPYSFVSQPGYVKERGKVTGTLAINNPLTNTRLPLEDAVVTLVQPQSATEPIPNQQWRHMSFWTHSLSGATPNFVIYNVIPGTYELHAWAKGVVGEFVLDKLVTVKAGEVVNLGKFTFVENRIAPIVWEIGIPDRTAMEYKHGNHFNQWGLYHKFKTEFPNSVNYYVGKSNYATDWNYCHVSIQGADGKYMQSPWNIYFNLNKIPTGTSVLRISIAASSYSALSVALNDGKATAEVKDLVDDACIRRDGIRGIWSMKEFTFSSSLLKQGENYISLHARAIGGYLTYYRFDGIMYDHVRLEVSDQSYPGVAIPA

SEQ ID NO: 9324 - protein, 316 aa, Piromyces finnis; identical to SEQ ID NO: 3972
  FAMILY NOT NAMED

SEQ ID NO: 9325 - protein, 321 aa, Piromyces finnis
  FAMILY NOT NAMED
ADVIQQVRPDFYYGVATTKSFFSNPKYKDIISTYNLHTGGNECKFYTIQGTQTFNTKQCDDSIAFAKKFGAKFRGHNLFWPANSPDWFKNYSDDIEEVKAYYLDYVAKVLDHYKDEEDIIYWDVVNESVTDDSTIDKYKLRYGSDRSNEFKGWDTYTEDIFTLAREHTNPNVKLIYNDYNAENNNGNFNGKTGAVYKYIKEMKEKGIPIDGVGLQMHISCNYTPNYEQLTELIDMYKEIGVEVHVTEIDVSMKNCKTHDQQRKLYMDVFRACFDNENCKVFTVWGAYDTESWIGASNVPLPFDDDMYPKDIYFDMLEYVMK

SEQ ID NO: 9326 - protein, 306 aa, Piromyces finnis
  FAMILY NOT NAMED
YAKDFRIGVAANTMRFNNQAYNEALKAFNYMVAENGCKLSGIQQRQGNYDFSDCDNHYKKAKELGMAFRGHALIWHAYMPSWFENANASTLKNAIVEHVTKVLQHYEGKIDTWDVVNEAIDDSSNGNGWKMRNSFLYQKVPNFVDLAFETARKVSPNTKLFYNDYNTEGIYGKTESVFQFVKDMKSRGIPIDGVGIQYHVSVDSQPQYNKIDDLISRYCGLGLEVHITELDVKCGSQCSSSNVESKQATVFTNALKACLNNSCCTGYLVWGVGDSDSWLGANEKGLLFNSNYQPKSQYTAVLNVLK

SEQ ID NO: 9327 - protein, 306 aa, Piromyces finnis; identical to SEQ ID NO: 9326
  FAMILY NOT NAMED

SEQ ID NO: 9328 - protein, 57 aa, Piromyces finnis
  FAMILY NOT NAMED
ATVFTNALKACLNNSCCTGYLVWGVGDSDSWLGANEKGLLFNSNYQPKSQYTAVLNV

SEQ ID NO: 9329 - protein, 57 aa, Piromyces finnis; identical to SEQ ID NO: 9328
  FAMILY NOT NAMED

SEQ ID NO: 9330 - protein, 57 aa, Piromyces finnis; identical to SEQ ID NO: 9328
  FAMILY NOT NAMED

SEQ ID NO: 9331 - protein, 211 aa, Piromyces finnis
  FAMILY NOT NAMED
AYTGDGTTYGDPVTGGYCMMPDSEAYTKDMMFAAMNLPQYNISAGCGSCLILAQADKPERVIRVRVVDRCGECPKGDIDLSNTAWKALTGDFIPGRVKIIWSIVPCTETWYDYPPLVEEGSPIKLKWKMASSVYWGGIQAFNTRYPVTSIERWDGNDWVHLKRDDMFHYMWEGTIPNTPMKVRVTQGDGVVVVVDGLTIDGSWYDVDDNYT

SEQ ID NO: 9332 - protein, 719 aa, Piromyces finnis
  FAMILY NOT NAMED
SLSYTWKNAEIVGGGFVPGIVFSEAEKDLVYARTDIGGLYRLNTSTKRWENLSKWVGVDNWGYAGIDTMCADPVDADRVYAAVGMYTNNWDPNNGAIISSTDRGDNWSITELPFKVGGNDPGRGMGERIAVDPNNNKILFFGARAGNGLWKSTDYAKTWTQVKSFTNVGKYATDTQYFTEAIGISFVTFDKYSGKKGSPTPNIYVGVADNSTSTVYVSKDAGASWVPIPDQPLHYFPHKGKITKDGMLYITYTDGCGPYDGQAGAIYRYNTKTGEWKDISPHQEPYFGYGGLAIDAQDQKTIVVATLNSWWPDAILFRSTDGGDTWSHIWEWNGYPERKFKYEIDPSISPWIEDNMKQIPEPTTKLGWMIESLEIDPFNSDRIMWGTGATIWGSEDLTNWDNGKKFHITIMASGIEETAVQDLVSPPSGDAHLLSVMGDLGGFRHTDLDTCPEVNFRSPTFSSGFSIDYAENVPNFWVRVGTEPYIALSWGNGESWYGVQAPGGVTEGGIVAVGAEGDVVWAPKPYDLGVFYGKETFKSSKGIPGGARICSDRVNGKIFYGYLGDTFYRSIDTGVSFTKMYTGLPEMEPGYAKNIKAVAGHEGDVWLAGNKGGLYHTEDGGETFYQIDGVEIANTIGFGKAAEGYDYPALYITGKIGNINGIFRSDDKGQNWVRINDDNNQYGTINFCITGDPRIYGRVYVCTNGFGIVYGDIDGDSGT

SEQ ID NO: 9333 - protein, 207 aa, Piromyces finnis
  FAMILY NOT NAMED
IYSGDGTAYGDATSGGNCLFPKKEYYNDMMYAALNNKQYNDDMGCGLCAVVVSTSNPYKAIRVRIIDQCPECEHGSLDFSDKAFKALSNKTPDRIKITWALIPCDVDVNEFPALVKPKAPLKFQFKSGSTQFWGEVEVFNTRYPVAKVELLLNGKYQSLYRRAYNYWALSSGGFGAGPYTFRVTLADNTVIQATNVEMVIPANDEGD

SEQ ID NO: 9334 - protein, 339 aa, Neocallimastix californiae
  FAMILY NOT NAMED
AAKWNEINDFNQSDYPTSALDNDWFRLLEKSVAMPSNNESVGDLSFKGKVVIITGAGGGLGRAYAKHFAKLGASVVVNDLGVLLRGRGANTQVADSVVEEIKQMGGIAVPSYDSVEEGEKIVETAIKNFGRVDIIINNAGILRDRSFGRMTDTDWMMTYRVHLKGTYKVTRAAWPYMMKQKYGRIINITSAAGLFGNFGQSNYAAAKSGVIGLTNALALEGKEYNITVNSVAPNAGTRMTATIMPQEMVELLKPEYTAPLISFLTHESCNATGGIYEVGSCWVARLRWQRSGGASFAINKLLYPESIATRWRDIINFEDGRDTYPTSIEESTAQMQVNL

SEQ ID NO: 9335 - protein, 339 aa, Neocallimastix californiae
  FAMILY NOT NAMED
AAKWNEINDFNQSDYPTSALDNDWFRLLEKSVAMPSNNDSIGDLSFKGRVVIVTGAGGGLGRAYAKHFAKLGASVVVNDLGVLLRGRGANTQVADGVVEEIKKMGGIAVPSYDSVEEGEKIVETAIKNFGRVDIIINNAGILRDRSFARMTDTDWMMTYRVHLKGTYKVTRAAWPYMMKQKYGRIINITSAAGLFGNFGQSNYAAAKSGVIGLTNALALEGKEHNITINSVAPNAGTRMTATIMPQEMVELLKPEYTAPLISFLTHESCNVTGGIYEVGSCWVARLRWQRSGGASFAINKLLYPESIATRWRDIINFEDGRDTYPTTIEESTAQMQVNL

SEQ ID NO: 9336 - protein, 339 aa, Anaeromyces robustus
  FAMILY NOT NAMED
AAKWNEINDFNQSDYPTSALDNDWFRLLEKSVAIPSNNESVGDLNFKGRVVIVTGAGGGLGRAYAKHFAKLGASVVVNDLGVLLRGRGANTQVADSVVEEIKKMGGIAVPSYDSVEEGEKIVETAIKNFGRVDVIINNAGILRDRSFARITDTDWMMTYKVHLKGTYKVTKAAWPYMIKQKYGRIINITSAAGLFGNFGQSNYAAAKSGVIGFTNALALEGKEHNITINSVAPNAGTRMTATIMPQEMVELLKPEYTAPLISFLTHESCTATGGIYEVGSCWVARLRWQRSGGASFAINKLLYPESIATRWRDIINFEDGRDTYPTTIEESTAQMQVNL

SEQ ID NO: 9337 - protein, 1840 aa, Anaeromyces robustus; identical to SEQ ID NO: 9056
  FAMILY NOT NAMED

SEQ ID NO: 9338 - protein, 339 aa, Piromyces finnis
  FAMILY NOT NAMED
AAKWNEINDFNQSDYPTSALDNDWFRLLEKSVAMPSNNESIGELSFKGRVVIVTGAGGGLGRAYAKHFAKLGASVVVNDLGVLLRGRGANTQVADSVVEEIKSMGGIAVPSYDSVEEGEKIVETAIKNFGRVDVIINNAGILRDRSFARMTDTDWMMTYKVHLKGCYKVTKAAWPYMVKQKYGRIINITSAAGLFGNFGQSNYAAAKAGVIGLTNTLALEGKEHNITVNSIAPNAGTRMTATIMPQEMVELLKPEYTAPLISFLTHESCTATGGIYEVGSCWIARIRWQRSGGASFAINKLLYPESIATRWRDIINFEDGRDTYPTTIEESTAQMQVNL

SEQ ID NO: 9339 - protein, 18 aa, Neocallimastix californiae
  FASYNTHASE
VSAVINAGYNVEVGCGAL

SEQ ID NO: 9340 - protein, 21 aa, Neocallimastix californiae
  FASYNTHASE
FYRGLVMQSSVERDELNRSDY

SEQ ID NO: 9341 - protein, 19 aa, Neocallimastix californiae
  FASYNTHASE
EAEVKQKPTAYVFTGQGAQ

SEQ ID NO: 9342 - protein, 18 aa, Neocallimastix californiae
  FASYNTHASE
DIEEMTYEEVILRLIELL

SEQ ID NO: 9343 - protein, 20 aa, Neocallimastix californiae
  FASYNTHASE
TRYTRLTGRPPLLVGGMTPT

SEQ ID NO: 9344 - protein, 19 aa, Neocallimastix californiae
  FASYNTHASE
MPIVVEWTGGRSGGHHSCE

SEQ ID NO: 9345 - protein, 22 aa, Neocallimastix californiae
  FASYNTHASE
PNTNEDYSLASGDVNPIHTNYY

SEQ ID NO: 9346 - protein, 21 aa, Neocallimastix californiae
  FASYNTHASE
FANLADLDVPITHGMWTSAAT

SEQ ID NO: 9347 - protein, 19 aa, Neocallimastix californiae
  FASYNTHASE
GYICDDAVYAGHSLGEYAA

SEQ ID NO: 9348 - protein, 24 aa, Neocallimastix californiae
  FASYNTHASE
RKPPPFICVLDEEFHVWLKRDSLW

SEQ ID NO: 9349 - protein, 23 aa, Neocallimastix californiae
  FASYNTHASE
GMGQDLYNKSAVAKAVWDRADAY

SEQ ID NO: 9350 - protein, 18 aa, Neocallimastix californiae
  FASYNTHASE
KPGNRDAILKVIQIARTF

SEQ ID NO: 9351 - protein, 22 aa, Neocallimastix californiae
  FASYNTHASE
HSSNIGYSRVSGDVNPIHTNPY

SEQ ID NO: 9352 - protein, 24 aa, Neocallimastix californiae
  FASYNTHASE
IKPPPFIPNMDKQFKYWFKKDSLW

SEQ ID NO: 9353 - protein, 19 aa, Neocallimastix californiae
  FASYNTHASE
MPIIMQWTGGRAGGHHSFE

SEQ ID NO: 9354 - protein, 21 aa, Neocallimastix californiae
  FASYNTHASE
FAQLADLPGNITHGMWTSAST

SEQ ID NO: 9355 - protein, 19 aa, Neocallimastix californiae
  FASYNTHASE
GFIQQNSAFAGHSLGEYAA

SEQ ID NO: 9356 - protein, 19 aa, Neocallimastix californiae
  FASYNTHASE
TAEVEQPITAYVFTGQGAQ

SEQ ID NO: 9357 - protein, 18 aa, Neocallimastix californiae
  FASYNTHASE
DLKDMTYYEVLRRMLELM

SEQ ID NO: 9358 - protein, 21 aa, Neocallimastix californiae
  FASYNTHASE
FYRGMTMQRAVQRDSKGRSDY

SEQ ID NO: 9359 - protein, 23 aa, Neocallimastix californiae
  FASYNTHASE
GMGMDLYEKSPVAREIWDRADAH

SEQ ID NO: 9360 - protein, 18 aa, Neocallimastix californiae
  FASYNTHASE
KPGSVSAIQQVIAIAKQN

SEQ ID NO: 9361 - protein, 19 aa, Neocallimastix californiae
  FASYNTHASE
MPIIMQWTGGRAGGHHSFE

SEQ ID NO: 9362 - protein, 23 aa, Neocallimastix californiae
  FASYNTHASE
GMGMDLYEKSPVAREIWDRADAH

SEQ ID NO: 9363 - protein, 24 aa, Neocallimastix californiae
  FASYNTHASE
IKPPPFIPNMDKQFKYWFKKDSLW

SEQ ID NO: 9364 - protein, 19 aa, Neocallimastix californiae
  FASYNTHASE
GFIQQNSAFAGHSLGEYAA

SEQ ID NO: 9365 - protein, 21 aa, Neocallimastix californiae
  FASYNTHASE
FAQLADLPGNITHGMWTSAST

SEQ ID NO: 9366 - protein, 19 aa, Neocallimastix californiae
  FASYNTHASE
TAEVEQPITAYVFTGQGAQ

SEQ ID NO: 9367 - protein, 18 aa, Neocallimastix californiae
  FASYNTHASE
VSACINAGYHIELAGGGQ

SEQ ID NO: 9368 - protein, 18 aa, Neocallimastix californiae
  FASYNTHASE
KPGSVSAIQQVIAIAKQN

SEQ ID NO: 9369 - protein, 21 aa, Neocallimastix californiae
  FASYNTHASE
FYRGMTMQRAVQRDSKGRSDY

SEQ ID NO: 9370 - protein, 20 aa, Neocallimastix californiae
  FASYNTHASE
TRFSRLLGKPPLMVGGMTPT

SEQ ID NO: 9371 - protein, 18 aa, Neocallimastix californiae
  FASYNTHASE
DLKDMTYYEVLRRMLELM

SEQ ID NO: 9372 - protein, 22 aa, Neocallimastix californiae
  FASYNTHASE
HSSNIGYSRVSGDVNPIHTNPY

SEQ ID NO: 9373 - protein, 23 aa, Neocallimastix californiae
  FASYNTHASE
GMGMDLYEKSPVAREIWDRADAH

SEQ ID NO: 9374 - protein, 19 aa, Neocallimastix californiae
  FASYNTHASE
MPIIMQWTGGRAGGHHSFE

SEQ ID NO: 9375 - protein, 20 aa, Neocallimastix californiae
  FASYNTHASE
TRFSRLLGKPPLMVGGMTPT

SEQ ID NO: 9376 - protein, 18 aa, Neocallimastix californiae
  FASYNTHASE
DLKDMTYYEVLRRMLELM

SEQ ID NO: 9377 - protein, 18 aa, Neocallimastix californiae
  FASYNTHASE
VSACINAGYHIELAGGGQ

SEQ ID NO: 9378 - protein, 21 aa, Neocallimastix californiae
  FASYNTHASE
FAQLADLPGNITHGMWTSAST

SEQ ID NO: 9379 - protein, 19 aa, Neocallimastix californiae
  FASYNTHASE
TAEVEQPITAYVFTGQGAQ

SEQ ID NO: 9380 - protein, 19 aa, Neocallimastix californiae
  FASYNTHASE
GFIQQNSAFAGHSLGEYAA

SEQ ID NO: 9381 - protein, 24 aa, Neocallimastix californiae
  FASYNTHASE
IKPPPFIPNMDKQFKYWFKKDSLW

SEQ ID NO: 9382 - protein, 18 aa, Neocallimastix californiae
  FASYNTHASE
KPGSVSAIQQVIAIAKQN

SEQ ID NO: 9383 - protein, 22 aa, Neocallimastix californiae
  FASYNTHASE
HSSNLGYSRVSGDVNPIHTNPY

SEQ ID NO: 9384 - protein, 21 aa, Neocallimastix californiae
  FASYNTHASE
FYRGMTMQRAVQRDSKGRSDY

SEQ ID NO: 9385 - protein, 19 aa, Neocallimastix californiae
  FASYNTHASE
MPIVVEWTGGRSGGHHSCE

SEQ ID NO: 9386 - protein, 21 aa, Neocallimastix californiae
  FASYNTHASE
FANLADLDVPITHGMWTSAAT

SEQ ID NO: 9387 - protein, 23 aa, Neocallimastix californiae
  FASYNTHASE
GMGQELYNKSAVAKAVWDRADAY

SEQ ID NO: 9388 - protein, 19 aa, Neocallimastix californiae
  FASYNTHASE
EAEVKQKPTAYVFTGQGAQ

SEQ ID NO: 9389 - protein, 21 aa, Neocallimastix californiae
  FASYNTHASE
FYRGLVMQSSVERDELNRSDY

SEQ ID NO: 9390 - protein, 18 aa, Neocallimastix californiae
  FASYNTHASE
VSAVINAGYNVEVGCGAL

SEQ ID NO: 9391 - protein, 24 aa, Neocallimastix californiae
  FASYNTHASE
RKPPPFICVLDDEFHVWLKRDSLW

SEQ ID NO: 9392 - protein, 22 aa, Neocallimastix californiae
  FASYNTHASE
PNTNEDYSLASGDVNPIHTNYY

SEQ ID NO: 9393 - protein, 18 aa, Neocallimastix californiae
  FASYNTHASE
DIEEMTYEEVILRLIELL

SEQ ID NO: 9394 - protein, 18 aa, Neocallimastix californiae
  FASYNTHASE
KPGNRDAILKVIQIARTF

SEQ ID NO: 9395 - protein, 20 aa, Neocallimastix californiae
  FASYNTHASE
TRYTRLTGRPPLLVGGMTPT

SEQ ID NO: 9396 - protein, 19 aa, Neocallimastix californiae
  FASYNTHASE
GYICDDAVYAGHSLGEYAA

SEQ ID NO: 9397 - protein, 20 aa, Anaeromyces robustus
  FASYNTHASE
TRYTRLTGRPPLLVGGMTPT

SEQ ID NO: 9398 - protein, 24 aa, Anaeromyces robustus
  FASYNTHASE
RKPPPFICVLDEEFHVWLKRDSLW

SEQ ID NO: 9399 - protein, 19 aa, Anaeromyces robustus
  FASYNTHASE
MPMVVEWTGGRSGGHHSCE

SEQ ID NO: 9400 - protein, 18 aa, Anaeromyces robustus
  FASYNTHASE
KPGNRDAIMKVIQIARTF

SEQ ID NO: 9401 - protein, 22 aa, Anaeromyces robustus
  FASYNTHASE
PNTNEDYSLASGDVNPIHTNYY

SEQ ID NO: 9402 - protein, 19 aa, Anaeromyces robustus
  FASYNTHASE
EAEVKQKPTAYVFTGQGAQ

SEQ ID NO: 9403 - protein, 18 aa, Anaeromyces robustus
  FASYNTHASE
VSAVINAGYNVEIGCGAL

SEQ ID NO: 9404 - protein, 18 aa, Anaeromyces robustus
  FASYNTHASE
DIEEMTYAEVILRLIELL

SEQ ID NO: 9405 - protein, 23 aa, Anaeromyces robustus
  FASYNTHASE
GMGQELYNKSAVAKSVWDRADAY

SEQ ID NO: 9406 - protein, 19 aa, Anaeromyces robustus
  FASYNTHASE
GYICDDAVYAGHSLGEYAA

SEQ ID NO: 9407 - protein, 21 aa, Anaeromyces robustus
  FASYNTHASE
FANLADLDVPITHGMWTSAAT

SEQ ID NO: 9408 - protein, 21 aa, Anaeromyces robustus
  FASYNTHASE
FYRGLVMQSSVERDALNRSDY

SEQ ID NO: 9409 - protein, 20 aa, Anaeromyces robustus
  FASYNTHASE
TRFSRLLGKPPLMVGGMTPT

SEQ ID NO: 9410 - protein, 21 aa, Anaeromyces robustus
  FASYNTHASE
FAQLADLPGNITHGMWTSAST

SEQ ID NO: 9411 - protein, 21 aa, Anaeromyces robustus
  FASYNTHASE
FYRGMTMQRAVQRDSKGRSDY

SEQ ID NO: 9412 - protein, 24 aa, Anaeromyces robustus
  FASYNTHASE
IKPPPFIPNMDKSFKYWFKKDSLW

SEQ ID NO: 9413 - protein, 18 aa, Anaeromyces robustus
  FASYNTHASE
VSACINAGYHIELAGGGQ

SEQ ID NO: 9414 - protein, 22 aa, Anaeromyces robustus
  FASYNTHASE
HSSNLGYSRVSGDVNPIHTNPY

SEQ ID NO: 9415 - protein, 18 aa, Anaeromyces robustus
  FASYNTHASE
KPGSVSAIKQVIAIARQN

SEQ ID NO: 9416 - protein, 19 aa, Anaeromyces robustus
  FASYNTHASE
TAEVEQPITAYVFTGQGAQ

SEQ ID NO: 9417 - protein, 19 aa, Anaeromyces robustus
  FASYNTHASE
MPIIMQWTGGRAGGHHSFE

SEQ ID NO: 9418 - protein, 18 aa, Anaeromyces robustus
  FASYNTHASE
DLKDMTYYEVLRRMLELM

SEQ ID NO: 9419 - protein, 23 aa, Anaeromyces robustus
  FASYNTHASE
GMGMDLYEKSAVAREIWDRADAH

SEQ ID NO: 9420 - protein, 19 aa, Anaeromyces robustus
  FASYNTHASE
GFIQQNSAFAGHSLGEYAA

SEQ ID NO: 9421 - protein, 20 aa, Piromyces finnis
  FASYNTHASE
TRFSRLIGKPPLMVGGMTPT

SEQ ID NO: 9422 - protein, 21 aa, Piromyces finnis
  FASYNTHASE
FAQLADLPGNITHGMWTSAST

SEQ ID NO: 9423 - protein, 18 aa, Piromyces finnis
  FASYNTHASE
DLKDMTYYEVLRRMLELM

SEQ ID NO: 9424 - protein, 23 aa, Piromyces finnis
  FASYNTHASE
GMGMDLYEKSPVAREIWDRADKH

SEQ ID NO: 9425 - protein, 19 aa, Piromyces finnis
  FASYNTHASE
GYIQQNSAFAGHSLGEYAA

SEQ ID NO: 9426 - protein, 18 aa, Piromyces finnis
  FASYNTHASE
VGACINAGYHIELAGGGQ

SEQ ID NO: 9427 - protein, 18 aa, Piromyces finnis
  FASYNTHASE
KPGSVSAIQQVIAIAKQN

SEQ ID NO: 9428 - protein, 24 aa, Piromyces finnis
  FASYNTHASE
IKPPPYIPIMDKSFKYWFKKDSLW

SEQ ID NO: 9429 - protein, 19 aa, Piromyces finnis
  FASYNTHASE
TAEVEQPITAYVFTGQGAQ

SEQ ID NO: 9430 - protein, 21 aa, Piromyces finnis
  FASYNTHASE
FYRGMTMQRAVQRDSKGRSDY

SEQ ID NO: 9431 - protein, 22 aa, Piromyces finnis
  FASYNTHASE
HSSNLGYSRVSGDVNPIHTNPY

SEQ ID NO: 9432 - protein, 19 aa, Piromyces finnis
  FASYNTHASE
MPIIMQWTGGRAGGHHSFE

SEQ ID NO: 9433 - protein, 20 aa, Piromyces finnis
  FASYNTHASE
TRFSRLIGKPPLMVGGMTPT

SEQ ID NO: 9434 - protein, 21 aa, Piromyces finnis
  FASYNTHASE
FAQLADLPGNITHGMWTSAST

SEQ ID NO: 9435 - protein, 18 aa, Piromyces finnis
  FASYNTHASE
DLKDMTYYEVLRRMLELM

SEQ ID NO: 9436 - protein, 23 aa, Piromyces finnis
  FASYNTHASE
GMGMDLYEKSPVAREIWDRADKH

SEQ ID NO: 9437 - protein, 19 aa, Piromyces finnis
  FASYNTHASE
GYIQQNSAFAGHSLGEYAA

SEQ ID NO: 9438 - protein, 18 aa, Piromyces finnis
  FASYNTHASE
VGACINAGYHIELAGGGQ

SEQ ID NO: 9439 - protein, 18 aa, Piromyces finnis
  FASYNTHASE
KPGSVSAIQQVIAIAKQN

SEQ ID NO: 9440 - protein, 24 aa, Piromyces finnis
  FASYNTHASE
IKPPPYIPIMDKSFKYWFKKDSLW

SEQ ID NO: 9441 - protein, 19 aa, Piromyces finnis
  FASYNTHASE
TAEVEQPITAYVFTGQGAQ

SEQ ID NO: 9442 - protein, 21 aa, Piromyces finnis
  FASYNTHASE
FYRGMTMQRAVQRDSKGRSDY

SEQ ID NO: 9443 - protein, 22 aa, Piromyces finnis
  FASYNTHASE
HSSNLGYSRVSGDVNPIHTNPY

SEQ ID NO: 9444 - protein, 19 aa, Piromyces finnis
  FASYNTHASE
MPIIMQWTGGRAGGHHSFE

SEQ ID NO: 9445 - protein, 20 aa, Piromyces finnis
  FASYNTHASE
TRFSRLIGKPPLMVGGMTPT

SEQ ID NO: 9446 - protein, 21 aa, Piromyces finnis
  FASYNTHASE
FAQLADLPGNITHGMWTSAST

SEQ ID NO: 9447 - protein, 18 aa, Piromyces finnis
  FASYNTHASE
DLKDMTYYEVLRRMLELM

SEQ ID NO: 9448 - protein, 23 aa, Piromyces finnis
  FASYNTHASE
GMGMDLYEKSPVAREIWDRADKH

SEQ ID NO: 9449 - protein, 19 aa, Piromyces finnis
  FASYNTHASE
GYIQQNSAFAGHSLGEYAA

SEQ ID NO: 9450 - protein, 18 aa, Piromyces finnis
  FASYNTHASE
VGACINAGYHIELAGGGQ

SEQ ID NO: 9451 - protein, 18 aa, Piromyces finnis
  FASYNTHASE
KPGSVSAIQQVIAIAKQN

SEQ ID NO: 9452 - protein, 24 aa, Piromyces finnis
  FASYNTHASE
IKPPPYIPIMDKSFKYWFKKDSLW

SEQ ID NO: 9453 - protein, 19 aa, Piromyces finnis
  FASYNTHASE
TAEVEQPITAYVFTGQGAQ

SEQ ID NO: 9454 - protein, 21 aa, Piromyces finnis
  FASYNTHASE
FYRGMTMQRAVQRDSKGRSDY

SEQ ID NO: 9455 - protein, 22 aa, Piromyces finnis
  FASYNTHASE
HSSNLGYSRVSGDVNPIHTNPY

SEQ ID NO: 9456 - protein, 19 aa, Piromyces finnis
  FASYNTHASE
MPIIMQWTGGRAGGHHSFE

SEQ ID NO: 9457 - protein, 20 aa, Piromyces finnis
  FASYNTHASE
TRFSRLIGKPPLMVGGMTPT

SEQ ID NO: 9458 - protein, 21 aa, Piromyces finnis
  FASYNTHASE
FAQLADLPGNITHGMWTSAST

SEQ ID NO: 9459 - protein, 18 aa, Piromyces finnis
  FASYNTHASE
DLKDMTYYEVLRRMLELM

SEQ ID NO: 9460 - protein, 23 aa, Piromyces finnis
  FASYNTHASE
GMGMDLYEKSPVAREIWDRADKH

SEQ ID NO: 9461 - protein, 19 aa, Piromyces finnis
  FASYNTHASE
GYIQQNSAFAGHSLGEYAA

SEQ ID NO: 9462 - protein, 18 aa, Piromyces finnis
  FASYNTHASE
VGACINAGYHIELAGGGQ

SEQ ID NO: 9463 - protein, 18 aa, Piromyces finnis
  FASYNTHASE
KPGSVSAIQQVIAIAKQN

SEQ ID NO: 9464 - protein, 24 aa, Piromyces finnis
  FASYNTHASE
IKPPPYIPIMDKSFKYWFKKDSLW

SEQ ID NO: 9465 - protein, 19 aa, Piromyces finnis
  FASYNTHASE
TAEVEQPITAYVFTGQGAQ

SEQ ID NO: 9466 - protein, 21 aa, Piromyces finnis
  FASYNTHASE
FYRGMTMQRAVQRDSKGRSDY

SEQ ID NO: 9467 - protein, 22 aa, Piromyces finnis
  FASYNTHASE
HSSNLGYSRVSGDVNPIHTNPY

SEQ ID NO: 9468 - protein, 19 aa, Piromyces finnis
  FASYNTHASE
MPIIMQWTGGRAGGHHSFE

SEQ ID NO: 9469 - protein, 3606 aa, Neocallimastix californiae
  FATTY ACID SYNTHASE SUBUNIT BETA
HVPEENWSCAEQIAYDFNSTFKNTFVVDDEDVEKKNTLNGFWIYVHFMEFATRYQADNKTLLTQKDITHLLINLFIDFSIRFLKGNDIHIRTRHFEHEFRIQVIQHFYTVFDYLQKDEEAANAIANFLPVEPALAKAVRAGDALALAVFGGQGYPGFNEILQAYTMYGAIVRDYIAELSTILKELASKPEFQRTYKQGLDILKWLRNPESLPEDAYLDSAPVSFPLIGIVQLVQYLILFRTFRKTPDWARHLFAGTTGHSQGLVTSVVIASSGTEEEYLENSKKAVSLLFLIGARSQQIFAITPLSPETLQEIADNGDENDMPTCMLSINGLPEATVRQAVNDLNKFIEDPARKVTISLINGLRMIVVTGAPESLQNLKMSLKKIQAGPNEDQSRIPFSKRKQIFTMKFLSVTIPAHNEILKEAAELVVEDAAKLNITFPTKNLAIPVYRTDNGVDMKEESDITDVVEPVVNQICILPVDWVKATNVPGLTHVLDFGPGGASGIGSLIQKNKEGTGVQVILSGTLASTNPDLKCKMYAYTTELDDLPYGINWAKEFAPKLIRNADGELLMDTRYTRLTGRPPLLVGGMTPTTANPQFVSAVINAGYNVEVGCGALYAPHVLDKCIKDIVERIPDGEGILCNIVFLNQRLWAFQFPGVLDMRKNRGIRIEGITIAAGVPSLEYCNKMIPQLIDAGIPYIGFKPGNRDAILKVIQIARTFPQMPIVVEWTGGRSGGHHSCEDFYAPILETYAALRKQSNIVVVVGSGFGDDVGTLPYITGDWSIELGYPPMPFDGLLVGSRVCVAKEALTSDGIKEVIVNTPGIEDQSQWEKSYDQPVGGVVTVESEYGEPIHKIATRGVMFWKELDKTIFSIHDPKKRLEKLLEKKDYIIERLNKDFQKVWFGKKNGKPCDIEEMTYEEVILRLIELLFVQKRKQWLDVSHLKTTYDFINRTEERFVQNSSQDAFLSSIEDLDVEDPVALMKEFFDTRAPGARTELLATEDVQYFIGLTRNKDRKPPPFICVLDEEFHVWLKRDSLWQAEDLDAVVDQDPQRVAILQGPVAIRHSKIANQPVKEILDGIIKSHIKSIEARYYANRAVPNVEYLGGSPIPASVSDVPANVKVEKEGNTMIYTLPAQEDQLPADKEWIEFMAGPKYGWLRALLCTPTIARNKSITHNRFMRVFKPRTSQIVKIFHNDEGDITKIEIFGWNRSMELPALEAEIDSQRIITVGLREWGVPGVAGAEVMKLLFRYTPNQGSTPIHEVMEGRNRRIAEFYYNLWYGPEDSGDGWGDLTSIYKCKKRVTEEDVKFFSDVTRYTHPSNKVVPSMDFIIVTSWVSVFKTIFAKEFDADITRLVHMNNGYEVIDPRPLRIGEVVDTRSIISAVTNLDSGKLIEVTGHVFREGKEYVKVTSSFLCRGKFDDYHMTFNIRDEPEYILEVKDDKILNALMTRKYISFTEPEKIQLGVKLVFRLKTEKRFATKNTYSSITTKGKIYINNSAVHGFNMEEVGQFNYDSTTDEKLEGKSETLGNPAIEFIKKYAKANDRKIYFENGGYNILPKGVSLLQRAPNTNEDYSLASGDVNPIHTNYYFANLADLDVPITHGMWTSAATRRYVETYAADNDAERVVSYKVNFIGMVSPKDELRTSLTHVGMHNGRKIIKVSVKDLRTNETVMEGEAEVKQKPTAYVFTGQGAQEVGMGQDLYNKSAVAKAVWDRADAYLMKKYGYSILEIVRTNPKSLTVYFGGEDGEKIRENYINMTCEIIDSNGKVQTKRMFPEIDENTLYYEYKSPTGLLNATQFTQPAITLTEKAAFEDMYEKGYICDDAVYAGHSLGEYAALSCVANTLSIESMAEIVFYRGLVMQSSVERDELNRSDYAMCAVNPVRVHPYFSFDLLVEVVKKINAEHGGLLEIVNYNVENYQYVVTGDLTSLEALKNLLTNLRAEAKKFITLYKEDATQAMELLNEKVRTYVKLAEERKAKEGFFNIERGAATIPLRGIDVPFHSSYLLWGVPTFRELLHQRVRREDVDVKCLVGRYIPNLMGEPFSVEKDYAIRLQKRTNSAYLEKIIEEWDQHLFEIPYIIMVELLSYQLASAVQWIKTQEFLFSSQKKGGADIERLIEFGPTPTLVGMAKRTLGMKYVKSDLALGKKRQLLSYAKNTTDIYYEYDDMEFEEEEAAAPVEEAPKAAPAPTPAPAPAPVPVAAPAPVAAAPAASVADAPVTATEILRAILAQKLKKSISEVPLNKSIKELSGGRSTIQNEVSGDLHTEFGGNSIPLKAEELALEELGKQISSTFNGQLGKYTTQMINRMLSGKMPAGFSASAVKTYLANTYGLGKGRTDGVLLVAITMEPSSRLGSEADAQGWLDNVVSAYSAVSGVALSKGSAAPAAAAVAAPVMPVAMPVAAAAGPAAAVADAPISPNEIIRVMLAQKLKKSINEIPLSKSIKELSGGRSTVQNEVSGDLHTEFGGNSIPLKAEELAITELGGAIGANHSGKLGKYTSTMVNRMLSGKMPAGFSASKAKDYLKTSYGLGERRTDAVLLYSTTIEPTSRLGSEADAQAWLDKAVDLYSGANSLGLAKGGAGGAVAAAVPGVAAMGMVNSAEVTALKMKQDSLIRTQLENYAKYLGIDLREDQKKLVASSESTAKLQSDLDLWFDEHGEDYANGIKPMFTSKKARTYDSSWNWGYQDFWFMVYDILAGEKKDADALIASDVFRTMVNRANASLEQQVEFVHRKVVADQKDAEIKATLEKVTGALLEAIKASSGKPVFKFNGPFQAPHALVDEEGKLVYKEIPRKGINSAVDYVKEMQEGAMQTIGSTTKKIPFLFVRDQAANGVDNVDEAMSKIYLNELKKIAEEGISFTGKHVLITGCGRNSIGECVLKYLLAGGAKVVATTSSYRRATMEHFRSVYEQVGTKGSTLVVVPFNQGSKKDVNDLIEFIYSKDSRVNGLGWDLDLVIPFAAISENGRDISDLDGKSELAHRIMMTNVIRILGAVRTQKMKVGSLVSAQVILPLSPNHGTFGGDGLYGESKIGLENLLNRWRSETWSKYLSITGACIGWTRGTGLMNSNNLISEGIESQGTCRTFTTTEMAFNLIGLVSDVMVSLSRKSPIYADLNGGMQYMADMNVALRHIREKMTDESEKKRMVIDEEKAHADIVGANKVESKRHVEPRSNIRIQFPELKSREELKDMEYLRDLLDLDRVVVVTGYGEVGPYGNTRTRWEMEADGKFSLEGCVELAWIMGFIKHVTYKQMPDGTLYSGWVDAKSGAPIKDIDIKATYEKDILAHTGIRLIEPELFNGYNPEKKKFLQEVMVDTDLPPFEASKEEAETFKRQHEDKVEIYEVGDGRYMVRILKGASIYVAKALQFDRLVSGQLPTGWDPARYGIPKDIIEQVDIITCYCIVSAVEALVSAGITDPYEFYEYVHVSEVGNACGSGVGAELANRAIFKDRFLDKPLQSDILQETFVNTMSAWINLLLLSSSGPIRTPVGACASAVESVDIGIDTILSGKAKVVFVGGYDDFQEEGSYEFAQMKATSNSREEMAQGREPNEMSRPTASSRGGFMEAQGVGTQVLMPASLALKMGVPIYGIVAHSATATDKEGRSVPAPGQGILT

SEQ ID NO: 9470 - protein, 3316 aa, Neocallimastix californiae
  FATTY ACID SYNTHASE SUBUNIT BETA
HSTQMIRDRIKKIMSKVPSGEGITMNIMFLNAFQWGFQYPLVQEMRKEGVPLDGLCIAAGVPSLDVANEILGNLKACGIKHVAFKPGSVSAIQQVIAIAKQNPDMPIIMQWTGGRAGGHHSFEDFHQPIIDTYASIRRQPNIIIVVGSGFGDAEGTLPYLTGEWARKFGYPPMPFDGILFGSRILVAAEAGTSEEVKKLLVKSEGIENEKEWENTYKGPTGGVITVKSELGEPIHKLATRGVLLWKELDETIFNLPPEKQLPALLARKEYIVHRLNKDYQKVWFPKKYDAEDPEKVVDLKDMTYYEVLRRMLELMYPNGQWIDVSLRMIYGDFFHRVEERFYKASEGKEFVSFLQSYEQLEEDPVGLLEKFMEERVPEARVQLINSDDLMYFLNICSRRDIKPPPFIPNMDKQFKYWFKKDSLWQSEHLEAVVGQDPGRVCVLQGPVAVRHSTKANEPISSILDTINQEHIKQLKARYYQNSDTVIPVVDYFGGAEIRDVRRKIRGVSIKSVKNDNIVKTMFEVTAENNEDLPDENDWYDLLAGQYYTWLRALLASKVFVKDDDGYYQDNCVRRILRPKPHHIVEIRSINDNIESLSMFNKQGGNEVVKITIDDKKLITVLMNEYSLNTKLVQLPLLFQYKPEQGYAPIHEVMEGRNERIKRFYYDLWFGLDNGKYTFEDDYNHDPREPFVSVSEPITRQQITDFVNIIGNRAESYTDRGQKVLFAPMDFAIVVGWQSIIRAIFPKFINADLLKLVHLTNGFRMIDNESGLKEGDIVKTESRIISVINDETGKIVEVKGVLKRDEKPFMEVISKFFYRGVFSDYDSTFKNVEEKAYHVTLKNKKDVHILESLDWFKMTTDDEQLALTQGDQLLFELNSEYTFKTSDVYSRVKTFGTVKKLLSTKVYVDVAKVDYLYDKPDGSCGNPVIDFLERNGKVQDTPVYFENGGYSIMPKGKGISSVVNTHSSNIGYSRVSGDVNPIHTNPYFAQLADLPGNITHGMWTSASTRKFVETFAAENHPHRVTSYEVKFLDMVFPGDRLETKLFHTGMANGKKIIQCKTINQDGKVVLEGTAEVEQPITAYVFTGQGAQEVGMGMDLYEKSPVAREIWDRADAHLMENYGFSIIDIVKNNPTEITIYFGNVKGQQIRKNYQQMTYEHVNSDGVVESLSLFPEIDDDSVSYTFRHIGGLLSATQFTQPSLVLMEKAAFEEMRSRGFIQQNSAFAGHSLGEYAALTAIGDVLSIETLVDVVFYRGMTMQRAVQRDSKGRSDYAMCAVNPTRVSRTFNESALQYLVANIKKVTEGLIEIVNYNVDNWQYVVSGDLISLQVLTLVLNYLKAEKIDLTVLLNTLSVEEVQKQVNEIISTSFEKAKEQKKKHGYIKLERGAASIPLRGIDVPFHSSFLLRGVAPFRQYLMSKFDPNLIDVNRLIGNYIPNLTAEPFSLKKEFIENIYAKTNSSRIKNVLKGWTDDKYASPRLQQKLGYILLIELLAYQFASAVRWIETQDRLFVDIGVERLIEIGPGPTLSGMAQKTLKFKYEYYDDATSYRREILSYSKNYKEIFYDFEDESDPEVSEEPSAPAAPVAAAAVPVPAPAPVPVAAPVVAAGSVADEDIQVKHLINILIAQKLKKKANEVPMTSTIKELVGGKSTLQNEVLGDLQKEFGSSNVPDKSEELPLNELASQIGTGSVALGKYSQTLVNKLISAKMAAGFTKSKISGYLSQKYGLGPKRTDALLLFGLTDEPSARFGSEDEAKAWLDKIATGYSAFVGVGLSSGAPAAVAPMAMAVAAAPVAAGAASVADEDIQVKHLINILIAQKLKKKANEVPMTSTIKELVGGKSTLQNEVLGDLQKEFGSNNVPDKSEELPLNELASQIGSGSVALGKYSQTLVNKLVSAKMAAGFTKSKIQEYLSQKYGLGPKRTDALLLFGLTDEPSARFGSDVEAKAWLDKIAPMYFSFVGVSAGAAPAAGAAAGVPMMAAPVNAGAIAEATRKYDQLIKEQLDIFLNYLDIDPREGFNLYEDELNNAAKLRAELDLWMNEHGDEYAQGIKPIFDPLKVRKYDSYWNWVHQESLILYYDILYGRLAVVDRKVTSQCIHVMNRADPHLIDHYAYRISVTDPKKGPTYELAKEFAQILMENCTEAMSENPVYKDVDIPTMPQTTVTESGEIKYAEVPRPGIRKMESYIKLMQAGSRITRIPTKHSNRSIRFTGGNNKTRVKSKKVPFLFLKDPKTGEYDEKLTKVYYKSLYAMANDGISFKNKYVLITGCGRNSIGSQIIKGLLNGGAKIIATTSRFSKATMQYYRQLYEDHGSKGSCLIVVPFNAASVEDVNRLIDYIYSKDPKNGLGWDLDYVIPFAAISENGRTLENIDSRSELAHRIMLTNLLRMLGKIVSQKEAHKYDTRPAQCILPMSPNHGTFGGDGLYSESKIALETLFNRWHSEGWGGYLTVAGAVIGWTRGTGLMNSNNLVAEGIEMFGVHTFSTHEMAFNLIGLMHSDICKLCLKNPVFADLNGGLQFIDNLNSNINMIRTILNETSEIRRSIKNEKELEKNITLGKLLEKEKKLVLKPRANLKFSFPKVKPFEELKKLDYLRGMIDLDRTVVVTGYGEVGPYGNSRTRWEMEAYGKFSLEGCIEMAWIMGMIKYAKNKKTKNGKLYSGWVDAETGEPVQDYEVKAKYEQRILEHTGIRFIEPELFDGYDPNKKNFYQEVAIDHDLPGFECSKDEAEQFKKKHGDRVDIFENGESGQWIVKIKKGSTIYIPKALQFDRTVAGQIPTGWKPETYGIPKSIIDQVDPITLYVIVATVEALVSSGITDPYEFYEYVHVSEVGNCSGGGVGGMVSNRKQYFERLFEKPVQNDILQECFINTMPAWINLLLLSSSGPIKTPVGACATAVESVEIGLETILSGKAKIVIVGGYDDFQEEGSYEFANMKATSNSLEELAHGRDPSEMSRPATTTRGGFMESQGAGHEILMTASLAIKMGVPIYGIIAHTSTATDKEGRSVPAPGQGILTTAREAHATYNPLLDFKYRARQLKFRRKQIKLWIENELELLREEVDAKENKDDEQFTKYIKERTAYINKEAKRQEKEALRTYGNEFYKNDPTISPLRGALAVFGLTIDDIEALSFHGTGTKANDTNESEVINKQFKHLGRSKGNVCPAIMQKYLTGHPKGAAASWMLNGMLQVIETGIIPGNRNADNIEEKLRKFEYIYFPSRSIHTDGIKAGLLKSFGFGQVGGEVLVISPDYVLSSLTKEEYDVYCKKREVRQQAMYRYLHESMTENADFVQVKDHPPYDDTNESSVYLDPLARASYDKKEGTWKFS

SEQ ID NO: 9471 - protein, 2410 aa, Neocallimastix californiae
  FATTY ACID SYNTHASE SUBUNIT BETA
NIPFDQWSVAEEVREQYHMRQNSTLETGDTNIPQEQREIELFIDFLEFCSAYAYGQGQGQGQEIVTQYSEYESVVAATDDSQGLLKFITCVFSEYCNRYCKTNNIHVTTASYPKKLRLHAIQTYYKILDLLVTANTNNNTVESALIEKENSRSKKSALFQAVAKHKASIFAVFGGQGSEDYFNEIKEIYSTYEVIIKSYLERMSCMLEELASKPELLQFFPKGLHVLKWLEEPETLPDTKYLVNAPISLPLVGLCQLLHYSVLYKILGKTPDEMRRCFVGTTGHSQGIISSVVVSSSGTEEEFIENSQKALSLLFWIGVRSQMAYPETTINPKILQDSLNNDEGEPTPMISFANFPVNKIVEHIKATNQHLPEDRKIHISLYNGPRSIVCSGHPQSLYGLNVTLRKLRAQPNIDQNRIPYSQRKIRFSSRFLPISVPFHCDYLKDVNDIIMKDVERDHLILGKGELVIPILSTETGEDLRGHPQFTYELIKQICTLPVHWEKATSVTNATHVLEFGPSGAGVGLLTHRNKIGTGIQIILANSLESTEKEVLSKDSLFNRDPSSVKYSMNWEKLFAPKLVKSANNGKIYVETRFSRLLGKPPLMVGGMTPTTANENLVSACINAGYHIELAGGGQHSTQMIRDRIKKIMSKVPSGEGITMNIMFLNAFQWGFQYPLVQEMRKEGVPLDGLCIAAGVPSLDVANEILGNLKACGIKHVAFKPGSVSAIQQVIAIAKQNPDMPIIMQWTGGRAGGHHSFEDFHQPIIDTYASIRRQPNIIIVVGSGFGDAEGTLPYLTGEWARKFGYPPMPFDGILFGSRILVAAEAGTSEEVKKLLVKSEGIENEKEWENTYKGPTGGVITVKSELGEPIHKLATRGVLLWKELDETIFNLPPEKQLPALLARKEYIVHRLNKDYQKVWFPKKYDAEDPEKVVDLKDMTYYEVLRRMLELMYPNGQWIDVSLRMIYGDFFHRVEERFYKASEGKEFVSFLQSYEQLEEDPVGLLEKFMEERVPEARVQLINSDDLMYFLNICSRRDIKPPPFIPNMDKQFKYWFKKDSLWQSEHLEAVVGQDPGRVCVLQGPVAVRHSTKANEPISSILDTINQEHIKQLKARYYQNSDTVIPVVDYFGGAEIRDVRRKIRGVSIKSVKNDNIVKTMFEVTAENNEDLPDENDWYDLLAGQYYTWLRALLASKVFVKDDDGYYQDNCVRRILRPKPHHIVEIRSINDNIESLSMFNKQGGNEVVKITIDDKKLITVLMNEYSLNTKLVQLPLLFQYKPEQGYAPIHEVMEGRNERIKRFYYDLWFGLDNGKYTFEDDYNHDPREPFVSVSEPITRQQITDFVNIIGNRAESYTDRGQKVLFAPMDFAIVVGWQSIIRAIFPKFINADLLKLVHLTNGFRMIDNESGLKEGDIVKTESRIISVINDETGKIVEVKGVLKRDEKPFMEVISKFFYRGVFSDYDSTFKNVEEKAYHVTLKNKKDVHILESLDWFKMTTDDEQLALTQGDQLLFELNSEYTFKTSDVYSRVKTFGTVKKLLSTKVYVDVAKVDYLYDKPDGSCGNPVIDFLERNGKVQDTPVYFENGGYSIMPKGKGISSVVNTHSSNIGYSRVSGDVNPIHTNPYFAQLADLPGNITHGMWTSASTRKFVETFAAENHPHRVTSYEVKFLDMVFPGDRLETKLFHTGMANGKKIIQCKTINQDGKVVLEGTAEVEQPITAYVFTGQGAQEVGMGMDLYEKSPVAREIWDRADAHLMENYGFSIIDIVKNNPTEITIYFGNVKGQQIRKNYQQMTYEHVNSDGVVESLSLFPEIDDDSVSYTFRHIGGLLSATQFTQPSLVLMEKAAFEEMRSRGFIQQNSAFAGHSLGEYAALTAIGDVLSIETLVDVVFYRGMTMQRAVQRDSKGRSDYAMCAVNPTRVSRTFNESALQYLVANIKKVTEGLIEIVNYNVDNWQYVVSGDLISLQVLTLVLNYLKAEKIDLTVLLNTLSVEEVQKQVNEIISTSFEKAKEQKKKHGYIKLERGAASIPLRGIDVPFHSSFLLRGVAPFRQYLMSKFDPNLIDVNRLIGNYIPNLTAEPFSLKKEFIENIYAKTNSSRIKNVLKGWTDDKYASPRLQQKLGYILLIELLAYQFASAVRWIETQDRLFVDIGVERLIEIGPGPTLSGMAQKTLKFKYEYYDDATSYRREILSYSKNYKEIFYDFEDESDPEVSEETSAPAAPVAAAAVPVPAPAPVPVAAPVVAAGSVADEDIQVKHLINILIAQKLKKKANEVPMTSTIKELVGGKSTLQNEVLGDLQKEFGSSNVPDKSEELPLNELASQIGTGSVALGKYSQTLVNKLISAKMAAGFTKSKISGYLSQKYGLGPKRTDALLLFGLTDEPSARFGSEDEAKAWLDKIATGYSAFVGVGLSSGAP

SEQ ID NO: 9472 - protein, 3956 aa, Neocallimastix californiae
  FATTY ACID SYNTHASE SUBUNIT BETA
NIPFDQWSVAEEVREQYHMRQNSSIETGDTSIPQEQRELELFIDFLEFSSAYAYGQGQGQEVVTQYSEYESVVAATDDSQGLLKFITCVFSEFCNSYCKTNNIHVTTASYPKKLRLHAIQIYYKILDLLVTANTNNNTIESALIEKEKSRSKKSALLQAVTKHKASIFAVFGGQGSEDYFNEIKEIYSTYEVIIKSYLERMSCMLEELASKPELLQFFPKGLHVLKWLEEPETLPDTKYLINAPISLPLVGLCQLLHYSVLYKSLGKTPDEMRRCFVGTTGHSQGIISSVVVSSSGTEEEFIDNSEKALSLLFWIGVRSQMAYPETTINPKILQDSLNNDEGEPTPMISFANLPVNKIVEHIKATNQHLPEDRKIHISLYNGPRSIVCSGHPQSLYGLNVTLRKLKAQANIDQNRIPYSQRKIRFSSRFLPISVPFHCDYLKDVNDIVMKDVERDNLTLGKGELAIPILSTETGEDLRGHPQFTYELIKQICTLPVYWEKATSITNATHILEFGPSGAGVGLLTHRNKVGTGIQIILANSLESSEKEVLSKDSLYNRDPSSIKYSMNWEKLFAPKLVKSANNGKIYVETRFSRLLGKPPLMVGGMTPTTANENLVSACINAGYHIELAGGGQHSTQMIRDRIKKIMSKVPSGEGITMNIMFLNAFQWGFQYPLVQEMRKEGIPLDGLCIAAGVPSLDVANEILGNLKACGIKHVAFKPGSVSAIQQVIAIAKQNPDMPIIMQWTGGRAGGHHSFEDFHQPIIDTYASIRRQPNIIIVVGSGFGDAEGTLPYLTGEWASKFGYPPMPFDGILFGSRILVAAEAGTSEEVKKLLVESEGIENEKEWENTYKGPTGGVVTVKSELGEPIHKLATRGVLLWKELDETIFNLPPEKQLPALLARKEYIVHRLNKDYQKVWFPKKYDAEDPEKVVDLKDMTYYEVLRRMLELMYPNGQWIDVSLRMIYGDFFHRVEERFYKASEGKEFVSFLQSYEQLEEDPVGLLEKFMEERVPEAKVQLINSDDLMYFLNICSRRDIKPPPFIPNMDKQFKYWFKKDSLWQSEHLEAVVGQDPGRVCVLQGPVAVRHSTKANEPISSILDTINQEHIKQLKARYYQNNDTLVPVVDYFGGAEIRDVRRKIRNVSIKSIKNDNIFSTMFEITAENNEDLPDENDWFDLLAGQYYTWLHALLASKVFVKDDDGYYQDNCVRRILRPKPQHIVEIRTVNDKIESLSMFNKQGGKEVVKITIDDDKKIITVLMNEYSLNTKLVQLPLLFQYKPEQGYAPIHEIMEGRNERIKRFYYDLWFGLDNGKYTFEEDYNHNPKEPFVSVSEPITRQQITDFVNIIGNRAESYTDRGQKVLFAPMDFAIVVGWQSIIRAIFPKFINADLLKLVHLSNGFRMIDNELGLKEGDVVKTESRIISVVNDETGKIVEVKGVLKRDEKPFMEVISKFFYRGIFTDYDSTFKNVKEKTYHVTLKNKKDVHILESLDWFKMTTDDKQLSLTQGDQLLFELNSEYTFKTSDIYRKVKTFGTIKKLLSTKVYVDIAKVDYLYEEPDGSCGNPVIDFLERNGKIQDTPVYFENGGYSIMPKGKGLSSVVNTHSSNLGYSRVSGDVNPIHTNPYFAQLADLPGNITHGMWTSASTRKFVETFAAENHPHRVTSYEVKFLDMVFPGDRLETKLFHTGMANGKKIIQCKTINQDGKVILEGTAEVEQPITAYVFTGQGAQEVGMGMDLYEKSPVAREIWDRADAHLMESYGFSIIDIVKNNPTEITIYFGNVKGQQIRKNYQQMTYEHVNADGVIESLSLFPEIDDDSDSYTFHHIGGLLSATQFTQPSLVLMEKAAFEEMRTRGFIQQNSAFAGHSLGEYAALTAIGDVLSIETLVDVVFYRGMTMQRAVQRDSKGRSDYAMCAVNPTRVSRTFNESALQYLVANIKKVTEGLIEIVNYNVDNWQYVVSGDLISLQVLTLVLNYLKAEKIDLTVLLNTLSVEEVQKQVIEMITTAFEKAKDQKKRHGFIKLERGAASIPLRGIDVPFHSSFLLRGVAPFRQYLMSKFDPNLIDVNRLIGNYIPNLTAEPFSLKKEFIENIYAKTNSSRIKNVLKGWTDDKYASPRLQQKLGYILLIELLAYQFASAVRWIETQDRLFVDIGVERLIEIGPGPTLSGMAQKTLKFKYEYYDDATSSRREILSYSRNYKEIFYDFEDESESEAVETVSKSAPTPTPTPTPVPVAAPVAAAGSVADEDIQVKHLINILIAQKLKKKANEVPMTSTIKELVGGKSTLQNEVLGDLQKEFGSNNVPDKSEELPLNELSSQIGTGSMALGKYSQTLVNKLISAKMAAGFTKSKISGYLSQKYGLGPKRTDALLLFGLTDEPASRFGSEDEAKAWLDKVASGYSAFVGVGLSAGAAAAAAPMAMSMPMAVASVATASAASVADEDIQVKHLINILIAQKLKKKANEVPMTSTIKELVGGKSTLQNEVLGDLQKEFGSNNVPDKSEELPLNELSGQIGSGSIALGKYSQTLVNKLISAKMAAGFTKSKISGYLSQKYGLGPKRTDALLLFGLTDEPASRFGSEDEAKAWLDKIAPMYFSFVGVSAGAAPAAGAAASVPMMAAPVNAGAIAEATRKYDQLIKEQLDIFLNYLDIDPREGFNLYEDELNNAARLRAELDLWINEHGDEYAQGIKPIFDPLKVRKYDSYWNWVHQESLILYYDILYGRLAVVDRKVTSQCIHVMNRADQHLLDHYNYRIRATDSKKGPTYELAKEFAQILLENCSETINENPVYKDVDVPTMPQTTVSESGEIKYAEVPRPGIRKMESYIKLMQAGSRITRIPTKHSNRSIRFTGGGNGSGNNKTRVKSKKVPFLFLKDPKTGEYDEKLTKVYYKALYAMANDGITFKNKYVLITGCGRNSIGSQVIKGLLNGGAKIIATTSRFSKATMQYYRQLYEDHGSKGSCLIVVPFNAASVEDVNRLIEYIYSKDPKNGLGWDLDYVIPFAAISENGRTLENIDSRSELAHRIMLTNLLRMLGKIVTEKESHKYDTRPAQCILPMSPNHGTFGGDGLYSESKIALETLFNRWHSEGWGGYLTVAGAVIGWTRGTGLMNSNNLVAEGIEMFGVHTFSTHEMAFNLIGLMHSDICKLCLKNPVFADLNGGLQFIDNLNGNINMIRTILNETSEIRRSIKNEKELEKSITLGKLLAKEKKLVLKPRANLKFSFPKVKPFEELKKLDYLRGMIDLDRTVVVTGYGEVGPYGNSRTRWEMEAYGKFSLEGCIEMAWIMGMIKYAKNKKTKDGKLYSGWVDAETGEPVQDFEVKAKYEERILQHTGIRFIEPELFNGYDPNKKNFYQEVAIDHDLPGFECSKEEAEQFKRKHGDRVDIFENGESGQWNVKFKKGSTIYIPKALQFDRTVAGQIPTGWKPETYGIPKSIIDQVDPVTLYVIVATVEALINSGITDPYEFYEYVHVSEVGNCSGGGVGGMLSSRKEYFERAFEKPIQSDILQECFINTMPAWINLLLLSSSGPIKTPVGACATAVESVEIGLETILSGKAKIVIVGGYDDFQEEGSYEFANMKATSNALDELAHGRDPSEMSRPGTTTRGGFMESQGAGHEILMTASLAIKMGVPIYGIIAHTSTATDKEGRSVPAPGQGILTTAREAHVTYNPLLDFKYRARQLKFRRKQIKLWIENEFELLREEMEGRKEGKEDNDNDEQFNKYVRERTAYINKEARRQEKEALRTYGNEFYKNDPTISPLRGALAVFGLTMDDIDALSFHGTGTKANDTNESEVINKQFKHLGRSKGNVCPAIMQKYLTGHPKGAAASWMLNGMLQVIETGIIPGNRNADNIEEKLRKFDYIYFPSRSIHTDGVKAGLLKSFGFGQVGGEVLVISPDYVLSSLTKEEYDVYCKKREVRQQAMYRYLHESMTENADFVQVKEHPPYDDTNESNVYLDPLARASYDKKEGSWKFN

SEQ ID NO: 9473 - protein, 2891 aa, Neocallimastix californiae
  FATTY ACID SYNTHASE SUBUNIT BETA
HVPEENWSCAEQIAYDFNSSFENTFVADDEDVEKKNTLNGFWIYVNFMEFATRYQANSKTLLTQKDITRLLINLFIDFSSRFLKGNDIHIRTRHFEHEFRIQVIQHYYTVFDYLQKDEEAANAIANFLPVEPALAKAVRAGDALALAVFGGQGYPGFNEILQAYTIYGAIVRDYIAELSTVLKELAAKPEFERTYKQGLDILKWLRNPESLPEDAYLDSAPVSFPLIGIVQLVQYLILFRSFRKTPDWARRLFAGTTGHSQGLVTSVVIASSGTEEEYLENSKKAVSLLFLIGARSQQIFAITPLSPETLQEIADNGDENDMPTCMLSINGLPEATVRQTVNEINKFIEEPDRKVTISLINGLRMIVVTGAPESLQNLKMTLKKIQAGPNEDQSRIPFSKRKQVFTMKFLSVTIPAHNEILKDAAELVVDDAAKLNITFPTKNLAIPVYRTDNGVDMKEEAEVTDVVESVVNQICILPVDWVKATNVPGLTHVLDFGPGGASGIGSLIQKNKEGTGVQVILSGTIASTNPDLKCKMYAYTTEVEDLPYGINWAKEFAPKLIRNADGELLMDTRYTRLTGRPPLLVGGMTPTTANSQFVSAVINAGYNVEVGCGALYAPHVLDKCIKEIVEKIPDGEGILCNIVFLNQRLWAFQFPGVLDMRKNRGIRIEGITIAAGVPSLEYCKKMIPQLIDAGIPYIGFKPGNRDAILKVIQIARTFPQMPIVVEWTGGRSGGHHSCEDFYAPILETYAALRKQSNIVVVVGSGFGDDVETLPFITGDWSIELGYPPMPFDGLLVGSRVCVAKEALTSDGIKEVIVNTPGIEDQSQWEKSYDRPVGGVVTVESEYGEPIHKIATRGIMFWKELDKTIFSIHDPKKRLEKLLEKKDYIIERLNKDFQKVWFGQKNGKPCDIEEMTYEEVILRLIELLFVQKRKEWLDVSHLKTTADFIYRTEERFVKDGSKETFLSSMDDLKVEDPVALMKEFFDTRAPGARTELLATEDVQYFIGLTRNKDRKPPPFICVLDDEFHVWLKRDSLWQAEDLDAVVDQDPQRVAILQGPVAIRHSKIANQPVKEILDGIIKSHIKSIEARYYANRAVPNVEYLGGTPIPANVTEVPANVKVEKDGNTMIYTLPAKEEDLPDDKEWIEFISGPKYGWLRALLCTPTVARNKSITHNRFKRVFKPRTSQIVKIFHNNEGDITKIEIFGWNRSMELPALEAEIDSQRVITVGLREWGVPDVAGAEVMKLLFRYTPNQGSTPIHEVMEGRNRRIAEFYYNLWYGPEDSGDGWGDLTSIYKCKKRVTEEDVKFFSDVTRYTHPSNKVVPSMDFIIVTSWVSVFKTIFAKEFDADITRLVHMNNGYEVIDPRPLKIGELVDTRSIISAVTNLDSGKLIEVTGHVFREGKEFVKVTSSFLCRGKFDDYNMTFNIRDEPEYILEVKDDKILNALMTRKYISFTEPEKIQVGVKLVLKLKTEKRFATKNTYSSITTKGKIFINHSAVHGFQMEEVGQFNYDSTTDEKLEGKKETLGNPAIEFVKKYAKANDRKIYFENGGYNILPKGVTLLQRAPNTNEDYSLASGDVNPIHTNYYFANLADLDVPITHGMWTSAATRRYIETYAADNDAERVVSYKVNFIGMVSPKDELRTSLTHVGMHNGRKIIKVSVKDLRTNETVMEGEAEVKQKPTAYVFTGQGAQEVGMGQELYNKSAVAKAVWDRADAYLMKKYGYSILEIVRTNPKSLTVYFGGEEGEKIRENYINMTCEIIDSNGKVQTKRMFPEIDENTLYYEYKSPTGLLNATQFTQPAITLTEKAAFEDMLENGYICDDAVYAGHSLGEYAALSCVANTLSIESMAEIVFYRGLVMQSSVERDELNRSDYAMCAVNPVRVHPYFSYDLLVEVVKKINSEHGGLLEIVNYNVENYQYVVTGDLTSLEALKNLLTNLRAESKKFIALYKEDATQAMDLLNEKVCIYVKLAEERKAKEGFFNIERGAATIPLRGIDVPFHSSYLLWGVPTFRELLHQRVRREDVDVKCLVGRYIPNLMGEPFSVEKDYAIRLQKRTNSTYLEKIIEEWDDHLFEIPYIIMVELLAYQLASAVQWIKTQEFLFSSKNKGGADVERLIEFGPTPTLVGMAKRTLGMNFAKSDLALGKKRQLLSYAKNTTEIYYEFDDAEFEEEADVAPVEEAPKAAPAPTPAPAPVPVAAPAPVAAAPAASVADAPVTATEILRAILAQKLKKSIGEVPLNKSIKELSGGRSTIQNEVSGDLHTEFGGNSIPLKAEELALEELGKQISSTFNGQLGKYTTQMINRMLSGKMPAGFSASAVKTYLANTYGLGKGRTDGVLLVAITMEPSSRLGSEADAQGWLDNVVSAYSAASGVAISKGSAAPAAAIAAPVMPVAAMPVAVSAGPAAAVADAPISPNEIIRVMLAQKLKKSINEIPMSKSIKELSGGRSTVQNEVSGDLHTEFGGNSIPLKAEELAITELGGAIGANHNGKLGKYTSTMVNRMLSGKMPAGFSASKAREYLKSSYGLGEKRTDGVLLYSTTIEPTSRLGSEADAQAWLDKAVDLYSGANSLGLSKGGAGGAVAAAVPGVAAMGMVNSAEVTALKMKQDSLIRTQLENYAKYLGVDLREDQKKLVASAESTAKLQSDLDLWFDEHGEDYANGIKPMFTSKKARTYDSSWNWGYQDFWFMVYDILAGEKKDADALIASDVFRTMVNRANASLEQQIEFVHRKVVADQKDAEIKATLEKVTGALLEAIKASSGKPVFKFNGPFQAPHALVDEEGQMIYKEIPRKGINSAVDYVKEMEEGAMQTIGSTTKKVPFLFVRDQAANGVDNVDEAMSKVYLNELKKIAEDGISFAGKHVLITGCGRNSIGECVLKYLLAGGAKVVATTSSYR

SEQ ID NO: 9474 - protein, 3962 aa, Anaeromyces robustus
  FATTY ACID SYNTHASE SUBUNIT BETA
HVPEENWSAAEQIAYDFNSSFDKQFAADDEDVEKRNTLNGFWIYVHFMEFATRYQADNKTLLTQKDITQLLIHLFIDFSTRFLRGNDIHIRTRHFNHEDRIQVIQHFYTVFDYLQKDSEAAEAVADYLPVEPALAKAVRAGDALALAVFGGQGYPGFNEILQAYTIYGAIVRDYIDELSTVLKDLASKPEFERTYKQGLDILKWLRHPDSLPEDAYLDSAPVSFPLIGIVQLVQYLILFRTFRKTPDWARHLFAGTTGHSQGLVTSVVIASSGTEEEYLENSKKAVSLLFLIGARSQQKFAITPLSPETLQEIADNEDENDMPTCMLSINGLPEAVIRQKVNELNSFIEEDSRKVTISLINGLRMIVVTGAPESLQNLKMTLKKIQAGPNEDQSRIPFSKRKLIFTMKFLSVSIPAHNEILKEAADLIIEDAAKLNITFPTQDLAIPVYRTDNGVDMKEEVDVPDVVESVVKQICILPVDWVKATNVPGLTHVLDFGPGGASGIGSLIQKNKEGTGVQVILSGTIASTNPDLKCKMYAYTTELEDLPYAINWAKEFAPKLIRNADGELLMDTRYTRLTGRPPLLVGGMTPTTANPQFVSAVINAGYNVEIGCGALYAPHVLDQCIQDVIKRIPDGEGILCNIVFLNQRLWAFQFPGVLDMRKNRGIRIEGITIAAGVPSLDYCKKMIPQMIDAGIPYIGFKPGNRDAIMKVIQIARTFPEMPMVVEWTGGRSGGHHSCEDFYAPILETYAALRKQKNIVVVVGSGFGDDVETLPFITGDWSIELGYPPMPFDGLLVGSRVCVAKEALTSDGIKEVIVNTPGIEDQSQWEKSYDQPVGGVVTVESEYGEPIHKIATRGIMFWKELDKTIFSISDPKKRLAKLLEKKDYVIERLNKDFQKVWFGQKNGKPCDIEEMTYAEVILRLIELLFVQKRKEWLDVSHLKTTADFIYRTEERFVKDPNQPTFLESIDSLKVEDPVALMEEFFNTRAPGARTELLTTEDVQYLIGLTRNKDRKPPPFICVLDEEFHVWLKRDSLWQAEDLDAVVDQDPQRVAILQGPVAIRHSKIANQPVKDILDGIVKSHIKSIESRYYANRAVPEVDYLGGTPIPANVREVPAHVKVEKDEKAGCMIYTLPDQEDQLPEDKAWIEFMAGPKYGWLRALLCTPTIARNKSITHNRFKRVFKPRTGQIVKIYYAKDAEAKEDTKAKANEDVKVEVEDDKDKVITKIEIFGWNRSMELPALEAEMDDQRVITVGLREWGVPGVAGAEVMKLLFRYTPEQGSTPIHEVMEGRNKRIAEFYYNLWYGREDSGDGWGDLTTIYKCKKRVTEEDVKFFSDVTRYTHPSNKIVPSMDFIIVTSWVSVFKTIFAKEFDADITRLVHMNNGYEVIDPRPLQIGEIVDTRSIISAVTNLDSGKLIEVTGHVFREGKEFIKVTSSFLCRGKFDDYPMTFNIREEPEYILEVKDEKILNALMTRQYISFTEPEKIQIGVKLVFRLKTEKRFATKTTYSSITTKGKIYINNSAVHGFQMEEVGQFNYDSANDEKLNGMETTLGNPSIEFIKKYAKANDHKIYFENGGYNILPKGVHLLQRAPNTNEDYSLASGDVNPIHTNYYFANLADLDVPITHGMWTSAATRRYVETYAADNDAERVVSYRVNFIGMVSPKDELRTSLTHVGMHNGRKIIKVSVKDLRTNETVMEGEAEVKQKPTAYVFTGQGAQEVGMGQELYNKSAVAKSVWDRADAYLMKKYGYSILEIVRTNPKSLTVYFGGEEGEKIRENYMNMTCEIIDSNGKVQTKRMFPEIDENTLYYEYKSPNGLLNATQFTQPAITLTEKAAFEDMLENGYICDDAVYAGHSLGEYAALSCVANTLSIESMAEIVFYRGLVMQSSVERDALNRSDYAMCAVNPVRVHPYFSYDLLVEVVKKINSEHDGGLLEIVNYNVENYQYVVTGDITSLEALKNLLTNLRAEAKKFITLYKEDASQAMDLLNEKVVHYVKEAEERKAKEGWFNLERGAATIPLRGIDVPFHSSYLLWGVPTFRELLHQRVRREDVDVKCLVGRYIPNLMGEPFSVEKDYAIRLQKRTNSTYLEKIIEEWDQHLFEIPYIIMIELLAYQLASAVQWIKTQEFLFSSEKKGGVDIERLIEFGPTPTLVGMAKRTLAKNYSQSDLALGKKRQLLSYAKNTTEIYYEFDDMEEEEDDGEATMVEEVNAKEAPVIAPAVPVAAPVAPAPVAAAPAAPAASVSDAPVTATEILRAILAQKLKKSINEIPLNKSIKELSGGRSTIQNEVSGDLHTEFGGNSIPLKAEELALEELGKQISSTFNGNLGKYTTQMINRMLSGKMPAGFSASAVKSYLANSYGLGKGRTDGVLLVAITMEPSSRLGSEADAQGWLDSVVNAYSSASGVSLQKGGAAPAAAAAPVAAMPVAMPVAAAAAPAASVPDAPISPNEIIRVMLAQKLKKSINDVPLSKSIKELSGGRSTVQNEVSGDLHTEFGGNSIPLKAEELAINELGNAIGANHSGKLGKYTSTMVNRMLSGKMPAGFSASKAKDYLKSSYGLGDRRTDAVLLYSTTVEPSSRLGSEAEAQAWLDKAVDLYSGANGLGLAKGGAGGAGGAAVAVPGVAAMGMVNSAEVTALKMKQDSLIRDQLENYAKYLGIDLREDQKKLVATAESQAKLQSDLDLWFEEHGEDYANGIKPMFSSKKARTFDSSWNWGYQDFWFMVYDILTANGDKDKKDAETYIQSDKFHTMIYRANDSLRQQVDFVHRKVVADQKDPEIKAILEKVTGTLLEKIDQAKSKDGKPIFKFNGPFVAPHAIIDEDGQMIYKEVPRKGIQTASDYVKEMEEGALQTVGPISKKMPYLFIRDQMATNGQGLDSMDEAMSKIYLNELKKIAEEGISFAGKHVLITGCGRNSIGENVLKYLIAGGAKVVATTSSYRRQTLEHFRSVYEQVGTKGSTLVVVPFNQGSKKDVNDLIEFIYSKDSRVNGLGWDLDLVIPFAAISENGRDISDLDGKSELAHRIMMTNVIRILGAIRNQKMKVRSLVSCQVVLPLSPNHGTFGGDGLYGESKIGLENLLNRWRSETWSNYLSITGACIGWTRGTGLMNSNNLISEGIESEGHCRTFTTTEMAFNLIGLVSDVMVSLSRKNPIYADLNGGMQYMADLNVALRRIREKMMDESEKKKMVIDEDHAHMDVIGVGKMEEQNKKRMVEPRSNIRIEFPELKDRSQLKDMEYLRDLLDLDRVVVVTGYGEVGPFGNCRTRWEMEAEGKFSLEGCVELAWIMGFIQHVTYKQMPDGTLYSGWVDAKSGAPIKDIDIKATYEKDILAHTGIRLIEPELFNGYNPEKKKFLQEVMVDTDLPPFEASKEEAETFKRQHEDHVEVYEVGDGRYMVRILKGASIYVAKALQFDRLVSGQLPTGWDPARYGIPKDIIEQVDPITCYCIVSAVEALVSAGITDPYEFYEYVHVSEVGNACGSGVGAEIANRAIFKDRFLDKPLQSDILQETFVNTMSAWINLLLLSSSGPIRTPVGACASAVESVDIGIDTILSGKAKVVFVGGYDDFQEEGSYEFAQMKATSNSREEMAQGREPDEMSRPTASSRGGFMESQGVGTQVLMPASLALKMGVPIYGIIAHSATATDKEGRSVPAPGQGILTTAREVNKTKGRSPLLNPKYRARQLNARKRWIKSWVEDELGLMNEEVEDMRKEGEAKEVIDAFIEERTQFIDAEARKQEKEAFQVWGQDFYKNDPTISPLRGALAAFGLTVDDIGVASFHGTGTKANDKNESDVFNKQFEHLGRTKGNACPVVCQKYLTGHGKGAAAAWMLNGVIQIIQTGIIPGNRNADNIDPLLEKFDHLWFNNKTFKTPGVKAGLLKSFGFGQVGGEILVIHPDCLFATLDDATYKTYKAKRDIREHKAFRYLHDTLSGQDFVQVKNEPPYTPEQESEVYLNPLARASYNKKTKKWDYE

SEQ ID NO: 9475 - protein, 3766 aa, Anaeromyces robustus
  FATTY ACID SYNTHASE SUBUNIT BETA
NIPFDQWSVAEEVREQYHMRQTPSPETADVNIPQEQREMQLFIDFLEFSSAYAYGQGQGQGEIITQYSEYESVAAGTEDSQGLLKFITCVFSEYCNRYCKTNNIHVTTASYPKKLRLHAIQTYYKILDLLVTSNTNNNTIEAAFIEKESKRCKKSALFQAVDKHKASIFAVFGGQGSEDYFDEIKEIYNTYEVLIKSYLERMACVLEELASKPELLQFFPKGLHVLKWLEEPETLPDTKYMINAPISLPLVGLCQLLHYCVLYKSLGKTPDEMRSSFVGTTGHSQGIISSVVVSSSGTEEEFIENSIKALSLLFWIGVRSQMAYPETTINPKILQDSLNNDEGEPTPMISFANLPVNKIVEHIKATNQHLPEDRKIHISLYNGPRSIVCSGHPQSLYGLNVTLRKLKAQANIDQNRIPYSQRKIRFNSRFLPISVPFHCDYLKDVNDTIMKDVERDHLILGKGELAIPIYSTETGEDLRGHPQFTYELIKQICTLPVHWEKATSITNATHILEFGPSGAGVGLLTHRNKIGTGVQIILANSLETTEKEVLSKDSLFNRDPSSVTYSMNWEKLFAPKLVKSANNGKIYVETRFSRLLGKPPLMVGGMTPTTANENLVSACINAGYHIELAGGGQHSTQMIRNRIKKIMSNVPCGEGITMNIMFLNAFQWGFQYPLVQEMRKEGIPLEGLCIAAGVPSLDVANEILSNLKACGIKHVAFKPGSVSAIKQVIAIARQNPDMPIIMQWTGGRAGGHHSFEDFHQPIIDTYAIIRRQPNIIIVVGSGFGNAEGTLPYLTGEWARKFGYPPMPFDGILFGSRILVAAEAGTSEEVKKLLVESEGIENEKEWENTYKGPTGGVVTVKSELGEPIHKLATRGVLLWKELDETIFSLPPEKQLPALLARKEYIVNRLNKDYQKVWFPKKYDAAEEDSSKVVDLKDMTYYEVLRRMLELMYPNGQWIDVSLRMIYGDFFHRTEERFYKASEGKEFISFLQSYEQLEEDPVGLLEKFMDERVPEARVQLLNSDDLMYFLNICSRRDIKPPPFIPNMDKSFKYWFKKDSLWQSEHLEAVVGQDPGRVCVLQGPVAVRHSTKANEPISSILETINQEHIKELKSRYYQNSDTVIPVVDYFGGAEIRDVRRKIRGVSIKGIKNDNIFSTMFEITAENNEDLPDEKDWLDLLAGQHYTWLHALLASKVYVKDDDGYYQDNCVRRILRPKPQQLVEIRTINDKIESLTLFTKQGGNEIVKISIDDKKVITVLMSEYSLNDKVVKLPLLFQYKPEQGYAPIHEIMEGRNERIKRFYYDLWFGLDNGKYSFEEDFNHDPREPFISVSEPITRQQITDFVNIIGNQAESYTDRGQKVLFAPMDFAIVVGWQSIIRAIFPKFIDADLLKLVHLSNGFRMIENETGLKEGDVVKTESRIISVVNDETGKIVEVKGVLKRDEKPFMEVISTFFYRGIFTDYDATFKNVEEKSYHVTLKSKKDVRILESLDWFKMATDDEELALVEGDQLLFELNSEYAYKTHDVYSKVKTFGTVKKLLSTKVYVDIAKVDYHYEKPDGSCGNPVIDFLERNGKVQDTPVYFENGGYSIMPKGKGLSSVVNTHSSNLGYSRVSGDVNPIHTNPYFAQLADLPGNITHGMWTSASTRKFVETFAAENHPHRVTSYEVKFLDMVLPGDRLETKLFHTGMANGKKIIQCKTINQNGQVILEGTAEVEQPITAYVFTGQGAQEVGMGMDLYEKSAVAREIWDRADAHLMETYGFSIIDIVKNNPTEITIYFGNVKGQQIRKNYQQMTYEHVNADGVIESLSLFPEIDDDSTSYTFHHIGGLLSATQFTQPSLVLMEKAAFEEMRSRGFIQQNSAFAGHSLGEYAALTAIGDVLSIETLVDVVFYRGMTMQRAVQRDSKGRSDYAMCAVNPTRVSSTFNENALQYLVANIQKVTEGLIEIVNYNVDNWQYVVSGDLISLQVLTNVLNYLKAEKIDLTVLLNTLSVEEVQKQVIEIVTNAFEKAKEQKRKRGFINLERGAASIPLRGIDVPFHSSFLLRGVAPFRQYLMSKFDPNLIDVNRLIGNYIPNLTAEPFSLEKKFIENIYAKTNSSRIKNVLKGWTDDKYASPRLQQKLGYILLIELLAYQFASAVRWIETQDRLFVDIGVERLIEIGPGPTLSGMAQKTLKFKYEYYDDATSYRREILSYSRNYKEIFYDLEDEDDSDKLESTPTSTPKSAPAPTPAPVAAPVPVAAPVPAPMPAVAAASVSDEDIQVKDLLHILIAQKLKKKVQEVPLTATIKDLVGGKSTLQNEVLGDLQKEFGSNNVPDKSEEIPLGELAGQIGSGAVPMGKYSQTLVNKLVSSKMAAGFTKSKIQDHLSQKYGLGPKRTEALLLFGLTDEPSARFGSEDEAKAWLDKVAPMYFNYVGVSAGAAPAGGAAPVGIPMAAVNAGALAEASKKYDQLIREQLDIFLNYLDIDPREGFNRYEEELNNAAKLRAELDLWINEHGDEYAQGIKPIFDPLKVRKYDSYWNWVHQESLILYYDILFGRLAVVDRKVTSQCIHVMNRADQHLLDLYSYHINTTDPKKGPTYELAKEFAQILMENCSEAIKENPVYKDVDIPTMPQTIVTEQGEIKYSEVPRPGINKMESYIKLMSAGSRITRIPTKHSNRSIRFTGGNNKTRVKSKKVPFLFLKDPKTGEYDEKATKVYYKALYDMANDGITFKNKYVLITGCGRNSIGSQVIKGLLNGGAKIIATTSRFSKATMQYYRQLYEDHGSKGSCLIVVPFNAASVEDVNHLIEYIYSKDPKNGLGWDLDYVIPFAAISENGRTLENIDSRSELAHRIMLTNLLRMLGKIVSEKEAHKYDTRPAQCILPMSPNHGTFGGDGLYSESKIALETLFNRWHSEGWGGYLTIAGAVIGWTRGTGLMNSNNLVAEGIEMFGVHTFSTHEMAFNLIGLMHSEICKMCLKNPVFADLNGGLQFIDNLNHNITMIRTILNETSEIRRSIKAEKDLEKSITLGKLLAKEKKLMLKPRANLKFAFPKMKPYEELKKLDYLRGMIDLDRTIVVTGYGEVGPYGNSRTRWEMEAYGKFSLEGCIEMAWIMGMIKYAKNKKTKDNKMYSGWVDTQTGEPVQDYEVKAKYEKRILEHTGIRFIEPDLFGGYDPNNKNFYQEVAIDHDLPGFECSKEEAEQFKKKHGDHIDIFENTESGQWIVKVKKGSTIFIPKALQFDRTVAAQIPTGWKPETYGVPKNIIDQVDPITLYVIVATVEALVSSGITDPYEFYEYVHVSEVGNCSGGGVGGMVSTHKEYFDRAFEKPVQSDILQESFINTMPAWINLLLLSSSGPIKTPVGACATAVESVDIGVETILSGKAKIVIVGGYDDFQEEGSYEFAQMKATSNSLDELAHGRDPSEMSRPATTTRSGFMEAQGAGHEILMKASLAIKMGVPIYGIIAHTSTATDKEGRSVPAPGQGILTTARESHASYNPLLDFKYRARQMNFRRKQIKLWVENELDLLKEEVEAKDQKDDEQSIKYIKERTAYINKEAKRQEKEALRTYGNEFYKNDPTIAPLRGALAVFGLTIDDIDALSFHGTGTKANDTNESEVINKQFKHLGRSKGNVCPAIMQKYLTGHPKGAAASWMLNGMLQVIETGIIPGNRNADNIEEKLRKYEYICYPSRSIHTDGVKAGLLKSFGFGQVGGEVLVIAPEYVLSSLTKEEYDEYCKKRDVRQQAMYRYLHDSMTENADFVQVKDHPPYDESNESSVYLDPLARASYDKKEGSWKFS

SEQ ID NO: 9476 - protein, 3755 aa, Piromyces finnis
  FATTY ACID SYNTHASE SUBUNIT BETA
NIPFDQWSVAEEVREQYHMRQNPLQATADTSIPQEQREIELFIDFLEFSSAYAYGQGQVQGEIVTQYSEYESVAAGAEDSQGLLKFITCVFSEFCNRYCKVNNIHVTTASYPKKLRLHAIQTYYKILDLLVSANTNNNTIESAFIEKESNRSKKSAIFQAVAKHKASVFAVFGGQGSEDYFDEINEIYSTYEAMVKSYLERMACILEELASKPELLQFFPKGLHVLKWLEEPETLPDKKYLVNAPISLPLVGLCQLLHYTVLYKSLGKTPDEMRRSFIGTTGHSQGIISSVVVSSSGTEEEFIENSEKALSLLFWIGVRSQMAYPETTINPKILQDSLNNDEGEPTPMISFANLPVSKIVEHIKATNQHLPEDRKIQISLYNGPRSIVCSGHPQSLYGLNVTLRKLKAQSNIDQNRIPFSQRKIRFSSRFLQISVPFHCDYLKDVNDIIMKDVERDHLILGKGELAIPIYSTENGEDLRGHPQFTYELIKQICTLPVHWEKATSVTNATHILEFGPVGAGVGLLTHRNKIGTGVQVILANSLETSEKEVLCKDALFNRDPSSVKYSMNWEKLFAPKLVKSSCNGKIYVETRFSRLIGKPPLMVGGMTPTTANENLVGACINAGYHIELAGGGQHSTQMIRDRIKKIMSKVPSGEGITMNIMFLNAFQWGFQYPLVQEMRKEGIPLEGLCIAAGVPSLDVANEILANLKACGIKHVAFKPGSVSAIQQVIAIAKQNPDMPIIMQWTGGRAGGHHSFEDFHQPIIDTYAAIRRQPNIIIVVGSGFGDAEGTLPYLTGDWARKFGYPPMPFDGILFGSRILVAAEAGTSEEVKKLLVASEGIENEKEWENTYKGSTGGIVTVKSELGEPIHKVATRGVLLWKELDETIFNLPAEKQLPALLARKEYIVKRLNKDYQKVWFPKKYDVEDPEKVVDLKDMTYYEVLRRMLELMYPNGQWIDVSLRMIYGDFFHRTEERFYKASEGKNFVSFLQSYEQLEEDPVGLLEKFMDERVPEARAQLLNSDDLMYFLNICGRRDIKPPPYIPIMDKSFKYWFKKDSLWQSEHLDAVVGQDPGRVCILQGPVAVRHSTKANEPIGSILESINQEHIKELKMRYYQNSDTVIPIVDYFGGAEIRDVRRKIRNVTIKGIKNDNIYSTIFEITAENNEDLPDENDWFDLLGGQYYTWLHALLTSKIFVKDDDGYYQDNCVRRILRPKPQHMVEIRTIDDKINSLTMFTNQGGKEIVKITIDDKNVITVLMSEYSLNTKLVQLPLLFQYKPEQGYAPIHEIMEGRNERIKRFYYDLWFGLENGKYTFEEDYNHDPKEPFISVSEPITRQQITDFVNIIGNQAESYTDRGQKVLYAPMDFAIVVGWQSIIRAIFPKFINADLLKLVHLSNGFRMIDNATGLKEGDIVKTESRIISVINDENGKIVEVKGVLKRDEKPFMEVISKFFYRGVFTDYESTFKNVEEKPYHVTLKTKKDVRILESLDWFKMTTEEEKLEEGDQLLFELNSEYTYKTHDIYSKVKTVGTVKKLLSTKVYVDVAKVDYSYEEPDGSCGNPVVNFMERNGMVQDTPDYFENGGYSIMPKGKGISSVVNTHSSNLGYSRVSGDVNPIHTNPYFAQLADLPGNITHGMWTSASTRKFVETFAAENHPQRVTSYEVNFLDMVFPGDRLETKLYHTGMANGKKIIKCKTINQNGQVILEGTAEVEQPITAYVFTGQGAQEVGMGMDLYEKSPVAREIWDRADKHLMENYGFSIIDIVKNNPTEITIYFGNVKGQQIRKNYQQMTYEHVNNEGVVESLSLFPEIDDDSVSYTFRHIGGLLSATQFTQPSLVLMEKAAFEEMRSRGYIQQNSAFAGHSLGEYAALTAIGDVLSIETLVDVVFYRGMTMQRAVQRDSKGRSDYAMCAVNPVRVGSTFNESALQYLVASIKKVTNGLIEIVNYNVDNWQYVVSGDLISLQVLTLVLNYLKFEKIDLTVLLKTLSEEELQKQVNEIINNAYVKAKDQKKKHGFIKLERGAASIPLRGIDVPFHSSFLLRGVAPFRQYLMSKFDPKLIDVNRLIGNYIPNLTAEPFSLEKKFIENIYAKTNSTRIKNVLKGWTDDKYASPLLQQKLGYILLIELLAYQFASAVRWIETQDRLFVDIGVERLIEIGPGPTLSGMAQKTLKFKYEYYDDATSYRREILSYSKNYKEIFYDFEDEDEPEKVEEAPKSAPAAAPAPAPAPVAAPVPVAAPAAPAAAVADEDIQVKHLIHILIAQKLKKSVQEVPMSATIKDLVGGKSTLQNEVLGDLQKEFGSSAVPDKSEELPLSELAGQIASGPIPMGKYSQTLVNKLISSKMAAGFTKGKINDYLSQKYGLGPKRTDALLLFGLTDEPASRFGSEDEAKAWLDKIAPNYFGFVGVSAGAAPAAGAAVSVPMAAVSSGALAEVSSKYEQLIREQLDIFMNYLDIDPRKGYNLYEEELSNAAKLRAELDVWINEHGDDYAQGIKPIFDPLKVRKYDSYWNWVYQESLILYYDILYGRLAAVDRKVTSQCIHVMNRADQHLLDLYDYKIDATDPKKGSTYELAKDFAQILRENCSEAISENPVYKDVEIPKKPQTIVTEQGEIKYSEVPRPGVSKMESYIKLMQGGSRITRIPTKHSNRSIRFAGGNNKTRVKSKKVPFLFLKDTKTGEYDEKATKVYYKSLYNMANDGITFKNKYVLVTGCGRNSIGSQIIKGLLNGGAKIIATTSRFSKVTMQYYRQLYEDHGSKGSCLIVVPFNAASTEDVNRLIEYIYSKDPKNGLGWDLDYVIPFAAISENGRTLENIDSRSELAHRIMLTNLLRMLGKIVSEKEAHKYDTRPAQCILPMSPNHGTFGGDGLYSESKIALETLFNRWHSEGWGGYLTIVGAVIGWTRGTGLMNSNNLVAEGIEMFGVHTFSTHEMAFNLIGLMHNDICKMCLKGPVFADLNGGLQFIDDLNSNITMIRTLLNETSEIRRSIKAEKDLEKSITLGKLMAKEKKLMLKPRANLKFTFPKVKPFDELKKLDYLSGMIDLDRTVVVTGYGEVGPYGNSRTRWEMEAYGKFSLEGCIEMAWIMGMIKYAKNKKTKDGKLYSGWVDSETGEPVQDFEVKAKYEERILKHTGIRFIEPELFNGYDPNNKVFYQEVAIDHDLPGFECSKEEAEQFKKKHGDRVDIYENAESGQWTVKIKKGSSIYIPKALQFDRTVAAQIPTGWKPETYGVPKSIIDQVDPITLYVIVATVEALISSGITDPYEFYEYVHVSEVGNCSGGGVGGMTSNHKQYFDRVFEKPVQSDILQECFINTMPAWINLLLLSSSGPIKTPVGACATAVESVEIGLETILSGKAKIVIVGGYDDFQEEGSYEFAQMKATSNSLEELAHGRDPSEMSRPATTTRAGFMEAQGAGHEILMTASLAIKMGVPIYGIIAHTSTATDKEGRSVPAPGQGILTTAREVGNGKSPLLNPKYRARQLNARKRWIKSWVEEELELMNEEVKDMEGESQEVIDAFIEERTAFIDAEARKQEKEAFQVWGQEFYKNDPTISPLRGALAVFGLTIDDIQALSFHGTSTKANDSNESEVFNKQFKHLGRTKGNACPVITQKYLTGHPKGAAASWMLNGMLQVIETGIIPGNRNADNIDEKLRKFEYLFYPSRSIHTDGVKAGLLKSFGFGQVGGEVLVISPDYVLGTLTKEEYDVYLKKREVRQQAMYRYLHDSMTENADFVQVKDHPPYDDASESSVYLDPLARASYDKKEGTWKFN

SEQ ID NO: 9477 - protein, 3754 aa, Piromyces finnis
  FATTY ACID SYNTHASE SUBUNIT BETA
NIPFDQWSVAEEVREQYHMRQNPLQATADTSIPQEQREIELFIDFLEFSSAYAYGQGQVQGEIVTQYSEYESVAAGAEDSQGLLKFITCVFSEFCNRYCKVNNIHVTTASYPKKLRLHAIQTYYKILDLLVSANTNNNTIESAFIEKESNRSKKSAIFQAVAKHKASVFAVFGGQGSEDYFDEINEIYSTYEAMVKSYLERMACILEELASKPELLQFFPKGLHVLKWLEEPETLPDKKYLVNAPISLPLVGLCQLLHYTVLYKSLGKTPDEMRRSFIGTTGHSQGIISSVVVSSSGTEEEFIENSEKALSLLFWIGVRSQMAYPETTINPKILQDSLNNDEGEPTPMISFANLPVSKIVEHIKATNQHLPEDRKIQISLYNGPRSIVCSGHPQSLYGLNVTLRKLKAQSNIDQNRIPFSQRKIRFSSRFLQISVPFHCDYLKDVNDIIMKDVERDHLILGKGELAIPIYSTENGEDLRGHPQFTYELIKQICTLPVHWEKATSVTNATHILEFGPVGAGVGLLTHRNKIGTGVQVILANSLETSEKEVLCKDALFNRDPSSVKYSMNWEKLFAPKLVKSSCNGKIYVETRFSRLIGKPPLMVGGMTPTTANENLVGACINAGYHIELAGGGQHSTQMIRDRIKKIMSKVPSGEGITMNIMFLNAFQWGFQYPLVQEMRKEGIPLEGLCIAAGVPSLDVANEILANLKACGIKHVAFKPGSVSAIQQVIAIAKQNPDMPIIMQWTGGRAGGHHSFEDFHQPIIDTYAAIRRQPNIIIVVGSGFGDAEGTLPYLTGDWARKFGYPPMPFDGILFGSRILVAAEAGTSEEVKKLLVASEGIENEKEWENTYKGSTGGIVTVKSELGEPIHKVATRGVLLWKELDETIFNLPAEKQLPALLARKEYIVKRLNKDYQKVWFPKKYDVEDPEKVVDLKDMTYYEVLRRMLELMYPNGQWIDVSLRMIYGDFFHRTEERFYKASEGKNFVSFLQSYEQLEEDPVGLLEKFMDERVPEARAQLLNSDDLMYFLNICGRRDIKPPPYIPIMDKSFKYWFKKDSLWQSEHLDAVVGQDPGRVCILQGPVAVRHSTKANEPIGSILESINQEHIKELKMRYYQNSDTVIPIVDYFGGAEIRDVRRKIRNVTIKGIKNDNIYSTIFEITAENNEDLPDENDWFDLLGGQYYTWLHALLTSKIFVKDDDGYYQDNCVRRILRPKPQHMVEIRTIDDKINSLTMFTNQGGKEIVKITIDDKNVITVLMSEYSLNTKLVQLPLLFQYKPEQGYAPIHEIMEGRNERIKRFYYDLWFGLENGKYTFEEDYNHDPKEPFISVSEPITRQQITDFVNIIGNQAESYTDRGQKVLYAPMDFAIVVGWQSIIRAIFPKFINADLLKLVHLSNGFRMIDNATGLKEGDIVKTESRIISVINDENGKIVEVKGVLKRDEKPFMEVISKFFYRGVFTDYESTFKNVEEKPYHVTLKTKKDVRILESLDWFKMTTEEEKLEEGDQLLFELNSEYTYKTHDIYSKVKTVGTVKKLLSTKVYVDVAKVDYSYEEPDGSCGNPVVNFMERNGMVQDTPDYFENGGYSIMPKGKGISSVVNTHSSNLGYSRVSGDVNPIHTNPYFAQLADLPGNITHGMWTSASTRKFVETFAAENHPQRVTSYEVNFLDMVFPGDRLETKLYHTGMANGKKIIKCKTINQNGQVILEGTAEVEQPITAYVFTGQGAQEVGMGMDLYEKSPVAREIWDRADKHLMENYGFSIIDIVKNNPTEITIYFGNVKGQQIRKNYQQMTYEHVNNEGVVESLSLFPEIDDDSVSYTFRHIGGLLSATQFTQPSLVLMEKAAFEEMRSRGYIQQNSAFAGHSLGEYAALTAIGDVLSIETLVDVVFYRGMTMQRAVQRDSKGRSDYAMCAVNPVRVGSTFNESALQYLVASIKKVTNGLIEIVNYNVDNWQYVVSGDLISLQVLTLVLNYLKFEKIDLTVLLKTLSEEELQKQVNEIINNAYVKAKDQKKKHGFIKLERGAASIPLRGIDVPFHSSFLLRGVAPFRQYLMSKFDPKLIDVNRLIGNYIPNLTAEPFSLEKKFIENIYAKTNSTRIKNVLKGWTDDKYASPLLQQKLGYILLIELLAYQFASAVRWIETQDRLFVDIGVERLIEIGPGPTLSGMAQKTLKFKYEYYDDATSYRREILSYSKNYKEIFYDFEDEDEPEKVEEAPKSAPAAAPAPAPAPVAAPVPVAAPAAPAAAVADEDIQVKHLIHILIAQKLKKSVQEVPMSATIKDLVGGKSTLQNEVLGDLQKEFGSSAVPDKSEELPLSELAGQIASGPIPMGKYSQTLVNKLISSKMAAGFTKGKINDYLSQKYGLGPKRTDALLLFGLTDEPASRFGSEDEAKAWLDKIAPNYFGFVGVSAGAAPAAGAAVSVPMAAVSSGALAEVSSKYEQLIREQLDIFMNYLDIDPRKGYNLYEEELSNAAKLRAELDVWINEHGDDYAQGIKPIFDPLKVRKYDSYWNWVYQESLILYYDILYGRLAAVDRKVTSQCIHVMNRADQHLLDLYDYKIDATDPKKGSTYELAKDFAQILRENCSEAISENPVYKDVEIPKKPQTIVTEQGEIKYSEVPRPGVSKMESYIKLMQGGSRITRIPTKHSNRSIRFAGGNNKTRVKSKKVPFLFLKDTKTGEYDEKATKVYYKSLYNMANDGITFKNKYVLVTGCGRNSIGSQIIKGLLNGGAKIIATTSRFSKVTMQYYRQLYEDHGSKGSCLIVVPFNAASTEDVNRLIEYIYSKDPKNGLGWDLDYVIPFAAISENGRTLENIDSRSELAHRIMLTNLLRMLGKIVSEKEAHKYDTRPAQCILPMSPNHGTFGGDGLYSESKIALETLFNRWHSEGWGGYLTIVGAVIGWTRGTGLMNSNNLVAEGIEMFGVHTFSTHEMAFNLIGLMHNDICKMCLKGPVFADLNGGLQFIDDLNSNITMIRTLLNETSEIRRSIKAEKDLEKSITLGKLMAKEKKLMLKPRANLKFTFPKVKPFDELKKLDYLSGMIDLDRTVVVTGYGEVGPYGNSRTRWEMEAYGKFSLEGCIEMAWIMGMIKYAKNKKTKDGKLYSGWVDSETGEPVQDFEVKAKYEERILKHTGIRFIEPELFNGYDPNNKVFYQEVAIDHDLPGFECSKEEAEQFKKKHGDRVDIYENAESGQWTVKIKKGSSIYIPKALQFDRTVAAQIPTGWKPETYGVPKSIIDQVDPITLYVIVATVEALISSGITDPYEFYEYVHVSEVGNCSGGGVGGMTSNHKQYFDRVFEKPVQSDILQECFINTMPAWINLLLLSSSGPIKTPVGACATAVESVEIGLETILSGKAKIVIVGGYDDFQEEGSYEFAQMKATSNSLEELAHGRDPSEMSRPATTTRAGFMEAQGAGHEILMTASLAIKMGVPIYGIIAHTSTATDKEGRSVPAPGQGILTTARESHASYNPLLDFKYRARQMKFRRKQIKLWIENELELLQEEMDTRENKDDEQFTKYVKERTAYINKEAKRLEKEALRTYGNEFYKNDPTISPLRGALAAFGLTVDDIGVASFHGTGTKANDKNESDVFNKQFEHLGRTKGNACPVVCQKYLTGHGKGAAAAWMLNGVIQILQTGIVPGNRNADNIDPLLEKYEHLWFNNKTFKTPGVKAGLLKSFGFGQVGGEILVVHPDCLFATLDENTYNAYKAKRDIREHKAFRKLHDTLTGEDFVQVKDEPPYTPEQESAVYLNPLARASYNKKTKKWDYE

SEQ ID NO: 9478 - protein, 3755 aa, Piromyces finnis
  FATTY ACID SYNTHASE SUBUNIT BETA
NIPFDQWSVAEEVREQYHMRQNPLQATADTSIPQEQREIELFIDFLEFSSAYAYGQGQVQGEIVTQYSEYESVAAGAEDSQGLLKFITCVFSEFCNRYCKVNNIHVTTASYPKKLRLHAIQTYYKILDLLVSANTNNNTIESAFIEKESNRSKKSAIFQAVAKHKASVFAVFGGQGSEDYFDEINEIYSTYEAMVKSYLERMACILEELASKPELLQFFPKGLHVLKWLEEPETLPDKKYLVNAPISLPLVGLCQLLHYTVLYKSLGKTPDEMRRSFIGTTGHSQGIISSVVVSSSGTEEEFIENSEKALSLLFWIGVRSQMAYPETTINPKILQDSLNNDEGEPTPMISFANLPVSKIVEHIKATNQHLPEDRKIQISLYNGPRSIVCSGHPQSLYGLNVTLRKLKAQSNIDQNRIPFSQRKIRFSSRFLQISVPFHCDYLKDVNDIIMKDVERDHLILGKGELAIPIYSTENGEDLRGHPQFTYELIKQICTLPVHWEKATSVTNATHILEFGPVGAGVGLLTHRNKIGTGVQVILANSLETSEKEVLCKDALFNRDPSSVKYSMNWEKLFAPKLVKSSCNGKIYVETRFSRLIGKPPLMVGGMTPTTANENLVGACINAGYHIELAGGGQHSTQMIRDRIKKIMSKVPSGEGITMNIMFLNAFQWGFQYPLVQEMRKEGIPLEGLCIAAGVPSLDVANEILANLKACGIKHVAFKPGSVSAIQQVIAIAKQNPDMPIIMQWTGGRAGGHHSFEDFHQPIIDTYAAIRRQPNIIIVVGSGFGDAEGTLPYLTGDWARKFGYPPMPFDGILFGSRILVAAEAGTSEEVKKLLVASEGIENEKEWENTYKGSTGGIVTVKSELGEPIHKVATRGVLLWKELDETIFNLPAEKQLPALLARKEYIVKRLNKDYQKVWFPKKYDVEDPEKVVDLKDMTYYEVLRRMLELMYPNGQWIDVSLRMIYGDFFHRTEERFYKASEGKNFVSFLQSYEQLEEDPVGLLEKFMDERVPEARAQLLNSDDLMYFLNICGRRDIKPPPYIPIMDKSFKYWFKKDSLWQSEHLDAVVGQDPGRVCILQGPVAVRHSTKANEPIGSILESINQEHIKELKMRYYQNSDTVIPIVDYFGGAEIRDVRRKIRNVTIKGIKNDNIYSTIFEITAENNEDLPDENDWFDLLGGQYYTWLHALLTSKIFVKDDDGYYQDNCVRRILRPKPQHMVEIRTIDDKINSLTMFTNQGGKEIVKITIDDKNVITVLMSEYSLNTKLVQLPLLFQYKPEQGYAPIHEIMEGRNERIKRFYYDLWFGLENGKYTFEEDYNHDPKEPFISVSEPITRQQITDFVNIIGNQAESYTDRGQKVLYAPMDFAIVVGWQSIIRAIFPKFINADLLKLVHLSNGFRMIDNATGLKEGDIVKTESRIISVINDENGKIVEVKGVLKRDEKPFMEVISKFFYRGVFTDYESTFKNVEEKPYHVTLKTKKDVRILESLDWFKMTTEEEKLEEGDQLLFELNSEYTYKTHDIYSKVKTVGTVKKLLSTKVYVDVAKVDYSYEEPDGSCGNPVVNFMERNGMVQDTPDYFENGGYSIMPKGKGISSVVNTHSSNLGYSRVSGDVNPIHTNPYFAQLADLPGNITHGMWTSASTRKFVETFAAENHPQRVTSYEVNFLDMVFPGDRLETKLYHTGMANGKKIIKCKTINQNGQVILEGTAEVEQPITAYVFTGQGAQEVGMGMDLYEKSPVAREIWDRADKHLMENYGFSIIDIVKNNPTEITIYFGNVKGQQIRKNYQQMTYEHVNNEGVVESLSLFPEIDDDSVSYTFRHIGGLLSATQFTQPSLVLMEKAAFEEMRSRGYIQQNSAFAGHSLGEYAALTAIGDVLSIETLVDVVFYRGMTMQRAVQRDSKGRSDYAMCAVNPVRVGSTFNESALQYLVASIKKVTNGLIEIVNYNVDNWQYVVSGDLISLQVLTLVLNYLKFEKIDLTVLLKTLSEEELQKQVNEIINNAYVKAKDQKKKHGFIKLERGAASIPLRGIDVPFHSSFLLRGVAPFRQYLMSKFDPKLIDVNRLIGNYIPNLTAEPFSLEKKFIENIYAKTNSTRIKNVLKGWTDDKYASPLLQQKLGYILLIELLAYQFASAVRWIETQDRLFVDIGVERLIEIGPGPTLSGMAQKTLKFKYEYYDDATSYRREILSYSKNYKEIFYDFEDEDEPEKVEEAPKSAPAAAPAPAPAPVAAPVPVAAPAAPAAAVADEDIQVKHLIHILIAQKLKKSVQEVPMSATIKDLVGGKSTLQNEVLGDLQKEFGSSAVPDKSEELPLSELAGQIASGPIPMGKYSQTLVNKLISSKMAAGFTKGKINDYLSQKYGLGPKRTDALLLFGLTDEPASRFGSEDEAKAWLDKIAPNYFGFVGVSAGAAPAAGAAVSVPMAAVSSGALAEVSSKYEQLIREQLDIFMNYLDIDPRKGYNLYEEELSNAAKLRAELDVWINEHGDDYAQGIKPIFDPLKVRKYDSYWNWVYQESLILYYDILYGRLAAVDRKVTSQCIHVMNRADQHLLDLYDYKIDATDPKKGSTYELAKDFAQILRENCSEAISENPVYKDVEIPKKPQTIVTEQGEIKYSEVPRPGVSKMESYIKLMQGGSRITRIPTKHSNRSIRFAGGNNKTRVKSKKVPFLFLKDTKTGEYDEKATKVYYKSLYNMANDGITFKNKYVLVTGCGRNSIGSQIIKGLLNGGAKIIATTSRFSKVTMQYYRQLYEDHGSKGSCLIVVPFNAASTEDVNRLIEYIYSKDPKNGLGWDLDYVIPFAAISENGRTLENIDSRSELAHRIMLTNLLRMLGKIVSEKEAHKYDTRPAQCILPMSPNHGTFGGDGLYSESKIALETLFNRWHSEGWGGYLTIVGAVIGWTRGTGLMNSNNLVAEGIEMFGVHTFSTHEMAFNLIGLMHNDICKMCLKGPVFADLNGGLQFIDDLNSNITMIRTLLNETSEIRRSIKAEKDLEKSITLGKLMAKEKKLMLKPRANLKFTFPKVKPFDELKKLDYLSGMIDLDRTVVVTGYGEVGPYGNSRTRWEMEAYGKFSLEGCIEMAWIMGMIKYAKNKKTKDGKLYSGWVDSETGEPVQDFEVKAKYEERILKHTGIRFIEPELFNGYDPNNKVFYQEVAIDHDLPGFECSKEEAEQFKKKHGDRVDIYENAESGQWTVKIKKGSSIYIPKALQFDRTVAAQIPTGWKPETYGVPKSIIDQVDPITLYVIVATVEALISSGITDPYEFYEYVHVSEVGNCSGGGVGGMTSNHKQYFDRVFEKPVQSDILQECFINTMPAWINLLLLSSSGPIKTPVGACATAVESVEIGLETILSGKAKIVIVGGYDDFQEEGSYEFAQMKATSNSLEELAHGRDPSEMSRPATTTRAGFMEAQGAGHEILMTASLAIKMGVPIYGIIAHTSTATDKEGRSVPAPGQGILTTARESHASYNPLLDFKYRARQMKFRRKQIKLWIENELELLQEEMDTRENKDDEQFTKYVKERTAYINKEAKRLEKEALRTYGNEFYKNDPTISPLRGALAVFGLTIDDIQALSFHGTSTKANDSNESEVFNKQFKHLGRTKGNACPVITQKYLTGHPKGAAASWMLNGMLQVIETGIIPGNRNADNIDEKLRKFEYLFYPSRSIHTDGVKAGLLKSFGFGQVGGEVLVISPDYVLGTLTKEEYDVYLKKREVRQQAMYRYLHDSMTENADFVQVKDHPPYDDASESSVYLDPLARASYDKKEGTWKFN

SEQ ID NO: 9479 - protein, 3754 aa, Piromyces finnis
  FATTY ACID SYNTHASE SUBUNIT BETA
NIPFDQWSVAEEVREQYHMRQNPLQATADTSIPQEQREIELFIDFLEFSSAYAYGQGQVQGEIVTQYSEYESVAAGAEDSQGLLKFITCVFSEFCNRYCKVNNIHVTTASYPKKLRLHAIQTYYKILDLLVSANTNNNTIESAFIEKESNRSKKSAIFQAVAKHKASVFAVFGGQGSEDYFDEINEIYSTYEAMVKSYLERMACILEELASKPELLQFFPKGLHVLKWLEEPETLPDKKYLVNAPISLPLVGLCQLLHYTVLYKSLGKTPDEMRRSFIGTTGHSQGIISSVVVSSSGTEEEFIENSEKALSLLFWIGVRSQMAYPETTINPKILQDSLNNDEGEPTPMISFANLPVSKIVEHIKATNQHLPEDRKIQISLYNGPRSIVCSGHPQSLYGLNVTLRKLKAQSNIDQNRIPFSQRKIRFSSRFLQISVPFHCDYLKDVNDIIMKDVERDHLILGKGELAIPIYSTENGEDLRGHPQFTYELIKQICTLPVHWEKATSVTNATHILEFGPVGAGVGLLTHRNKIGTGVQVILANSLETSEKEVLCKDALFNRDPSSVKYSMNWEKLFAPKLVKSSCNGKIYVETRFSRLIGKPPLMVGGMTPTTANENLVGACINAGYHIELAGGGQHSTQMIRDRIKKIMSKVPSGEGITMNIMFLNAFQWGFQYPLVQEMRKEGIPLEGLCIAAGVPSLDVANEILANLKACGIKHVAFKPGSVSAIQQVIAIAKQNPDMPIIMQWTGGRAGGHHSFEDFHQPIIDTYAAIRRQPNIIIVVGSGFGDAEGTLPYLTGDWARKFGYPPMPFDGILFGSRILVAAEAGTSEEVKKLLVASEGIENEKEWENTYKGSTGGIVTVKSELGEPIHKVATRGVLLWKELDETIFNLPAEKQLPALLARKEYIVKRLNKDYQKVWFPKKYDVEDPEKVVDLKDMTYYEVLRRMLELMYPNGQWIDVSLRMIYGDFFHRTEERFYKASEGKNFVSFLQSYEQLEEDPVGLLEKFMDERVPEARAQLLNSDDLMYFLNICGRRDIKPPPYIPIMDKSFKYWFKKDSLWQSEHLDAVVGQDPGRVCILQGPVAVRHSTKANEPIGSILESINQEHIKELKMRYYQNSDTVIPIVDYFGGAEIRDVRRKIRNVTIKGIKNDNIYSTIFEITAENNEDLPDENDWFDLLGGQYYTWLHALLTSKIFVKDDDGYYQDNCVRRILRPKPQHMVEIRTIDDKINSLTMFTNQGGKEIVKITIDDKNVITVLMSEYSLNTKLVQLPLLFQYKPEQGYAPIHEIMEGRNERIKRFYYDLWFGLENGKYTFEEDYNHDPKEPFISVSEPITRQQITDFVNIIGNQAESYTDRGQKVLYAPMDFAIVVGWQSIIRAIFPKFINADLLKLVHLSNGFRMIDNATGLKEGDIVKTESRIISVINDENGKIVEVKGVLKRDEKPFMEVISKFFYRGVFTDYESTFKNVEEKPYHVTLKTKKDVRILESLDWFKMTTEEEKLEEGDQLLFELNSEYTYKTHDIYSKVKTVGTVKKLLSTKVYVDVAKVDYSYEEPDGSCGNPVVNFMERNGMVQDTPDYFENGGYSIMPKGKGISSVVNTHSSNLGYSRVSGDVNPIHTNPYFAQLADLPGNITHGMWTSASTRKFVETFAAENHPQRVTSYEVNFLDMVFPGDRLETKLYHTGMANGKKIIKCKTINQNGQVILEGTAEVEQPITAYVFTGQGAQEVGMGMDLYEKSPVAREIWDRADKHLMENYGFSIIDIVKNNPTEITIYFGNVKGQQIRKNYQQMTYEHVNNEGVVESLSLFPEIDDDSVSYTFRHIGGLLSATQFTQPSLVLMEKAAFEEMRSRGYIQQNSAFAGHSLGEYAALTAIGDVLSIETLVDVVFYRGMTMQRAVQRDSKGRSDYAMCAVNPVRVGSTFNESALQYLVASIKKVTNGLIEIVNYNVDNWQYVVSGDLISLQVLTLVLNYLKFEKIDLTVLLKTLSEEELQKQVNEIINNAYVKAKDQKKKHGFIKLERGAASIPLRGIDVPFHSSFLLRGVAPFRQYLMSKFDPKLIDVNRLIGNYIPNLTAEPFSLEKKFIENIYAKTNSTRIKNVLKGWTDDKYASPLLQQKLGYILLIELLAYQFASAVRWIETQDRLFVDIGVERLIEIGPGPTLSGMAQKTLKFKYEYYDDATSYRREILSYSKNYKEIFYDFEDEDEPEKVEEAPKSAPAAAPAPAPAPVAAPVPVAAPAAPAAAVADEDIQVKHLIHILIAQKLKKSVQEVPMSATIKDLVGGKSTLQNEVLGDLQKEFGSSAVPDKSEELPLSELAGQIASGPIPMGKYSQTLVNKLISSKMAAGFTKGKINDYLSQKYGLGPKRTDALLLFGLTDEPASRFGSEDEAKAWLDKIAPNYFGFVGVSAGAAPAAGAAVSVPMAAVSSGALAEVSSKYEQLIREQLDIFMNYLDIDPRKGYNLYEEELSNAAKLRAELDVWINEHGDDYAQGIKPIFDPLKVRKYDSYWNWVYQESLILYYDILYGRLAAVDRKVTSQCIHVMNRADQHLLDLYDYKIDATDPKKGSTYELAKDFAQILRENCSEAISENPVYKDVEIPKKPQTIVTEQGEIKYSEVPRPGVSKMESYIKLMQGGSRITRIPTKHSNRSIRFAGGNNKTRVKSKKVPFLFLKDTKTGEYDEKATKVYYKSLYNMANDGITFKNKYVLVTGCGRNSIGSQIIKGLLNGGAKIIATTSRFSKVTMQYYRQLYEDHGSKGSCLIVVPFNAASTEDVNRLIEYIYSKDPKNGLGWDLDYVIPFAAISENGRTLENIDSRSELAHRIMLTNLLRMLGKIVSEKEAHKYDTRPAQCILPMSPNHGTFGGDGLYSESKIALETLFNRWHSEGWGGYLTIVGAVIGWTRGTGLMNSNNLVAEGIEMFGVHTFSTHEMAFNLIGLMHNDICKMCLKGPVFADLNGGLQFIDDLNSNITMIRTLLNETSEIRRSIKAEKDLEKSITLGKLMAKEKKLMLKPRANLKFTFPKVKPFDELKKLDYLSGMIDLDRTVVVTGYGEVGPYGNSRTRWEMEAYGKFSLEGCIEMAWIMGMIKYAKNKKTKDGKLYSGWVDSETGEPVQDFEVKAKYEERILKHTGIRFIEPELFNGYDPNNKVFYQEVAIDHDLPGFECSKEEAEQFKKKHGDRVDIYENAESGQWTVKIKKGSSIYIPKALQFDRTVAAQIPTGWKPETYGVPKSIIDQVDPITLYVIVATVEALISSGITDPYEFYEYVHVSEVGNCSGGGVGGMTSNHKQYFDRVFEKPVQSDILQECFINTMPAWINLLLLSSSGPIKTPVGACATAVESVEIGLETILSGKAKIVIVGGYDDFQEEGSYEFAQMKATSNSLEELAHGRDPSEMSRPATTTRAGFMEAQGAGHEILMTASLAIKMGVPIYGIIAHTSTATDKEGRSVPAPGQGILTTAREVGNGKSPLLNPKYRARQLNARKRWIKSWVEEELELMNEEVKDMEGESQEVIDAFIEERTAFIDAEARKQEKEAFQVWGQEFYKNDPTISPLRGALAAFGLTVDDIGVASFHGTGTKANDKNESDVFNKQFEHLGRTKGNACPVVCQKYLTGHGKGAAAAWMLNGVIQILQTGIVPGNRNADNIDPLLEKYEHLWFNNKTFKTPGVKAGLLKSFGFGQVGGEILVVHPDCLFATLDENTYNAYKAKRDIREHKAFRKLHDTLTGEDFVQVKDEPPYTPEQESAVYLNPLARASYNKKTKKWDYE

SEQ ID NO: 9480 - protein, 33 aa, Neocallimastix californiae
  fCBD
SIWQQCGGQNYNGPTCCEAGTTCVKLSDYYYQC

SEQ ID NO: 9481 - protein, 32 aa, Neocallimastix californiae
  fCBD
ALYDQCGGEGYFGPTKCCKGKCISQGPYYSQC

SEQ ID NO: 9482 - protein, 33 aa, Neocallimastix californiae
  fCBD
KAYAQCGGLGYEGSTCCQAGTICTVVNEHYSHC

SEQ ID NO: 9483 - protein, 32 aa, Neocallimastix californiae
  fCBD
ALYDQCGGDGYFGPTECCKGKCISQGPYYSQC

SEQ ID NO: 9484 - protein, 33 aa, Neocallimastix californiae
  fCBD
KAYGKCGGNDWTGSTCCMVGTSCQKINEWVSLC

SEQ ID NO: 9485 - protein, 34 aa, Neocallimastix californiae
  fCBD
VDFDQCGGVGYNGPTNCCNPDYKCKEYGTYYFQC

SEQ ID NO: 9486 - protein, 33 aa, Neocallimastix californiae
  fCBD
KAYAQCGGIGYEGPNCCQAGTVCTEINEHYSHC

SEQ ID NO: 9487 - protein, 34 aa, Neocallimastix californiae
  fCBD
GPFEPCGGLRYKGAPTCCQTGYYCSRRNNNYYQC

SEQ ID NO: 9488 - protein, 32 aa, Neocallimastix californiae
  fCBD
KAYGSCNGNGFSPNLPKCCEEGYYCNTRRNQC

SEQ ID NO: 9489 - protein, 34 aa, Neocallimastix californiae
  fCBD
KGYMPCGGSKFPDAPTCCEKYYYCETADPSYHQC

SEQ ID NO: 9490 - protein, 34 aa, Neocallimastix californiae
  fCBD
KAYEMCGGTLFPNQPTCCEPGNTCVIMNPRYHEC

SEQ ID NO: 9491 - protein, 33 aa, Neocallimastix californiae
  fCBD
NVWGQCGGEGWNGPTCCNSGSVCVVTNQYYHQC

SEQ ID NO: 9492 - protein, 34 aa, Neocallimastix californiae; identical to SEQ ID NO: 6226
  fCBD

SEQ ID NO: 9493 - protein, 33 aa, Neocallimastix californiae; identical to SEQ ID NO: 6227
  fCBD

SEQ ID NO: 9494 - protein, 33 aa, Neocallimastix californiae; identical to SEQ ID NO: 6228
  fCBD

SEQ ID NO: 9495 - protein, 34 aa, Neocallimastix californiae
  fCBD
PGYSVCGGSLFRDASPCCEQGFACKIISESYYVC

SEQ ID NO: 9496 - protein, 34 aa, Neocallimastix californiae
  fCBD
KGYRPCGGSEYPDASPCCEEGFTCRAYNDLVSVC

SEQ ID NO: 9497 - protein, 34 aa, Neocallimastix californiae
  fCBD
EAYRPCGGSYFQDGPNCCEPGFICVDANPLFKQC

SEQ ID NO: 9498 - protein, 32 aa, Neocallimastix californiae
  fCBD
KAYEMCGGSFNPVRCCEKGTVCTVFSEYHHEC

SEQ ID NO: 9499 - protein, 28 aa, Neocallimastix californiae
  fCBD
CGGLLYPNAPGCCEGYVCYSMNAYYKEC

SEQ ID NO: 9500 - protein, 34 aa, Neocallimastix californiae
  fCBD
KAYQPCGGNDYPNAPNCCEAGFACLMKNPNYHQC

SEQ ID NO: 9501 - protein, 34 aa, Neocallimastix californiae; identical to SEQ ID NO: 6229
  fCBD

SEQ ID NO: 9502 - protein, 34 aa, Neocallimastix californiae
  fCBD
KANQPCGGSYYPNAPTCCEPGYECTFRSPFFSLC

SEQ ID NO: 9503 - protein, 34 aa, Neocallimastix californiae
  fCBD
PGFYPCGGSLFPDASPCCEEGFTCRYNNEYVSVC

SEQ ID NO: 9504 - protein, 34 aa, Neocallimastix californiae
  fCBD
KGYHPCGGLYYPDASPCCEEGFRCESNNQYTFVC

SEQ ID NO: 9505 - protein, 34 aa, Neocallimastix californiae
  fCBD
KGYYPCGGLRYPDESPCCEEGFRCQYQNPFYFQC

SEQ ID NO: 9506 - protein, 34 aa, Neocallimastix californiae
  fCBD
PGYNPCGGTNFPDASPCCEQGFKCEFHNEKLAIC

SEQ ID NO: 9507 - protein, 33 aa, Neocallimastix californiae
  fCBD
ARYAQCGGVNYHGSTKCCGNLTCVYRGEYYSQC

SEQ ID NO: 9508 - protein, 33 aa, Neocallimastix californiae
  fCBD
TPYGQCGGINYNGPTCCPSGYTCKFISDYYYQC

SEQ ID NO: 9509 - protein, 32 aa, Neocallimastix californiae
  fCBD
KEFDQCDGINYNGPKCCSVGKCVRLNDYYYQC

SEQ ID NO: 9510 - protein, 34 aa, Neocallimastix californiae
  fCBD
KAFEMCGGTLFSNAPKCCEPGNTCVKRYDIYHQC

SEQ ID NO: 9511 - protein, 34 aa, Neocallimastix californiae
  fCBD
GPYEKCGGYEFPNAPRCCQAGYYCDKTYHNYHQC

SEQ ID NO: 9512 - protein, 34 aa, Neocallimastix californiae
  fCBD
LAYGICGGYDFPDAPTCCEDGYYCSKKYPNFHQC

SEQ ID NO: 9513 - protein, 34 aa, Neocallimastix californiae
  fCBD
GPYEKCGGYEFPNAPSCCVKNFYCDKTHSNYYQC

SEQ ID NO: 9514 - protein, 34 aa, Neocallimastix californiae
  fCBD
GPYEPCGGTEFLDYPSCCKPGYYCLKRHPKYYQC

SEQ ID NO: 9515 - protein, 34 aa, Neocallimastix californiae; identical to SEQ ID NO: 9514
  fCBD

SEQ ID NO: 9516 - protein, 33 aa, Neocallimastix californiae
  fCBD
KAFEMCGGELFPNAPSCCEPGNTCVNRSTFYQC

SEQ ID NO: 9517 - protein, 32 aa, Neocallimastix californiae
  fCBD
SQWAQCGGIGFNGPTCCSSGKCVKLNDWYSQC

SEQ ID NO: 9518 - protein, 33 aa, Neocallimastix californiae
  fCBD
KHWDQCGGVNHRGPFCCESGLTCVFVNDYYSQC

SEQ ID NO: 9519 - protein, 34 aa, Neocallimastix californiae
  fCBD
KAFEMCGGTLFPEAPNCCEPGNICVKKYDTYHQC

SEQ ID NO: 9520 - protein, 35 aa, Neocallimastix californiae
  fCBD
LKYSPCGGENFPEITTNCCEEGSSCLAHNQYYYQC

SEQ ID NO: 9521 - protein, 34 aa, Neocallimastix californiae
  fCBD
KAFEMCGGTLFPNAPNCCEPGNTCIIKYDTYHQC

SEQ ID NO: 9522 - protein, 34 aa, Neocallimastix californiae
  fCBD
SAYSVCGGYDFPNAPTCCQKGYYCSKVQPNFHQC

SEQ ID NO: 9523 - protein, 34 aa, Neocallimastix californiae
  fCBD
GAYAICGGYNFPKAPRCCQPGYYCDKSHPNYYQC

SEQ ID NO: 9524 - protein, 34 aa, Neocallimastix californiae
  fCBD
EAYAICGGSQYPNVPNCCIEGYYCDKSHENYYQC

SEQ ID NO: 9525 - protein, 34 aa, Neocallimastix californiae
  fCBD
KSFEMCGGTLFPNVPNCCEPGNTCVIKHDTYHQC

SEQ ID NO: 9526 - protein, 34 aa, Neocallimastix californiae
  fCBD
VAYGCCGGSDNPDAPNCCQSGYTCVKDDPRFWQC

SEQ ID NO: 9527 - protein, 34 aa, Neocallimastix californiae
  fCBD
RVYEICGGKNYPNAPKCCEPGSKCVHFSEDFYQC

SEQ ID NO: 9528 - protein, 34 aa, Neocallimastix californiae
  fCBD
KAYEPCGGLEHPNAPTCCEAGFACLQKNPNYHQC

SEQ ID NO: 9529 - protein, 34 aa, Neocallimastix californiae; identical to SEQ ID NO: 9528
  fCBD

SEQ ID NO: 9530 - protein, 34 aa, Neocallimastix californiae
  fCBD
GPYEPCGGSSFLDYPRCCPPGYYCLHRNEIYHQC

SEQ ID NO: 9531 - protein, 34 aa, Neocallimastix californiae
  fCBD
KPYEPCGGSGFLDYPRCCPPGYYCLHRNEIYHQC

SEQ ID NO: 9532 - protein, 34 aa, Neocallimastix californiae
  fCBD
KPYEPCGGSGFLEYPRCCPPGYYCLHRNEIYHQC

SEQ ID NO: 9533 - protein, 32 aa, Neocallimastix californiae
  fCBD
KAFGRCNGNGSLPNVPRCCEDGYYCNSYWNQC

SEQ ID NO: 9534 - protein, 33 aa, Neocallimastix californiae
  fCBD
KAFEMCGGQLFPKAPNCCESGYTCVDRGTYHQC

SEQ ID NO: 9535 - protein, 34 aa, Neocallimastix californiae
  fCBD
GPYEPCGGSSFLDYPNCCPPGYYCLHRNEIYHQC

SEQ ID NO: 9536 - protein, 29 aa, Neocallimastix californiae
  fCBD
PAFGQCGGTDYRGSTKCCENLRCVYLNDY

SEQ ID NO: 9537 - protein, 34 aa, Neocallimastix californiae
  fCBD
KSYEACGGSRYPNVPKCCTPGNVCVKNNNVFHQC

SEQ ID NO: 9538 - protein, 34 aa, Neocallimastix californiae
  fCBD
REFNVCGGISNPYAPKCCKSGYICVSFNKYFSIC

SEQ ID NO: 9539 - protein, 34 aa, Neocallimastix californiae; identical to SEQ ID NO: 6236
  fCBD

SEQ ID NO: 9540 - protein, 34 aa, Neocallimastix californiae
  fCBD
GPYEPCGGISFLDSPSCCPQGYYCLKRNENYHQC

SEQ ID NO: 9541 - protein, 33 aa, Neocallimastix californiae
  fCBD
KSFEMCGGILFPNVPNCCEPGNTCIERETYNQC

SEQ ID NO: 9542 - protein, 34 aa, Neocallimastix californiae
  fCBD
RAFEMCGGTLFPNAPNCCEEGSTCNKKYPYYHQC

SEQ ID NO: 9543 - protein, 34 aa, Neocallimastix californiae
  fCBD
KANEPCGGSYYKDAPNCCEPGYACVYRSSFYSVC

SEQ ID NO: 9544 - protein, 34 aa, Neocallimastix californiae
  fCBD
KSYEMCGGTNYPDAPNCCEPGNFCWKKYSNLYQC

SEQ ID NO: 9545 - protein, 34 aa, Neocallimastix californiae
  fCBD
KAFEMCGGTLFPNAANCCEPGNTCVKKYDIYYQC

SEQ ID NO: 9546 - protein, 34 aa, Neocallimastix californiae
  fCBD
GAYEICGGYEYPNAPNCCIKNYYCDKTYDNYYQC

SEQ ID NO: 9547 - protein, 33 aa, Anaeromyces robustus
  fCBD
KAYAQCGGKEYTGPNCCQAGTICTEINEHYSHC

SEQ ID NO: 9548 - protein, 32 aa, Anaeromyces robustus
  fCBD
ALYDQCGGEGYFGPTECCKGKCTSQGPYYSQC

SEQ ID NO: 9549 - protein, 34 aa, Anaeromyces robustus
  fCBD
RGYYPCGGSNNPDAKGCCEPGFYCYQHDQYYHQC

SEQ ID NO: 9550 - protein, 34 aa, Anaeromyces robustus
  fCBD
SSYSMCGGNLYPDAPDCCEEGNFCWKTHPDYYQC

SEQ ID NO: 9551 - protein, 34 aa, Anaeromyces robustus
  fCBD
MAYNACGGLANPDAHACCEKGYRCEYINDYFYMC

SEQ ID NO: 9552 - protein, 34 aa, Anaeromyces robustus
  fCBD
PPFYPCGGLSYPDASPCCQSGYKCEYHSDELSVC

SEQ ID NO: 9553 - protein, 26 aa, Anaeromyces robustus
  fCBD
PDYPDAPTCCVDGYVCGELKQGFVQC

SEQ ID NO: 9554 - protein, 34 aa, Anaeromyces robustus
  fCBD
EKLKICGGKSYPDASPCCEEGYRCEAVNEYIYMC

SEQ ID NO: 9555 - protein, 33 aa, Anaeromyces robustus; identical to SEQ ID NO: 6239
  fCBD

SEQ ID NO: 9556 - protein, 33 aa, Anaeromyces robustus
  fCBD
KVWDQCGGATYYGPTCCESNSRCIVHNEYYSQC

SEQ ID NO: 9557 - protein, 34 aa, Anaeromyces robustus
  fCBD
PPYMVCGGSSFPDASPCCEEGYVCEFQNEYVYMC

SEQ ID NO: 9558 - protein, 34 aa, Anaeromyces robustus
  fCBD
KGYNPCGGINYPDASPCCEEGYRCEVYNELMYIC

SEQ ID NO: 9559 - protein, 34 aa, Anaeromyces robustus
  fCBD
SAFQPCGGPKAENASSCCEEGYKCSYYNGYISLC

SEQ ID NO: 9560 - protein, 34 aa, Anaeromyces robustus
  fCBD
GPYMPCGGTEHQDAPNCCVPNYICSTSNSKYHQC

SEQ ID NO: 9561 - protein, 34 aa, Anaeromyces robustus
  fCBD
KVYNVCGGTNYPNAPKCCESGSTCVAFSSMHHEC

SEQ ID NO: 9562 - protein, 34 aa, Anaeromyces robustus
  fCBD
EPYQPCGGIYYQNSPKCCKSGSTCVKNDPNFYQC

SEQ ID NO: 9563 - protein, 34 aa, Anaeromyces robustus
  fCBD
SDYNPCGGKAYPDASPCCAEGSVCVYHNESLSLC

SEQ ID NO: 9564 - protein, 33 aa, Anaeromyces robustus
  fCBD
GNWNQCGGKEYTGPTCCNENYHCIYVNEYYSQC

SEQ ID NO: 9565 - protein, 34 aa, Anaeromyces robustus
  fCBD
PAYQPCGGKQYPDASSCCVEGYICSRHSSDISIC

SEQ ID NO: 9566 - protein, 34 aa, Anaeromyces robustus
  fCBD
PGYQPCGGRKYRDASPCCVEGYVCSFHSNDISIC

SEQ ID NO: 9567 - protein, 33 aa, Anaeromyces robustus; identical to SEQ ID NO: 6242
  fCBD

SEQ ID NO: 9568 - protein, 34 aa, Anaeromyces robustus
  fCBD
KSYGICGGTAYPDAPTCCEEGNFCWKRYDNLHQC

SEQ ID NO: 9569 - protein, 34 aa, Anaeromyces robustus
  fCBD
KAYDACGGSNYPNSPRCCIEGLTCVYESEAASYC

SEQ ID NO: 9570 - protein, 32 aa, Anaeromyces robustus
  fCBD
RAYEMCGGYGYETKCCESGTICKVFSEYHHQC

SEQ ID NO: 9571 - protein, 34 aa, Anaeromyces robustus
  fCBD
KAYQPCGGLEYPDAPNCCEAGFACLRKNPNYHQC

SEQ ID NO: 9572 - protein, 34 aa, Anaeromyces robustus
  fCBD
KAYYPCGGSYYPDLPNCCEPGFVCVETTSVIKQC

SEQ ID NO: 9573 - protein, 34 aa, Anaeromyces robustus
  fCBD
LPWGVCGGYDFPDAPNCCTPGFACDKTYPSYYQC

SEQ ID NO: 9574 - protein, 34 aa, Anaeromyces robustus
  fCBD
KGYYPCGGNRFPDAPSCCEAGFYCKKNNIDYYQC

SEQ ID NO: 9575 - protein, 34 aa, Anaeromyces robustus
  fCBD
KAFQPCGGNDYKNASPCCVEGYVCDVINTRISIC

SEQ ID NO: 9576 - protein, 33 aa, Anaeromyces robustus
  fCBD
GGYGQCGGINYTGPTCCPSGYSCKKHNDYYSQC

SEQ ID NO: 9577 - protein, 34 aa, Anaeromyces robustus
  fCBD
PDYEKCGGIGYNGPTCCENPNFKCEVINEYFHQC

SEQ ID NO: 9578 - protein, 33 aa, Anaeromyces robustus; identical to SEQ ID NO: 6245
  fCBD

SEQ ID NO: 9579 - protein, 34 aa, Anaeromyces robustus
  fCBD
PGYQPCGGRKHKDASPCCVEGYVCTYHNKDLSVC

SEQ ID NO: 9580 - protein, 34 aa, Anaeromyces robustus
  fCBD
KGFLPCGGSLMPDAPNCCEPGFYCRIENEYFHQC

SEQ ID NO: 9581 - protein, 34 aa, Anaeromyces robustus
  fCBD
EAYMPCGGTNYPDAPSCCVKNYSCKKYTPEHFQC

SEQ ID NO: 9582 - protein, 34 aa, Anaeromyces robustus
  fCBD
PGFSPCGGKKYPDASPCCEEGFKCEYHNKNLFVC

SEQ ID NO: 9583 - protein, 34 aa, Anaeromyces robustus
  fCBD
QGFFPCGGLRHPDASPCCEEGFRCEYQNENYYMC

SEQ ID NO: 9584 - protein, 37 aa, Anaeromyces robustus; identical to SEQ ID NO: 6246
  fCBD

SEQ ID NO: 9585 - protein, 32 aa, Anaeromyces robustus
  fCBD
DFYQKCGADDEPKRCCVPGSKCVRLTQFHYQC

SEQ ID NO: 9586 - protein, 33 aa, Anaeromyces robustus
  fCBD
KEFEMCGGSLYPDSPECCEGTFCLKSNSKYHQC

SEQ ID NO: 9587 - protein, 34 aa, Anaeromyces robustus; identical to SEQ ID NO: 6247
  fCBD

SEQ ID NO: 9588 - protein, 34 aa, Anaeromyces robustus
  fCBD
DAYQSCGGLFNPNAPNCCKEGFTCVKKDPNFYQC

SEQ ID NO: 9589 - protein, 34 aa, Anaeromyces robustus
  fCBD
GAFEICGGTDYPNAPNCCITGYICNKIHVNYYLC

SEQ ID NO: 9590 - protein, 34 aa, Anaeromyces robustus
  fCBD
GAFEICGGKDHPDAPNCCISGYACDKTFKRHYIC

SEQ ID NO: 9591 - protein, 34 aa, Anaeromyces robustus
  fCBD
SAYNACGGTDYPDAPNCCVPNYVCIKTSSKYHQC

SEQ ID NO: 9592 - protein, 34 aa, Anaeromyces robustus
  fCBD
GAFEICGGKDHPDAPNCCISGYVCDKTFKRHYIC

SEQ ID NO: 9593 - protein, 33 aa, Anaeromyces robustus
  fCBD
KKFDMCAPQLPNAPDCCEPGFTCTNELTNFYQC

SEQ ID NO: 9594 - protein, 34 aa, Anaeromyces robustus
  fCBD
KVYDICGGTNYPNAPKCCESGSTCVAFSEIHHQC

SEQ ID NO: 9595 - protein, 32 aa, Anaeromyces robustus
  fCBD
KAYEMCGGMNTEKKCCEQGSRCVEFNEFYHQC

SEQ ID NO: 9596 - protein, 34 aa, Anaeromyces robustus
  fCBD
KPYQPCGGLGYPDAPNCCEQGYVCQHNDLYYHQC

SEQ ID NO: 9597 - protein, 34 aa, Anaeromyces robustus
  fCBD
KLYDICGGKLFPDAPTCCEQGSKCIIYDESISRC

SEQ ID NO: 9598 - protein, 33 aa, Anaeromyces robustus
  fCBD
KEYEMCGGTLYPDAPSCCEGTFCWTKYKEYHQC

SEQ ID NO: 9599 - protein, 30 aa, Anaeromyces robustus; identical to SEQ ID NO: 6248
  fCBD

SEQ ID NO: 9600 - protein, 33 aa, Anaeromyces robustus; identical to SEQ ID NO: 6249
  fCBD

SEQ ID NO: 9601 - protein, 33 aa, Piromyces finnis
  fCBD
KKWQQCGGIGYSGPTQCESGSECVATNEFYSQC

SEQ ID NO: 9602 - protein, 33 aa, Piromyces finnis; identical to SEQ ID NO: 9482
  fCBD

SEQ ID NO: 9603 - protein, 33 aa, Piromyces finnis
  fCBD
EAYGKCGGKDWTGSTCCMVGTSCKEVNEWVSLC

SEQ ID NO: 9604 - protein, 32 aa, Piromyces finnis; identical to SEQ ID NO: 9483
  fCBD

SEQ ID NO: 9605 - protein, 33 aa, Piromyces finnis; identical to SEQ ID NO: 9603
  fCBD

SEQ ID NO: 9606 - protein, 101 aa, Neocallimastix californiae
  fn3_3
QRGKVTGKLTIKNQLDNSVFKLDDAVVTLVQPESNSESIPNQQWRHYSFWTHSISGVSPNFTINNVIPGTYQLRAWSKGVVGEFILNKTITVTAGQTTNLG

SEQ ID NO: 9607 - protein, 97 aa, Anaeromyces robustus
  fn3_3
KRGSVSGKLVIKDPLYGSLKISDATVTLVQPESSTEPIHPQQWHKMSHWVTHVTGDFKIENVVPGTYQLRAWSKGIVGEFYTTNTITVTSGQETKLG

SEQ ID NO: 9608 - protein, 97 aa, Piromyces finnis
  fn3_3
KRGSVSGKLVINDPLYGNLKLSDATVTLVQPESSNEPIHPQQWHKMSHWVTHITGDFKIENVVPGTYELRAWCKGIVGEFYTTNTITVTSGQETRLG

SEQ ID NO: 9609 - protein, 101 aa, Piromyces finnis
  fn3_3
ERGKVTGTLAINNPLTNTRLPLEDAVVTLVQPQSATEPIPNQQWRHMSFWTHSLSGATPNFVIYNVIPGTYELHAWAKGVVGEFVLDKLVTVKAGEVVNLG

SEQ ID NO: 9610 - protein, 90 aa, Neocallimastix californiae
  Fn3_assoc
KSSGTIYYTLDSSDPTTSNTAKIYNGEIRMYDRSIEENVYGKHQHEDNSPYSTTLQTNYKATNVKYDKLTIVRAATKLQDGSFSPVVTKA

SEQ ID NO: 9611 - protein, 73 aa, Neocallimastix californiae
  Fn3-like
PQAYLTMPSPKDDPRIGEYPEFQLKGFEKYFLKAGEKRKVNLLVPYAETKYFNTTTNTWETTIDGKYKVSIGL

SEQ ID NO: 9612 - protein, 72 aa, Neocallimastix californiae
  Fn3-like
VPMLFLGYPEVSELKNYPIRGLKAFDKINLKAGEKKTVTLTVDQHGLSYYNTSQGKFVVPSGGEYTVYVGKS

SEQ ID NO: 9613 - protein, 73 aa, Neocallimastix californiae
  Fn3-like
PQAYLTMPSAKDDPRIGEYPEFQFKGFDKIFLKAGEKKKINLLVPYAETKYFNTTTNTWETTIDGKYKVSIGL

SEQ ID NO: 9614 - protein, 74 aa, Neocallimastix californiae
  Fn3-like
TLQAYLTMPSAEDDPRIGEYPEYMLKAFEKVFLKAHEKKQVNLLVPYAETKYFNTTTNTWQETIDGKYKVSIGL

SEQ ID NO: 9615 - protein, 72 aa, Neocallimastix californiae
  Fn3-like
VPMLFLGFPNVSEMGDYPVRNLKAFDKINLKAGESKTVTLEVDQHGLSYYNTNKKKFVVPTGGEYTVYVGKS

SEQ ID NO: 9616 - protein, 74 aa, Anaeromyces robustus; identical to SEQ ID NO: 9614
  Fn3-like

SEQ ID NO: 9617 - protein, 72 aa, Anaeromyces robustus; identical to SEQ ID NO: 9615
  Fn3-like

SEQ ID NO: 9618 - protein, 71 aa, Piromyces finnis
  Fn3-like
VYLTMPTVEADPRIGVYPELNFKNFTKIYLEAGEKRKVNLLVAYADTQYFNTTKNEWQTTIDGTYKVHVGF

SEQ ID NO: 9619 - protein, 71 aa, Piromyces finnis; identical to SEQ ID NO: 9618
  Fn3-like

SEQ ID NO: 9620 - protein, 287 aa, Neocallimastix californiae
  Galactose mutarotase-like
DSITIDNNSSSYSISGKNFNFIIDKSTGTLKNYKYKGETLINEGPTPNFFRGYVENDYNGSNWAKTFDPNWRNAMNGARVNSIDVKNGVGSEKIIVSHLSLPKAGNTKVDITYTIQSNGSIDVELNVDGTRAGLGNYLRVGSIMILPKGAEKLSWYGNGPVETFNDRKTNGRKGVWENTVSGMFYPFMKADDCGNLTDIKWIAVQNNGKGASLLIAADGTVEASALHFTPEDLMRADHPFKLKPRKETILSVDYGSMGTGSATCGQATLDKYRLPSGKQYRWKFTIF

SEQ ID NO: 9621 - protein, 263 aa, Neocallimastix californiae
  Galactose mutarotase-like
SLTQNNNSYILKNNYATVVISKKDGYITSLKIAGDNQEFLNRAYIDANGSKAGFHAKKSTIIKNTNDHVEIAFTDNVLNMDWEVRYTMLNDTKGVYFSLKLDHKASYADTQFSEIRLVFRLKSNPFNWLQIEDNVGRYLPTAEEQKNCEVMGPKEACKVKTGEVLHKYDWSIDALKHDVHGFSTKNGLGCWFVLPSMEWKNGGAYNRDLACHNGENDSIQIMYMAGSHYGAGDEYPKKGENWSKVYGPYLIYVNKAGSPQASW

SEQ ID NO: 9622 - protein, 289 aa, Neocallimastix californiae
  Galactose mutarotase-like
ADAVNVSETSNGFSVSGKNFQFTVDKSTGTIKSYTYNGATLITEGPTPNFWRGYVENDNNGGGWVKAFDPSWRSAMEGARCDGVSTKNGSDGDKIITSRLTLPKAGSTKVDITYTIHGDGSVDVEFNVDASRAGLGNFLRVGSIMKLPTGAEKLSWYGNGPVETFNDRKTNGRMGVWESTVTDMFFPYMKADDTGNLTDLKWISVQNEKKSASILIAAEGKVEGSALHFTPEDLMRADHPFKLSPRKETYLSVDYGSMGTGSATCGQGTLDKYRLPSNRQYNWKFTIIP

SEQ ID NO: 9623 - protein, 268 aa, Anaeromyces robustus
  Galactose mutarotase-like
VNLTENNTSYILSNGLATFTIAKSSGFITSMKYKNNSQEFLNRSYIDANGGKVYFSVTSSSVVIRTDDLVEIVFYDDYSKHVGTGFAIDWEVRYTMRSGVSGLYFSLTQAHKSNYEEAQCSELRLVMRLKSDVFNWLQVDDFTKRVMPTAAQQNKCTTLSPQEACQLETGEVIHKYDWSIDVLEHKVHGFASISKNLGSWFVMPSMEWKNGGAVNRDLACHQGGADSLQILYLRGSHYGAGDAILKRGEVWSKMHGPILIYLNEGSDV

SEQ ID NO: 9624 - protein, 290 aa, Piromyces finnis
  Galactose mutarotase-like
NDSISVTENQNSYILSGKNFEFLINKSSGLLSTYKYRGETIITEGPTPNFWRGYVENDNNGAGWAKTFDSNWRNAMNGARCDKIEVNNGSDSSEKIIVSHLTLPKVGSTKVDITYTVHCDGSVDVEFNVDATRSDLGNFLRVGSMMKLPEGFEKLSWYGNGPVETFNDRKTNGRMGVWESTVTDMFYPYMKADDCGNLTDLKWISVQSKKRSASILVVAEGAVEGSALHFAPEDLMRADHPYKLRPLKTTILSVDYGSMGTGSATCGQATLDKYRLPSDRPYNWKFTIIP

SEQ ID NO: 9625 - protein, 279 aa, Piromyces finnis
  Galactose mutarotase-like
VTLTENNTSYILSNGLATFTIAKSSGFITSMKYKNNSQEFLNRSYIDANGGKVYFSVTSSYVATKNSDLVEIVFVDDYSKHVGTGFAIDWEVRYTMKSNVSGIYFSLTQSHKSNYEEAQCSELRLVMRLKSDVFNWLQVDDFNKRVMPTASEQSKCVTLSPSEACRLESGEVIHKYDWSVDALEHKVHGFGSISKNLGSWYVIPSMEWKNGGAVNRDLACHQGGSDSLQILYFRGSHYGAGDAVLKKGEVWSKMHGPILIYLNEGSDVNALWADANRQA

SEQ ID NO: 9626 - protein, 269 aa, Piromyces finnis
  Galactose mutarotase-like
SLTDNGSSYILRNDYAIVTIAKNSGYITSLKLNGNNQEFLNRSYIDANGGKVYFSPQSSKVIKNTSSHVEVAFYDNYNSNSKLGLDWEVRYTMLSDTRGVYYSLTNTHKTNYPETSYSEIRLVLRLKADIFNHLQVEDDVYRDMPSAADQNKCVEMGPKEACQLPNGEVIHKYDWSVDMLKHHIHGFSSKSTGLGCWFVIPSLEWKNGGAYNRDLSCHQGGSDSLQIMYMNGSHYGGGDATIKSGEYFQKVYGPFLIYLNKASSVEASW

SEQ ID NO: 9627 - protein, 110 aa, Neocallimastix californiae
  Galactose-bd-like
NYAASMAWQSGISVKGQGAVTQVNYGRGSWTGVSNVALGNAKTITLRASSSSGATVKICAGSENGTVLGYVDIPAGGSLQNVTGNLSGASGTKNLFFIASGNLTIESWQL

SEQ ID NO: 9628 - protein, 110 aa, Neocallimastix californiae; identical to SEQ ID NO: 9627
  Galactose-bd-like

SEQ ID NO: 9629 - protein, 119 aa, Neocallimastix californiae
  Galactose-bd-like
VNAYNTNYASMMAWQGGVSTNGLGHTTVTYNRGEWTGVSNVDFGEAATSVKITAASNNGAVIRITTGSPNGDVVGYVSIPATGGNSNFKTVTADINTVSGTKHVFFVASGDVVVDTWQF

SEQ ID NO: 9630 - protein, 110 aa, Neocallimastix californiae
  Galactose-bd-like
NYAASFAWQSGISVKGQGAVTQVNYGRGAWTGVSNVNLGNAKSITLKASSSGGATVKICAGSENGTVLGYVDIPAGGSLQNVSGNLSGASGTKNLFFIASGNLTIESWQL

SEQ ID NO: 9631 - protein, 215 aa, Neocallimastix californiae
  Galactose-bd-like
EDIFAVNREPASCNPVPYQDTESAVNAVWDYNAREQSSFLQMLTGKNENWDLVVVQNSNQAQSHINSGCFKSDFRPSADHGWKTVQLPKSWTCQGFDFSIYTNVNQPWQSRYDSYVPVPEAPVNYNPVGLYRKKFTLDSSMRKSGRRIYIEFDGVESAYYVYVNGQAVGYSEDTFSPHRFDITDVLSSGENTLAVEVHKFCDGTWFEDQDMIYDG

SEQ ID NO: 9632 - protein, 165 aa, Neocallimastix californiae
  Galactose-bd-like
IKNPSFEQDNVNSLSKDSTRGAFVATSVVNWKLSGSYGVSDIMTSSATATDNNFGAPGNPSDGKQMYYIRNAWNASSASLLQSVTLPAGIYKLTIDNKCVTASSHAAYLVAGEDNVTLPFKDSLPSKWTTTELLFTLSRDTTLNIGIEVEFGSGSGGSVLVDNFR

SEQ ID NO: 9633 - protein, 113 aa, Neocallimastix californiae
  Galactose-bd-like
SKVNNASSFAWQYGITIKGQDNVLPVNYVKGAWTGISNVDLGNAKSITLKAYAPNGATIKVCVGSENGTVLGYVDIPKGNSLQNVTGNLDNASGTKNLFLVSSGDATIESWQL

SEQ ID NO: 9634 - protein, 156 aa, Neocallimastix californiae
  Galactose-bd-like
EDPNGYLFHNTFERGIDGWSSRGSAQVSFNKNTAYDGNGSIYCSERGANWSGASRNLSPNVFKPGNAYSFSVVVKYEEGPASQIFYLTLQYDDGSGETQYEKVSIVEVAKGQWTQLYNTNYKIPDRACNMLFYVETEKGEDSFYVDEAIGAPAGTA

SEQ ID NO: 9635 - protein, 109 aa, Neocallimastix californiae
  Galactose-bd-like
YAASFAWQSGISVKGQGAVTQVNYGRGAWTGVSNVALGNAKSITLKASSSSGATVKICAGSENGTVLGYVDIPAGGSLQNVTGNLSGASGTKSLFFIASGNLTIESWQL

SEQ ID NO: 9636 - protein, 175 aa, Neocallimastix californiae
  Galactose-bd-like
PIAWEIGIPDRTAMEYKHGDHFNQWGLPYKFPQEFPNGVNYYIGKSNYAKDWNYCHVSVPGNGGTYKSVPWNIYFNLNKKPTGTAVLRVSVAANTSTALSVSINGGKNSAEVSNFKDDACVRRDGIRGFYRELEFKFSPNDFKIGENKITLNARKTGGYTNSYQFDGIMYDHIRL

SEQ ID NO: 9637 - protein, 121 aa, Neocallimastix californiae
  Galactose-bd-like
ENVDAFKTYYASMMAWEGGVSINGLGHTTVTYNKGDWTGVSNVDFGNGAYGIKVSAASRNGAVIKIAAGSETGNALGYINIPATGGTNSFKTVTASLSKITGVKNIFFIASGDVVLDTWQF

SEQ ID NO: 9638 - protein, 215 aa, Neocallimastix californiae
  Galactose-bd-like
EDVFAVNREAASCNPVPFQNVEAAVNAVWDYNAREDSSYLQMLTGKNQNWDLVVEQNAQKAQNHINNGCFKPNYQPSSNNGWKTVQLPKSWTCQGFDFSIYTNVGQPWQSNYDGYVPVPQAPTNYNPVGLYRKKFTVDSTMRQSGRRIYIEFDGVESAYYVYVNGQAIGYSEDTFSPHRFDITDALTNGENTLAVEVHKFCDGTWFEDQDMIYDG

SEQ ID NO: 9639 - protein, 156 aa, Neocallimastix californiae
  Galactose-bd-like
EPDENGYYFHNTFEEDEDTWTGRHTASIQVSQKAAYAGKSSLYCYKREYNWTGAQRTLSPKMFKPGETYSFSVVVRYDEGPASQNFYLTLQYENGTDEVQYDKISIESVKKGEWTQLANANYKIPANAYDMYFYVETEEGEDSFYVDEAIGAVAGT

SEQ ID NO: 9640 - protein, 105 aa, Neocallimastix californiae
  Galactose-bd-like
MAWQSGISVEGHGAVTQVKYGRGAWTGVSNVDLGSASSITLKASSRSGATIKVCTDSENGNALGYVEIPAGGSLQNVTGQLSGATGTKNLFFVSSGDAVIESWQL

SEQ ID NO: 9641 - protein, 121 aa, Anaeromyces robustus; identical to SEQ ID NO: 9637
  Galactose-bd-like

SEQ ID NO: 9642 - protein, 156 aa, Anaeromyces robustus; identical to SEQ ID NO: 9639
  Galactose-bd-like

SEQ ID NO: 9643 - protein, 110 aa, Anaeromyces robustus
  Galactose-bd-like
NYAASMAWQSGISVEGHGAVTQVKYGRGAWTGVSNVDLGSASSITLKASSRSGATIKVCTDSENGNALGYVEIPAGGSLQNVTGQLSGATGTKNLFFVSSGDAVIESWQL

SEQ ID NO: 9644 - protein, 110 aa, Anaeromyces robustus
  Galactose-bd-like
YASSFAWQSGIKIKGQGEVTTVEYPSGGWTGISQVALGDAKSITIKASSQSGATIKICTGNENGNVLGYVEIPSGGNLKEVTGDLTNATGTQDLFLVASNNVSIESWKLN

SEQ ID NO: 9645 - protein, 178 aa, Anaeromyces robustus
  Galactose-bd-like
GPTIFEVGVPDRTAEEYLHGDHFNQWGLYNKFAEEFPNSVNFYIGKSDWQFDWNYCQVSIPGGANGNYKACEPWKIHFNINKVPSGNILLRVSIAASSSTALSVSVNGRNQSSEVKDLIDDACIRRDGIRGIWSMKEFTFPASLLKQGENYVSLHTRAIGGYLTYYRFDGIMYDHIRL

SEQ ID NO: 9646 - protein, 116 aa, Anaeromyces robustus
  Galactose-bd-like
VDGSAVNPAANMAWQNGISVKGQGAVLPVSYTRGAWTGVSNVALGGASSITLKASSQSGATIKICTESENGQAIGYVDIPAGGSLQNVSGTLSGATGTKNLFFVSSGDATIESWQL

SEQ ID NO: 9647 - protein, 118 aa, Anaeromyces robustus
  Galactose-bd-like
KDVDGFAVNPAANMAWQYGISVNGQGAVVPVNYNRGAWTGVSNVALGGATSITLKASSKSGATIKICTESENGQALGYVDIPAGGSLQNVSGTLSGATGTKNLFFVSSGDATIESWQL

SEQ ID NO: 9648 - protein, 158 aa, Anaeromyces robustus
  Galactose-bd-like
EEPDKDGYYFHNTFENGTDRWENRGYASVSQSKDDAYKGSGSLYCDNREYNWSGASRSLSSNVFEAGKEYSFSVIVKYNEGPDSQKFYLTLQYDNGTDEIQYDKIATVNVSKDQWVQLANTNYKIPANASDLIFYVETEEGLESFYIDEAIGAAAGTK

SEQ ID NO: 9649 - protein, 118 aa, Piromyces finnis
  Galactose-bd-like
SNVDAYSTNYASMMAWQAGVSVYGLGHTTVTYRKGTWTGVSGVEFGDNATSVKISAASANGATIRITSGSENGEVIGYVTVPATGDEFVTVTADVSVSGVKDIFFVASDEVVVDTWQF

SEQ ID NO: 9650 - protein, 213 aa, Piromyces finnis
  Galactose-bd-like
EDVFAINREAASCNPIPYQDLNSAVNAVWDYNAREQSDYLQMLTGKNENWDLVVEQNSNKAQTHINSGCFKPDYKPSSSWKTVQLPKSWTCQGFDFSIYTNIGQPWQSNYDTDIPVPHAPTNYNPVGLYRKKFMVDSTMRQSGRRIYIEFDGVESAYYVYVNGQGVGYSEDTFSPHRFDITDFLVNGENTLAVEVHKFCDGTWFEDQDMIYDG

SEQ ID NO: 9651 - protein, 76 aa, Piromyces finnis
  Galactose-bd-like
NAPSTGMYDLSIVYCANMGQKINTLMVNGQSAGDVTFTENKKFESKDVGAIYLNKGKNTIGLVASWGWMWVDAFVI

SEQ ID NO: 9652 - protein, 157 aa, Piromyces finnis
  Galactose-bd-like
PDKDGYYFHNTFENGAERWENRGYASVAQSKDTAYKGNGSLYCEKREYNWSGASRSLSSNVFEPGKEFSFSAVVKYDEGPESQTFFLSLQYNDDSGETQYDKIAIVKVTQGEWVQLANTNYKIPANSSNLMFYIETEEELSSFYVDEAIAAPAGTKI

SEQ ID NO: 9653 - protein, 178 aa, Piromyces finnis
  Galactose-bd-like
GPTVFEVGIPDRTAEEYLHGDHFNQWGLYNQFQDEFPNSVNFRIGESDWQFDWNYCQVSIPGGADGKYKAAEPWKIYFNLDKVPSGNILVRVSVAASSSTALSVSVNGKNQSAEVKDLVDDACIRRDGIRGIWSMKEFTFSSSLLKQGENYISLHARAIGGYLTYYRFDGIMYDHVRL

SEQ ID NO: 9654 - protein, 174 aa, Piromyces finnis
  Galactose-bd-like
IVWEIGIPDRTAMEYKHGNHFNQWGLYHKFKTEFPNSVNYYVGKSNYATDWNYCHVSIQGADGKYMQSPWNIYFNLNKIPTGTSVLRISIAASSYSALSVALNDGKATAEVKDLVDDACIRRDGIRGIWSMKEFTFSSSLLKQGENYISLHARAIGGYLTYYRFDGIMYDHVRL

SEQ ID NO: 9655 - protein, 109 aa, Piromyces finnis
  Galactose-bd-like
LAASFAWQSGIKIKGQGAVTTVEIPRGGWTGVSHVALGNAKSITIKASSSSGATIKVCTGNEKGDVLGYVEIPAGGSLQEVTAEISNASGTKDLFFVASNSVSMESWQL

SEQ ID NO: 9656 - protein, 118 aa, Piromyces finnis; identical to SEQ ID NO: 9649
  Galactose-bd-like

SEQ ID NO: 9657 - protein, 109 aa, Piromyces finnis; identical to SEQ ID NO: 9655
  Galactose-bd-like

SEQ ID NO: 9658 - protein, 119 aa, Piromyces finnis
  Galactose-bd-like
SNVDAYSTNYASMMAWQAGVSVNGLGHTTVSYNRGDWTGVSNVDFGDSATSVKISAASSNGATIRITSGSENGDVIGYVTIPATGGDKNFKTVTANVKASGTKNIFFVASGDVTIDTWQ

SEQ ID NO: 9659 - protein, 109 aa, Piromyces finnis; identical to SEQ ID NO: 9655
  Galactose-bd-like

SEQ ID NO: 9660 - protein, 119 aa, Piromyces finnis; identical to SEQ ID NO: 9658
  Galactose-bd-like

SEQ ID NO: 9661 - protein, 119 aa, Piromyces finnis; identical to SEQ ID NO: 9658
  Galactose-bd-like

SEQ ID NO: 9662 - protein, 109 aa, Piromyces finnis; identical to SEQ ID NO: 9655
  Galactose-bd-like

SEQ ID NO: 9663 - protein, 108 aa, Piromyces finnis
  Galactose-bd-like
AASFAWQYGISVKGQAAVTTVNYSRGGWTGVSNVALGNAQSITLKASSKSGATVKICTGSENGQAIGYVDIPAGGSLQNVTGSISGASGTKNLFFVASGDLSIESWQL

SEQ ID NO: 9664 - protein, 119 aa, Piromyces finnis; identical to SEQ ID NO: 9658
  Galactose-bd-like

SEQ ID NO: 9665 - protein, 118 aa, Piromyces finnis; identical to SEQ ID NO: 9649
  Galactose-bd-like

SEQ ID NO: 9666 - protein, 118 aa, Piromyces finnis; identical to SEQ ID NO: 9649
  Galactose-bd-like

SEQ ID NO: 9667 - protein, 108 aa, Piromyces finnis; identical to SEQ ID NO: 9663
  Galactose-bd-like

SEQ ID NO: 9668 - protein, 117 aa, Piromyces finnis
  Galactose-bd-like
YYEAEDGKLDGITVYKDLSGFSGTGYVGRFENPGNSITVTVNAPSTGMYDLSIIYCANMGQKINTLMVNGQSAGDVTFTENKKFESKDVGAIYLNKGKNTIGLVASWGWMWVDAFVI

SEQ ID NO: 9669 - protein, 140 aa, Neocallimastix californiae
  Galactose-binding domain-like
NVRATYTVIFKNATGMPSGYDNWGWDCSISYSGGAMVITPKKGKYGAVSLKNTSRSFTGGSLRFDMKNEGKVKILVENSDKDEKFDVDTIAPSDEYQTYIFDIDFDLPFDRIDFQDANGTGDRIYIKNLVYSTGSAEDFD

SEQ ID NO: 9670 - protein, 153 aa, Neocallimastix californiae
  Galactose-binding domain-like
RKVRATYSVIYETGKKLNSGYENWGWLAKMSFKDNAMVVTSDEDEYGAVSVHKNSGYYGTGGCIHLLAKTENTALVKVQGVKGEPEEDAFSVGTVRSSDDFTEYKFDVDSEYTFDRIIIQDGQASGIPINVRYLIYSTGSCDDFNPPVDTSYV

SEQ ID NO: 9671 - protein, 110 aa, Neocallimastix californiae
  Galactose-binding domain-like
SWGWASVDVNDDGSVVAVLEEDKYGAFSLHTGKKFGAGKIHVELKSDKEGFPVKIIVHSTDDEQIVIKTIDDAYSEELKAYDVEVPAGTYDRISIQDAWGKALTITMNNY

SEQ ID NO: 9672 - protein, 125 aa, Neocallimastix californiae
  Galactose-binding domain-like
ELDGKWQNWSWGIDSTEVDEEGNFVNHITAGSWGAVSFKRSDGVEFGAGTLYFKAKVNDTRANLQILFHSSTDDDDYVNVGNYKGISISEMTQYQVEVTAPEGKKYDRITIQDVFNQGITLYLND

SEQ ID NO: 9673 - protein, 108 aa, Neocallimastix californiae
  Galactose-binding domain-like
YAASMAWQSGISVKGQGAVTQVNYGRGSWTGVSNVALGNAKTITLRASSSSGATVKICAGSENGTVLGYVDIPAGGSLQNVTGNLSGASGTKNLFFIASGNLTIESWQ

SEQ ID NO: 9674 - protein, 109 aa, Neocallimastix californiae
  Galactose-binding domain-like
NYAASMAWQSGISVKGQGAVTQVNYGRGSWTGVSNVALGNAKTITLRASSSSGATVKICAGSENGTVLGYVDIPAGGSLQNVTGNLSGASGTKNLFFIASGNLTIESWQ

SEQ ID NO: 9675 - protein, 113 aa, Neocallimastix californiae
  Galactose-binding domain-like
TNYASMMAWQGGVSTNGLGHTTVTYNRGEWTGVSNVDFGEAATSVKITAASNNGAVIRITTGSPNGDVVGYVSIPATGGNSNFKTVTADINTVSGTKHVFFVASGDVVVDTWQ

SEQ ID NO: 9676 - protein, 108 aa, Neocallimastix californiae
  Galactose-binding domain-like
AASFAWQSGISVKGQGAVTQVNYGRGAWTGVSNVNLGNAKSITLKASSSGGATVKICAGSENGTVLGYVDIPAGGSLQNVSGNLSGASGTKNLFFIASGNLTIESWQL

SEQ ID NO: 9677 - protein, 180 aa, Neocallimastix californiae
  Galactose-binding domain-like
NENWDLVVVQNSNQAQSHINSGCFKSDFRPSADHGWKTVQLPKSWTCQGFDFSIYTNVNQPWQSRYDSYVPVPEAPVNYNPVGLYRKKFTLDSSMRKSGRRIYIEFDGVESAYYVYVNGQAVGYSEDTFSPHRFDITDVLSSGENTLAVEVHKFCDGTWFEDQDMIYDGGIFRDVFLVSA

SEQ ID NO: 9678 - protein, 167 aa, Neocallimastix californiae
  Galactose-binding domain-like
YIKNPSFEQDNVNSLSKDSTRGAFVATSVVNWKLSGSYGVSDIMTSSATATDNNFGAPGNPSDGKQMYYIRNAWNASSASLLQSVTLPAGIYKLTIDNKCVTASSHAAYLVAGEDNVTLPFKDSLPSKWTTTELLFTLSRDTTLNIGIEVEFGSGSGGSVLVDNFRL

SEQ ID NO: 9679 - protein, 111 aa, Neocallimastix californiae
  Galactose-binding domain-like
NNASSFAWQYGITIKGQDNVLPVNYVKGAWTGISNVDLGNAKSITLKAYAPNGATIKVCVGSENGTVLGYVDIPKGNSLQNVTGNLDNASGTKNLFLVSSGDATIESWQLT

SEQ ID NO: 9680 - protein, 144 aa, Neocallimastix californiae
  Galactose-binding domain-like
GYLFHNTFERGIDGWSSRGSAQVSFNKNTAYDGNGSIYCSERGANWSGASRNLSPNVFKPGNAYSFSVVVKYEEGPASQIFYLTLQYDDGSGETQYEKVSIVEVAKGQWTQLYNTNYKIPDRACNMLFYVETEKGEDSFYVDEA

SEQ ID NO: 9681 - protein, 124 aa, Neocallimastix californiae
  Galactose-binding domain-like
IDPAWSNWSWNYESVEVDDDGNVVAVLEEDKYGAFSLHTDKEFNAGKIHIELKSDKEGAPVKIIVHTTGDEQVTVETIEDAYSDELKAYDVDVPAAEGDTYNRISVQDAWGKALTITMNNFYFT

SEQ ID NO: 9682 - protein, 132 aa, Neocallimastix californiae
  Galactose-binding domain-like
YDIIKEGEFMIDGKWQNWSWGVEDSEFDEDGNFVNYITADTYGGVSFKRSDSVQFGAGTLYFKAKVNDTNANLQVLFHTTAEEYVNMGNFKDISDTEMTQYKAKVTAPTAEKYDRITIQDVANNGLTLYLND

SEQ ID NO: 9683 - protein, 124 aa, Neocallimastix californiae
  Galactose-binding domain-like
EGFMIEPGWANWSWGYESVDIDEEGNVVALFEEEKYGAFSVHGDKEFSAGKIHIELKSDKEGAPVKIIVHTKDDEQITLETIEDAYSDELKAYDVDVTATEGATYDRISVQDAWGKAITLTINN

SEQ ID NO: 9684 - protein, 109 aa, Neocallimastix californiae
  Galactose-binding domain-like
NYAASFAWQSGISVKGQGAVTQVNYGRGAWTGVSNVALGNAKSITLKASSSSGATVKICAGSENGTVLGYVDIPAGGSLQNVTGNLSGASGTKSLFFIASGNLTIESWQ

SEQ ID NO: 9685 - protein, 175 aa, Neocallimastix californiae; identical to SEQ ID NO: 9636
  Galactose-binding domain-like

SEQ ID NO: 9686 - protein, 120 aa, Neocallimastix californiae
  Galactose-binding domain-like
VDAFKTYYASMMAWEGGVSINGLGHTTVTYNKGDWTGVSNVDFGNGAYGIKVSAASRNGAVIKIAAGSETGNALGYINIPATGGTNSFKTVTASLSKITGVKNIFFIASGDVVLDTWQFT

SEQ ID NO: 9687 - protein, 139 aa, Neocallimastix californiae
  Galactose-binding domain-like
RATYTTIFRTTSSMPNGYDDWGWGCNISYSGGAMVITPEEGEYGALSLKRISGYFKGGSIRFDMKNEGKVNVMVENSDTDDKITVKSINPSSSYETYILDVDFGSFDRINFQDARGDGSRIWIKNLVHSTGYADEFVDP

SEQ ID NO: 9688 - protein, 151 aa, Neocallimastix californiae
  Galactose-binding domain-like
KVKPTYSVIYEIGGRLNTGYDNWGWDSSLTFKDGSMVVTADKGSYGAASIKNTKKDFGVGGSIRFDVKSKGKLLVKVESTEDKEVAIVGTTDGGESDFKTYIFDIDYDGPFDRINLQDSNGNGDPIYIRYLIYSTGSADDFVDPIDTSRQP

SEQ ID NO: 9689 - protein, 132 aa, Neocallimastix californiae
  Galactose-binding domain-like
YDIIKEGDYMINGKWQNWSWGVENAEFDDDGNLVATITAGTYGGVSFKRSDSTLFGKGTLYFKAMVNDTRAQLQVLFHTTGDEYVNVGSFSKFSDSELVQYSVNIKEPTGDKYDRITIQDVANNGLTLYLND

SEQ ID NO: 9690 - protein, 180 aa, Neocallimastix californiae
  Galactose-binding domain-like
NQNWDLVVEQNAQKAQNHINNGCFKPNYQPSSNNGWKTVQLPKSWTCQGFDFSIYTNVGQPWQSNYDGYVPVPQAPTNYNPVGLYRKKFTVDSTMRQSGRRIYIEFDGVESAYYVYVNGQAIGYSEDTFSPHRFDITDALTNGENTLAVEVHKFCDGTWFEDQDMIYDGGIFRDVFLVSA

SEQ ID NO: 9691 - protein, 144 aa, Neocallimastix californiae
  Galactose-binding domain-like
GYYFHNTFEEDEDTWTGRHTASIQVSQKAAYAGKSSLYCYKREYNWTGAQRTLSPKMFKPGETYSFSVVVRYDEGPASQNFYLTLQYENGTDEVQYDKISIESVKKGEWTQLANANYKIPANAYDMYFYVETEEGEDSFYVDEA

SEQ ID NO: 9692 - protein, 86 aa, Neocallimastix californiae
  Galactose-binding domain-like
YGRGAWTGVSNVDLGSASSITLKASSRSGATIKVCTDSENGNALGYVEIPAGGSLQNVTGQLSGATGTKNLFFVSSGDAVIESWQL

SEQ ID NO: 9693 - protein, 120 aa, Anaeromyces robustus; identical to SEQ ID NO: 9686
  Galactose-binding domain-like

SEQ ID NO: 9694 - protein, 151 aa, Anaeromyces robustus; identical to SEQ ID NO: 9688
  Galactose-binding domain-like

SEQ ID NO: 9695 - protein, 139 aa, Anaeromyces robustus; identical to SEQ ID NO: 9687
  Galactose-binding domain-like

SEQ ID NO: 9696 - protein, 132 aa, Anaeromyces robustus; identical to SEQ ID NO: 9689
  Galactose-binding domain-like

SEQ ID NO: 9697 - protein, 144 aa, Anaeromyces robustus; identical to SEQ ID NO: 9691
  Galactose-binding domain-like

SEQ ID NO: 9698 - protein, 108 aa, Anaeromyces robustus
  Galactose-binding domain-like
AASMAWQSGISVEGHGAVTQVKYGRGAWTGVSNVDLGSASSITLKASSRSGATIKVCTDSENGNALGYVEIPAGGSLQNVTGQLSGATGTKNLFFVSSGDAVIESWQL

SEQ ID NO: 9699 - protein, 107 aa, Anaeromyces robustus
  Galactose-binding domain-like
ASSFAWQSGIKIKGQGEVTTVEYPSGGWTGISQVALGDAKSITIKASSQSGATIKICTGNENGNVLGYVEIPSGGNLKEVTGDLTNATGTQDLFLVASNNVSIESWK

SEQ ID NO: 9700 - protein, 178 aa, Anaeromyces robustus; identical to SEQ ID NO: 9645
  Galactose-binding domain-like

SEQ ID NO: 9701 - protein, 114 aa, Anaeromyces robustus
  Galactose-binding domain-like
DGSAVNPAANMAWQNGISVKGQGAVLPVSYTRGAWTGVSNVALGGASSITLKASSQSGATIKICTESENGQAIGYVDIPAGGSLQNVSGTLSGATGTKNLFFVSSGDATIESWQ

SEQ ID NO: 9702 - protein, 116 aa, Anaeromyces robustus
  Galactose-binding domain-like
DVDGFAVNPAANMAWQYGISVNGQGAVVPVNYNRGAWTGVSNVALGGATSITLKASSKSGATIKICTESENGQALGYVDIPAGGSLQNVSGTLSGATGTKNLFFVSSGDATIESWQ

SEQ ID NO: 9703 - protein, 144 aa, Anaeromyces robustus
  Galactose-binding domain-like
DGYYFHNTFENGTDRWENRGYASVSQSKDDAYKGSGSLYCDNREYNWSGASRSLSSNVFEAGKEYSFSVIVKYNEGPDSQKFYLTLQYDNGTDEIQYDKIATVNVSKDQWVQLANTNYKIPANASDLIFYVETEEGLESFYIDE

SEQ ID NO: 9704 - protein, 95 aa, Piromyces finnis
  Galactose-binding domain-like
GLGHTTVTYRKGTWTGVSGVEFGDNATSVKISAASANGATIRITSGSENGEVIGYVTVPATGDEFVTVTADVSVSGVKDIFFVASDEVVVDTWQF

SEQ ID NO: 9705 - protein, 178 aa, Piromyces finnis
  Galactose-binding domain-like
NENWDLVVEQNSNKAQTHINSGCFKPDYKPSSSWKTVQLPKSWTCQGFDFSIYTNIGQPWQSNYDTDIPVPHAPTNYNPVGLYRKKFMVDSTMRQSGRRIYIEFDGVESAYYVYVNGQGVGYSEDTFSPHRFDITDFLVNGENTLAVEVHKFCDGTWFEDQDMIYDGGIFRDVFLVSA

SEQ ID NO: 9706 - protein, 76 aa, Piromyces finnis; identical to SEQ ID NO: 9651
  Galactose-binding domain-like

SEQ ID NO: 9707 - protein, 150 aa, Piromyces finnis
  Galactose-binding domain-like
DGYYFHNTFENGAERWENRGYASVAQSKDTAYKGNGSLYCEKREYNWSGASRSLSSNVFEPGKEFSFSAVVKYDEGPESQTFFLSLQYNDDSGETQYDKIAIVKVTQGEWVQLANTNYKIPANSSNLMFYIETEEELSSFYVDEAIAAPA

SEQ ID NO: 9708 - protein, 178 aa, Piromyces finnis; identical to SEQ ID NO: 9653
  Galactose-binding domain-like

SEQ ID NO: 9709 - protein, 175 aa, Piromyces finnis
  Galactose-binding domain-like
PIVWEIGIPDRTAMEYKHGNHFNQWGLYHKFKTEFPNSVNYYVGKSNYATDWNYCHVSIQGADGKYMQSPWNIYFNLNKIPTGTSVLRISIAASSYSALSVALNDGKATAEVKDLVDDACIRRDGIRGIWSMKEFTFSSSLLKQGENYISLHARAIGGYLTYYRFDGIMYDHVRL

SEQ ID NO: 9710 - protein, 125 aa, Piromyces finnis
  Galactose-binding domain-like
AVNSEWQNWSWGVNDSEIDENGAMANELNAGDWAGVSFKRSDTTKFGKFTLYFKAMVSDPKAVIQVVVHNSSEEDDYTTVGSFKGLSDSEMKEYSLEVDVDAKYDRITIQDIYNKGYTLYINDVY

SEQ ID NO: 9711 - protein, 139 aa, Piromyces finnis
  Galactose-binding domain-like
LNAAWQDWSWGNDENSFDDDGNYQATFQEEKYGALSLHTGDTFNAGKLHLELKSDTEGAPINIVVHTIEGNEFVTLETISSPSTEELEAYDIDVPAVSGDNYNRISIQDAWGKAITVTVNNIYFIPSEVPQENKPINTN

SEQ ID NO: 9712 - protein, 132 aa, Piromyces finnis
  Galactose-binding domain-like
YDLVKEGDYMIDAKWQNWSWGVENSEFDDDGNMVNYIAAGTYGGVSFKRGDSTLFGKGIFHFKAMVNDTNAQIQVLFHTTADEYVAIGSVSDLSDSELVEYTLEVDEPTAEKYDRFTIQDVANNGLVLTLND

SEQ ID NO: 9713 - protein, 108 aa, Piromyces finnis
  Galactose-binding domain-like
LAASFAWQSGIKIKGQGAVTTVEIPRGGWTGVSHVALGNAKSITIKASSSSGATIKVCTGNEKGDVLGYVEIPAGGSLQEVTAEISNASGTKDLFFVASNSVSMESWQ

SEQ ID NO: 9714 - protein, 95 aa, Piromyces finnis; identical to SEQ ID NO: 9704
  Galactose-binding domain-like

SEQ ID NO: 9715 - protein, 108 aa, Piromyces finnis; identical to SEQ ID NO: 9713
  Galactose-binding domain-like

SEQ ID NO: 9716 - protein, 115 aa, Piromyces finnis
  Galactose-binding domain-like
AYSTNYASMMAWQAGVSVNGLGHTTVSYNRGDWTGVSNVDFGDSATSVKISAASSNGATIRITSGSENGDVIGYVTIPATGGDKNFKTVTANVKASGTKNIFFVASGDVTIDTWQ

SEQ ID NO: 9717 - protein, 108 aa, Piromyces finnis; identical to SEQ ID NO: 9713
  Galactose-binding domain-like

SEQ ID NO: 9718 - protein, 115 aa, Piromyces finnis; identical to SEQ ID NO: 9716
  Galactose-binding domain-like

SEQ ID NO: 9719 - protein, 115 aa, Piromyces finnis; identical to SEQ ID NO: 9716
  Galactose-binding domain-like

SEQ ID NO: 9720 - protein, 108 aa, Piromyces finnis; identical to SEQ ID NO: 9713
  Galactose-binding domain-like

SEQ ID NO: 9721 - protein, 107 aa, Piromyces finnis
  Galactose-binding domain-like
AASFAWQYGISVKGQAAVTTVNYSRGGWTGVSNVALGNAQSITLKASSKSGATVKICTGSENGQAIGYVDIPAGGSLQNVTGSISGASGTKNLFFVASGDLSIESWQ

SEQ ID NO: 9722 - protein, 115 aa, Piromyces finnis; identical to SEQ ID NO: 9716
  Galactose-binding domain-like

SEQ ID NO: 9723 - protein, 95 aa, Piromyces finnis; identical to SEQ ID NO: 9704
  Galactose-binding domain-like

SEQ ID NO: 9724 - protein, 95 aa, Piromyces finnis; identical to SEQ ID NO: 9704
  Galactose-binding domain-like

SEQ ID NO: 9725 - protein, 107 aa, Piromyces finnis; identical to SEQ ID NO: 9721
  Galactose-binding domain-like

SEQ ID NO: 9726 - protein, 120 aa, Piromyces finnis
  Galactose-binding domain-like
SKKVYYEAEDGKLDGITVYKDLSGFSGTGYVGRFENPGNSITVTVNAPSTGMYDLSIIYCANMGQKINTLMVNGQSAGDVTFTENKKFESKDVGAIYLNKGKNTIGLVASWGWMWVDAFV

SEQ ID NO: 9727 - protein, 103 aa, Piromyces finnis
  Galactose-binding domain-like
EYTVLYANTDALPDTTSNQSWSAEISFTDNCMTGVIEENAWGALSLKYEGELFENGSLRFDIKSSFDNAPVTVYAQNFETEDAIVISKVAAGTKWNTVTVDIE

SEQ ID NO: 9728 - protein, 20 aa, Neocallimastix californiae
  GDHRDH
EMVELLKPEYTAPLISFLTH

SEQ ID NO: 9729 - protein, 17 aa, Neocallimastix californiae
  GDHRDH
VVIITGAGGGLGRAYAK

SEQ ID NO: 9730 - protein, 16 aa, Neocallimastix californiae
  GDHRDH
MMKQKYGRIINITSAA

SEQ ID NO: 9731 - protein, 11 aa, Neocallimastix californiae
  GDHRDH
GRVDIIINNAG

SEQ ID NO: 9732 - protein, 19 aa, Neocallimastix californiae
  GDHRDH
YAAAKSGVIGLTNALALEG

SEQ ID NO: 9733 - protein, 17 aa, Neocallimastix californiae
  GDHRDH
YNITVNSVAPNAGTRMT

SEQ ID NO: 9734 - protein, 17 aa, Neocallimastix californiae
  GDHRDH
VVIVTGAGGGLGRAYAK

SEQ ID NO: 9735 - protein, 19 aa, Neocallimastix californiae
  GDHRDH
YAAAKSGVIGLTNALALEG

SEQ ID NO: 9736 - protein, 11 aa, Neocallimastix californiae
  GDHRDH
GRVDIIINNAG

SEQ ID NO: 9737 - protein, 16 aa, Neocallimastix californiae
  GDHRDH
MMKQKYGRIINITSAA

SEQ ID NO: 9738 - protein, 17 aa, Neocallimastix californiae
  GDHRDH
HNITINSVAPNAGTRMT

SEQ ID NO: 9739 - protein, 16 aa, Anaeromyces robustus
  GDHRDH
MIKQKYGRIINITSAA

SEQ ID NO: 9740 - protein, 17 aa, Anaeromyces robustus
  GDHRDH
HNITINSVAPNAGTRMT

SEQ ID NO: 9741 - protein, 11 aa, Anaeromyces robustus
  GDHRDH
GRVDVIINNAG

SEQ ID NO: 9742 - protein, 19 aa, Anaeromyces robustus
  GDHRDH
YAAAKSGVIGFTNALALEG

SEQ ID NO: 9743 - protein, 17 aa, Anaeromyces robustus
  GDHRDH
VVIVTGAGGGLGRAYAK

SEQ ID NO: 9744 - protein, 17 aa, Piromyces finnis
  GDHRDH
VVIVTGAGGGLGRAYAK

SEQ ID NO: 9745 - protein, 16 aa, Piromyces finnis
  GDHRDH
MVKQKYGRIINITSAA

SEQ ID NO: 9746 - protein, 19 aa, Piromyces finnis
  GDHRDH
YAAAKAGVIGLTNTLALEG

SEQ ID NO: 9747 - protein, 11 aa, Piromyces finnis
  GDHRDH
GRVDVIINNAG

SEQ ID NO: 9748 - protein, 17 aa, Piromyces finnis
  GDHRDH
HNITVNSIAPNAGTRMT

SEQ ID NO: 9749 - protein, 368 aa, Neocallimastix californiae
  GH_fam_N_dom
KLWYDSPARAWTDALPVGNSHLGGMVYGGAQRDEIQLNEDTFWAGGPHNNIPRNAASALPQARRMIFEGRFGQAQDYIDKNFFTGQNGMGYLTLGSLFINFSDVSGFSNYYRDLDLNNAIATSKFTANGSNIERSLFASMADDVIVYNIATDGKPLNFSVNHKCPLQTNASSSGNRLILKIRGKDQEGVGAKLNAYVIVEIVSDGRVSASGSSLNVSNAKEATILISAATNFVNYHDVSGDAAKKAEAALSKVKNVDYSTLKSKHIEAYKKQFDRVKISLPTSSASADQTVNRILNFNRSDDQDLVALMFQYGRYLLITSSQPGGQAANLQGIWNDSTDAPWDSKYTININAQMNYWPAEVTNLSECH

SEQ ID NO: 9750 - protein, 26 aa, Neocallimastix californiae
  GH_fam_N_dom
KLWYNSPATTWTEALPVGNSHLGGMV

SEQ ID NO: 9751 - protein, 367 aa, Anaeromyces robustus
  GH_fam_N_dom
KLWYNNPAGEWTEALPVGNSHLGAMIYGGAQRDELQLNEDTFWAGGPHNNIPGNAANALPQARQMIFEGRFGQAENYINQNFFTGQNGMGYLTLGSLFINFSDIKDYSNYYRELDISNAIATTTFNANGGSMERTLFASMTDDVLVYHISSEKATSFSLSHKCALSTSVSSSGNRLIIQVRGKDQEGVRGQLSAYGIAEVVTDGRVSASGSSLSVSGAKEAMIIFSAATNFVNYRDVSGDAKKKVEATLQKVKNVAYETLKERHIEAYKKQFDRVKIALPVNSSAQNPTMDRLANFNRSGDQDLVALMFQYGRYLLISSSQPGGQPANLQGIWNDSTDAPWDSKYTININAQMNYWPAEVTNLSECH

SEQ ID NO: 9752 - protein, 370 aa, Anaeromyces robustus
  GH_fam_N_dom
KLWYDIPAREWTEALPVGNSHLGAMIYGGVQRDELQLNEETFWGGGPHNNVVNNAFPKIQQARQMIFDGKFMQAENYINQNCLSGIDGMPYLPLGSLFINYSDIKEYSNYYRELDISNAMTTTKFTANGVNMERTLFASMTDDVLVYHITSDPKKPISFSLSYQFPRLTNSISTSGNRLIIKVNGKDHEGVKGRVTAYGIAEVVTDGKVNGNGSTLSVSGANEAIIFFSAATNFVNYKDVSGDPKKKAEAALEKVINTSYETLKKRHIEAYKKQFDRVKLSLPMNAYALNPTMDRLANFNKSGDQDLVTLMFQYGRYLLISSSQPGGQPATLQGIWNDNIDAPWDSKYTININIQMNYWPAEVTNLSECH

SEQ ID NO: 9753 - protein, 367 aa, Piromyces finnis
  GH_fam_N_dom
KLWYNSPANAWTEALPVGNSHLGGMVFGGAQTDEIQLNEETFWAGGPHNNIPQRANSVLSQARQLIFSSKFGDAQNLIDKNFFSGQNGMGYLTLGSLYIKFSDVKDVSNYYRDLDLNTAIATSKFTSNGMNVERSLFASMADNVLAYKITNENKPISFTVSHKCQLSTSVSTSNNRMILKIRGKDQEGVGSKLSAYGIVEIVTDGRVSASGSSLSVSGAYDTVIYITAATNFVSYNDVSGDAQKKAEAAIQSALKSTYSSLKDKHLAAYKKQFDRVKISLPVNSNAENQTVDRLANFNRSGDQDLIALMFQYGRYLLITSSQPGGQPANLQGIWNDSIDAPWDSKYTININTEMNYWPAEVTNLSEC

SEQ ID NO: 9754 - protein, 63 aa, Neocallimastix californiae
  GH04125P-RELATED
EISQVVRIECDEKGTTAAAVTEVHGSAKALPKTPIIFNFICNRPFIYVLYDNVNDDIGFVGQV

SEQ ID NO: 9755 - protein, 95 aa, Neocallimastix californiae
  GH97_C
RWDGLKLINGEVGRYYNLARRTGDRWFAAGVSVEARDMKWKPTFLDSNKKYTATLYRERGNNRQALEIVTLKNVTPNTELNIHVMNGGGYAIKFT

SEQ ID NO: 9756 - protein, 251 aa, Neocallimastix californiae
  GH97_N
VYSPNQKTFITFELDNGNGSLFYLVKQDDKDLVERSPLGIKTNLGDFTNGLNFKEVHVKIVNEKYPTYSGKKDEYVNHYVEKTIIFNSSRNSNVDFGIVARSYNDGVAFRYIIITGDHKELTIEPNDEVTGIKLPDDATVWEMSYNYEEFMYEEEFEEKTINDIGRNVKPTMPMLFRTGDDKYGLVTEAVKVGTYVGSHLEVDYDHVLRFKFDDHQRSAVKTQTPFQSPWRAFVVGGLDEIMENTMVENLS

SEQ ID NO: 9757 - protein, 12 aa, Neocallimastix californiae
  GLHYDRLASE10
RNIPIDGVGLQY

SEQ ID NO: 9758 - protein, 11 aa, Neocallimastix californiae
  GLHYDRLASE10
IDTWDVVNEAI

SEQ ID NO: 9759 - protein, 11 aa, Neocallimastix californiae
  GLHYDRLASE10
VKLFYNDYNTE

SEQ ID NO: 9760 - protein, 12 aa, Neocallimastix californiae
  GLHYDRLASE10
FRGHALIWHSMA

SEQ ID NO: 9761 - protein, 11 aa, Neocallimastix californiae
  GLHYDRLASE10
IIYWDVINESV

SEQ ID NO: 9762 - protein, 12 aa, Neocallimastix californiae
  GLHYDRLASE10
FRGHNLFWPAYS

SEQ ID NO: 9763 - protein, 11 aa, Neocallimastix californiae
  GLHYDRLASE10
VKLFYNDYNAE

SEQ ID NO: 9764 - protein, 12 aa, Neocallimastix californiae
  GLHYDRLASE10
KGVPIDGVGLQM

SEQ ID NO: 9765 - protein, 12 aa, Neocallimastix californiae
  GLHYDRLASE10
FRGHALVWHSMA

SEQ ID NO: 9766 - protein, 11 aa, Neocallimastix californiae
  GLHYDRLASE10
VKLFYNDYNTE

SEQ ID NO: 9767 - protein, 12 aa, Neocallimastix californiae
  GLHYDRLASE10
RNIPIDGVGIQY

SEQ ID NO: 9768 - protein, 11 aa, Neocallimastix californiae
  GLHYDRLASE10
IDTWDVVNEAI

SEQ ID NO: 9769 - protein, 11 aa, Neocallimastix californiae
  GLHYDRLASE10
VDVWDVVNEAV

SEQ ID NO: 9770 - protein, 11 aa, Neocallimastix californiae
  GLHYDRLASE10
VKLIYNDYNTF

SEQ ID NO: 9771 - protein, 12 aa, Neocallimastix californiae
  GLHYDRLASE10
AENLVDGVGLQS

SEQ ID NO: 9772 - protein, 12 aa, Neocallimastix californiae
  GLHYDRLASE10
MRGHTLVWHVQT

SEQ ID NO: 9773 - protein, 12 aa, Neocallimastix californiae
  GLHYDRLASE10
MRGHTLVWHTQA

SEQ ID NO: 9774 - protein, 12 aa, Neocallimastix californiae
  GLHYDRLASE10
AENLIDGVGLQS

SEQ ID NO: 9775 - protein, 11 aa, Neocallimastix californiae
  GLHYDRLASE10
VKLIYNDFNTF

SEQ ID NO: 9776 - protein, 11 aa, Neocallimastix californiae
  GLHYDRLASE10
IDVWDVVNEAV

SEQ ID NO: 9777 - protein, 12 aa, Neocallimastix californiae
  GLHYDRLASE10
FRGHALIWHAMA

SEQ ID NO: 9778 - protein, 11 aa, Neocallimastix californiae
  GLHYDRLASE10
TKLFYNDYNTE

SEQ ID NO: 9779 - protein, 11 aa, Neocallimastix californiae
  GLHYDRLASE10
IDTWDVVNEAL

SEQ ID NO: 9780 - protein, 12 aa, Neocallimastix californiae
  GLHYDRLASE10
RNIPIDGVGIQY

SEQ ID NO: 9781 - protein, 11 aa, Neocallimastix californiae
  GLHYDRLASE10
TKLFYNDYNTE

SEQ ID NO: 9782 - protein, 12 aa, Neocallimastix californiae
  GLHYDRLASE10
RNIPIDGVGIQY

SEQ ID NO: 9783 - protein, 11 aa, Neocallimastix californiae
  GLHYDRLASE10
IDTWDVVNEAI

SEQ ID NO: 9784 - protein, 12 aa, Neocallimastix californiae
  GLHYDRLASE10
FRGHALIWHAMA

SEQ ID NO: 9785 - protein, 12 aa, Neocallimastix californiae
  GLHYDRLASE10
RNIPIDGVGIQY

SEQ ID NO: 9786 - protein, 11 aa, Neocallimastix californiae
  GLHYDRLASE10
IDTWDVVNEAI

SEQ ID NO: 9787 - protein, 11 aa, Neocallimastix californiae
  GLHYDRLASE10
TKLFYNDYNTE

SEQ ID NO: 9788 - protein, 12 aa, Neocallimastix californiae
  GLHYDRLASE10
FRGHCLIWHAYQ

SEQ ID NO: 9789 - protein, 11 aa, Neocallimastix californiae
  GLHYDRLASE10
IDTWDVVNEAI

SEQ ID NO: 9790 - protein, 11 aa, Neocallimastix californiae
  GLHYDRLASE10
TKLFYNDYNTE

SEQ ID NO: 9791 - protein, 12 aa, Neocallimastix californiae
  GLHYDRLASE10
RNIPIDGVGIQY

SEQ ID NO: 9792 - protein, 11 aa, Neocallimastix californiae
  GLHYDRLASE10
IDTWDVVNEAI

SEQ ID NO: 9793 - protein, 11 aa, Neocallimastix californiae
  GLHYDRLASE10
TKLFYNDYNTE

SEQ ID NO: 9794 - protein, 12 aa, Neocallimastix californiae
  GLHYDRLASE10
RNIPIDGVGIQY

SEQ ID NO: 9795 - protein, 12 aa, Neocallimastix californiae
  GLHYDRLASE10
FRGHCLIWHSYQ

SEQ ID NO: 9796 - protein, 12 aa, Neocallimastix californiae
  GLHYDRLASE10
MRGHVLVWHNQV

SEQ ID NO: 9797 - protein, 11 aa, Neocallimastix californiae
  GLHYDRLASE10
VDVWDVVNEAV

SEQ ID NO: 9798 - protein, 12 aa, Neocallimastix californiae
  GLHYDRLASE10
KEDLVDAIGMQS

SEQ ID NO: 9799 - protein, 11 aa, Neocallimastix californiae
  GLHYDRLASE10
VKLVYNDYCTY

SEQ ID NO: 9800 - protein, 11 aa, Neocallimastix californiae
  GLHYDRLASE10
IDVWDVVNEAI

SEQ ID NO: 9801 - protein, 12 aa, Neocallimastix californiae
  GLHYDRLASE10
VRGHVLVWHTQT

SEQ ID NO: 9802 - protein, 11 aa, Neocallimastix californiae
  GLHYDRLASE10
VKLVYNDYNTF

SEQ ID NO: 9803 - protein, 12 aa, Neocallimastix californiae
  GLHYDRLASE10
KDNLVDALGMQS

SEQ ID NO: 9804 - protein, 11 aa, Neocallimastix californiae
  GLHYDRLASE10
VDVWDVVNEAV

SEQ ID NO: 9805 - protein, 12 aa, Neocallimastix californiae
  GLHYDRLASE10
MRGHTLVWHVQA

SEQ ID NO: 9806 - protein, 11 aa, Neocallimastix californiae
  GLHYDRLASE10
VKLVYNDFNTF

SEQ ID NO: 9807 - protein, 12 aa, Neocallimastix californiae
  GLHYDRLASE10
AENLIDGVGLQS

SEQ ID NO: 9808 - protein, 12 aa, Neocallimastix californiae
  GLHYDRLASE10
YRGHNLFWPANS

SEQ ID NO: 9809 - protein, 11 aa, Neocallimastix californiae
  GLHYDRLASE10
VKLIYNDYNAE

SEQ ID NO: 9810 - protein, 11 aa, Neocallimastix californiae
  GLHYDRLASE10
IIYWDVINESV

SEQ ID NO: 9811 - protein, 12 aa, Neocallimastix californiae
  GLHYDRLASE10
NGVPIDGVGLQM

SEQ ID NO: 9812 - protein, 12 aa, Neocallimastix californiae
  GLHYDRLASE10
MRGHVLVWHNQA

SEQ ID NO: 9813 - protein, 11 aa, Neocallimastix californiae
  GLHYDRLASE10
VDVWDVVNEAI

SEQ ID NO: 9814 - protein, 11 aa, Neocallimastix californiae
  GLHYDRLASE10
VKLVYNDYSTF

SEQ ID NO: 9815 - protein, 12 aa, Neocallimastix californiae
  GLHYDRLASE10
KEDLVDAIGMQS

SEQ ID NO: 9816 - protein, 11 aa, Neocallimastix californiae
  GLHYDRLASE10
TKLVYNDVDTF

SEQ ID NO: 9817 - protein, 12 aa, Neocallimastix californiae
  GLHYDRLASE10
AEDLVDALGMES

SEQ ID NO: 9818 - protein, 12 aa, Neocallimastix californiae
  GLHYDRLASE10
IRGHVLVWHKQT

SEQ ID NO: 9819 - protein, 11 aa, Neocallimastix californiae
  GLHYDRLASE10
VDVFDVVNEAI

SEQ ID NO: 9820 - protein, 11 aa, Neocallimastix californiae
  GLHYDRLASE10
VKLIYNDYYCE

SEQ ID NO: 9821 - protein, 12 aa, Neocallimastix californiae
  GLHYDRLASE10
YRGHNLFWPANS

SEQ ID NO: 9822 - protein, 11 aa, Neocallimastix californiae
  GLHYDRLASE10
IIYWDVINESV

SEQ ID NO: 9823 - protein, 12 aa, Neocallimastix californiae
  GLHYDRLASE10
KEVPIDGVGLQM

SEQ ID NO: 9824 - protein, 12 aa, Neocallimastix californiae
  GLHYDRLASE10
MRGHTLVWHVQT

SEQ ID NO: 9825 - protein, 12 aa, Neocallimastix californiae
  GLHYDRLASE10
SENLIDGVGLQS

SEQ ID NO: 9826 - protein, 11 aa, Neocallimastix californiae
  GLHYDRLASE10
VDVWDVVNEAV

SEQ ID NO: 9827 - protein, 11 aa, Neocallimastix californiae
  GLHYDRLASE10
VKLIYNDYNTF

SEQ ID NO: 9828 - protein, 11 aa, Neocallimastix californiae
  GLHYDRLASE10
VDVWDVVNEAI

SEQ ID NO: 9829 - protein, 11 aa, Neocallimastix californiae
  GLHYDRLASE10
VKLVYNDFNTF

SEQ ID NO: 9830 - protein, 12 aa, Neocallimastix californiae
  GLHYDRLASE10
KEDLIDGIGLQS

SEQ ID NO: 9831 - protein, 12 aa, Neocallimastix californiae
  GLHYDRLASE10
IRGHVLIWHTQT

SEQ ID NO: 9832 - protein, 11 aa, Neocallimastix californiae
  GLHYDRLASE10
TKLFYNDYNTE

SEQ ID NO: 9833 - protein, 12 aa, Neocallimastix californiae
  GLHYDRLASE10
FRGHALVWHSMA

SEQ ID NO: 9834 - protein, 12 aa, Neocallimastix californiae
  GLHYDRLASE10
RNIPIDGVGIQY

SEQ ID NO: 9835 - protein, 11 aa, Neocallimastix californiae
  GLHYDRLASE10
IDTWDVVNEAI

SEQ ID NO: 9836 - protein, 12 aa, Neocallimastix californiae
  GLHYDRLASE10
IRGHVLVWHKQT

SEQ ID NO: 9837 - protein, 11 aa, Neocallimastix californiae
  GLHYDRLASE10
VKLVYNDYNTF

SEQ ID NO: 9838 - protein, 11 aa, Neocallimastix californiae
  GLHYDRLASE10
IDVWDVVNEAV

SEQ ID NO: 9839 - protein, 12 aa, Neocallimastix californiae
  GLHYDRLASE10
KDNLIDAIGMQS

SEQ ID NO: 9840 - protein, 12 aa, Neocallimastix californiae
  GLHYDRLASE10
MRGHTLVWHTQT

SEQ ID NO: 9841 - protein, 11 aa, Neocallimastix californiae
  GLHYDRLASE10
VDVWDVVNEAV

SEQ ID NO: 9842 - protein, 12 aa, Neocallimastix californiae
  GLHYDRLASE10
EENLIDGIGMQS

SEQ ID NO: 9843 - protein, 11 aa, Neocallimastix californiae
  GLHYDRLASE10
VKLIYNDYNTF

SEQ ID NO: 9844 - protein, 12 aa, Neocallimastix californiae
  GLHYDRLASE10
FRGHALIWHSMA

SEQ ID NO: 9845 - protein, 11 aa, Neocallimastix californiae
  GLHYDRLASE10
IDTWDVVNEAI

SEQ ID NO: 9846 - protein, 12 aa, Neocallimastix californiae
  GLHYDRLASE10
RNIPIDGVGLQY

SEQ ID NO: 9847 - protein, 11 aa, Neocallimastix californiae
  GLHYDRLASE10
TKLFYNDYNTE

SEQ ID NO: 9848 - protein, 12 aa, Neocallimastix californiae
  GLHYDRLASE10
KDVPIDGVGLQM

SEQ ID NO: 9849 - protein, 11 aa, Neocallimastix californiae
  GLHYDRLASE10
IIYWDVINESV

SEQ ID NO: 9850 - protein, 11 aa, Neocallimastix californiae
  GLHYDRLASE10
VKLFYNDYNAE

SEQ ID NO: 9851 - protein, 11 aa, Anaeromyces robustus
  GLHYDRLASE10
TKLFYNDYNTE

SEQ ID NO: 9852 - protein, 11 aa, Anaeromyces robustus
  GLHYDRLASE10
IDTWDVVNEAI

SEQ ID NO: 9853 - protein, 12 aa, Anaeromyces robustus
  GLHYDRLASE10
RNIPIDGVGIQY

SEQ ID NO: 9854 - protein, 12 aa, Anaeromyces robustus
  GLHYDRLASE10
FRGHALVWHSMA

SEQ ID NO: 9855 - protein, 11 aa, Anaeromyces robustus
  GLHYDRLASE10
IIYWDVINESV

SEQ ID NO: 9856 - protein, 12 aa, Anaeromyces robustus
  GLHYDRLASE10
KDVPIDGVGLQM

SEQ ID NO: 9857 - protein, 11 aa, Anaeromyces robustus
  GLHYDRLASE10
VKLFYNDYNAE

SEQ ID NO: 9858 - protein, 12 aa, Anaeromyces robustus
  GLHYDRLASE10
FRGHNLFWPAYS

SEQ ID NO: 9859 - protein, 12 aa, Anaeromyces robustus
  GLHYDRLASE10
RNIPIDGVGIQY

SEQ ID NO: 9860 - protein, 11 aa, Anaeromyces robustus
  GLHYDRLASE10
IDAWDVVNEAI

SEQ ID NO: 9861 - protein, 11 aa, Anaeromyces robustus
  GLHYDRLASE10
VKLFYNDYNTE

SEQ ID NO: 9862 - protein, 12 aa, Anaeromyces robustus
  GLHYDRLASE10
FRGHCLIWHAYQ

SEQ ID NO: 9863 - protein, 11 aa, Anaeromyces robustus
  GLHYDRLASE10
TKLFYNDYNTE

SEQ ID NO: 9864 - protein, 12 aa, Anaeromyces robustus
  GLHYDRLASE10
FRGHALIWHSMA

SEQ ID NO: 9865 - protein, 11 aa, Anaeromyces robustus
  GLHYDRLASE10
IDTWDVVNEAI

SEQ ID NO: 9866 - protein, 12 aa, Anaeromyces robustus
  GLHYDRLASE10
RNIPIDGVGIQY

SEQ ID NO: 9867 - protein, 12 aa, Anaeromyces robustus
  GLHYDRLASE10
AENLVDGVGLQS

SEQ ID NO: 9868 - protein, 12 aa, Anaeromyces robustus
  GLHYDRLASE10
MRGHTLVWHTQT

SEQ ID NO: 9869 - protein, 11 aa, Anaeromyces robustus
  GLHYDRLASE10
VDVWDVVNEAV

SEQ ID NO: 9870 - protein, 11 aa, Anaeromyces robustus
  GLHYDRLASE10
VKLIYNDYNTF

SEQ ID NO: 9871 - protein, 11 aa, Anaeromyces robustus
  GLHYDRLASE10
TKLVYNDYDTW

SEQ ID NO: 9872 - protein, 12 aa, Anaeromyces robustus
  GLHYDRLASE10
IRGHVLVWHKQT

SEQ ID NO: 9873 - protein, 11 aa, Anaeromyces robustus
  GLHYDRLASE10
VDVVDVVNEAV

SEQ ID NO: 9874 - protein, 12 aa, Piromyces finnis
  GLHYDRLASE10
IRGHALVWHTQV

SEQ ID NO: 9875 - protein, 12 aa, Piromyces finnis
  GLHYDRLASE10
QENLIDGIGMQS

SEQ ID NO: 9876 - protein, 11 aa, Piromyces finnis
  GLHYDRLASE10
VDVWDVVNEAI

SEQ ID NO: 9877 - protein, 11 aa, Piromyces finnis
  GLHYDRLASE10
VKLIYNDHNTF

SEQ ID NO: 9878 - protein, 12 aa, Piromyces finnis
  GLHYDRLASE10
KGIPIDGVGLQM

SEQ ID NO: 9879 - protein, 11 aa, Piromyces finnis
  GLHYDRLASE10
IIYWDVVNESV

SEQ ID NO: 9880 - protein, 11 aa, Piromyces finnis
  GLHYDRLASE10
VKLIYNDYNAE

SEQ ID NO: 9881 - protein, 12 aa, Piromyces finnis
  GLHYDRLASE10
FRGHNLFWPANS

SEQ ID NO: 9882 - protein, 11 aa, Piromyces finnis
  GLHYDRLASE10
IDTWDVVNEAI

SEQ ID NO: 9883 - protein, 11 aa, Piromyces finnis
  GLHYDRLASE10
TKLFYNDYNTE

SEQ ID NO: 9884 - protein, 12 aa, Piromyces finnis
  GLHYDRLASE10
RGIPIDGVGIQY

SEQ ID NO: 9885 - protein, 12 aa, Piromyces finnis
  GLHYDRLASE10
FRGHALIWHAYM

SEQ ID NO: 9886 - protein, 12 aa, Piromyces finnis
  GLHYDRLASE10
FRGHALIWHAYM

SEQ ID NO: 9887 - protein, 11 aa, Piromyces finnis
  GLHYDRLASE10
IDTWDVVNEAI

SEQ ID NO: 9888 - protein, 11 aa, Piromyces finnis
  GLHYDRLASE10
TKLFYNDYNTE

SEQ ID NO: 9889 - protein, 12 aa, Piromyces finnis
  GLHYDRLASE10
RGIPIDGVGIQY

SEQ ID NO: 9890 - protein, 8 aa, Neocallimastix californiae
  GLHYDRLASE11
WEKLGLRI

SEQ ID NO: 9891 - protein, 10 aa, Neocallimastix californiae
  GLHYDRLASE11
PQIEYYVVDD

SEQ ID NO: 9892 - protein, 5 aa, Neocallimastix californiae
  GLHYDRLASE11
QSTFT

SEQ ID NO: 9893 - protein, 9 aa, Neocallimastix californiae
  GLHYDRLASE11
QIFSVRTEQ

SEQ ID NO: 9894 - protein, 6 aa, Neocallimastix californiae
  GLHYDRLASE11
DGGTYK

SEQ ID NO: 9895 - protein, 9 aa, Neocallimastix californiae
  GLHYDRLASE11
YVGVYGWMD

SEQ ID NO: 9896 - protein, 8 aa, Neocallimastix californiae
  GLHYDRLASE11
WEKLGLKM

SEQ ID NO: 9897 - protein, 9 aa, Neocallimastix californiae
  GLHYDRLASE11
YVGVYGWTL

SEQ ID NO: 9898 - protein, 9 aa, Neocallimastix californiae
  GLHYDRLASE11
QYFSLRREP

SEQ ID NO: 9899 - protein, 10 aa, Neocallimastix californiae
  GLHYDRLASE11
GVFEFYIVDN

SEQ ID NO: 9900 - protein, 9 aa, Neocallimastix californiae
  GLHYDRLASE11
YIGIYGWTR

SEQ ID NO: 9901 - protein, 10 aa, Neocallimastix californiae
  GLHYDRLASE11
PLVEFYVVDN

SEQ ID NO: 9902 - protein, 6 aa, Neocallimastix californiae
  GLHYDRLASE11
DGARYT

SEQ ID NO: 9903 - protein, 9 aa, Neocallimastix californiae
  GLHYDRLASE11
QYFSIRQTA

SEQ ID NO: 9904 - protein, 8 aa, Neocallimastix californiae
  GLHYDRLASE11
WEKLGMTM

SEQ ID NO: 9905 - protein, 6 aa, Neocallimastix californiae
  GLHYDRLASE11
DGATYT

SEQ ID NO: 9906 - protein, 10 aa, Neocallimastix californiae
  GLHYDRLASE11
PLVEFYVVDN

SEQ ID NO: 9907 - protein, 9 aa, Neocallimastix californiae
  GLHYDRLASE11
QFFSIRKEA

SEQ ID NO: 9908 - protein, 8 aa, Neocallimastix californiae
  GLHYDRLASE11
WEKLGMKL

SEQ ID NO: 9909 - protein, 6 aa, Neocallimastix californiae
  GLHYDRLASE11
DGAKYT

SEQ ID NO: 9910 - protein, 8 aa, Neocallimastix californiae
  GLHYDRLASE11
WEKLGMKL

SEQ ID NO: 9911 - protein, 10 aa, Neocallimastix californiae
  GLHYDRLASE11
PLVEFYVVDN

SEQ ID NO: 9912 - protein, 9 aa, Neocallimastix californiae
  GLHYDRLASE11
QFFSIRQTA

SEQ ID NO: 9913 - protein, 9 aa, Neocallimastix californiae
  GLHYDRLASE11
YVGIYGWTR

SEQ ID NO: 9914 - protein, 10 aa, Neocallimastix californiae
  GLHYDRLASE11
PLVEYYVVDN

SEQ ID NO: 9915 - protein, 9 aa, Neocallimastix californiae
  GLHYDRLASE11
YIGIYGWTR

SEQ ID NO: 9916 - protein, 9 aa, Neocallimastix californiae
  GLHYDRLASE11
QYFSIRKEA

SEQ ID NO: 9917 - protein, 6 aa, Neocallimastix californiae
  GLHYDRLASE11
DGAEYT

SEQ ID NO: 9918 - protein, 10 aa, Neocallimastix californiae
  GLHYDRLASE11
PQIEYYVVDD

SEQ ID NO: 9919 - protein, 6 aa, Neocallimastix californiae
  GLHYDRLASE11
DGGTYK

SEQ ID NO: 9920 - protein, 9 aa, Neocallimastix californiae
  GLHYDRLASE11
YIGIYGWMD

SEQ ID NO: 9921 - protein, 8 aa, Neocallimastix californiae
  GLHYDRLASE11
WEKLGLRI

SEQ ID NO: 9922 - protein, 5 aa, Neocallimastix californiae
  GLHYDRLASE11
QSTFT

SEQ ID NO: 9923 - protein, 9 aa, Neocallimastix californiae
  GLHYDRLASE11
QIFSVRTSQ

SEQ ID NO: 9924 - protein, 9 aa, Neocallimastix californiae
  GLHYDRLASE11
QYFSIRKEA

SEQ ID NO: 9925 - protein, 10 aa, Neocallimastix californiae
  GLHYDRLASE11
PLVEYYVVDN

SEQ ID NO: 9926 - protein, 6 aa, Neocallimastix californiae
  GLHYDRLASE11
DGAEYT

SEQ ID NO: 9927 - protein, 9 aa, Neocallimastix californiae
  GLHYDRLASE11
YIGIYGWTR

SEQ ID NO: 9928 - protein, 8 aa, Neocallimastix californiae
  GLHYDRLASE11
WEELGLTL

SEQ ID NO: 9929 - protein, 6 aa, Neocallimastix californiae
  GLHYDRLASE11
DGDTYE

SEQ ID NO: 9930 - protein, 5 aa, Neocallimastix californiae
  GLHYDRLASE11
TSTFP

SEQ ID NO: 9931 - protein, 9 aa, Neocallimastix californiae
  GLHYDRLASE11
YIGIYGWTV

SEQ ID NO: 9932 - protein, 9 aa, Neocallimastix californiae
  GLHYDRLASE11
QFFSVRRSA

SEQ ID NO: 9933 - protein, 10 aa, Neocallimastix californiae
  GLHYDRLASE11
PLVEYYIVDD

SEQ ID NO: 9934 - protein, 8 aa, Neocallimastix californiae
  GLHYDRLASE11
WESLGMKL

SEQ ID NO: 9935 - protein, 9 aa, Neocallimastix californiae
  GLHYDRLASE11
YVGVYGWTR

SEQ ID NO: 9936 - protein, 6 aa, Neocallimastix californiae
  GLHYDRLASE11
DGAQYT

SEQ ID NO: 9937 - protein, 8 aa, Neocallimastix californiae
  GLHYDRLASE11
WEKLGMKL

SEQ ID NO: 9938 - protein, 10 aa, Neocallimastix californiae
  GLHYDRLASE11
PLVEYYIVDN

SEQ ID NO: 9939 - protein, 9 aa, Neocallimastix californiae
  GLHYDRLASE11
QYFSIRQQA

SEQ ID NO: 9940 - protein, 9 aa, Neocallimastix californiae
  GLHYDRLASE11
QYFSLRTSP

SEQ ID NO: 9941 - protein, 8 aa, Neocallimastix californiae
  GLHYDRLASE11
WEKIGLKM

SEQ ID NO: 9942 - protein, 10 aa, Neocallimastix californiae
  GLHYDRLASE11
GVFEFYIVDN

SEQ ID NO: 9943 - protein, 9 aa, Neocallimastix californiae
  GLHYDRLASE11
YVGVYGWTL

SEQ ID NO: 9944 - protein, 9 aa, Anaeromyces robustus
  GLHYDRLASE11
YIGIYGWTV

SEQ ID NO: 9945 - protein, 8 aa, Anaeromyces robustus
  GLHYDRLASE11
WESLGMKL

SEQ ID NO: 9946 - protein, 6 aa, Anaeromyces robustus
  GLHYDRLASE11
DGDTYE

SEQ ID NO: 9947 - protein, 9 aa, Anaeromyces robustus
  GLHYDRLASE11
QFFSVRRSA

SEQ ID NO: 9948 - protein, 5 aa, Anaeromyces robustus
  GLHYDRLASE11
TSTFP

SEQ ID NO: 9949 - protein, 10 aa, Anaeromyces robustus
  GLHYDRLASE11
PLVEYYIVDD

SEQ ID NO: 9950 - protein, 9 aa, Anaeromyces robustus
  GLHYDRLASE11
QYFSLRTSP

SEQ ID NO: 9951 - protein, 10 aa, Anaeromyces robustus
  GLHYDRLASE11
GVFEFYIVDN

SEQ ID NO: 9952 - protein, 8 aa, Anaeromyces robustus
  GLHYDRLASE11
WEKIGLKM

SEQ ID NO: 9953 - protein, 9 aa, Anaeromyces robustus
  GLHYDRLASE11
YVGVYGWTL

SEQ ID NO: 9954 - protein, 9 aa, Anaeromyces robustus
  GLHYDRLASE11
YVGIYGWTR

SEQ ID NO: 9955 - protein, 6 aa, Anaeromyces robustus
  GLHYDRLASE11
DGAKYT

SEQ ID NO: 9956 - protein, 9 aa, Anaeromyces robustus
  GLHYDRLASE11
QYFSIRQQP

SEQ ID NO: 9957 - protein, 8 aa, Anaeromyces robustus
  GLHYDRLASE11
WEKLGMTM

SEQ ID NO: 9958 - protein, 10 aa, Anaeromyces robustus
  GLHYDRLASE11
PLVEFYVVDN

SEQ ID NO: 9959 - protein, 9 aa, Anaeromyces robustus
  GLHYDRLASE11
QYFSIRQQA

SEQ ID NO: 9960 - protein, 10 aa, Anaeromyces robustus
  GLHYDRLASE11
PLVEFYVVDN

SEQ ID NO: 9961 - protein, 8 aa, Anaeromyces robustus
  GLHYDRLASE11
WEKLGMTM

SEQ ID NO: 9962 - protein, 9 aa, Anaeromyces robustus
  GLHYDRLASE11
YVGIYGWTR

SEQ ID NO: 9963 - protein, 6 aa, Anaeromyces robustus
  GLHYDRLASE11
DGAKYT

SEQ ID NO: 9964 - protein, 9 aa, Anaeromyces robustus
  GLHYDRLASE11
YVGIYGWTR

SEQ ID NO: 9965 - protein, 10 aa, Anaeromyces robustus
  GLHYDRLASE11
PLVEFYVVDN

SEQ ID NO: 9966 - protein, 8 aa, Anaeromyces robustus
  GLHYDRLASE11
WEKLGMTM

SEQ ID NO: 9967 - protein, 9 aa, Anaeromyces robustus
  GLHYDRLASE11
QYFSIRQQA

SEQ ID NO: 9968 - protein, 6 aa, Anaeromyces robustus
  GLHYDRLASE11
DGAKYT

SEQ ID NO: 9969 - protein, 9 aa, Anaeromyces robustus
  GLHYDRLASE11
QYFSIRQQA

SEQ ID NO: 9970 - protein, 10 aa, Anaeromyces robustus
  GLHYDRLASE11
PLVEFYIVDN

SEQ ID NO: 9971 - protein, 9 aa, Anaeromyces robustus
  GLHYDRLASE11
YVGIYGWTR

SEQ ID NO: 9972 - protein, 6 aa, Anaeromyces robustus
  GLHYDRLASE11
DGAKYT

SEQ ID NO: 9973 - protein, 8 aa, Anaeromyces robustus
  GLHYDRLASE11
WEKLGMQM

SEQ ID NO: 9974 - protein, 6 aa, Anaeromyces robustus
  GLHYDRLASE11
DGAQYT

SEQ ID NO: 9975 - protein, 8 aa, Anaeromyces robustus
  GLHYDRLASE11
WEKLGMTL

SEQ ID NO: 9976 - protein, 9 aa, Anaeromyces robustus
  GLHYDRLASE11
QYFSIRQQA

SEQ ID NO: 9977 - protein, 9 aa, Anaeromyces robustus
  GLHYDRLASE11
YVGIYGWTR

SEQ ID NO: 9978 - protein, 10 aa, Anaeromyces robustus
  GLHYDRLASE11
PLVEFYVVDN

SEQ ID NO: 9979 - protein, 9 aa, Piromyces finnis
  GLHYDRLASE11
QYFSIRQQA

SEQ ID NO: 9980 - protein, 6 aa, Piromyces finnis
  GLHYDRLASE11
DGATYT

SEQ ID NO: 9981 - protein, 10 aa, Piromyces finnis
  GLHYDRLASE11
PLVEFYVVDN

SEQ ID NO: 9982 - protein, 9 aa, Piromyces finnis
  GLHYDRLASE11
YVGIYGWTR

SEQ ID NO: 9983 - protein, 8 aa, Piromyces finnis
  GLHYDRLASE11
WAKLGMNL

SEQ ID NO: 9984 - protein, 10 aa, Piromyces finnis
  GLHYDRLASE11
PLVEFYVVDN

SEQ ID NO: 9985 - protein, 9 aa, Piromyces finnis
  GLHYDRLASE11
YVGIYGWTR

SEQ ID NO: 9986 - protein, 9 aa, Piromyces finnis
  GLHYDRLASE11
QYFSIRQQA

SEQ ID NO: 9987 - protein, 8 aa, Piromyces finnis
  GLHYDRLASE11
WEKLGMKL

SEQ ID NO: 9988 - protein, 6 aa, Piromyces finnis
  GLHYDRLASE11
DGATYT

SEQ ID NO: 9989 - protein, 10 aa, Piromyces finnis
  GLHYDRLASE11
PLVEFYVVDN

SEQ ID NO: 9990 - protein, 9 aa, Piromyces finnis
  GLHYDRLASE11
YVGIYGWTR

SEQ ID NO: 9991 - protein, 9 aa, Piromyces finnis
  GLHYDRLASE11
QYFSIRQQA

SEQ ID NO: 9992 - protein, 8 aa, Piromyces finnis
  GLHYDRLASE11
WEKLGMKL

SEQ ID NO: 9993 - protein, 6 aa, Piromyces finnis
  GLHYDRLASE11
DGATYT

SEQ ID NO: 9994 - protein, 9 aa, Piromyces finnis
  GLHYDRLASE11
YVGIYGWTR

SEQ ID NO: 9995 - protein, 6 aa, Piromyces finnis
  GLHYDRLASE11
DGAQYT

SEQ ID NO: 9996 - protein, 9 aa, Piromyces finnis
  GLHYDRLASE11
QYFSIRQQA

SEQ ID NO: 9997 - protein, 10 aa, Piromyces finnis
  GLHYDRLASE11
PLVEFYVVDN

SEQ ID NO: 9998 - protein, 8 aa, Piromyces finnis
  GLHYDRLASE11
WEKLGMKL

SEQ ID NO: 9999 - protein, 13 aa, Neocallimastix californiae
  GLHYDRLASE16
MQTNLFIYGNGGR

SEQ ID NO: 10000 - protein, 22 aa, Neocallimastix californiae
  GLHYDRLASE16
PCYFILTNWMCVGCDGWTGPAD

SEQ ID NO: 10001 - protein, 18 aa, Neocallimastix californiae
  GLHYDRLASE16
GRMRTNVRYKSGKFEVRA

SEQ ID NO: 10002 - protein, 17 aa, Neocallimastix californiae
  GLHYDRLASE16
IVLKVDNQVIRTFNNPM

SEQ ID NO: 10003 - protein, 17 aa, Neocallimastix californiae
  GLHYDRLASE16
PPTDLSKDFHLYTFEWN

SEQ ID NO: 10004 - protein, 13 aa, Neocallimastix californiae
  GLHYDRLASE16
MQTNLFIHGNGGR

SEQ ID NO: 10005 - protein, 18 aa, Neocallimastix californiae
  GLHYDRLASE16
GRMRTNVRYKSGKFEVRA

SEQ ID NO: 10006 - protein, 22 aa, Neocallimastix californiae
  GLHYDRLASE16
PSYFILTNWMCIGCDGWTGPAD

SEQ ID NO: 10007 - protein, 17 aa, Neocallimastix californiae
  GLHYDRLASE16
PPTDLSKDFHLYTFEWS

SEQ ID NO: 10008 - protein, 17 aa, Neocallimastix californiae
  GLHYDRLASE16
IVLKVDNEVIRTFNNPM

SEQ ID NO: 10009 - protein, 17 aa, Anaeromyces robustus
  GLHYDRLASE16
IVLKVDNQVVRTFNNPM

SEQ ID NO: 10010 - protein, 13 aa, Anaeromyces robustus
  GLHYDRLASE16
MQTNLFINGQGGR

SEQ ID NO: 10011 - protein, 17 aa, Anaeromyces robustus
  GLHYDRLASE16
PPYDLSRDFHTYTFEWT

SEQ ID NO: 10012 - protein, 18 aa, Anaeromyces robustus
  GLHYDRLASE16
GRMRTNVRYKSGKFEVRA

SEQ ID NO: 10013 - protein, 22 aa, Anaeromyces robustus
  GLHYDRLASE16
PSYFILTNWMCVGCDGWTGPAD

SEQ ID NO: 10014 - protein, 15 aa, Neocallimastix californiae
  GLHYDRLASE2
VESAYYVYVNGQAVG

SEQ ID NO: 10015 - protein, 15 aa, Neocallimastix californiae
  GLHYDRLASE2
LKNNPSIFAWSIGNE

SEQ ID NO: 10016 - protein, 15 aa, Neocallimastix californiae
  GLHYDRLASE2
MPYIMCEYDIASGNA

SEQ ID NO: 10017 - protein, 14 aa, Neocallimastix californiae
  GLHYDRLASE2
INGKRLLIKGVNRH

SEQ ID NO: 10018 - protein, 18 aa, Neocallimastix californiae
  GLHYDRLASE2
DIALMKKHNINAIRTSHY

SEQ ID NO: 10019 - protein, 18 aa, Neocallimastix californiae
  GLHYDRLASE2
DITLMKTNNINAIRTSHY

SEQ ID NO: 10020 - protein, 15 aa, Neocallimastix californiae
  GLHYDRLASE2
VESAYYVYVNGQAIG

SEQ ID NO: 10021 - protein, 14 aa, Neocallimastix californiae
  GLHYDRLASE2
INGKRLLLKGVNRH

SEQ ID NO: 10022 - protein, 15 aa, Neocallimastix californiae
  GLHYDRLASE2
LKNHPSIVAWSIGNE

SEQ ID NO: 10023 - protein, 15 aa, Neocallimastix californiae
  GLHYDRLASE2
MPYVMCEYDHAMGNS

SEQ ID NO: 10024 - protein, 15 aa, Piromyces finnis
  GLHYDRLASE2
VESAYYVYVNGQGVG

SEQ ID NO: 10025 - protein, 15 aa, Piromyces finnis
  GLHYDRLASE2
MPYVMCEYDHAMGNS

SEQ ID NO: 10026 - protein, 18 aa, Piromyces finnis
  GLHYDRLASE2
DITLMKKNNINAIRTSHY

SEQ ID NO: 10027 - protein, 14 aa, Piromyces finnis
  GLHYDRLASE2
INGKRLLLKGVNRH

SEQ ID NO: 10028 - protein, 15 aa, Piromyces finnis
  GLHYDRLASE2
LKNNPSIVAWSIGNE

SEQ ID NO: 10029 - protein, 23 aa, Neocallimastix californiae
  GLHYDRLASE26
LWKILYERMVNYHGLNNLIWLWN

SEQ ID NO: 10030 - protein, 12 aa, Neocallimastix californiae
  GLHYDRLASE26
PIEYIDIIGVDI

SEQ ID NO: 10031 - protein, 17 aa, Neocallimastix californiae
  GLHYDRLASE26
PLIWRPLHENNGDWFWW

SEQ ID NO: 10032 - protein, 14 aa, Neocallimastix californiae
  GLHYDRLASE26
KKYQGKGIMSAQWH

SEQ ID NO: 10033 - protein, 17 aa, Neocallimastix californiae
  GLHYDRLASE26
PLIWRPLHENNGDWFWW

SEQ ID NO: 10034 - protein, 23 aa, Neocallimastix californiae
  GLHYDRLASE26
LWKILYERMVNYHGLNNLIWLWN

SEQ ID NO: 10035 - protein, 14 aa, Neocallimastix californiae
  GLHYDRLASE26
KKYQGKGIMSAQWH

SEQ ID NO: 10036 - protein, 12 aa, Neocallimastix californiae
  GLHYDRLASE26
PIEYIDIIGVDI

SEQ ID NO: 10037 - protein, 12 aa, Neocallimastix californiae
  GLHYDRLASE26
GDDYIDYTSIDG

SEQ ID NO: 10038 - protein, 17 aa, Neocallimastix californiae
  GLHYDRLASE26
EIWLRPLHEANGDWYTW

SEQ ID NO: 10039 - protein, 12 aa, Neocallimastix californiae
  GLHYDRLASE26
GDEYVDIISEDV

SEQ ID NO: 10040 - protein, 14 aa, Neocallimastix californiae
  GLHYDRLASE26
KKYEGKGILHAQWH

SEQ ID NO: 10041 - protein, 23 aa, Neocallimastix californiae
  GLHYDRLASE26
LYKMMYERFTKVHKLNNLIWCWN

SEQ ID NO: 10042 - protein, 17 aa, Neocallimastix californiae
  GLHYDRLASE26
PIIWRPLHEASGGWFWW

SEQ ID NO: 10043 - protein, 23 aa, Anaeromyces robustus
  GLHYDRLASE26
LWKILYERMVNYHGLNNLIWLWN

SEQ ID NO: 10044 - protein, 17 aa, Anaeromyces robustus
  GLHYDRLASE26
PLLWRPLHENNGDWFWW

SEQ ID NO: 10045 - protein, 14 aa, Anaeromyces robustus
  GLHYDRLASE26
KKYQGKGIMSAQWH

SEQ ID NO: 10046 - protein, 12 aa, Anaeromyces robustus
  GLHYDRLASE26
PIEYIDLIGVDI

SEQ ID NO: 10047 - protein, 17 aa, Piromyces finnis
  GLHYDRLASE26
PLIWRPLHENNGDWFWW

SEQ ID NO: 10048 - protein, 12 aa, Piromyces finnis
  GLHYDRLASE26
PVDYIDIIGVDI

SEQ ID NO: 10049 - protein, 23 aa, Piromyces finnis
  GLHYDRLASE26
LWKILYERMVNYHGLNNLIWLWN

SEQ ID NO: 10050 - protein, 14 aa, Piromyces finnis
  GLHYDRLASE26
KKYEGKGIMAAQWH

SEQ ID NO: 10051 - protein, 12 aa, Piromyces finnis
  GLHYDRLASE26
PVDYIDIIGVDI

SEQ ID NO: 10052 - protein, 17 aa, Piromyces finnis
  GLHYDRLASE26
PLIWRPLHENNGDWFWW

SEQ ID NO: 10053 - protein, 23 aa, Piromyces finnis
  GLHYDRLASE26
LWKILYERMVNYHGLNNLIWLWN

SEQ ID NO: 10054 - protein, 14 aa, Piromyces finnis
  GLHYDRLASE26
KKYEGKGIMAAQWH

SEQ ID NO: 10055 - protein, 16 aa, Neocallimastix californiae
  GLHYDRLASE3
AAGRNWEGYGEDTYLA

SEQ ID NO: 10056 - protein, 16 aa, Neocallimastix californiae
  GLHYDRLASE3
VLATIKHFAGNEQETN

SEQ ID NO: 10057 - protein, 19 aa, Neocallimastix californiae
  GLHYDRLASE3
LPSGLNIASTFDPEIMKKI

SEQ ID NO: 10058 - protein, 16 aa, Neocallimastix californiae
  GLHYDRLASE3
RLGFKGMCFQDGPAGV

SEQ ID NO: 10059 - protein, 18 aa, Neocallimastix californiae
  GLHYDRLASE3
VLKKQMLFHGFVTSDWWG

SEQ ID NO: 10060 - protein, 16 aa, Neocallimastix californiae
  GLHYDRLASE3
CIVSAKHYVANDVEHN

SEQ ID NO: 10061 - protein, 19 aa, Neocallimastix californiae
  GLHYDRLASE3
WQVGINNAATFNKELLYKI

SEQ ID NO: 10062 - protein, 18 aa, Neocallimastix californiae
  GLHYDRLASE3
ILKEKMNFQGFVMSDWWA

SEQ ID NO: 10063 - protein, 16 aa, Neocallimastix californiae
  GLHYDRLASE3
RKNFKGICLQDGPAGV

SEQ ID NO: 10064 - protein, 16 aa, Neocallimastix californiae
  GLHYDRLASE3
ASGRVWENFGEDPYLS

SEQ ID NO: 10065 - protein, 16 aa, Neocallimastix californiae
  GLHYDRLASE3
RLDFKGMCLQDGPAGV

SEQ ID NO: 10066 - protein, 18 aa, Neocallimastix californiae
  GLHYDRLASE3
VLKKQMMFHGFVTSDWWG

SEQ ID NO: 10067 - protein, 16 aa, Neocallimastix californiae
  GLHYDRLASE3
VLATVKHFAGNEQETR

SEQ ID NO: 10068 - protein, 19 aa, Neocallimastix californiae
  GLHYDRLASE3
FPSGLNIASTFDPEIMKKL

SEQ ID NO: 10069 - protein, 16 aa, Neocallimastix californiae
  GLHYDRLASE3
AAGRNWEGYGEDTYLA

SEQ ID NO: 10070 - protein, 16 aa, Neocallimastix californiae
  GLHYDRLASE3
RLGFKGLCLQDGPAGV

SEQ ID NO: 10071 - protein, 19 aa, Neocallimastix californiae
  GLHYDRLASE3
FPSGLNIASTFDPELMKSL

SEQ ID NO: 10072 - protein, 16 aa, Neocallimastix californiae
  GLHYDRLASE3
VGGRNWEGYGEDTYLA

SEQ ID NO: 10073 - protein, 16 aa, Neocallimastix californiae
  GLHYDRLASE3
VIATIKHFVGNEQETK

SEQ ID NO: 10074 - protein, 18 aa, Neocallimastix californiae
  GLHYDRLASE3
VLKKQMLFHGFVTSDWWG

SEQ ID NO: 10075 - protein, 16 aa, Anaeromyces robustus
  GLHYDRLASE3
VIATIKHFVGNEQETK

SEQ ID NO: 10076 - protein, 16 aa, Anaeromyces robustus
  GLHYDRLASE3
RLGFKGLCLQDGPAGV

SEQ ID NO: 10077 - protein, 19 aa, Anaeromyces robustus
  GLHYDRLASE3
FPSGLNIASTFDPELMKSL

SEQ ID NO: 10078 - protein, 18 aa, Anaeromyces robustus
  GLHYDRLASE3
VLKKQMLFHGFVTSDWWG

SEQ ID NO: 10079 - protein, 16 aa, Anaeromyces robustus
  GLHYDRLASE3
VGGRNWEGYGEDTYLA

SEQ ID NO: 10080 - protein, 16 aa, Anaeromyces robustus
  GLHYDRLASE3
VIVSAKHYVANDIEHN

SEQ ID NO: 10081 - protein, 18 aa, Anaeromyces robustus
  GLHYDRLASE3
ILKEGMNFQGFIVSDWWA

SEQ ID NO: 10082 - protein, 16 aa, Anaeromyces robustus
  GLHYDRLASE3
RKNFKGLCLQDGPAGV

SEQ ID NO: 10083 - protein, 19 aa, Anaeromyces robustus
  GLHYDRLASE3
WQTGINSAATFNKDLLYKI

SEQ ID NO: 10084 - protein, 16 aa, Anaeromyces robustus
  GLHYDRLASE3
ASGRVWENFGEDPYLS

SEQ ID NO: 10085 - protein, 16 aa, Piromyces finnis
  GLHYDRLASE3
AAGRNWEGYGEDTFLA

SEQ ID NO: 10086 - protein, 18 aa, Piromyces finnis
  GLHYDRLASE3
VLKKQFKFHGFVTSDWWG

SEQ ID NO: 10087 - protein, 16 aa, Piromyces finnis
  GLHYDRLASE3
RLGFKGLCLQDGPAGV

SEQ ID NO: 10088 - protein, 19 aa, Piromyces finnis
  GLHYDRLASE3
FPSGLNIASTFDQNLMKKL

SEQ ID NO: 10089 - protein, 16 aa, Piromyces finnis
  GLHYDRLASE3
VFATAKHFAGNEQEYK

SEQ ID NO: 10090 - protein, 16 aa, Piromyces finnis
  GLHYDRLASE3
AAGRNWEGYGEDTFLA

SEQ ID NO: 10091 - protein, 18 aa, Piromyces finnis
  GLHYDRLASE3
VLKKQFKFHGFVTSDWWG

SEQ ID NO: 10092 - protein, 16 aa, Piromyces finnis
  GLHYDRLASE3
RLGFKGLCLQDGPAGV

SEQ ID NO: 10093 - protein, 19 aa, Piromyces finnis
  GLHYDRLASE3
FPSGLNIASTFDQNLMKKL

SEQ ID NO: 10094 - protein, 16 aa, Piromyces finnis
  GLHYDRLASE3
VFATAKHFAGNEQEYK

SEQ ID NO: 10095 - protein, 20 aa, Neocallimastix californiae
  GLHYDRLASE48
EVVHATNLEWTGNPDEWKSS

SEQ ID NO: 10096 - protein, 24 aa, Neocallimastix californiae
  GLHYDRLASE48
SFINTFQRGASESAWKTVPHPCWE

SEQ ID NO: 10097 - protein, 28 aa, Neocallimastix californiae
  GLHYDRLASE48
GWTGKNAQGANIRSGVKFIDIRPKYKED

SEQ ID NO: 10098 - protein, 26 aa, Neocallimastix californiae
  GLHYDRLASE48
PVYHDPPSNNWTGMQGWGMERVCSLY

SEQ ID NO: 10099 - protein, 17 aa, Neocallimastix californiae
  GLHYDRLASE48
SFWVWLEAVNGKLTGNY

SEQ ID NO: 10100 - protein, 25 aa, Neocallimastix californiae
  GLHYDRLASE48
NVPYHSIETMMVEAPDHGHESVSET

SEQ ID NO: 10101 - protein, 23 aa, Neocallimastix californiae
  GLHYDRLASE48
RQLELFRWLQSAEGCIAGGATNS

SEQ ID NO: 10102 - protein, 27 aa, Neocallimastix californiae
  GLHYDRLASE48
KQWRYTAAPDADARAIQAAYFGYIWAE

SEQ ID NO: 10103 - protein, 19 aa, Neocallimastix californiae
  GLHYDRLASE48
SGKNSAHYLISWYFAWGGG

SEQ ID NO: 10104 - protein, 27 aa, Neocallimastix californiae
  GLHYDRLASE48
KQWRYTAAPDADARAIQAAYFGYIWAE

SEQ ID NO: 10105 - protein, 17 aa, Neocallimastix californiae
  GLHYDRLASE48
SFWVWLEAVNGKLTGNY

SEQ ID NO: 10106 - protein, 28 aa, Neocallimastix californiae
  GLHYDRLASE48
GWSGKNAQGAQLKSGIKFIDIRPKYKED

SEQ ID NO: 10107 - protein, 24 aa, Neocallimastix californiae
  GLHYDRLASE48
SFINTFQRGASESAWKTVPHPCWE

SEQ ID NO: 10108 - protein, 19 aa, Neocallimastix californiae
  GLHYDRLASE48
SGKNSAHYLISWYFAWGGG

SEQ ID NO: 10109 - protein, 23 aa, Neocallimastix californiae
  GLHYDRLASE48
RQLELFRWLQSAEGCIAGGATNS

SEQ ID NO: 10110 - protein, 26 aa, Neocallimastix californiae
  GLHYDRLASE48
PVYHDPPSNNWTGMQGWGMERVCSLY

SEQ ID NO: 10111 - protein, 20 aa, Neocallimastix californiae
  GLHYDRLASE48
EVVHATNLEWSGNPDEWNAS

SEQ ID NO: 10112 - protein, 25 aa, Neocallimastix californiae
  GLHYDRLASE48
NVPYHSIETMMVEAPDQGHESVSET

SEQ ID NO: 10113 - protein, 26 aa, Neocallimastix californiae
  GLHYDRLASE48
PVYHDPPSNNWTGMQGWGMERVCSLY

SEQ ID NO: 10114 - protein, 20 aa, Neocallimastix californiae
  GLHYDRLASE48
EIVHATNLEWSGNPDEWKSS

SEQ ID NO: 10115 - protein, 23 aa, Neocallimastix californiae
  GLHYDRLASE48
RQLELFRWLQSAEGCIAGGATNS

SEQ ID NO: 10116 - protein, 19 aa, Neocallimastix californiae
  GLHYDRLASE48
SGKNSAHYLISWYFAWGGG

SEQ ID NO: 10117 - protein, 28 aa, Neocallimastix californiae
  GLHYDRLASE48
GWSGKNAQGANIKSGVKFIDIRPKYKED

SEQ ID NO: 10118 - protein, 26 aa, Neocallimastix californiae
  GLHYDRLASE48
PVYHDPPSNNWTGMQGWGMERVCSLY

SEQ ID NO: 10119 - protein, 20 aa, Neocallimastix californiae
  GLHYDRLASE48
EIVHATNLAWTGNPDEWKSS

SEQ ID NO: 10120 - protein, 28 aa, Neocallimastix californiae
  GLHYDRLASE48
GWTGKNAQGANIRSGVKFIDIRPKYKED

SEQ ID NO: 10121 - protein, 26 aa, Neocallimastix californiae
  GLHYDRLASE48
PVYHDPPSNNWTGMQGWGMERVCSLY

SEQ ID NO: 10122 - protein, 17 aa, Neocallimastix californiae
  GLHYDRLASE48
SFWIWLEAVNGKITGNY

SEQ ID NO: 10123 - protein, 25 aa, Neocallimastix californiae
  GLHYDRLASE48
KVPYHSVETLMVEAPDHGHESVSET

SEQ ID NO: 10124 - protein, 28 aa, Neocallimastix californiae
  GLHYDRLASE48
GWSGKNAQGANIRNGVTFIDIRPKYKQD

SEQ ID NO: 10125 - protein, 19 aa, Neocallimastix californiae
  GLHYDRLASE48
RGKNSAHYLISWYFAWGGG

SEQ ID NO: 10126 - protein, 20 aa, Neocallimastix californiae
  GLHYDRLASE48
EVVHATNLEWSGNPDEWNSS

SEQ ID NO: 10127 - protein, 24 aa, Neocallimastix californiae
  GLHYDRLASE48
SFINTFQRGPSESTWKTVPHPCWE

SEQ ID NO: 10128 - protein, 27 aa, Neocallimastix californiae
  GLHYDRLASE48
KQWRYTAAPDADARAIQAAYFAYIWAE

SEQ ID NO: 10129 - protein, 23 aa, Neocallimastix californiae
  GLHYDRLASE48
RQLELFRWLQSAEGCIAGGATNS

SEQ ID NO: 10130 - protein, 28 aa, Neocallimastix californiae
  GLHYDRLASE48
GWSGKNAQGANIKNGVTFIDIRPKYKQD

SEQ ID NO: 10131 - protein, 24 aa, Neocallimastix californiae
  GLHYDRLASE48
SFINTFQRGASESAWKTVPHPCWE

SEQ ID NO: 10132 - protein, 27 aa, Neocallimastix californiae
  GLHYDRLASE48
KQWRYTDAPDADARAIQGAYFAWLWAK

SEQ ID NO: 10133 - protein, 25 aa, Neocallimastix californiae
  GLHYDRLASE48
VVPYHSIETLMVEAPDQGHESVSET

SEQ ID NO: 10134 - protein, 23 aa, Neocallimastix californiae
  GLHYDRLASE48
RQIELFRWLQTSEGCIAGGATNS

SEQ ID NO: 10135 - protein, 20 aa, Neocallimastix californiae
  GLHYDRLASE48
QIVHATNLSWEGSPDEWNSS

SEQ ID NO: 10136 - protein, 26 aa, Neocallimastix californiae
  GLHYDRLASE48
PVYHDPPSNNWTGMQGWGMERTCCYY

SEQ ID NO: 10137 - protein, 17 aa, Neocallimastix californiae
  GLHYDRLASE48
SFWVWLEAVNGKLTGDY

SEQ ID NO: 10138 - protein, 19 aa, Neocallimastix californiae
  GLHYDRLASE48
SGKNSAHYLISWYFSWGGG

SEQ ID NO: 10139 - protein, 20 aa, Neocallimastix californiae
  GLHYDRLASE48
EVVHATNLEWTGNPDEWKSS

SEQ ID NO: 10140 - protein, 28 aa, Neocallimastix californiae
  GLHYDRLASE48
GWTGKNAQGANIRSGVKFIDIRPKYKQD

SEQ ID NO: 10141 - protein, 27 aa, Neocallimastix californiae
  GLHYDRLASE48
KQWRYTAAPDADARAIQAAYFGYIWAK

SEQ ID NO: 10142 - protein, 25 aa, Neocallimastix californiae
  GLHYDRLASE48
NVPYHSIETMMVEAPDHGHESVSET

SEQ ID NO: 10143 - protein, 17 aa, Neocallimastix californiae
  GLHYDRLASE48
SFWVWLEAVHGKLTGNY

SEQ ID NO: 10144 - protein, 24 aa, Neocallimastix californiae
  GLHYDRLASE48
SFINTFQRGASESAWKTVPHPCWE

SEQ ID NO: 10145 - protein, 23 aa, Neocallimastix californiae
  GLHYDRLASE48
RQLELFRWLQSAEGCIAGGATNS

SEQ ID NO: 10146 - protein, 19 aa, Neocallimastix californiae
  GLHYDRLASE48
SGKNSAHYLISWYFAWGGG

SEQ ID NO: 10147 - protein, 26 aa, Neocallimastix californiae
  GLHYDRLASE48
PVYHDPPSNNWTGMQGWGMERVCSLY

SEQ ID NO: 10148 - protein, 26 aa, Neocallimastix californiae
  GLHYDRLASE48
PVYHDPPSNNWTGMQGWGMERVCSLY

SEQ ID NO: 10149 - protein, 28 aa, Neocallimastix californiae
  GLHYDRLASE48
GWTGKNAQGANIRSGVKFIDIRPKYKQD

SEQ ID NO: 10150 - protein, 20 aa, Neocallimastix californiae
  GLHYDRLASE48
EVVHATNLEWTGNPDEWKSS

SEQ ID NO: 10151 - protein, 20 aa, Neocallimastix californiae
  GLHYDRLASE48
EIVHATNFEWSGNPDEWKAS

SEQ ID NO: 10152 - protein, 19 aa, Neocallimastix californiae
  GLHYDRLASE48
RGKNSAHYLISWYFSWGGG

SEQ ID NO: 10153 - protein, 23 aa, Neocallimastix californiae
  GLHYDRLASE48
RQLELFRWLQAAEGCIAGGATNS

SEQ ID NO: 10154 - protein, 17 aa, Neocallimastix californiae
  GLHYDRLASE48
SFWVWLEAINGKMTGDY

SEQ ID NO: 10155 - protein, 25 aa, Neocallimastix californiae
  GLHYDRLASE48
NVPYHSIETMMVEAPDYGHESVSET

SEQ ID NO: 10156 - protein, 27 aa, Neocallimastix californiae
  GLHYDRLASE48
KQWRYTAAPDADSRAIQAAYFAYIWAK

SEQ ID NO: 10157 - protein, 28 aa, Neocallimastix californiae
  GLHYDRLASE48
GWTGKNAQGANIRNGVKFIDIRPKYKED

SEQ ID NO: 10158 - protein, 24 aa, Neocallimastix californiae
  GLHYDRLASE48
SFINTFQRGASESAWKTVPHPCWE

SEQ ID NO: 10159 - protein, 26 aa, Neocallimastix californiae
  GLHYDRLASE48
PVYHDPPSNNWTGMQGWGMERVCSLY

SEQ ID NO: 10160 - protein, 19 aa, Neocallimastix californiae
  GLHYDRLASE48
RGKNSAHYLISWYFSWGGG

SEQ ID NO: 10161 - protein, 26 aa, Neocallimastix californiae
  GLHYDRLASE48
PVYHDPPSNNWTGMQGWGMERVCSLY

SEQ ID NO: 10162 - protein, 17 aa, Neocallimastix californiae
  GLHYDRLASE48
SFWVWLEAINGKMTGDY

SEQ ID NO: 10163 - protein, 24 aa, Neocallimastix californiae
  GLHYDRLASE48
SFINTFQRGASESAWKTVPHPCWE

SEQ ID NO: 10164 - protein, 27 aa, Neocallimastix californiae
  GLHYDRLASE48
KQWRYTAAPDADARAIQAAYFAYIWAK

SEQ ID NO: 10165 - protein, 25 aa, Neocallimastix californiae
  GLHYDRLASE48
NVPYHSVETMMVEAPDYGHESVSET

SEQ ID NO: 10166 - protein, 20 aa, Neocallimastix californiae
  GLHYDRLASE48
EITHATNFSWSGNPDEWNPS

SEQ ID NO: 10167 - protein, 28 aa, Neocallimastix californiae
  GLHYDRLASE48
GWTGKNAQGATLEHGVKFIDIRPKYKQD

SEQ ID NO: 10168 - protein, 23 aa, Neocallimastix californiae
  GLHYDRLASE48
RQLELFRWLQASEGCIAGGATNS

SEQ ID NO: 10169 - protein, 23 aa, Neocallimastix californiae
  GLHYDRLASE48
RQLELFRWLQASEGCIAGGATNS

SEQ ID NO: 10170 - protein, 28 aa, Neocallimastix californiae
  GLHYDRLASE48
GWTGKNAQGANIRSGVTFIDIRPKYKQD

SEQ ID NO: 10171 - protein, 26 aa, Neocallimastix californiae
  GLHYDRLASE48
PVYHDPPSNNWTGMQGWGMERVCSLY

SEQ ID NO: 10172 - protein, 27 aa, Neocallimastix californiae
  GLHYDRLASE48
KQWRYTAAPDADARAIQAAYFGYMWAE

SEQ ID NO: 10173 - protein, 25 aa, Neocallimastix californiae
  GLHYDRLASE48
TVPYHSIETLMVEAPDHGHESVSET

SEQ ID NO: 10174 - protein, 20 aa, Neocallimastix californiae
  GLHYDRLASE48
EVIHSTNLEWSGNPDEWNSN

SEQ ID NO: 10175 - protein, 17 aa, Neocallimastix californiae
  GLHYDRLASE48
SFWIWLEAVNGKLTGNY

SEQ ID NO: 10176 - protein, 24 aa, Neocallimastix californiae
  GLHYDRLASE48
SFINTFQRGSSESTWKTVPHPCWE

SEQ ID NO: 10177 - protein, 19 aa, Neocallimastix californiae
  GLHYDRLASE48
RGKNSAHYLISWYFAWGGG

SEQ ID NO: 10178 - protein, 27 aa, Neocallimastix californiae
  GLHYDRLASE48
KQWRYTAAPDADARAIQAAYFGYIWAE

SEQ ID NO: 10179 - protein, 23 aa, Neocallimastix californiae
  GLHYDRLASE48
RQLELIRWLQATEGCIAGGATNS

SEQ ID NO: 10180 - protein, 28 aa, Neocallimastix californiae
  GLHYDRLASE48
GWTGKNAQGANLKSGVTFIDIRPKYKQD

SEQ ID NO: 10181 - protein, 17 aa, Neocallimastix californiae
  GLHYDRLASE48
SFWIWLEAVNGKLTGNY

SEQ ID NO: 10182 - protein, 24 aa, Neocallimastix californiae
  GLHYDRLASE48
SFINTFQRGASESTWKTVPHPSWE

SEQ ID NO: 10183 - protein, 19 aa, Neocallimastix californiae
  GLHYDRLASE48
RGKNSAHYLISWYFAWGGG

SEQ ID NO: 10184 - protein, 20 aa, Neocallimastix californiae
  GLHYDRLASE48
QVIHATNLEWSGNPDEWNKN

SEQ ID NO: 10185 - protein, 25 aa, Neocallimastix californiae
  GLHYDRLASE48
NVPYHSIETLMVEAPDHGHESVSET

SEQ ID NO: 10186 - protein, 26 aa, Neocallimastix californiae
  GLHYDRLASE48
PVYHDPPSNNWTGMQGWGMERTCSLY

SEQ ID NO: 10187 - protein, 24 aa, Neocallimastix californiae
  GLHYDRLASE48
SFINTFQRGSSESTWKTVPHPCWE

SEQ ID NO: 10188 - protein, 23 aa, Neocallimastix californiae
  GLHYDRLASE48
RQLELFRWLQASEGCIAGGATNS

SEQ ID NO: 10189 - protein, 19 aa, Neocallimastix californiae
  GLHYDRLASE48
RGKNSAHYLISWYFAWGGG

SEQ ID NO: 10190 - protein, 26 aa, Neocallimastix californiae
  GLHYDRLASE48
PVYHDPPSNNWTGMQGWGMERVCSLY

SEQ ID NO: 10191 - protein, 28 aa, Neocallimastix californiae
  GLHYDRLASE48
GWTGKNAQGANLKSGVTFIDIRPKYKQD

SEQ ID NO: 10192 - protein, 27 aa, Neocallimastix californiae
  GLHYDRLASE48
KQWRYTAAPDADARAIQAAYFGYIWAE

SEQ ID NO: 10193 - protein, 20 aa, Neocallimastix californiae
  GLHYDRLASE48
QVVHATNLEWSGNPDEWNKS

SEQ ID NO: 10194 - protein, 20 aa, Neocallimastix californiae
  GLHYDRLASE48
QVVHATNLEWSGNPDEWNKS

SEQ ID NO: 10195 - protein, 24 aa, Neocallimastix californiae
  GLHYDRLASE48
SFINTFQRGSSESTWKTVPHPCWE

SEQ ID NO: 10196 - protein, 28 aa, Neocallimastix californiae
  GLHYDRLASE48
GWTGKNAQGANLKSGVTFIDIRPKYKQD

SEQ ID NO: 10197 - protein, 23 aa, Neocallimastix californiae
  GLHYDRLASE48
RQLELFRWLQASEGCIAGGATNS

SEQ ID NO: 10198 - protein, 27 aa, Neocallimastix californiae
  GLHYDRLASE48
KQWRYTAAPDADARAIQAAYFGYIWAE

SEQ ID NO: 10199 - protein, 26 aa, Neocallimastix californiae
  GLHYDRLASE48
PVYHDPPSNNWTGMQGWGMERVCSLY

SEQ ID NO: 10200 - protein, 19 aa, Neocallimastix californiae
  GLHYDRLASE48
RGKNSAHYLISWYFAWGGG

SEQ ID NO: 10201 - protein, 20 aa, Neocallimastix californiae
  GLHYDRLASE48
SFRIPNRLSFEGQPEKWIPN

SEQ ID NO: 10202 - protein, 28 aa, Neocallimastix californiae
  GLHYDRLASE48
DFKGVYGRSTKINDKSSFLSIRPYYKRD

SEQ ID NO: 10203 - protein, 23 aa, Neocallimastix californiae
  GLHYDRLASE48
RQIEFIRWLQSSEGAIVGNAIYI

SEQ ID NO: 10204 - protein, 17 aa, Neocallimastix californiae
  GLHYDRLASE48
SYKLWIEAIQGKISGKW

SEQ ID NO: 10205 - protein, 28 aa, Neocallimastix californiae
  GLHYDRLASE48
GWTGKNAQGANIRSGVKFIDIRPKYKED

SEQ ID NO: 10206 - protein, 24 aa, Neocallimastix californiae
  GLHYDRLASE48
SFINTFQRGASESAWKTVPHPCWE

SEQ ID NO: 10207 - protein, 26 aa, Neocallimastix californiae
  GLHYDRLASE48
PVYHDPPSNNWTGMQGWGMERVCSLY

SEQ ID NO: 10208 - protein, 25 aa, Neocallimastix californiae
  GLHYDRLASE48
NVPYHSIETMMVEAPDYGHESVSET

SEQ ID NO: 10209 - protein, 27 aa, Neocallimastix californiae
  GLHYDRLASE48
KQWRYTAAPDADARAIQAAYFAYIWAE

SEQ ID NO: 10210 - protein, 19 aa, Neocallimastix californiae
  GLHYDRLASE48
RGKNSAHYLISWYFSWGGG

SEQ ID NO: 10211 - protein, 17 aa, Neocallimastix californiae
  GLHYDRLASE48
SFWVWLEAINGKMTGNY

SEQ ID NO: 10212 - protein, 23 aa, Neocallimastix californiae
  GLHYDRLASE48
RQLELFRWLQAAEGCIAGGATNS

SEQ ID NO: 10213 - protein, 20 aa, Neocallimastix californiae
  GLHYDRLASE48
EIVHATNFEWSGNPDEWKPS

SEQ ID NO: 10214 - protein, 23 aa, Anaeromyces robustus
  GLHYDRLASE48
RQLELFRWLQASEGCIAGGATNS

SEQ ID NO: 10215 - protein, 26 aa, Anaeromyces robustus
  GLHYDRLASE48
PVYHDPPSNNWTGMQGWGMERVCSLY

SEQ ID NO: 10216 - protein, 19 aa, Anaeromyces robustus
  GLHYDRLASE48
RGKNSAHYLISWYFAWGGG

SEQ ID NO: 10217 - protein, 20 aa, Anaeromyces robustus
  GLHYDRLASE48
EVIHSTNLEWSGNPDEWNSN

SEQ ID NO: 10218 - protein, 19 aa, Anaeromyces robustus
  GLHYDRLASE48
RGKNSAHYLISWYFAWGGG

SEQ ID NO: 10219 - protein, 28 aa, Anaeromyces robustus
  GLHYDRLASE48
GWTGKNAQGANLKSGVTFIDIRPKYKQD

SEQ ID NO: 10220 - protein, 26 aa, Anaeromyces robustus
  GLHYDRLASE48
PVYHDPPSNNWTGMQGWGMERTCSLY

SEQ ID NO: 10221 - protein, 23 aa, Anaeromyces robustus
  GLHYDRLASE48
RQLELIRWLQATEGCIAGGATNS

SEQ ID NO: 10222 - protein, 20 aa, Anaeromyces robustus
  GLHYDRLASE48
QVIHATNLEWSGNPDEWNKN

SEQ ID NO: 10223 - protein, 23 aa, Anaeromyces robustus
  GLHYDRLASE48
RQLELFRWLQSSEGCIAGGATNS

SEQ ID NO: 10224 - protein, 24 aa, Anaeromyces robustus
  GLHYDRLASE48
SFINTFQRGSSESTWKTIPHPCWE

SEQ ID NO: 10225 - protein, 28 aa, Anaeromyces robustus
  GLHYDRLASE48
GWTGKNAQGANIKNGVTFIDIRPKYKQD

SEQ ID NO: 10226 - protein, 25 aa, Anaeromyces robustus
  GLHYDRLASE48
KVPYHSVETLMVEAPDHGHESVSET

SEQ ID NO: 10227 - protein, 17 aa, Anaeromyces robustus
  GLHYDRLASE48
SFWIWLEAVNGKLTGNY

SEQ ID NO: 10228 - protein, 20 aa, Anaeromyces robustus
  GLHYDRLASE48
EITHCTNIKWEGNPDEWNSS

SEQ ID NO: 10229 - protein, 19 aa, Anaeromyces robustus
  GLHYDRLASE48
SGKNSAHYLISWYFAWGGG

SEQ ID NO: 10230 - protein, 26 aa, Anaeromyces robustus
  GLHYDRLASE48
PVYHDPPSNNWSGMQGWGMERVCSLY

SEQ ID NO: 10231 - protein, 27 aa, Anaeromyces robustus
  GLHYDRLASE48
KQWRYTAAPDADARAIQAAYFGYIWAK

SEQ ID NO: 10232 - protein, 19 aa, Anaeromyces robustus
  GLHYDRLASE48
SGKNSAHYLISWAYSWGGG

SEQ ID NO: 10233 - protein, 17 aa, Anaeromyces robustus
  GLHYDRLASE48
SYWIWLEAVNGKITGNY

SEQ ID NO: 10234 - protein, 27 aa, Anaeromyces robustus
  GLHYDRLASE48
KQYKYTTCPDADARAIQATYFAYLWAK

SEQ ID NO: 10235 - protein, 25 aa, Anaeromyces robustus
  GLHYDRLASE48
IETLIVEEDNSFSRLDYGHLSTSET

SEQ ID NO: 10236 - protein, 24 aa, Anaeromyces robustus
  GLHYDRLASE48
VLINTFRRGPSESVWQTIPHPSFD

SEQ ID NO: 10237 - protein, 23 aa, Anaeromyces robustus
  GLHYDRLASE48
RQLEFMRWLQTPEGCIAGGATNS

SEQ ID NO: 10238 - protein, 26 aa, Anaeromyces robustus
  GLHYDRLASE48
PVYHNPSSNNWIGMQARSIERVCSLY

SEQ ID NO: 10239 - protein, 28 aa, Anaeromyces robustus
  GLHYDRLASE48
DWKGRNPQGAYLKRGACFLDIRPKYKED

SEQ ID NO: 10240 - protein, 20 aa, Anaeromyces robustus
  GLHYDRLASE48
EIIHATKLTWEGNPDDWDSS

SEQ ID NO: 10241 - protein, 28 aa, Anaeromyces robustus
  GLHYDRLASE48
DFKGVYGQSAKINDKSTFISIRPYYKKD

SEQ ID NO: 10242 - protein, 20 aa, Anaeromyces robustus
  GLHYDRLASE48
SFRIPNKLSFEGHPEKWKPN

SEQ ID NO: 10243 - protein, 23 aa, Anaeromyces robustus
  GLHYDRLASE48
RQIEFIRWLQSSEGAIVGNAKYP

SEQ ID NO: 10244 - protein, 19 aa, Anaeromyces robustus
  GLHYDRLASE48
STDENKNYLLSRYFSWKGS

SEQ ID NO: 10245 - protein, 17 aa, Piromyces finnis
  GLHYDRLASE48
SYKLWIEALQGKISGKW

SEQ ID NO: 10246 - protein, 23 aa, Piromyces finnis
  GLHYDRLASE48
RQIEFIRWLQSSEGAIVGVAQYP

SEQ ID NO: 10247 - protein, 20 aa, Piromyces finnis
  GLHYDRLASE48
LFKIPNKLTFEGQPKDWNQK

SEQ ID NO: 10248 - protein, 28 aa, Piromyces finnis
  GLHYDRLASE48
GFKGMYGRSSKINDKSTFISIRPYYKKD

SEQ ID NO: 10249 - protein, 20 aa, Piromyces finnis
  GLHYDRLASE48
EVIHATNLGWDGNPDEWKAS

SEQ ID NO: 10250 - protein, 28 aa, Piromyces finnis
  GLHYDRLASE48
GWSGKNAQGANIKSGATFIDIRPKYKED

SEQ ID NO: 10251 - protein, 20 aa, Piromyces finnis
  GLHYDRLASE48
EIVHATNLDWSGNPDEWNSS

SEQ ID NO: 10252 - protein, 28 aa, Piromyces finnis
  GLHYDRLASE48
GWSGKNAQGANIKSGATFIDIRPKYKED

SEQ ID NO: 10253 - protein, 25 aa, Piromyces finnis
  GLHYDRLASE48
KVPYHSVETLMVEAPDHGHESVSET

SEQ ID NO: 10254 - protein, 17 aa, Piromyces finnis
  GLHYDRLASE48
SFWIWLEAVNGKITGNY

SEQ ID NO: 10255 - protein, 19 aa, Piromyces finnis
  GLHYDRLASE48
RGKNSAHYLISWYFAWGGG

SEQ ID NO: 10256 - protein, 26 aa, Piromyces finnis
  GLHYDRLASE48
PVYHDPPSNNWTGMQGWGMERVCSLY

SEQ ID NO: 10257 - protein, 23 aa, Piromyces finnis
  GLHYDRLASE48
RQLELFRWLQTPEGCIAGGATNS

SEQ ID NO: 10258 - protein, 24 aa, Piromyces finnis
  GLHYDRLASE48
SFINTFQRGASESTWKTVPHPCWE

SEQ ID NO: 10259 - protein, 27 aa, Piromyces finnis
  GLHYDRLASE48
KQWRYTAAPDADARAVQAAYFAYIWAE

SEQ ID NO: 10260 - protein, 24 aa, Piromyces finnis
  GLHYDRLASE48
SFINTFQRGASESTWKTVPHPCWE

SEQ ID NO: 10261 - protein, 26 aa, Piromyces finnis
  GLHYDRLASE48
PVYHDPPSNNWTGMQGWGMERVCSLY

SEQ ID NO: 10262 - protein, 19 aa, Piromyces finnis
  GLHYDRLASE48
RGKNSAHYLISWYFAWGGG

SEQ ID NO: 10263 - protein, 25 aa, Piromyces finnis
  GLHYDRLASE48
KVPYHSVETLMVEAPDHGHESVSET

SEQ ID NO: 10264 - protein, 23 aa, Piromyces finnis
  GLHYDRLASE48
RQLELFRWLQTPEGCIAGGATNS

SEQ ID NO: 10265 - protein, 20 aa, Piromyces finnis
  GLHYDRLASE48
EIVHATNLDWSGNPDEWNSS

SEQ ID NO: 10266 - protein, 17 aa, Piromyces finnis
  GLHYDRLASE48
SFWIWLEAVNGKITGNY

SEQ ID NO: 10267 - protein, 28 aa, Piromyces finnis
  GLHYDRLASE48
GWTGKNAQGANIKSGVTFIDIRPKYKQD

SEQ ID NO: 10268 - protein, 27 aa, Piromyces finnis
  GLHYDRLASE48
KQWRYTAAPDADARAVQAAYFAYIWAE

SEQ ID NO: 10269 - protein, 28 aa, Piromyces finnis
  GLHYDRLASE48
GWTGKNAQGANIKSGVTFIDIRPKYKQD

SEQ ID NO: 10270 - protein, 20 aa, Piromyces finnis
  GLHYDRLASE48
EVIHATNLGWDGNPDEWKAS

SEQ ID NO: 10271 - protein, 28 aa, Piromyces finnis
  GLHYDRLASE48
GWSGKNAQGANIKSGATFIDIRPKYKED

SEQ ID NO: 10272 - protein, 20 aa, Piromyces finnis
  GLHYDRLASE48
EVIHATNLGWDGNPDEWKAS

SEQ ID NO: 10273 - protein, 28 aa, Piromyces finnis
  GLHYDRLASE48
GWSGKNAQGANIKSGATFIDIRPKYKED

SEQ ID NO: 10274 - protein, 25 aa, Piromyces finnis
  GLHYDRLASE48
KVPYHSVETLMVEAPDHGHESVSET

SEQ ID NO: 10275 - protein, 17 aa, Piromyces finnis
  GLHYDRLASE48
SFWIWLEAVNGKITGNY

SEQ ID NO: 10276 - protein, 19 aa, Piromyces finnis
  GLHYDRLASE48
RGKNSAHYLISWYFAWGGG

SEQ ID NO: 10277 - protein, 26 aa, Piromyces finnis
  GLHYDRLASE48
PVYHDPPSNNWTGMQGWGMERVCSLY

SEQ ID NO: 10278 - protein, 23 aa, Piromyces finnis
  GLHYDRLASE48
RQLELFRWLQTPEGCIAGGATNS

SEQ ID NO: 10279 - protein, 20 aa, Piromyces finnis
  GLHYDRLASE48
EIVHATNLDWSGNPDEWNSS

SEQ ID NO: 10280 - protein, 24 aa, Piromyces finnis
  GLHYDRLASE48
SFINTFQRGASESTWKTVPHPCWE

SEQ ID NO: 10281 - protein, 27 aa, Piromyces finnis
  GLHYDRLASE48
KQWRYTAAPDADARAVQAAYFAYIWAE

SEQ ID NO: 10282 - protein, 28 aa, Piromyces finnis
  GLHYDRLASE48
GWTGKNAQGANIKSGVTFIDIRPKYKQD

SEQ ID NO: 10283 - protein, 20 aa, Piromyces finnis
  GLHYDRLASE48
EVIHATNLGWDGNPDEWKAS

SEQ ID NO: 10284 - protein, 24 aa, Piromyces finnis
  GLHYDRLASE48
SFINTFQRGASESTWKTVPHPCWE

SEQ ID NO: 10285 - protein, 26 aa, Piromyces finnis
  GLHYDRLASE48
PVYHDPPSNNWTGMQGWGMERVCSLY

SEQ ID NO: 10286 - protein, 19 aa, Piromyces finnis
  GLHYDRLASE48
RGKNSAHYLISWYFAWGGG

SEQ ID NO: 10287 - protein, 25 aa, Piromyces finnis
  GLHYDRLASE48
KVPYHSVETLMVEAPDHGHESVSET

SEQ ID NO: 10288 - protein, 23 aa, Piromyces finnis
  GLHYDRLASE48
RQLELFRWLQTPEGCIAGGATNS

SEQ ID NO: 10289 - protein, 20 aa, Piromyces finnis
  GLHYDRLASE48
EIVHATNLDWSGNPDEWNSS

SEQ ID NO: 10290 - protein, 17 aa, Piromyces finnis
  GLHYDRLASE48
SFWIWLEAVNGKITGNY

SEQ ID NO: 10291 - protein, 28 aa, Piromyces finnis
  GLHYDRLASE48
GWTGKNAQGANIKSGVTFIDIRPKYKQD

SEQ ID NO: 10292 - protein, 27 aa, Piromyces finnis
  GLHYDRLASE48
KQWRYTAAPDADARAVQAAYFAYIWAE

SEQ ID NO: 10293 - protein, 28 aa, Piromyces finnis
  GLHYDRLASE48
GWTGKNAQGANIKSGVTFIDIRPKYKQD

SEQ ID NO: 10294 - protein, 23 aa, Piromyces finnis
  GLHYDRLASE48
RQLELFRWLQTPEGCIAGGATNS

SEQ ID NO: 10295 - protein, 24 aa, Piromyces finnis
  GLHYDRLASE48
SFINTFQRGASESTWKTVPHPCWE

SEQ ID NO: 10296 - protein, 20 aa, Piromyces finnis
  GLHYDRLASE48
EIVHATNLDWSGNPDEWNSS

SEQ ID NO: 10297 - protein, 27 aa, Piromyces finnis
  GLHYDRLASE48
KQWRYTAAPDADARAVQAAYFAYIWAE

SEQ ID NO: 10298 - protein, 19 aa, Piromyces finnis
  GLHYDRLASE48
RGKNSAHYLISWYFAWGGG

SEQ ID NO: 10299 - protein, 26 aa, Piromyces finnis
  GLHYDRLASE48
PVYHDPPSNNWTGMQGWGMERVCSLY

SEQ ID NO: 10300 - protein, 23 aa, Piromyces finnis
  GLHYDRLASE48
RQLELFRWLQTPEGCIAGGATNS

SEQ ID NO: 10301 - protein, 24 aa, Piromyces finnis
  GLHYDRLASE48
SFINTFQRGASESTWKTVPHPCWE

SEQ ID NO: 10302 - protein, 26 aa, Piromyces finnis
  GLHYDRLASE48
PVYHDPPSNNWTGMQGWGMERVCSLY

SEQ ID NO: 10303 - protein, 19 aa, Piromyces finnis
  GLHYDRLASE48
RGKNSAHYLISWYFAWGGG

SEQ ID NO: 10304 - protein, 28 aa, Piromyces finnis
  GLHYDRLASE48
GWTGKNAQGANIKSGVTFIDIRPKYKQD

SEQ ID NO: 10305 - protein, 27 aa, Piromyces finnis
  GLHYDRLASE48
KQWRYTAAPDADARAVQAAYFAYIWAE

SEQ ID NO: 10306 - protein, 20 aa, Piromyces finnis
  GLHYDRLASE48
EIVHATNLDWSGNPDEWNSS

SEQ ID NO: 10307 - protein, 17 aa, Piromyces finnis
  GLHYDRLASE48
SFWIWLEAVNGKITGNY

SEQ ID NO: 10308 - protein, 25 aa, Piromyces finnis
  GLHYDRLASE48
KVPYHSVETLMVEAPDHGHESVSET

SEQ ID NO: 10309 - protein, 13 aa, Neocallimastix californiae
  GLHYDRLASE6
HVAMYLDIGHAFW

SEQ ID NO: 10310 - protein, 19 aa, Neocallimastix californiae
  GLHYDRLASE6
DSSLIAKAEKMKTYSNAIW

SEQ ID NO: 10311 - protein, 10 aa, Neocallimastix californiae
  GLHYDRLASE6
VRGFTDNVAN

SEQ ID NO: 10312 - protein, 14 aa, Neocallimastix californiae
  GLHYDRLASE6
LDAFYWIKPLGESD

SEQ ID NO: 10313 - protein, 13 aa, Neocallimastix californiae
  GLHYDRLASE6
VLTVFVVYDLPGR

SEQ ID NO: 10314 - protein, 15 aa, Neocallimastix californiae
  GLHYDRLASE6
KSEYIDVIEGHLKTY

SEQ ID NO: 10315 - protein, 13 aa, Neocallimastix californiae
  GLHYDRLASE6
VYFVCDTSRNGKK

SEQ ID NO: 10316 - protein, 20 aa, Neocallimastix californiae
  GLHYDRLASE6
PGEWCNQTGVGIGARPQASP

SEQ ID NO: 10317 - protein, 14 aa, Neocallimastix californiae
  GLHYDRLASE6
LDAFYWIKPLGESD

SEQ ID NO: 10318 - protein, 20 aa, Neocallimastix californiae
  GLHYDRLASE6
PGEWCNQTGVGIGARPQASP

SEQ ID NO: 10319 - protein, 10 aa, Neocallimastix californiae
  GLHYDRLASE6
VRGFTDNVAN

SEQ ID NO: 10320 - protein, 13 aa, Neocallimastix californiae
  GLHYDRLASE6
VYFVCDTSRNGKK

SEQ ID NO: 10321 - protein, 15 aa, Neocallimastix californiae
  GLHYDRLASE6
KSEYIDVIEGHLKTY

SEQ ID NO: 10322 - protein, 13 aa, Neocallimastix californiae
  GLHYDRLASE6
VLTVFVVYDLPGR

SEQ ID NO: 10323 - protein, 19 aa, Neocallimastix californiae
  GLHYDRLASE6
DSSLIAKAEKMKTYSNAIW

SEQ ID NO: 10324 - protein, 13 aa, Neocallimastix californiae
  GLHYDRLASE6
HVAMYLDIGHAFW

SEQ ID NO: 10325 - protein, 13 aa, Neocallimastix californiae
  GLHYDRLASE6
HVAMYLDIGHAFW

SEQ ID NO: 10326 - protein, 10 aa, Neocallimastix californiae
  GLHYDRLASE6
VRGFTDNVSN

SEQ ID NO: 10327 - protein, 19 aa, Neocallimastix californiae
  GLHYDRLASE6
DSSLIAKAEKMKTYSNAIW

SEQ ID NO: 10328 - protein, 15 aa, Neocallimastix californiae
  GLHYDRLASE6
KSEYIDVIEGHLKTY

SEQ ID NO: 10329 - protein, 13 aa, Neocallimastix californiae
  GLHYDRLASE6
VYFVSDSSRNGKK

SEQ ID NO: 10330 - protein, 20 aa, Neocallimastix californiae
  GLHYDRLASE6
PGEWCNQTGVGVGARPQASP

SEQ ID NO: 10331 - protein, 13 aa, Neocallimastix californiae
  GLHYDRLASE6
ILTVFVVYDLPGR

SEQ ID NO: 10332 - protein, 14 aa, Neocallimastix californiae
  GLHYDRLASE6
LDAFYWIKPLGESD

SEQ ID NO: 10333 - protein, 19 aa, Neocallimastix californiae
  GLHYDRLASE6
SGELQQQANRVKYTPTAVW

SEQ ID NO: 10334 - protein, 15 aa, Neocallimastix californiae
  GLHYDRLASE6
YKNYVDSVYNSFRSY

SEQ ID NO: 10335 - protein, 20 aa, Neocallimastix californiae
  GLHYDRLASE6
TKTWCNFVGTGFGERPKGNP

SEQ ID NO: 10336 - protein, 13 aa, Neocallimastix californiae
  GLHYDRLASE6
NTAVFMMYWIPTR

SEQ ID NO: 10337 - protein, 13 aa, Neocallimastix californiae
  GLHYDRLASE6
MRFIVDTSRNGVD

SEQ ID NO: 10338 - protein, 10 aa, Neocallimastix californiae
  GLHYDRLASE6
IRGFSTNVSN

SEQ ID NO: 10339 - protein, 14 aa, Neocallimastix californiae
  GLHYDRLASE6
LDAYMWLKPPAESD

SEQ ID NO: 10340 - protein, 13 aa, Neocallimastix californiae
  GLHYDRLASE6
NVQVYLDAGHSQW

SEQ ID NO: 10341 - protein, 19 aa, Neocallimastix californiae
  GLHYDRLASE6
DSSLIAKAEKMKTYSNAIW

SEQ ID NO: 10342 - protein, 15 aa, Neocallimastix californiae
  GLHYDRLASE6
KSEYIDVIEGHLKTY

SEQ ID NO: 10343 - protein, 13 aa, Neocallimastix californiae
  GLHYDRLASE6
VLTVFVVYDLPGR

SEQ ID NO: 10344 - protein, 20 aa, Neocallimastix californiae
  GLHYDRLASE6
PGEWCNQTGCGIGARPKASP

SEQ ID NO: 10345 - protein, 13 aa, Neocallimastix californiae
  GLHYDRLASE6
VYFFSDSSRNGKK

SEQ ID NO: 10346 - protein, 13 aa, Neocallimastix californiae
  GLHYDRLASE6
NVALYLDIGHAFW

SEQ ID NO: 10347 - protein, 10 aa, Neocallimastix californiae
  GLHYDRLASE6
VRGFVDNVAN

SEQ ID NO: 10348 - protein, 14 aa, Neocallimastix californiae
  GLHYDRLASE6
LDAFYWVKPIGESD

SEQ ID NO: 10349 - protein, 19 aa, Neocallimastix californiae
  GLHYDRLASE6
DSSLIAKAEKMKTYSNAIW

SEQ ID NO: 10350 - protein, 15 aa, Neocallimastix californiae
  GLHYDRLASE6
KSEYIDVIEGHLKEY

SEQ ID NO: 10351 - protein, 13 aa, Neocallimastix californiae
  GLHYDRLASE6
ILTVFVVYDLPGR

SEQ ID NO: 10352 - protein, 13 aa, Neocallimastix californiae
  GLHYDRLASE6
HVAMYLDIGHAFW

SEQ ID NO: 10353 - protein, 15 aa, Neocallimastix californiae
  GLHYDRLASE6
KTEYIDVIEGHLKKY

SEQ ID NO: 10354 - protein, 13 aa, Neocallimastix californiae
  GLHYDRLASE6
HVAMYLDIGHAFW

SEQ ID NO: 10355 - protein, 12 aa, Neocallimastix californiae
  GLHYDRLASE6
PGEWCNQTGVGI

SEQ ID NO: 10356 - protein, 19 aa, Neocallimastix californiae
  GLHYDRLASE6
DSSLIAKAEKMKTYSNAIW

SEQ ID NO: 10357 - protein, 13 aa, Neocallimastix californiae
  GLHYDRLASE6
VLTVFVVYDLPGR

SEQ ID NO: 10358 - protein, 10 aa, Neocallimastix californiae
  GLHYDRLASE6
VRGFTDNVSN

SEQ ID NO: 10359 - protein, 13 aa, Neocallimastix californiae
  GLHYDRLASE6
VYFVSDTSRNGHK

SEQ ID NO: 10360 - protein, 19 aa, Neocallimastix californiae
  GLHYDRLASE6
SPELQAKAKNVEKVSSAVW

SEQ ID NO: 10361 - protein, 20 aa, Neocallimastix californiae
  GLHYDRLASE6
NQTWCNLIYAGLGEPSRGSP

SEQ ID NO: 10362 - protein, 14 aa, Neocallimastix californiae
  GLHYDRLASE6
LDAFMWLKPPGEAD

SEQ ID NO: 10363 - protein, 15 aa, Neocallimastix californiae
  GLHYDRLASE6
YKGYVDKIANTIKKF

SEQ ID NO: 10364 - protein, 10 aa, Neocallimastix californiae
  GLHYDRLASE6
IRGFSTNVSN

SEQ ID NO: 10365 - protein, 13 aa, Neocallimastix californiae
  GLHYDRLASE6
KRFIVDTGRSGVD

SEQ ID NO: 10366 - protein, 13 aa, Neocallimastix californiae
  GLHYDRLASE6
NVSAYLDAAHSKW

SEQ ID NO: 10367 - protein, 13 aa, Neocallimastix californiae
  GLHYDRLASE6
KTVTFILYMIPTR

SEQ ID NO: 10368 - protein, 14 aa, Neocallimastix californiae
  GLHYDRLASE6
LDAFYWVKPIGESD

SEQ ID NO: 10369 - protein, 13 aa, Neocallimastix californiae
  GLHYDRLASE6
VYFFSDSSRNGKK

SEQ ID NO: 10370 - protein, 19 aa, Neocallimastix californiae
  GLHYDRLASE6
DSSLIAKAEKMKTYSNAIW

SEQ ID NO: 10371 - protein, 20 aa, Neocallimastix californiae
  GLHYDRLASE6
PGEWCNQTGCGVGARPKASP

SEQ ID NO: 10372 - protein, 15 aa, Neocallimastix californiae
  GLHYDRLASE6
KSEYIDVIEGHLKTY

SEQ ID NO: 10373 - protein, 13 aa, Neocallimastix californiae
  GLHYDRLASE6
VLTVFVVYDLPGR

SEQ ID NO: 10374 - protein, 13 aa, Neocallimastix californiae
  GLHYDRLASE6
NVALYLDIGHAFW

SEQ ID NO: 10375 - protein, 10 aa, Neocallimastix californiae
  GLHYDRLASE6
VRGFVDNVAN

SEQ ID NO: 10376 - protein, 15 aa, Neocallimastix californiae
  GLHYDRLASE6
KSEYIDVIEGHLKTY

SEQ ID NO: 10377 - protein, 19 aa, Neocallimastix californiae
  GLHYDRLASE6
NASLIAKAEKMKEFSNAIW

SEQ ID NO: 10378 - protein, 13 aa, Neocallimastix californiae
  GLHYDRLASE6
VKFVTDTSHNGKK

SEQ ID NO: 10379 - protein, 14 aa, Neocallimastix californiae
  GLHYDRLASE6
LDAFYWIKPFGNVS

SEQ ID NO: 10380 - protein, 13 aa, Neocallimastix californiae
  GLHYDRLASE6
HVALYLDIGHAYL

SEQ ID NO: 10381 - protein, 20 aa, Neocallimastix californiae
  GLHYDRLASE6
RELWCKSTSAGVGARPMAIP

SEQ ID NO: 10382 - protein, 13 aa, Neocallimastix californiae
  GLHYDRLASE6
VLTVFVVYNLPGR

SEQ ID NO: 10383 - protein, 10 aa, Neocallimastix californiae
  GLHYDRLASE6
IRGFADNIGG

SEQ ID NO: 10384 - protein, 20 aa, Neocallimastix californiae
  GLHYDRLASE6
SGTWCNFKGAGLGERPKGNP

SEQ ID NO: 10385 - protein, 14 aa, Neocallimastix californiae
  GLHYDRLASE6
LDAYMWIKTPGEAD

SEQ ID NO: 10386 - protein, 13 aa, Neocallimastix californiae
  GLHYDRLASE6
KTVVFVLYMIPTR

SEQ ID NO: 10387 - protein, 15 aa, Neocallimastix californiae
  GLHYDRLASE6
YKSYVDKIYNTINKY

SEQ ID NO: 10388 - protein, 19 aa, Neocallimastix californiae
  GLHYDRLASE6
SGNVKQKAEKVKYVPTAAW

SEQ ID NO: 10389 - protein, 13 aa, Neocallimastix californiae
  GLHYDRLASE6
LKFIVDTSRNGAN

SEQ ID NO: 10390 - protein, 13 aa, Neocallimastix californiae
  GLHYDRLASE6
NVRVYLDAAHGAW

SEQ ID NO: 10391 - protein, 10 aa, Neocallimastix californiae
  GLHYDRLASE6
LRGISTNVSN

SEQ ID NO: 10392 - protein, 20 aa, Neocallimastix californiae
  GLHYDRLASE6
TKTWCNFVGTGFGERPKGNP

SEQ ID NO: 10393 - protein, 13 aa, Neocallimastix californiae
  GLHYDRLASE6
NTAVFIMYWIPTR

SEQ ID NO: 10394 - protein, 13 aa, Neocallimastix californiae
  GLHYDRLASE6
NVQVYLDAGHSQW

SEQ ID NO: 10395 - protein, 15 aa, Neocallimastix californiae
  GLHYDRLASE6
YKNYVDSVYNTFRSN

SEQ ID NO: 10396 - protein, 10 aa, Neocallimastix californiae
  GLHYDRLASE6
IRGFSTNISN

SEQ ID NO: 10397 - protein, 14 aa, Neocallimastix californiae
  GLHYDRLASE6
LDAYMWLKPPAESD

SEQ ID NO: 10398 - protein, 13 aa, Neocallimastix californiae
  GLHYDRLASE6
MRFIVDTSRNGVD

SEQ ID NO: 10399 - protein, 19 aa, Neocallimastix californiae
  GLHYDRLASE6
SGELQQQASRVKYTPTAVW

SEQ ID NO: 10400 - protein, 14 aa, Neocallimastix californiae
  GLHYDRLASE6
LDAFYWIKPLGESD

SEQ ID NO: 10401 - protein, 10 aa, Neocallimastix californiae
  GLHYDRLASE6
VRGFTDNVAN

SEQ ID NO: 10402 - protein, 20 aa, Neocallimastix californiae
  GLHYDRLASE6
PGEWCNQTGVGIGARPQASP

SEQ ID NO: 10403 - protein, 15 aa, Neocallimastix californiae
  GLHYDRLASE6
KSEYIDVIEEKLRTY

SEQ ID NO: 10404 - protein, 13 aa, Neocallimastix californiae
  GLHYDRLASE6
VLTVFVVYDLPGR

SEQ ID NO: 10405 - protein, 13 aa, Neocallimastix californiae
  GLHYDRLASE6
HVAMYLDIGHAFW

SEQ ID NO: 10406 - protein, 19 aa, Neocallimastix californiae
  GLHYDRLASE6
DASLISKAEKMKTFSNAIW

SEQ ID NO: 10407 - protein, 13 aa, Neocallimastix californiae
  GLHYDRLASE6
VYFVCDTSRNGKK

SEQ ID NO: 10408 - protein, 10 aa, Neocallimastix californiae
  GLHYDRLASE6
VRGFASNVAN

SEQ ID NO: 10409 - protein, 14 aa, Neocallimastix californiae
  GLHYDRLASE6
LDAFYWVKPYGESD

SEQ ID NO: 10410 - protein, 19 aa, Neocallimastix californiae
  GLHYDRLASE6
DSSLKFKAEKMKEYSNAIW

SEQ ID NO: 10411 - protein, 13 aa, Neocallimastix californiae
  GLHYDRLASE6
HVAMYLDIGHAFW

SEQ ID NO: 10412 - protein, 13 aa, Neocallimastix californiae
  GLHYDRLASE6
VYFIEDTSRNGHK

SEQ ID NO: 10413 - protein, 13 aa, Neocallimastix californiae
  GLHYDRLASE6
VLTVFVVYDLPGR

SEQ ID NO: 10414 - protein, 20 aa, Neocallimastix californiae
  GLHYDRLASE6
SGEWCNQMGSGIGARPKAYP

SEQ ID NO: 10415 - protein, 13 aa, Neocallimastix californiae
  GLHYDRLASE6
VLTVFVVYDLPGR

SEQ ID NO: 10416 - protein, 13 aa, Neocallimastix californiae
  GLHYDRLASE6
HVAMYLDIGHAFW

SEQ ID NO: 10417 - protein, 15 aa, Neocallimastix californiae
  GLHYDRLASE6
KTEYIDVIESHLKQY

SEQ ID NO: 10418 - protein, 20 aa, Neocallimastix californiae
  GLHYDRLASE6
PGEWCNQTGVGVGARPQASP

SEQ ID NO: 10419 - protein, 19 aa, Neocallimastix californiae
  GLHYDRLASE6
DSSLRSKVEKMKTFSNAIW

SEQ ID NO: 10420 - protein, 14 aa, Neocallimastix californiae
  GLHYDRLASE6
LDAFYWIKPLGESD

SEQ ID NO: 10421 - protein, 10 aa, Neocallimastix californiae
  GLHYDRLASE6
VRGFVDNVAN

SEQ ID NO: 10422 - protein, 13 aa, Neocallimastix californiae
  GLHYDRLASE6
VYFVSDTSRNGHK

SEQ ID NO: 10423 - protein, 19 aa, Neocallimastix californiae
  GLHYDRLASE6
SSSLKAKAEKMKTYSNAIW

SEQ ID NO: 10424 - protein, 13 aa, Neocallimastix californiae
  GLHYDRLASE6
HVAMYLDIGHAFW

SEQ ID NO: 10425 - protein, 10 aa, Neocallimastix californiae
  GLHYDRLASE6
VRGFVDNVAN

SEQ ID NO: 10426 - protein, 15 aa, Neocallimastix californiae
  GLHYDRLASE6
KTEYIDVIESHLKKY

SEQ ID NO: 10427 - protein, 20 aa, Neocallimastix californiae
  GLHYDRLASE6
PGEWCNQTGVGIGARPQASP

SEQ ID NO: 10428 - protein, 13 aa, Neocallimastix californiae
  GLHYDRLASE6
VYFVSDSSRNGHK

SEQ ID NO: 10429 - protein, 14 aa, Neocallimastix californiae
  GLHYDRLASE6
LDAFYWIKPLGESD

SEQ ID NO: 10430 - protein, 13 aa, Neocallimastix californiae
  GLHYDRLASE6
VLTVFVVYDLPGR

SEQ ID NO: 10431 - protein, 15 aa, Neocallimastix californiae
  GLHYDRLASE6
KTEYIDVIEKQLKQY

SEQ ID NO: 10432 - protein, 19 aa, Neocallimastix californiae
  GLHYDRLASE6
SSSLKAKAEKMKTYSNAIW

SEQ ID NO: 10433 - protein, 13 aa, Neocallimastix californiae
  GLHYDRLASE6
HVAMYLDIGHAFW

SEQ ID NO: 10434 - protein, 10 aa, Neocallimastix californiae
  GLHYDRLASE6
VRGFVDNVAN

SEQ ID NO: 10435 - protein, 20 aa, Neocallimastix californiae
  GLHYDRLASE6
PGEWCNQTGVGIGARPQASP

SEQ ID NO: 10436 - protein, 13 aa, Neocallimastix californiae
  GLHYDRLASE6
VYFVSDSSRNGHK

SEQ ID NO: 10437 - protein, 14 aa, Neocallimastix californiae
  GLHYDRLASE6
LDAFYWIKPLGESD

SEQ ID NO: 10438 - protein, 13 aa, Neocallimastix californiae
  GLHYDRLASE6
VLTVFVVYDLPGR

SEQ ID NO: 10439 - protein, 10 aa, Neocallimastix californiae
  GLHYDRLASE6
VRGFTDNVAN

SEQ ID NO: 10440 - protein, 20 aa, Neocallimastix californiae
  GLHYDRLASE6
PGEWCNQTGVGVGARPQANP

SEQ ID NO: 10441 - protein, 19 aa, Neocallimastix californiae
  GLHYDRLASE6
DSSLISKAEKMKTFSNAIW

SEQ ID NO: 10442 - protein, 13 aa, Neocallimastix californiae
  GLHYDRLASE6
VYFVSDTSRNGKK

SEQ ID NO: 10443 - protein, 15 aa, Neocallimastix californiae
  GLHYDRLASE6
KTEYIDVIEEKLKTY

SEQ ID NO: 10444 - protein, 13 aa, Neocallimastix californiae
  GLHYDRLASE6
HVAMYLDIGHAFW

SEQ ID NO: 10445 - protein, 13 aa, Neocallimastix californiae
  GLHYDRLASE6
VLTVFVVYDLPGR

SEQ ID NO: 10446 - protein, 14 aa, Neocallimastix californiae
  GLHYDRLASE6
LDAFYWIKPLGESD

SEQ ID NO: 10447 - protein, 13 aa, Neocallimastix californiae
  GLHYDRLASE6
VLTVFVVYDLPGR

SEQ ID NO: 10448 - protein, 14 aa, Neocallimastix californiae
  GLHYDRLASE6
LDAFYWIKPLGESD

SEQ ID NO: 10449 - protein, 13 aa, Neocallimastix californiae
  GLHYDRLASE6
VYFVSDTSRNGKK

SEQ ID NO: 10450 - protein, 15 aa, Neocallimastix californiae
  GLHYDRLASE6
KTEYIDVIEEKLKTY

SEQ ID NO: 10451 - protein, 13 aa, Neocallimastix californiae
  GLHYDRLASE6
HVAMYLDIGHAFW

SEQ ID NO: 10452 - protein, 10 aa, Neocallimastix californiae
  GLHYDRLASE6
VRGFTDNVAN

SEQ ID NO: 10453 - protein, 19 aa, Neocallimastix californiae
  GLHYDRLASE6
DSSLISKAEKMKTFSNAIW

SEQ ID NO: 10454 - protein, 20 aa, Neocallimastix californiae
  GLHYDRLASE6
PGEWCNQTGVGVGARPQANP

SEQ ID NO: 10455 - protein, 13 aa, Neocallimastix californiae
  GLHYDRLASE6
VYFVCDSSRNGKK

SEQ ID NO: 10456 - protein, 13 aa, Neocallimastix californiae
  GLHYDRLASE6
VLTVFVVYDLPGR

SEQ ID NO: 10457 - protein, 19 aa, Neocallimastix californiae
  GLHYDRLASE6
DSSLISKAEKMKTYSNAIW

SEQ ID NO: 10458 - protein, 14 aa, Neocallimastix californiae
  GLHYDRLASE6
LDAFYWIKPLGESD

SEQ ID NO: 10459 - protein, 20 aa, Neocallimastix californiae
  GLHYDRLASE6
PGEWCNQTGAGVGYRPQANP

SEQ ID NO: 10460 - protein, 13 aa, Neocallimastix californiae
  GLHYDRLASE6
HVAMYLDIGHAFW

SEQ ID NO: 10461 - protein, 10 aa, Neocallimastix californiae
  GLHYDRLASE6
VRGFTDNVAN

SEQ ID NO: 10462 - protein, 15 aa, Neocallimastix californiae
  GLHYDRLASE6
YKGYVDNIYNTINRY

SEQ ID NO: 10463 - protein, 14 aa, Neocallimastix californiae
  GLHYDRLASE6
LDAYMWIKTPGEAD

SEQ ID NO: 10464 - protein, 10 aa, Neocallimastix californiae
  GLHYDRLASE6
IRGISTNISN

SEQ ID NO: 10465 - protein, 13 aa, Neocallimastix californiae
  GLHYDRLASE6
NVRVYLDAAHGAW

SEQ ID NO: 10466 - protein, 13 aa, Neocallimastix californiae
  GLHYDRLASE6
MKFIVDTSRNGQN

SEQ ID NO: 10467 - protein, 13 aa, Neocallimastix californiae
  GLHYDRLASE6
KTVVFVLYMIPTR

SEQ ID NO: 10468 - protein, 19 aa, Neocallimastix californiae
  GLHYDRLASE6
SGQLQEKAKKVKYVPTAAW

SEQ ID NO: 10469 - protein, 20 aa, Neocallimastix californiae
  GLHYDRLASE6
NNTWCNFKGAGLGPRPQANP

SEQ ID NO: 10470 - protein, 19 aa, Neocallimastix californiae
  GLHYDRLASE6
TPELQAKAKNVEKVATAVW

SEQ ID NO: 10471 - protein, 14 aa, Neocallimastix californiae
  GLHYDRLASE6
LDAFMWLKPPAESD

SEQ ID NO: 10472 - protein, 13 aa, Neocallimastix californiae
  GLHYDRLASE6
KTITFILYMIPTR

SEQ ID NO: 10473 - protein, 20 aa, Neocallimastix californiae
  GLHYDRLASE6
NQTWCNLIYAGLGEKSRGNP

SEQ ID NO: 10474 - protein, 10 aa, Neocallimastix californiae
  GLHYDRLASE6
IRGISTNVSN

SEQ ID NO: 10475 - protein, 13 aa, Neocallimastix californiae
  GLHYDRLASE6
NVNAYLDAAHHKW

SEQ ID NO: 10476 - protein, 15 aa, Neocallimastix californiae
  GLHYDRLASE6
YQGYVDSIAATIKKY

SEQ ID NO: 10477 - protein, 13 aa, Neocallimastix californiae
  GLHYDRLASE6
KKFIVDTGRSGVD

SEQ ID NO: 10478 - protein, 13 aa, Anaeromyces robustus
  GLHYDRLASE6
VYFVSDSSRNGHK

SEQ ID NO: 10479 - protein, 19 aa, Anaeromyces robustus
  GLHYDRLASE6
NSSLKAKAEKMKTFSNAIW

SEQ ID NO: 10480 - protein, 13 aa, Anaeromyces robustus
  GLHYDRLASE6
HVAMYLDIGHAFW

SEQ ID NO: 10481 - protein, 13 aa, Anaeromyces robustus
  GLHYDRLASE6
VLTVFVVYDLPGR

SEQ ID NO: 10482 - protein, 20 aa, Anaeromyces robustus
  GLHYDRLASE6
PGEWCNQTGVGIGARPQASP

SEQ ID NO: 10483 - protein, 10 aa, Anaeromyces robustus
  GLHYDRLASE6
VRGFVDNVAN

SEQ ID NO: 10484 - protein, 14 aa, Anaeromyces robustus
  GLHYDRLASE6
LDAFYWIKPLGESD

SEQ ID NO: 10485 - protein, 13 aa, Anaeromyces robustus
  GLHYDRLASE6
NVRVYLDAAHGAW

SEQ ID NO: 10486 - protein, 13 aa, Anaeromyces robustus
  GLHYDRLASE6
MKFIVDTSRNGQN

SEQ ID NO: 10487 - protein, 15 aa, Anaeromyces robustus
  GLHYDRLASE6
YKGYVDNIYNTINRY

SEQ ID NO: 10488 - protein, 20 aa, Anaeromyces robustus
  GLHYDRLASE6
NNTWCNFKGAGLGPRPQANP

SEQ ID NO: 10489 - protein, 19 aa, Anaeromyces robustus
  GLHYDRLASE6
SGQLQEKAKKVKYVPTAAW

SEQ ID NO: 10490 - protein, 13 aa, Anaeromyces robustus
  GLHYDRLASE6
KTVVFVLYMIPTR

SEQ ID NO: 10491 - protein, 14 aa, Anaeromyces robustus
  GLHYDRLASE6
LDAYMWIKTPGEAD

SEQ ID NO: 10492 - protein, 10 aa, Anaeromyces robustus
  GLHYDRLASE6
IRGISTNISN

SEQ ID NO: 10493 - protein, 15 aa, Anaeromyces robustus
  GLHYDRLASE6
YQGYVDSIAATIKKY

SEQ ID NO: 10494 - protein, 14 aa, Anaeromyces robustus
  GLHYDRLASE6
LDAFMWLKPPAESD

SEQ ID NO: 10495 - protein, 10 aa, Anaeromyces robustus
  GLHYDRLASE6
IRGISTNVSN

SEQ ID NO: 10496 - protein, 19 aa, Anaeromyces robustus
  GLHYDRLASE6
TPELQAKAKNVEKVATAVW

SEQ ID NO: 10497 - protein, 13 aa, Anaeromyces robustus
  GLHYDRLASE6
NVNAYLDAAHHKW

SEQ ID NO: 10498 - protein, 20 aa, Anaeromyces robustus
  GLHYDRLASE6
NQTWCNLIYAGLGEKSRGNP

SEQ ID NO: 10499 - protein, 13 aa, Anaeromyces robustus
  GLHYDRLASE6
KKFIVDTGRSGVD

SEQ ID NO: 10500 - protein, 13 aa, Anaeromyces robustus
  GLHYDRLASE6
KTITFILYMIPTR

SEQ ID NO: 10501 - protein, 19 aa, Anaeromyces robustus
  GLHYDRLASE6
DSSLKAKAEKMKTYPNAIW

SEQ ID NO: 10502 - protein, 10 aa, Anaeromyces robustus
  GLHYDRLASE6
VRGFVDNVAN

SEQ ID NO: 10503 - protein, 13 aa, Anaeromyces robustus
  GLHYDRLASE6
HVAMYLDIGHAFW

SEQ ID NO: 10504 - protein, 13 aa, Anaeromyces robustus
  GLHYDRLASE6
VLTVFVVYDLPGR

SEQ ID NO: 10505 - protein, 15 aa, Anaeromyces robustus
  GLHYDRLASE6
KTEYIDVIEEQLKKY

SEQ ID NO: 10506 - protein, 13 aa, Anaeromyces robustus
  GLHYDRLASE6
NVQVYLDAGHSQW

SEQ ID NO: 10507 - protein, 13 aa, Anaeromyces robustus
  GLHYDRLASE6
MRFVIDTSRNGQD

SEQ ID NO: 10508 - protein, 15 aa, Anaeromyces robustus
  GLHYDRLASE6
YKSYVDDVANTFRSN

SEQ ID NO: 10509 - protein, 10 aa, Anaeromyces robustus
  GLHYDRLASE6
IRGFSTNVSN

SEQ ID NO: 10510 - protein, 19 aa, Anaeromyces robustus
  GLHYDRLASE6
SGNLQQQANRVKYVPTAVW

SEQ ID NO: 10511 - protein, 14 aa, Anaeromyces robustus
  GLHYDRLASE6
LDAYMWLKPPAESD

SEQ ID NO: 10512 - protein, 13 aa, Anaeromyces robustus
  GLHYDRLASE6
STAVFIMYWIPTR

SEQ ID NO: 10513 - protein, 20 aa, Anaeromyces robustus
  GLHYDRLASE6
TKTWCNLVGTGFGERPKGNP

SEQ ID NO: 10514 - protein, 14 aa, Anaeromyces robustus
  GLHYDRLASE6
LDAVYWFKPPGESD

SEQ ID NO: 10515 - protein, 15 aa, Anaeromyces robustus
  GLHYDRLASE6
YKEWIDEIAGYFKNH

SEQ ID NO: 10516 - protein, 13 aa, Anaeromyces robustus
  GLHYDRLASE6
FGWVVDTSRNGVS

SEQ ID NO: 10517 - protein, 20 aa, Anaeromyces robustus
  GLHYDRLASE6
GESWCNIKGAGIGRRPEANP

SEQ ID NO: 10518 - protein, 10 aa, Anaeromyces robustus
  GLHYDRLASE6
LRGFTSNISN

SEQ ID NO: 10519 - protein, 13 aa, Anaeromyces robustus
  GLHYDRLASE6
ILTSFIIYNLPNR

SEQ ID NO: 10520 - protein, 19 aa, Anaeromyces robustus
  GLHYDRLASE6
EPEIAEIVAKVAKYPTPTW

SEQ ID NO: 10521 - protein, 13 aa, Anaeromyces robustus
  GLHYDRLASE6
NVGVYLDLAQVGW

SEQ ID NO: 10522 - protein, 20 aa, Anaeromyces robustus
  GLHYDRLASE6
VEDWCYNAPLGIGARPQANP

SEQ ID NO: 10523 - protein, 13 aa, Anaeromyces robustus
  GLHYDRLASE6
VLTTFVLYNLPGR

SEQ ID NO: 10524 - protein, 10 aa, Anaeromyces robustus
  GLHYDRLASE6
VRGFADNISN

SEQ ID NO: 10525 - protein, 19 aa, Anaeromyces robustus
  GLHYDRLASE6
DPTVIEKVEKMKQYSTGIW

SEQ ID NO: 10526 - protein, 14 aa, Anaeromyces robustus
  GLHYDRLASE6
LDAFVWIKPFYGDK

SEQ ID NO: 10527 - protein, 13 aa, Anaeromyces robustus
  GLHYDRLASE6
NVFLYLDVGHAFW

SEQ ID NO: 10528 - protein, 13 aa, Anaeromyces robustus
  GLHYDRLASE6
QTAVFILYWIPTR

SEQ ID NO: 10529 - protein, 15 aa, Anaeromyces robustus
  GLHYDRLASE6
YHTYVNRIVNGFKSH

SEQ ID NO: 10530 - protein, 13 aa, Anaeromyces robustus
  GLHYDRLASE6
MKFIVDTARNGVD

SEQ ID NO: 10531 - protein, 20 aa, Anaeromyces robustus
  GLHYDRLASE6
TGTWCNVKGTGFGERPRGSP

SEQ ID NO: 10532 - protein, 19 aa, Anaeromyces robustus
  GLHYDRLASE6
SGELKAKAQKIQDAPTAIW

SEQ ID NO: 10533 - protein, 14 aa, Anaeromyces robustus
  GLHYDRLASE6
LDAYMWLKPGGDSD

SEQ ID NO: 10534 - protein, 13 aa, Anaeromyces robustus
  GLHYDRLASE6
NVRTYIDAAHGRW

SEQ ID NO: 10535 - protein, 10 aa, Anaeromyces robustus
  GLHYDRLASE6
VRGLSTNVSN

SEQ ID NO: 10536 - protein, 15 aa, Piromyces finnis
  GLHYDRLASE6
YKEWIDEIAGYFAAH

SEQ ID NO: 10537 - protein, 19 aa, Piromyces finnis
  GLHYDRLASE6
ENEVAEIVAKVARYPTPTW

SEQ ID NO: 10538 - protein, 9 aa, Piromyces finnis
  GLHYDRLASE6
NVGVYMDLA

SEQ ID NO: 10539 - protein, 13 aa, Piromyces finnis
  GLHYDRLASE6
VLTSFIIYNLPNR

SEQ ID NO: 10540 - protein, 13 aa, Piromyces finnis
  GLHYDRLASE6
KTITFILYMIPTR

SEQ ID NO: 10541 - protein, 13 aa, Piromyces finnis
  GLHYDRLASE6
NVSAYLDAAHGKW

SEQ ID NO: 10542 - protein, 10 aa, Piromyces finnis
  GLHYDRLASE6
IRGFSTNVSN

SEQ ID NO: 10543 - protein, 15 aa, Piromyces finnis
  GLHYDRLASE6
YQGIVDKIANTISKY

SEQ ID NO: 10544 - protein, 19 aa, Piromyces finnis
  GLHYDRLASE6
SDELKAKAKNVMNVSSAVW

SEQ ID NO: 10545 - protein, 13 aa, Piromyces finnis
  GLHYDRLASE6
KKFIVDTGRSGVD

SEQ ID NO: 10546 - protein, 10 aa, Piromyces finnis
  GLHYDRLASE6
IRGFSTNVSN

SEQ ID NO: 10547 - protein, 14 aa, Piromyces finnis
  GLHYDRLASE6
LDAYMWLKPPGEAD

SEQ ID NO: 10548 - protein, 15 aa, Piromyces finnis
  GLHYDRLASE6
YQGIVDKIANTISKY

SEQ ID NO: 10549 - protein, 13 aa, Piromyces finnis
  GLHYDRLASE6
NVSAYLDAAHGKW

SEQ ID NO: 10550 - protein, 20 aa, Piromyces finnis
  GLHYDRLASE6
NQTWCNFVYAGLGEPSRGSP

SEQ ID NO: 10551 - protein, 19 aa, Piromyces finnis
  GLHYDRLASE6
SGDLAAKAEKVKQVPTAVW

SEQ ID NO: 10552 - protein, 13 aa, Piromyces finnis
  GLHYDRLASE6
KTVVFILYMIPTR

SEQ ID NO: 10553 - protein, 10 aa, Piromyces finnis
  GLHYDRLASE6
IRGFSTNVSN

SEQ ID NO: 10554 - protein, 14 aa, Piromyces finnis
  GLHYDRLASE6
LDAYMWLKPPGEAD

SEQ ID NO: 10555 - protein, 15 aa, Piromyces finnis
  GLHYDRLASE6
YQGIVDKIANTISKY

SEQ ID NO: 10556 - protein, 13 aa, Piromyces finnis
  GLHYDRLASE6
KTITFILYMIPTR

SEQ ID NO: 10557 - protein, 20 aa, Piromyces finnis
  GLHYDRLASE6
NQTWCNFVYAGLGEPSRGSP

SEQ ID NO: 10558 - protein, 19 aa, Piromyces finnis
  GLHYDRLASE6
SDELKAKANNVMNVSSAVW

SEQ ID NO: 10559 - protein, 13 aa, Piromyces finnis
  GLHYDRLASE6
KKFIVDTGRSGVD

SEQ ID NO: 10560 - protein, 13 aa, Piromyces finnis
  GLHYDRLASE6
NVSAYLDAAHGKW

SEQ ID NO: 10561 - protein, 10 aa, Piromyces finnis
  GLHYDRLASE6
IRGFSTNVSN

SEQ ID NO: 10562 - protein, 20 aa, Piromyces finnis
  GLHYDRLASE6
NQTWCNFVYAGLGEPSRGSP

SEQ ID NO: 10563 - protein, 13 aa, Piromyces finnis
  GLHYDRLASE6
NVSAYLDAAHGKW

SEQ ID NO: 10564 - protein, 15 aa, Piromyces finnis
  GLHYDRLASE6
YQGIVDKIANTISKY

SEQ ID NO: 10565 - protein, 19 aa, Piromyces finnis
  GLHYDRLASE6
SDELKAKANNVMNVSSAVW

SEQ ID NO: 10566 - protein, 13 aa, Piromyces finnis
  GLHYDRLASE6
KKFIVDTGRSGVD

SEQ ID NO: 10567 - protein, 14 aa, Piromyces finnis
  GLHYDRLASE6
LDAYMWLKPPGEAD

SEQ ID NO: 10568 - protein, 13 aa, Piromyces finnis
  GLHYDRLASE6
KTITFILYMIPTR

SEQ ID NO: 10569 - protein, 13 aa, Piromyces finnis
  GLHYDRLASE6
NVSVYLDAAHGKW

SEQ ID NO: 10570 - protein, 14 aa, Piromyces finnis
  GLHYDRLASE6
LDAYMWLKPPGEAD

SEQ ID NO: 10571 - protein, 10 aa, Piromyces finnis
  GLHYDRLASE6
IRGLSTNVSN

SEQ ID NO: 10572 - protein, 20 aa, Piromyces finnis
  GLHYDRLASE6
NETWCNFVGTGFGERPQGNP

SEQ ID NO: 10573 - protein, 13 aa, Piromyces finnis
  GLHYDRLASE6
MHFIVDTGRNGVD

SEQ ID NO: 10574 - protein, 20 aa, Piromyces finnis
  GLHYDRLASE6
PGEWCNQMGSGIGARPQASP

SEQ ID NO: 10575 - protein, 14 aa, Piromyces finnis
  GLHYDRLASE6
LDAFYWVKPYGESD

SEQ ID NO: 10576 - protein, 13 aa, Piromyces finnis
  GLHYDRLASE6
VLTVFVVYDLPGR

SEQ ID NO: 10577 - protein, 13 aa, Piromyces finnis
  GLHYDRLASE6
VYFIEDTSRNGVK

SEQ ID NO: 10578 - protein, 19 aa, Piromyces finnis
  GLHYDRLASE6
NSSLIAKAEKMKEYSNAIW

SEQ ID NO: 10579 - protein, 10 aa, Piromyces finnis
  GLHYDRLASE6
VRGFASNVAN

SEQ ID NO: 10580 - protein, 13 aa, Piromyces finnis
  GLHYDRLASE6
HIAMYLDIGHAFW

SEQ ID NO: 10581 - protein, 13 aa, Piromyces finnis
  GLHYDRLASE6
VYFIEDTSRNGVK

SEQ ID NO: 10582 - protein, 19 aa, Piromyces finnis
  GLHYDRLASE6
DSSLIAKAEKMKEYSNAIW

SEQ ID NO: 10583 - protein, 13 aa, Piromyces finnis
  GLHYDRLASE6
VLTVFVVYDLPGR

SEQ ID NO: 10584 - protein, 14 aa, Piromyces finnis
  GLHYDRLASE6
LDAFYWVKPYGESD

SEQ ID NO: 10585 - protein, 20 aa, Piromyces finnis
  GLHYDRLASE6
PGEWCNQMGSGIGARPQASP

SEQ ID NO: 10586 - protein, 10 aa, Piromyces finnis
  GLHYDRLASE6
VRGFASNVAN

SEQ ID NO: 10587 - protein, 13 aa, Piromyces finnis
  GLHYDRLASE6
HIAMYLDIGHAFW

SEQ ID NO: 10588 - protein, 10 aa, Piromyces finnis
  GLHYDRLASE6
VRGFASNVAN

SEQ ID NO: 10589 - protein, 13 aa, Piromyces finnis
  GLHYDRLASE6
HIAMYLDIGHAFW

SEQ ID NO: 10590 - protein, 13 aa, Piromyces finnis
  GLHYDRLASE6
VLTVFVVYDLPGR

SEQ ID NO: 10591 - protein, 14 aa, Piromyces finnis
  GLHYDRLASE6
LDAFYWVKPYGESD

SEQ ID NO: 10592 - protein, 19 aa, Piromyces finnis
  GLHYDRLASE6
NSSLIAKAEKMKEYSNAIW

SEQ ID NO: 10593 - protein, 13 aa, Piromyces finnis
  GLHYDRLASE6
VYFIEDTSRNGVK

SEQ ID NO: 10594 - protein, 20 aa, Piromyces finnis
  GLHYDRLASE6
PGEWCNQMGSGIGARPQASP

SEQ ID NO: 10595 - protein, 14 aa, Piromyces finnis
  GLHYDRLASE6
LDAFYWVKPYGESD

SEQ ID NO: 10596 - protein, 19 aa, Piromyces finnis
  GLHYDRLASE6
NSSLIAKAEKMKEYSNAIW

SEQ ID NO: 10597 - protein, 13 aa, Piromyces finnis
  GLHYDRLASE6
HIAMYLDIGHAFW

SEQ ID NO: 10598 - protein, 13 aa, Piromyces finnis
  GLHYDRLASE6
VYFIEDTSRNGVK

SEQ ID NO: 10599 - protein, 13 aa, Piromyces finnis
  GLHYDRLASE6
VLTVFVVYDLPGR

SEQ ID NO: 10600 - protein, 10 aa, Piromyces finnis
  GLHYDRLASE6
VRGFASNVAN

SEQ ID NO: 10601 - protein, 20 aa, Piromyces finnis
  GLHYDRLASE6
PGEWCNQMGSGIGARPQASP

SEQ ID NO: 10602 - protein, 20 aa, Piromyces finnis
  GLHYDRLASE6
PGEWCNQMGSGIGARPQASP

SEQ ID NO: 10603 - protein, 10 aa, Piromyces finnis
  GLHYDRLASE6
VRGFASNVAN

SEQ ID NO: 10604 - protein, 14 aa, Piromyces finnis
  GLHYDRLASE6
LDAFYWVKPYGESD

SEQ ID NO: 10605 - protein, 19 aa, Piromyces finnis
  GLHYDRLASE6
NSSLIAKAEKMKEYSNAIW

SEQ ID NO: 10606 - protein, 13 aa, Piromyces finnis
  GLHYDRLASE6
HIAMYLDIGHAFW

SEQ ID NO: 10607 - protein, 13 aa, Piromyces finnis
  GLHYDRLASE6
VYFIEDTSRNGVK

SEQ ID NO: 10608 - protein, 13 aa, Piromyces finnis
  GLHYDRLASE6
VLTVFVVYDLPGR

SEQ ID NO: 10609 - protein, 20 aa, Piromyces finnis
  GLHYDRLASE6
PGEWCNQMGSGIGARPQASP

SEQ ID NO: 10610 - protein, 14 aa, Piromyces finnis
  GLHYDRLASE6
LDAFYWVKPYGESD

SEQ ID NO: 10611 - protein, 13 aa, Piromyces finnis
  GLHYDRLASE6
VLTVFVVYDLPGR

SEQ ID NO: 10612 - protein, 13 aa, Piromyces finnis
  GLHYDRLASE6
VYFIEDTSRNGVK

SEQ ID NO: 10613 - protein, 19 aa, Piromyces finnis
  GLHYDRLASE6
NSSLIAKAEKMKEYSNAIW

SEQ ID NO: 10614 - protein, 10 aa, Piromyces finnis
  GLHYDRLASE6
VRGFASNVAN

SEQ ID NO: 10615 - protein, 13 aa, Piromyces finnis
  GLHYDRLASE6
HIAMYLDIGHAFW

SEQ ID NO: 10616 - protein, 20 aa, Piromyces finnis
  GLHYDRLASE6
PGEWCNQMGSGIGARPQASP

SEQ ID NO: 10617 - protein, 10 aa, Piromyces finnis
  GLHYDRLASE6
VRGFASNVAN

SEQ ID NO: 10618 - protein, 14 aa, Piromyces finnis
  GLHYDRLASE6
LDAFYWVKPYGESD

SEQ ID NO: 10619 - protein, 19 aa, Piromyces finnis
  GLHYDRLASE6
NSSLIAKAEKMKEYSNAIW

SEQ ID NO: 10620 - protein, 13 aa, Piromyces finnis
  GLHYDRLASE6
HIAMYLDIGHAFW

SEQ ID NO: 10621 - protein, 13 aa, Piromyces finnis
  GLHYDRLASE6
VYFIEDTSRNGVK

SEQ ID NO: 10622 - protein, 13 aa, Piromyces finnis
  GLHYDRLASE6
VLTVFVVYDLPGR

SEQ ID NO: 10623 - protein, 13 aa, Piromyces finnis
  GLHYDRLASE6
VYFIEDTSRNGVK

SEQ ID NO: 10624 - protein, 19 aa, Piromyces finnis
  GLHYDRLASE6
DSSLIAKAEKMKEYSNAIW

SEQ ID NO: 10625 - protein, 13 aa, Piromyces finnis
  GLHYDRLASE6
VLTVFVVYDLPGR

SEQ ID NO: 10626 - protein, 14 aa, Piromyces finnis
  GLHYDRLASE6
LDAFYWVKPYGESD

SEQ ID NO: 10627 - protein, 20 aa, Piromyces finnis
  GLHYDRLASE6
PGEWCNQMGSGIGARPQASP

SEQ ID NO: 10628 - protein, 10 aa, Piromyces finnis
  GLHYDRLASE6
VRGFASNVAN

SEQ ID NO: 10629 - protein, 13 aa, Piromyces finnis
  GLHYDRLASE6
HIAMYLDIGHAFW

SEQ ID NO: 10630 - protein, 14 aa, Piromyces finnis
  GLHYDRLASE6
LDAFYWVKPYGESD

SEQ ID NO: 10631 - protein, 13 aa, Piromyces finnis
  GLHYDRLASE6
VLTVFVVYDLPGR

SEQ ID NO: 10632 - protein, 10 aa, Piromyces finnis
  GLHYDRLASE6
VRGFASNVAN

SEQ ID NO: 10633 - protein, 13 aa, Piromyces finnis
  GLHYDRLASE6
VYFIEDTSRNGVK

SEQ ID NO: 10634 - protein, 19 aa, Piromyces finnis
  GLHYDRLASE6
DSSLIAKAEKMKEYSNAIW

SEQ ID NO: 10635 - protein, 20 aa, Piromyces finnis
  GLHYDRLASE6
PGEWCNQMGSGIGARPQASP

SEQ ID NO: 10636 - protein, 13 aa, Piromyces finnis
  GLHYDRLASE6
HIAMYLDIGHAFW

SEQ ID NO: 10637 - protein, 13 aa, Piromyces finnis
  GLHYDRLASE6
VYFIEDTSRNGVK

SEQ ID NO: 10638 - protein, 19 aa, Piromyces finnis
  GLHYDRLASE6
DSSLIAKAEKMKEYSNAIW

SEQ ID NO: 10639 - protein, 13 aa, Piromyces finnis
  GLHYDRLASE6
VLTVFVVYDLPGR

SEQ ID NO: 10640 - protein, 14 aa, Piromyces finnis
  GLHYDRLASE6
LDAFYWVKPYGESD

SEQ ID NO: 10641 - protein, 20 aa, Piromyces finnis
  GLHYDRLASE6
PGEWCNQMGSGIGARPQASP

SEQ ID NO: 10642 - protein, 10 aa, Piromyces finnis
  GLHYDRLASE6
VRGFASNVAN

SEQ ID NO: 10643 - protein, 13 aa, Piromyces finnis
  GLHYDRLASE6
HIAMYLDIGHAFW

SEQ ID NO: 10644 - protein, 20 aa, Piromyces finnis
  GLHYDRLASE6
PGEWCNQMGSGIGARPQASP

SEQ ID NO: 10645 - protein, 14 aa, Piromyces finnis
  GLHYDRLASE6
LDAFYWVKPYGESD

SEQ ID NO: 10646 - protein, 13 aa, Piromyces finnis
  GLHYDRLASE6
VLTVFVVYDLPGR

SEQ ID NO: 10647 - protein, 13 aa, Piromyces finnis
  GLHYDRLASE6
VYFIEDTSRNGVK

SEQ ID NO: 10648 - protein, 19 aa, Piromyces finnis
  GLHYDRLASE6
NSSLIAKAEKMKEYSNAIW

SEQ ID NO: 10649 - protein, 10 aa, Piromyces finnis
  GLHYDRLASE6
VRGFASNVAN

SEQ ID NO: 10650 - protein, 13 aa, Piromyces finnis
  GLHYDRLASE6
HIAMYLDIGHAFW

SEQ ID NO: 10651 - protein, 14 aa, Piromyces finnis
  GLHYDRLASE6
LDAFYWVKPYGESD

SEQ ID NO: 10652 - protein, 13 aa, Piromyces finnis
  GLHYDRLASE6
VLTVFVVYDLPGR

SEQ ID NO: 10653 - protein, 10 aa, Piromyces finnis
  GLHYDRLASE6
VRGFASNVAN

SEQ ID NO: 10654 - protein, 13 aa, Piromyces finnis
  GLHYDRLASE6
VYFIEDTSRNGVK

SEQ ID NO: 10655 - protein, 19 aa, Piromyces finnis
  GLHYDRLASE6
DSSLIAKAEKMKEYSNAIW

SEQ ID NO: 10656 - protein, 20 aa, Piromyces finnis
  GLHYDRLASE6
PGEWCNQMGSGIGARPQASP

SEQ ID NO: 10657 - protein, 13 aa, Piromyces finnis
  GLHYDRLASE6
HIAMYLDIGHAFW

SEQ ID NO: 10658 - protein, 14 aa, Piromyces finnis
  GLHYDRLASE6
LDAFYWVKPYGESD

SEQ ID NO: 10659 - protein, 19 aa, Piromyces finnis
  GLHYDRLASE6
NSSLIAKAEKMKEYSNAIW

SEQ ID NO: 10660 - protein, 13 aa, Piromyces finnis
  GLHYDRLASE6
HIAMYLDIGHAFW

SEQ ID NO: 10661 - protein, 13 aa, Piromyces finnis
  GLHYDRLASE6
VYFIEDTSRNGVK

SEQ ID NO: 10662 - protein, 13 aa, Piromyces finnis
  GLHYDRLASE6
VLTVFVVYDLPGR

SEQ ID NO: 10663 - protein, 10 aa, Piromyces finnis
  GLHYDRLASE6
VRGFASNVAN

SEQ ID NO: 10664 - protein, 20 aa, Piromyces finnis
  GLHYDRLASE6
PGEWCNQMGSGIGARPQASP

SEQ ID NO: 10665 - protein, 10 aa, Piromyces finnis
  GLHYDRLASE6
VRGFASNVAN

SEQ ID NO: 10666 - protein, 13 aa, Piromyces finnis
  GLHYDRLASE6
HIAMYLDIGHAFW

SEQ ID NO: 10667 - protein, 13 aa, Piromyces finnis
  GLHYDRLASE6
VLTVFVVYDLPGR

SEQ ID NO: 10668 - protein, 14 aa, Piromyces finnis
  GLHYDRLASE6
LDAFYWVKPYGESD

SEQ ID NO: 10669 - protein, 19 aa, Piromyces finnis
  GLHYDRLASE6
NSSLIAKAEKMKEYSNAIW

SEQ ID NO: 10670 - protein, 13 aa, Piromyces finnis
  GLHYDRLASE6
VYFIEDTSRNGVK

SEQ ID NO: 10671 - protein, 20 aa, Piromyces finnis
  GLHYDRLASE6
PGEWCNQMGSGIGARPQASP

SEQ ID NO: 10672 - protein, 14 aa, Piromyces finnis
  GLHYDRLASE6
LDAFYWVKPYGESD

SEQ ID NO: 10673 - protein, 19 aa, Piromyces finnis
  GLHYDRLASE6
NSSLIAKAEKMKEYSNAIW

SEQ ID NO: 10674 - protein, 13 aa, Piromyces finnis
  GLHYDRLASE6
HIAMYLDIGHAFW

SEQ ID NO: 10675 - protein, 13 aa, Piromyces finnis
  GLHYDRLASE6
VYFIEDTSRNGVK

SEQ ID NO: 10676 - protein, 13 aa, Piromyces finnis
  GLHYDRLASE6
VLTVFVVYDLPGR

SEQ ID NO: 10677 - protein, 10 aa, Piromyces finnis
  GLHYDRLASE6
VRGFASNVAN

SEQ ID NO: 10678 - protein, 20 aa, Piromyces finnis
  GLHYDRLASE6
PGEWCNQMGSGIGARPQASP

SEQ ID NO: 10679 - protein, 14 aa, Piromyces finnis
  GLHYDRLASE6
LDAFYWVKPYGESD

SEQ ID NO: 10680 - protein, 13 aa, Piromyces finnis
  GLHYDRLASE6
VLTVFVVYDLPGR

SEQ ID NO: 10681 - protein, 10 aa, Piromyces finnis
  GLHYDRLASE6
VRGFASNVAN

SEQ ID NO: 10682 - protein, 13 aa, Piromyces finnis
  GLHYDRLASE6
VYFIEDTSRNGVK

SEQ ID NO: 10683 - protein, 19 aa, Piromyces finnis
  GLHYDRLASE6
DSSLIAKAEKMKEYSNAIW

SEQ ID NO: 10684 - protein, 20 aa, Piromyces finnis
  GLHYDRLASE6
PGEWCNQMGSGIGARPQASP

SEQ ID NO: 10685 - protein, 13 aa, Piromyces finnis
  GLHYDRLASE6
HIAMYLDIGHAFW

SEQ ID NO: 10686 - protein, 10 aa, Piromyces finnis
  GLHYDRLASE6
VRGFASNVAN

SEQ ID NO: 10687 - protein, 13 aa, Piromyces finnis
  GLHYDRLASE6
HIAMYLDIGHAFW

SEQ ID NO: 10688 - protein, 13 aa, Piromyces finnis
  GLHYDRLASE6
VLTVFVVYDLPGR

SEQ ID NO: 10689 - protein, 14 aa, Piromyces finnis
  GLHYDRLASE6
LDAFYWVKPYGESD

SEQ ID NO: 10690 - protein, 19 aa, Piromyces finnis
  GLHYDRLASE6
NSSLIAKAEKMKEYSNAIW

SEQ ID NO: 10691 - protein, 13 aa, Piromyces finnis
  GLHYDRLASE6
VYFIEDTSRNGVK

SEQ ID NO: 10692 - protein, 20 aa, Piromyces finnis
  GLHYDRLASE6
PGEWCNQMGSGIGARPQASP

SEQ ID NO: 10693 - protein, 20 aa, Piromyces finnis
  GLHYDRLASE6
PGEWCNQMGSGIGARPQASP

SEQ ID NO: 10694 - protein, 10 aa, Piromyces finnis
  GLHYDRLASE6
VRGFASNVAN

SEQ ID NO: 10695 - protein, 14 aa, Piromyces finnis
  GLHYDRLASE6
LDAFYWVKPYGESD

SEQ ID NO: 10696 - protein, 19 aa, Piromyces finnis
  GLHYDRLASE6
NSSLIAKAEKMKEYSNAIW

SEQ ID NO: 10697 - protein, 13 aa, Piromyces finnis
  GLHYDRLASE6
HIAMYLDIGHAFW

SEQ ID NO: 10698 - protein, 13 aa, Piromyces finnis
  GLHYDRLASE6
VYFIEDTSRNGVK

SEQ ID NO: 10699 - protein, 13 aa, Piromyces finnis
  GLHYDRLASE6
VLTVFVVYDLPGR

SEQ ID NO: 10700 - protein, 13 aa, Piromyces finnis
  GLHYDRLASE6
MKFIVDTSRNGAN

SEQ ID NO: 10701 - protein, 14 aa, Piromyces finnis
  GLHYDRLASE6
LDAYMWIKTPGEAD

SEQ ID NO: 10702 - protein, 13 aa, Piromyces finnis
  GLHYDRLASE6
NTVVFVLYMIPTR

SEQ ID NO: 10703 - protein, 13 aa, Piromyces finnis
  GLHYDRLASE6
NVRVYLDAAHGAW

SEQ ID NO: 10704 - protein, 15 aa, Piromyces finnis
  GLHYDRLASE6
YKGYVDKIYNTINQY

SEQ ID NO: 10705 - protein, 19 aa, Piromyces finnis
  GLHYDRLASE6
SGSLAEKAKKVKYVPTAAW

SEQ ID NO: 10706 - protein, 20 aa, Piromyces finnis
  GLHYDRLASE6
SGTWCNFKGAGLGARPQGSP

SEQ ID NO: 10707 - protein, 10 aa, Piromyces finnis
  GLHYDRLASE6
LRGISTNVSN

SEQ ID NO: 10708 - protein, 20 aa, Piromyces finnis
  GLHYDRLASE6
PGEWCNQMGSGIGARPQANP

SEQ ID NO: 10709 - protein, 13 aa, Piromyces finnis
  GLHYDRLASE6
VLTVFVVYDLPGR

SEQ ID NO: 10710 - protein, 13 aa, Piromyces finnis
  GLHYDRLASE6
VYFIEDTSRNGVK

SEQ ID NO: 10711 - protein, 10 aa, Piromyces finnis
  GLHYDRLASE6
VRGFASNVAN

SEQ ID NO: 10712 - protein, 19 aa, Piromyces finnis
  GLHYDRLASE6
DSSLIAKAEKMKEYSNAIW

SEQ ID NO: 10713 - protein, 13 aa, Piromyces finnis
  GLHYDRLASE6
HIAMYLDIGHAFW

SEQ ID NO: 10714 - protein, 14 aa, Piromyces finnis
  GLHYDRLASE6
LDAFYWVKPYGESD

SEQ ID NO: 10715 - protein, 20 aa, Piromyces finnis
  GLHYDRLASE6
PGEWCNQMGSGIGARPQANP

SEQ ID NO: 10716 - protein, 19 aa, Piromyces finnis
  GLHYDRLASE6
DSSLIAKAEKMKEYSNAIW

SEQ ID NO: 10717 - protein, 13 aa, Piromyces finnis
  GLHYDRLASE6
VYFIEDTSRNGVK

SEQ ID NO: 10718 - protein, 13 aa, Piromyces finnis
  GLHYDRLASE6
VLTVFVVYDLPGR

SEQ ID NO: 10719 - protein, 13 aa, Piromyces finnis
  GLHYDRLASE6
HVSMYLDIGHAFW

SEQ ID NO: 10720 - protein, 14 aa, Piromyces finnis
  GLHYDRLASE6
LDAFYWVKPYGESD

SEQ ID NO: 10721 - protein, 10 aa, Piromyces finnis
  GLHYDRLASE6
VRGFASNVAN

SEQ ID NO: 10722 - protein, 20 aa, Piromyces finnis
  GLHYDRLASE6
PGEWCNQMGSGIGARPQANP

SEQ ID NO: 10723 - protein, 19 aa, Piromyces finnis
  GLHYDRLASE6
DSSLIAKAEKMKEYSNAIW

SEQ ID NO: 10724 - protein, 13 aa, Piromyces finnis
  GLHYDRLASE6
VYFIEDTSRNGVK

SEQ ID NO: 10725 - protein, 13 aa, Piromyces finnis
  GLHYDRLASE6
VLTVFVVYDLPGR

SEQ ID NO: 10726 - protein, 13 aa, Piromyces finnis
  GLHYDRLASE6
HIAMYLDIGHAFW

SEQ ID NO: 10727 - protein, 14 aa, Piromyces finnis
  GLHYDRLASE6
LDAFYWVKPYGESD

SEQ ID NO: 10728 - protein, 10 aa, Piromyces finnis
  GLHYDRLASE6
VRGFASNVAN

SEQ ID NO: 10729 - protein, 20 aa, Piromyces finnis
  GLHYDRLASE6
PGEWCNQMGSGIGARPQANP

SEQ ID NO: 10730 - protein, 13 aa, Piromyces finnis
  GLHYDRLASE6
HVSMYLDIGHAFW

SEQ ID NO: 10731 - protein, 13 aa, Piromyces finnis
  GLHYDRLASE6
VLTVFVVYDLPGR

SEQ ID NO: 10732 - protein, 13 aa, Piromyces finnis
  GLHYDRLASE6
VYFIEDTSRNGVK

SEQ ID NO: 10733 - protein, 10 aa, Piromyces finnis
  GLHYDRLASE6
VRGFASNVAN

SEQ ID NO: 10734 - protein, 19 aa, Piromyces finnis
  GLHYDRLASE6
DSSLIAKAEKMKEYSNAIW

SEQ ID NO: 10735 - protein, 14 aa, Piromyces finnis
  GLHYDRLASE6
LDAFYWVKPYGESD

SEQ ID NO: 10736 - protein, 10 aa, Piromyces finnis
  GLHYDRLASE6
VRGFASNVAN

SEQ ID NO: 10737 - protein, 19 aa, Piromyces finnis
  GLHYDRLASE6
DSSLIAKAEKMKEYSNAIW

SEQ ID NO: 10738 - protein, 13 aa, Piromyces finnis
  GLHYDRLASE6
VLTVFVVYDLPGR

SEQ ID NO: 10739 - protein, 14 aa, Piromyces finnis
  GLHYDRLASE6
LDAFYWVKPYGESD

SEQ ID NO: 10740 - protein, 20 aa, Piromyces finnis
  GLHYDRLASE6
PGEWCNQMGSGIGARPQANP

SEQ ID NO: 10741 - protein, 13 aa, Piromyces finnis
  GLHYDRLASE6
VYFIEDTSRNGVK

SEQ ID NO: 10742 - protein, 13 aa, Piromyces finnis
  GLHYDRLASE6
HVSMYLDIGHAFW

SEQ ID NO: 10743 - protein, 10 aa, Piromyces finnis
  GLHYDRLASE6
VRGFASNVAN

SEQ ID NO: 10744 - protein, 13 aa, Piromyces finnis
  GLHYDRLASE6
HIAMYLDIGHAFW

SEQ ID NO: 10745 - protein, 14 aa, Piromyces finnis
  GLHYDRLASE6
LDAFYWVKPYGESD

SEQ ID NO: 10746 - protein, 19 aa, Piromyces finnis
  GLHYDRLASE6
DSSLIAKAEKMKEYSNAIW

SEQ ID NO: 10747 - protein, 13 aa, Piromyces finnis
  GLHYDRLASE6
VYFIEDTSRNGVK

SEQ ID NO: 10748 - protein, 20 aa, Piromyces finnis
  GLHYDRLASE6
PGEWCNQMGSGIGARPQANP

SEQ ID NO: 10749 - protein, 13 aa, Piromyces finnis
  GLHYDRLASE6
VLTVFVVYDLPGR

SEQ ID NO: 10750 - protein, 10 aa, Piromyces finnis
  GLHYDRLASE6
VRGFASNVAN

SEQ ID NO: 10751 - protein, 13 aa, Piromyces finnis
  GLHYDRLASE6
HIAMYLDIGHAFW

SEQ ID NO: 10752 - protein, 13 aa, Piromyces finnis
  GLHYDRLASE6
VYFIEDTSRNGVK

SEQ ID NO: 10753 - protein, 14 aa, Piromyces finnis
  GLHYDRLASE6
LDAFYWVKPYGESD

SEQ ID NO: 10754 - protein, 19 aa, Piromyces finnis
  GLHYDRLASE6
DSSLIAKAEKMKEYSNAIW

SEQ ID NO: 10755 - protein, 20 aa, Piromyces finnis
  GLHYDRLASE6
PGEWCNQMGSGIGARPQANP

SEQ ID NO: 10756 - protein, 13 aa, Piromyces finnis
  GLHYDRLASE6
VLTVFVVYDLPGR

SEQ ID NO: 10757 - protein, 10 aa, Piromyces finnis
  GLHYDRLASE6
VRGFASNVAN

SEQ ID NO: 10758 - protein, 19 aa, Piromyces finnis
  GLHYDRLASE6
DSSLIAKAEKMKEYSNAIW

SEQ ID NO: 10759 - protein, 13 aa, Piromyces finnis
  GLHYDRLASE6
VLTVFVVYDLPGR

SEQ ID NO: 10760 - protein, 14 aa, Piromyces finnis
  GLHYDRLASE6
LDAFYWVKPYGESD

SEQ ID NO: 10761 - protein, 20 aa, Piromyces finnis
  GLHYDRLASE6
PGEWCNQMGSGIGARPQANP

SEQ ID NO: 10762 - protein, 13 aa, Piromyces finnis
  GLHYDRLASE6
HIAMYLDIGHAFW

SEQ ID NO: 10763 - protein, 13 aa, Piromyces finnis
  GLHYDRLASE6
VYFIEDTSRNGVK

SEQ ID NO: 10764 - protein, 19 aa, Piromyces finnis
  GLHYDRLASE6
DSSLIAKAEKMKEYSNAIW

SEQ ID NO: 10765 - protein, 13 aa, Piromyces finnis
  GLHYDRLASE6
VLTVFVVYDLPGR

SEQ ID NO: 10766 - protein, 10 aa, Piromyces finnis
  GLHYDRLASE6
VRGFASNVAN

SEQ ID NO: 10767 - protein, 13 aa, Piromyces finnis
  GLHYDRLASE6
HIAMYLDIGHAFW

SEQ ID NO: 10768 - protein, 13 aa, Piromyces finnis
  GLHYDRLASE6
VYFIEDTSRNGVK

SEQ ID NO: 10769 - protein, 14 aa, Piromyces finnis
  GLHYDRLASE6
LDAFYWVKPYGESD

SEQ ID NO: 10770 - protein, 20 aa, Piromyces finnis
  GLHYDRLASE6
PGEWCNQMGSGIGARPQANP

SEQ ID NO: 10771 - protein, 13 aa, Piromyces finnis
  GLHYDRLASE6
HIAMYLDIGHAFW

SEQ ID NO: 10772 - protein, 19 aa, Piromyces finnis
  GLHYDRLASE6
DSSLIAKAEKMKEYSNAIW

SEQ ID NO: 10773 - protein, 10 aa, Piromyces finnis
  GLHYDRLASE6
VRGFASNVAN

SEQ ID NO: 10774 - protein, 14 aa, Piromyces finnis
  GLHYDRLASE6
LDAFYWVKPYGESD

SEQ ID NO: 10775 - protein, 20 aa, Piromyces finnis
  GLHYDRLASE6
PGEWCNQMGSGIGARPQANP

SEQ ID NO: 10776 - protein, 13 aa, Piromyces finnis
  GLHYDRLASE6
VLTVFVVYDLPGR

SEQ ID NO: 10777 - protein, 13 aa, Piromyces finnis
  GLHYDRLASE6
VYFIEDTSRNGVK

SEQ ID NO: 10778 - protein, 19 aa, Piromyces finnis
  GLHYDRLASE6
DSSLIAKAEKMKEYSNAIW

SEQ ID NO: 10779 - protein, 10 aa, Piromyces finnis
  GLHYDRLASE6
VRGFASNVAN

SEQ ID NO: 10780 - protein, 14 aa, Piromyces finnis
  GLHYDRLASE6
LDAFYWVKPYGESD

SEQ ID NO: 10781 - protein, 20 aa, Piromyces finnis
  GLHYDRLASE6
PGEWCNQMGSGIGARPQANP

SEQ ID NO: 10782 - protein, 13 aa, Piromyces finnis
  GLHYDRLASE6
VLTVFVVYDLPGR

SEQ ID NO: 10783 - protein, 13 aa, Piromyces finnis
  GLHYDRLASE6
VYFIEDTSRNGVK

SEQ ID NO: 10784 - protein, 13 aa, Piromyces finnis
  GLHYDRLASE6
HVSMYLDIGHAFW

SEQ ID NO: 10785 - protein, 13 aa, Piromyces finnis
  GLHYDRLASE6
VLTVFVVYDLPGR

SEQ ID NO: 10786 - protein, 10 aa, Piromyces finnis
  GLHYDRLASE6
VRGFASNVAN

SEQ ID NO: 10787 - protein, 14 aa, Piromyces finnis
  GLHYDRLASE6
LDAFYWVKPYGESD

SEQ ID NO: 10788 - protein, 20 aa, Piromyces finnis
  GLHYDRLASE6
PGEWCNQMGSGIGARPQANP

SEQ ID NO: 10789 - protein, 13 aa, Piromyces finnis
  GLHYDRLASE6
VYFIEDTSRNGVK

SEQ ID NO: 10790 - protein, 19 aa, Piromyces finnis
  GLHYDRLASE6
DSSLIAKAEKMKEYSNAIW

SEQ ID NO: 10791 - protein, 13 aa, Piromyces finnis
  GLHYDRLASE6
HIAMYLDIGHAFW

SEQ ID NO: 10792 - protein, 18 aa, Neocallimastix californiae
  GLHYDRLASE8
APDGEMYFMMSLLFAANR

SEQ ID NO: 10793 - protein, 9 aa, Neocallimastix californiae
  GLHYDRLASE8
YMYDAMRCA

SEQ ID NO: 10794 - protein, 13 aa, Neocallimastix californiae
  GLHYDRLASE8
VRSEGMSYGMMIC

SEQ ID NO: 10795 - protein, 14 aa, Neocallimastix californiae
  GLHYDRLASE8
YYDGLVHYLSMLHL

SEQ ID NO: 10796 - protein, 17 aa, Neocallimastix californiae
  GLHYDRLASE8
DPSYDLPAFVDLFSRWS

SEQ ID NO: 10797 - protein, 9 aa, Neocallimastix californiae
  GLHYDRLASE8
YMYDAMRCA

SEQ ID NO: 10798 - protein, 13 aa, Neocallimastix californiae
  GLHYDRLASE8
VRSEGMSYGMMIA

SEQ ID NO: 10799 - protein, 18 aa, Neocallimastix californiae
  GLHYDRLASE8
APDGEMYFMMSLLFAANR

SEQ ID NO: 10800 - protein, 14 aa, Neocallimastix californiae
  GLHYDRLASE8
YYDGLVHYLAMLHL

SEQ ID NO: 10801 - protein, 9 aa, Anaeromyces robustus
  GLHYDRLASE8
YMYDAMRCA

SEQ ID NO: 10802 - protein, 13 aa, Anaeromyces robustus
  GLHYDRLASE8
VRSEGMSYGMMIA

SEQ ID NO: 10803 - protein, 18 aa, Anaeromyces robustus
  GLHYDRLASE8
APDGEMYFMMSLLFAANR

SEQ ID NO: 10804 - protein, 14 aa, Anaeromyces robustus
  GLHYDRLASE8
YYDGLVHYLAMLHL

SEQ ID NO: 10805 - protein, 18 aa, Piromyces finnis
  GLHYDRLASE8
APDGEMYFMMSLLFAANR

SEQ ID NO: 10806 - protein, 17 aa, Piromyces finnis
  GLHYDRLASE8
DPSYDLPAFVDLFSRWS

SEQ ID NO: 10807 - protein, 9 aa, Piromyces finnis
  GLHYDRLASE8
YMYDAMRCA

SEQ ID NO: 10808 - protein, 13 aa, Piromyces finnis
  GLHYDRLASE8
VRSEGMSYGMMIA

SEQ ID NO: 10809 - protein, 14 aa, Piromyces finnis
  GLHYDRLASE8
YYDGLVHYLSMLHL

SEQ ID NO: 10810 - protein, 17 aa, Piromyces finnis
  GLHYDRLASE8
DPSYDLPAFVDLFSRWS

SEQ ID NO: 10811 - protein, 13 aa, Piromyces finnis
  GLHYDRLASE8
VRSEGMSYGMMIA

SEQ ID NO: 10812 - protein, 18 aa, Piromyces finnis
  GLHYDRLASE8
APDGEMYFMMSLLFAANR

SEQ ID NO: 10813 - protein, 14 aa, Piromyces finnis
  GLHYDRLASE8
YYDGLVHYLSMLHL

SEQ ID NO: 10814 - protein, 9 aa, Piromyces finnis
  GLHYDRLASE8
YMYDAMRCA

SEQ ID NO: 10815 - protein, 18 aa, Piromyces finnis
  GLHYDRLASE8
APDGEMYFMMSLLFAANR

SEQ ID NO: 10816 - protein, 9 aa, Piromyces finnis
  GLHYDRLASE8
YMYDAMRCA

SEQ ID NO: 10817 - protein, 17 aa, Piromyces finnis
  GLHYDRLASE8
DPSYDLPAFVDLFSRWS

SEQ ID NO: 10818 - protein, 14 aa, Piromyces finnis
  GLHYDRLASE8
YYDGLVHYLSMLHL

SEQ ID NO: 10819 - protein, 49 aa, Neocallimastix californiae
  GLUCOSE-METHANOL-CHOLINE (GMC) OXIDOREDUCTASE
ETVTVTVKSISNNQCAEKWTQCGGQGYTGPTCCKSGSTCHEINKYYSQC

SEQ ID NO: 10820 - protein, 34 aa, Piromyces finnis; identical to SEQ ID NO: 6250
  GLUCOSE-METHANOL-CHOLINE (GMC) OXIDOREDUCTASE

SEQ ID NO: 10821 - protein, 475 aa, Neocallimastix californiae
  GLUCOSYLCERAMIDASE
KIYATNFNNRKFEGFGTSFCWWANRLGYSDILSEKAATLFYDKKEGLGLTIIRYNIGGGDNPSHNHITRTDSNMPGYAINPRYNGNGSYTWDYNWNSDFNQRNALLKAIAKNKEEIIVEGFSNSPPYFMTNSGCSTGNTDPNKDNLKSDAYPAFAKYLADVAEHFSKSWGVTFQSMTPVNEPFTNYWGANSKKQEGCHFDQGNSESKIIVELRKAIDQKGLKSIQISGTDETSIDTQITSYEKLSNEAKNIITRIDTHTYSGSKRYELRVLAENSKKNLWMSEVDGGGVAGTNAGEMGAGLWLANRIIEDLNGLRSSAWVLWQVIDNHISKNGYNGKKDSGMVNLNGGYWGIAVADHDKNDIILTQKYYAFGQFSRYIRPGYTIIGCYNNSVAAYDSVGKKLVIVATNTANTTKTVDFNLSEFTSVGYNIRVIRTSGSVSNGEKWAELKPLIPYGKGFNADLKGNSITTFIVDDV

SEQ ID NO: 10822 - protein, 474 aa, Anaeromyces robustus
  GLUCOSYLCERAMIDASE
QIYASNFNNRKFEGFGTSFCWWANRLGYSDSLSEKAATLFYDKEKGLGLTVIRYNIGGGDDPTHNHITRTDSNMPGYAINPKYDGRSYTWDYNWNSDSNQRNVLLKSVAKNKDEIIVEAFSNSPPYFMTYSGCSTGNFDPGKDNLRSDAYPAFAKYLADVAEHFKTHWGVYFQSITPTNEPYTNFWGANSYKQEGCHFDQGESESKIIVELRKAIDQKGLKEMQISGTDETSIDTQITSFEKLSNEAKNIITRIDTHTYGGWKRDELRLLAENNHKNLWMSEVDGKGTEGTNAGEMGAAIWLANRIIGDLNGLRASAWVLWQVIDNHISKNGYNGRKDSGMININEGYWGVAVADHDNDNIILTQKYYGFGQFSRYIRPGYTIIGSYNNSVAAYDNEGKKLVIVATNTAGSNKIVDFDLSTFTSVGYNVRVIRTSGSMSNGEHWAELTPLIPYGKGFNAELKANSITTFIVDDV

SEQ ID NO: 10823 - protein, 271 aa, Anaeromyces robustus
  GLUCOSYLCERAMIDASE
QIYASNFNNRRFEGFGTSFCWWANRLGYSDSLAEKAATLFYDKVNGLGLTVIRYNIGGGDDPTHHHITRTDSNMPGYAINPRYDGRSYTWDYNWNSDANQRNVLLKSVAKNRDEIIVEAFSNSPPYFMTNSGCSTGNFDANKDNLKSDAYPAFAKYLADVAEHFKTSWGVGFQSITPVNEPFTNYWGANSKKQEGCHFDQGNSESKIIVELKKAIDQRGLRDMQISGTDETSIDTQITSFQKLSNEAKNIITRIDTHTYGGSKRDELRLLA

SEQ ID NO: 10824 - protein, 268 aa, Neocallimastix californiae
  Glyco_10
CKFVSIQGTKGRFNFNDCDAHYNKAKELGMDFRGHALIWHSMAPKWLEYEDSNTMRNSIVNHITTVLKHYEGKIDTWDVVNEAIDDDSNGNGWKYRNSFLYQKNRDFIDLAFKTARQVAPKVKLFYNDYNTEGIWGKSESVYQFVADLKKRNIPIDGVGLQYHVSVQNQPQFNKINDLIGRYCKLGLEVHITELDVSCVNSCNAGDVESRQSQVFTNALKACLNNSCCTAFLVWGIGDPDSWLGNDKKGLLFNGNYQPKSQYNALLNV

SEQ ID NO: 10825 - protein, 278 aa, Neocallimastix californiae
  Glyco_10
CKFYTFNGSQTFNTKPCDDTVAFAKKYGAKFRGHNLFWPAYSPQWFQDAHDGSDPEAVKEYILDYVAKVLDHYKDEEDIIYWDVINESVTDDSTAKNIKLRTGSDNSNEFEGWDTYTEDIFKVAREHTNENVKLFYNDYNAEANNGNFDGKTGAVFEYIRSMREKGVPIDGVGLQMHVSCNWTPNYEQLTKLISQYEEIGVEVHITEIDVKRTQCKSAEAQKEVFMNVFKACFDHENCKVFTVWGSYDEESWVGVENEPVLFDVDMYPKDIYFDMLDY

SEQ ID NO: 10826 - protein, 268 aa, Neocallimastix californiae
  Glyco_10
CKFVSIQGTKGKFNFNDCDNHLKKAKELGMDFRGHALVWHSMAPDWLKNEDSKTMRQSIVNHITKVLQHYDGKIDTWDVVNEAIDDDSNGNGWKYRNSFLYQKNRDFIDLAFKTARQVAPKVKLFYNDYNTEGIWGKSESVYQFIADLKKRNIPIDGVGIQYHVSVKNQPQLNKITDLIGRYCKLGLEVHITEIDVSCEGACNNGDVQNRQAQVFTNALKACLANSCCTAYLVWGIGDNDSWLGADKKGLLFDGSYKPKAQYTALLNT

SEQ ID NO: 10827 - protein, 304 aa, Neocallimastix californiae
  Glyco_10
MKAENILDKAASQANAKKGDDMPVLKFDTIVDGLEFCKENNIKMRGHTLVWHVQTPEWFFRTDFSDSGSYVNAAKMEKRMESYIKQMLEFVQYYYPGIVDVWDVVNEAVEIEGGSYDASTGWNTRTRYNGSPNPWYTTMGADYVIKAFRIARKYADKNVKLIYNDYNTFMSQKTTAICNLIKKLKAENLVDGVGLQSYLNADWPNRNDYKTAIQKFAALGVEVQATELTIRTDGTANKYNTQAKHYEEVFKIYKDLKKSGVNITSVTVFGLQDGYLFYNNDSTDTRLWDHNLKKKPVYNSIMKV

SEQ ID NO: 10828 - protein, 305 aa, Neocallimastix californiae
  Glyco_10
MKAEFMLDKSASQANARNGNDMPVLKFDTIVDGLEFCKENNIKMRGHTLVWHTQAPEWFFRTGFNDNGSYVDKNKMEKRMESYIKQMLEFIQYYYPGVIDVWDVVNEAVEIANGSYDASSGWNTRTKFDNNKTNPWYATMGPDYVFKAFRFARKYADKNVKLIYNDFNTFQYPKTDNICNLVKKLKAENLIDGVGLQSYLGPSWPNRNDYKNAIQKFGALGVEVQITELTISVENGNNKFTTQANQYRDVFKIYKDLKKSGVNITSVTVFGLQDHYLFYDNDNTETRLWDGNLKKKPVYNAIMNV

SEQ ID NO: 10829 - protein, 269 aa, Neocallimastix californiae
  Glyco_10
CKFVSIQYTKGKFNFDDCDNHLKKAKELGMAFRGHALIWHAMAPGWLEREDGNTMKQSIINHITTVLKHYEGKIDTWDVVNEALDDSSNGNGWKLRNSFLYQKVPDFIDIAFQTARKVSPNTKLFYNDYNTEGIWGKSESCYQFIADMKKRNIPIDGVGIQYHVGINVQPKFEKINNLISRYCKLGVEVHITELDVSCDDNCRDADGGESKQGQVYTNALKACLNNSCCTGFLVWGIGDKDSWRGVESKPLLFDANYQPKGQYTAILNT

SEQ ID NO: 10830 - protein, 230 aa, Neocallimastix californiae; identical to SEQ ID NO: 9257
  Glyco_10

SEQ ID NO: 10831 - protein, 269 aa, Neocallimastix californiae
  Glyco_10
CKFVSIQYNKGRYNFDDCDNHLKKAQELGMAFRGHALIWHAMAPGWLEREDGNTMKQSIIDHITTVLKHYEGKIDTWDVVNEAIDDGSNGNGWKLRNSFLYQKVPNFIDIAFQTARKVSPKTKLFYNDYNTEGIWAKSESVYQFVADMKRRNIPIDGVGIQYHVGINVQPQFQKINDLIGRYCKLGVEVHITELDVSCDDNCRDWDGGESKQGQVYTNALKACLGNSCCTGFLVWGIGDKDSWRGEENKPLLFNSNYQPKGQYTAILNT

SEQ ID NO: 10832 - protein, 268 aa, Neocallimastix californiae
  Glyco_10
CKLSGIQQQKGVYNFNDCDNHLKKAQELGMDFRGHCLIWHAYQPSWFENADANTLKNAIVDHITKTLQHYEGKIDTWDVVNEAIDDSSNGNGWKMRNSFLYQKVPNFIDLAFQTARKVSPNTKLFYNDYNTEGIYGKSESVYQFVKDLVSRNIPIDGVGIQYHVSVQSQPQYNKINDLISRYCKLGLEVHITELDVKCDNQCYSGNVEQQQATVFTNALKACLSNSCCTGYLVWGVGDNNSWLGSDKKGLLFDGNYRPKSQYTAVLNM

SEQ ID NO: 10833 - protein, 268 aa, Neocallimastix californiae
  Glyco_10
CKLSGIQQQKGVYNFSDCDNHLKKAKELGMDFRGHCLIWHSYQPSWFENADANTLKNAIVDHITKTLQHYEGKIDTWDVVNEAIDDSSNGNGWKMRNSFLYQKVPNFVDLAFQTARKVSPNTKLFYNDYNTEGIYGKSESVYQFVKDMISRNIPIDGVGIQYHVSVSSQPKYEKINDLISRYCKLGIEVHITELDVKCDNQCNSNNVEQQQATVFTNALKACFSNSCCTGYLVWGVGDNDSWLGSDKKGLLFNSNYKPKSQYTAILNF

SEQ ID NO: 10834 - protein, 307 aa, Neocallimastix californiae
  Glyco_10
MKSLFILNQEGSIKNLKEGKQDPALDFSGIVDGLDFCQKNGIHMRGHVLVWHNQVPRWFFTKDYSEDGEFVDPETMEYRLDSFIRQYLGFVQYYYPGVVDVWDVVNEAVEVVGEQYDNSTGWYTRTLYDEVKPNMWYDMFGPDYVVKTFRIARKYALPNVKLVYNDYCTYVTKPISKRDAIVKLLGILQKEDLVDAIGMQSYINPEEDVNDHLAAIEVYQQTGLEIQITELTIRVKNTDDWEEYNIQQYSQLFEGIMKYVRKGYNIGSVTVFGLQDGYRFYENDSTKTRLFDHDLQKKKVYRAIMDI

SEQ ID NO: 10835 - protein, 307 aa, Neocallimastix californiae
  Glyco_10
MKPEFVLDKEGCLKNAENGSEEVVLKFDDIVDGLDFALKNNIHVRGHVLVWHTQTPDWFFRKGFNSENEFADVETIYQRLESYIRQYLGFVQHNYPGVIDVWDVVNEAIEINDGYFDNSTGWYTRVSTQTEESLWYKIVGPDYVKKTFEIARKYALPNVKLVYNDYNTFQTYPHDKTQAIIDLMNILRKDNLVDALGMQSYIGETWPKIEEYVRAIERFTEAGLELQITELTITPPSGEGWLEKQAQQYREFFEKVMEQINKGANITSVTVFGIQDGYRFYTSDSTKTRLLDHDLQKKPNYEAIMEV

SEQ ID NO: 10836 - protein, 305 aa, Neocallimastix californiae
  Glyco_10
MKADQMLDKAASQANARSGNDMPVLKFDSIVDGLEYCKANNIKMRGHTLVWHVQAPEWFFRTGFNDNGNYVDKNKMEKRMESYIKQMFEFVQHYYPGVVDVWDVVNEAVEITNGSFDASSGWNTRTKYDNNKTNPWYATMGPDYVFKAFRFARKYANKDVKLVYNDFNTFMSQKTNAICNLVKKLKAENLIDGVGLQSYLGPSWPNRNDYKNAIQKFSALGVEIQITELTISVEESNNKFNAQANHYRDVFKIYKDLKKSGVNITSVTVFGLQDHYLFYDNDKTETRLWDRNLKKKQAYNSVMSV

SEQ ID NO: 10837 - protein, 278 aa, Neocallimastix californiae
  Glyco_10
CKFYTINGSETFNTKACDESIAFAKKQGAKYRGHNLFWPANSPSWFKSAYDGKDPEEVKEYILDYITKVLDHYKDEEDIIYWDVINESVTDDSTPENIKLRTGSDTSNEFKGWDTYTEDIFKLAREHTNENVKLIYNDYNAEANGGNFGGKTGAVFQYIKSMKENGVPIDGVGLQMHISCNWTPNYEELTKLISQYEEIGVEVHVTEIDVKMENCKTHDDQRKVYMNIFKACFDHENCKVFTVWGAYDSESWVGAENEPLIFDEDMYPKDIYFDMLDY

SEQ ID NO: 10838 - protein, 307 aa, Neocallimastix californiae
  Glyco_10
MKAVFVLNQEGSIKNLKKGKQDPVLDFSTFVDGLDFCQKNGIHMRGHVLVWHNQAPRWFFTKNYEEDGEYVDAKTMEYRLESYIKQYLSFVQFNYPGVVDVWDVVNEAIEVVDNQYDKSTGWYTRTLYGNNSPNMWYDIFGPDYVVKTFRIARKYALPNVKLVYNDYSTFVTKPVSKRDAIIKLLGILKKEDLVDAIGMQSYINPDEDINEYLAAVDEYQKTGLEIQITELTIRVKSTDDWEEYNIQQYSQLFEGLMKRVKKGYNIGSVTVFGLQDGYRFYENDTQKFRLFDHDLKKKKVYHAIMKI

SEQ ID NO: 10839 - protein, 312 aa, Neocallimastix californiae
  Glyco_10
MKSIKIMDEEGSRKNIAEGREEVAVDFSGIIDGLEFAKKNGIHIRGHVLVWHKQTPDWFFRKDFDTEKEYADVETIFVRLESYMKAFFDFLNFNYPGVVDVFDVVNEAIEVREGKFDNSTGWYTRTESLEGDDNIWNTLVGPSYVVRAFRIARKYALPTTKLVYNDVDTFMTKPHDKTQAVIDLMNILRAEDLVDALGMESYIDQDLVNVDAPEDYARAIERFTEAGLEIQITEFTIYNDDREDWLETQTKRYRDFFQVVIDHVKKGYDNISSFTVFGLQDGYRFYDNDTQKTRLFDHDLQKKPNYYAIMEI

SEQ ID NO: 10840 - protein, 276 aa, Neocallimastix californiae
  Glyco_10
CKFYTIQASKTRNFYQCDQSLSYAKKFGAKYRGHNLFWPANSPNWFKTYSDDIEVTKSYIIDYIKSVLNHYRDDDSIIYWDVINESVMDESTSNDIQLRTGSKTSDEFLGWDTYTEDIFKLARDNINENVKLIYNDYYCEANNGNFDGKTGAVFNYIKNMKEKEVPIDGVGLQMHVSCNDAPSYDDLYLLISRYEEIGVEVHVTEIDVTMARCNSLKDQKDVYMNIFKACFNHNNCKVFTVWGAYDTESWIGAENTPLIFDSDMYPKDIYFEMLDY

SEQ ID NO: 10841 - protein, 304 aa, Neocallimastix californiae
  Glyco_10
MKAEHILDKSASQANANKGNDMPVLKFDTIIDGLEFCKENNIKMRGHTLVWHVQTPEWFFRTNFSDSGSYVNAQKMEKRMESYIKQMLEFVQYYYPGVVDVWDVVNEAVEIEGGSYDSSTGWNTRTKYNGSANPWYATMGPDYVFKAFRFARKYADKNVKLIYNDYNTFMSQKTNAIYNLVKKLKSENLIDGVGLQSYLNADWPNRNDYKNAMQRFASLGVEIQATELTIKTDGSSNKFNNQAKHYQEVFKIYKDLKKSGVNITSVTVFGLQDGYLFYSNDSTDTRLWDHNLKKKPVYYSIMNA

SEQ ID NO: 10842 - protein, 307 aa, Neocallimastix californiae
  Glyco_10
MKPLYILDKEGSIQNIKNGIQDPKLNFTSIVDGLEFAYKNGIHIRGHVLIWHTQTPDWFFNEGYTDDGKKVSPEVMESRLDSYIKQYLSFVQFNYPGVVDVWDVVNEAIEITDGQYDANTGWYTRTMLNNTPNPYYDMFGPDYVIKAFRIARKYALPNVKLVYNDFNTFQVWPHNKTQAIMDLAGILQKEDLIDGIGLQSYLGVTWPSLDEYFRGVERLATTGLELQITELTITAPDGDNWLEAQAEQYRDFFERLMKHVEEGYNIGSVTVFGLQDGYLFYASDSTKTRLLDHDLQKKPNFEAIMSI

SEQ ID NO: 10843 - protein, 268 aa, Neocallimastix californiae
  Glyco_10
CKFVSIQGTKGKFNFNDCDNHLKKAQELGMDFRGHALVWHSMAPKWLENEDANTMKNSIINHITTVLKHYEGKIDTWDVVNEAIDDSSNGNGWNMRKSFLYNKVPNFIDIAFQTARQVSPKTKLFYNDYNTEGIWGKSESVYQFVADLKKRNIPIDGVGIQYHVSLENNPRFDKINDLISRYCKLGVEVHITEMDVSCDKNCWASDVEQQQGKVFTNALQACLNNSCCTGFLVWGIGDNDSWIGGDKKGLLFNSNYQPKSQYTAVLNL

SEQ ID NO: 10844 - protein, 307 aa, Neocallimastix californiae
  Glyco_10
MKPEYIFDKEGCLKNAENGSEEMALKFDDIVDGLDFALKNNIHIRGHVLVWHKQTPDWFFRKGFNSENEFADVDTIYYRLESFIKQYLGFIQFNYPGVIDVWDVVNEAVEINDGSFDNSTGWYTRTMTGDEESLWYKVVGPDYVKKTFEIARKYALPNVKLVYNDYNTFQTYPHDKTQAIIDLIDILRKDNLIDAIGMQSYIGVNWPSVDEYIRAIERFTEAGLEIQITELTITAPSGDDWLEKQAQQYGELFERIMEQIKKGANISSVTVFGLQDGYRFYSSDSTKTRLLDHDLQKKPNYEAIMKV

SEQ ID NO: 10845 - protein, 307 aa, Neocallimastix californiae
  Glyco_10
MKPSYLLDQNGSQKNIMKGIQDPSVNFQSAIDTLEYCKKNNIKMRGHTLVWHTQTPSWFFKKDYDDKNDYVDSEVMELRIESYIKQVMQFVQYYYPGVVDVWDVVNEAVEIDEGYYDEKVSWKTRTKCNESSNPWYETMGPDYVIKAFRFARKYAAPGVKLIYNDYNTFMSEKTTAIINLLKILKEENLIDGIGMQSYLTPTFPERSTYANAIKKFGELGIEVQITELTISIDDKLSEEEMYEKQAEQYKEVFEIYLKAYHNGINIGSVTVFGLQDGYLFYTNDSTKTRLWDKDLQKKKNYYSILEV

SEQ ID NO: 10846 - protein, 268 aa, Neocallimastix californiae
  Glyco_10
CKFVSIQGTKGKFNFNDCDAHLNKAKQLGMDFRGHALIWHSMAPKWLENEDSNSMKNSIVNHITNVLKHYEGKIDTWDVVNEAIDDSSNGNGWKMRNSFLYQKVPNFIDLSFQTARKVSPKTKLFYNDYNTEGIWGKSESVYQFIADLKKRNIPIDGVGLQYHVSVQHQPQFNKINDLIGRYCKLGVEVHITELDVSCVESCYAGDVEKKQSDVFTNALKACLGNSCCTGFLVWGIGDPDSWLGSDKKGLLFNSNYQPKSQYTAVLNV

SEQ ID NO: 10847 - protein, 230 aa, Neocallimastix californiae
  Glyco_10
KTYSSDIEEVKEYYLDYVAKVLDHYKDEEDIIYWDVINESVTDDSTVDNIKLRYGSDDSNEFKGWDTYTEDIFKVAREHTNKNVKLFYNDYNAENNNGNYNGKTGAVFNYIKSMREKDVPIDGVGLQMHISCNYYPNYDQLYELISQYEEIGVEVHITEIDVSMKSCSTLEDQKKLYMDVFKACFDHSNCKVFTVWGAYDSESWVGAENVPLIFDEDMYPKDIYFDMLDY

SEQ ID NO: 10848 - protein, 268 aa, Anaeromyces robustus; identical to SEQ ID NO: 10843
  Glyco_10

SEQ ID NO: 10849 - protein, 276 aa, Anaeromyces robustus
  Glyco_10
CKFYTFQGTETFNTKPCDDSIAFAKKLGAKFRGHNLFWPAYSPSWFKTYSSDIEEVKEYYLDYVAKVLDHYKDEEDIIYWDVINESVTDDSTVDNIKLRYGSDDSNEFKGWDTYTEDIFKVAREHTNKNVKLFYNDYNAENNNGNYNGKTGAVFNYIKSMREKDVPIDGVGLQMHISCNYYPNYDQLYELISQYEEIGVEVHITEIDVSMKSCSTLEDQKKLYMDVFKACFDHSNCKVFTVWGAYDSESWVGAENVPLIFDEDMYPKDIYFDMLDY

SEQ ID NO: 10850 - protein, 268 aa, Anaeromyces robustus
  Glyco_10
CKLSGIQQQKGVYNFNDCDNHYKKAKELGMDFRGHCLIWHAYQPSWFQNADANTLKNAIVDHITKVLQHYDGKIDAWDVVNEAIDDSSNGNGWKMRNSFLYQKVPNFIDLAFQTARKVAPNVKLFYNDYNTEGVYAKTESVYQFIQDMIKRNIPIDGVGIQYHVAVNQQPSYQKINDLIGRYCKLGLEVHITELDVKCDNVCNSGNVEQQQATVFTNALKACLNNSCCTGYLVWGIGDNDSWLGGDKKGLLFNSQYKPKSQYTAVLNV

SEQ ID NO: 10851 - protein, 269 aa, Anaeromyces robustus
  Glyco_10
CKFVSIQGTKGRYNFDDCDNHLKKAQELKMDFRGHALIWHSMAPQWLEREDSNTMKQSIIDHITTVLKHYEGKIDTWDVVNEAIDDGSNGNGWKLRNSFLYQKVPNFIDIAFQTARKVSPNTKLFYNDYNTEGIWAKSESVYQFVADMKKRNIPIDGVGIQYHVGVNVQPQFDKINNLISRYCKLGVEVHITELDVSCDDNCNDRDGGEGKQSQVYINALKACLNNSCCTGFLVWGIGDSDSWRGAENKPLLFNSNYQPKGQYNAILET

SEQ ID NO: 10852 - protein, 304 aa, Anaeromyces robustus
  Glyco_10
MKAEHMLDKTASQNNAKNGNDMPVLKFDTIIDGLEFCQKNNVKMRGHTLVWHTQTPSWFFRTNFQDNGSFVNASKMEKRMESYIKQMLEFIQYYYPGVVDVWDVVNEAVEITNGSYDSSTGWNTRTKFDGGDNLWYKTMGADYVFKAFRFARKYADKNVKLIYNDYNTFMSQKTNAISNLIKKLKAENLVDGVGLQSYLNADWPNRNDYKSAIQKFSSLGVEIQITELTIKTDGSGNKFNNQATHYQQVFQIYKDLKKSGVNITSVTVFGLQDGYLFYSNDSTDTRLWDHNLKKKPVYNAIMKV

SEQ ID NO: 10853 - protein, 308 aa, Anaeromyces robustus
  Glyco_10
MKSLFIMDQEKSLKNLAEGKEEVGINFSGVIDGLEFSAKNNLNIRGHVLVWHKQTPEWFWRKDFDETKEYVDRETIFKRLDSFMKNYFDFLNFNYPGVVDVVDVVNEAVEVLEGKYDNSTGWYTRTESYEGDENIWYNLVGPDYVKEAFRIARKYALPTTKLVYNDYDTWRTTPHDKTEAIINLMKILKAEDLVDVIGMESYITPGEPTPEEYGKAIERYAAEGLEIQITEFTIYVTDGDDWLEQQTIHYRDMFKAIMEAYKKGANITSFTVFGLQDGYRFYDSDSTRTRLYDHDLQKKPNFQAIMDI

SEQ ID NO: 10854 - protein, 308 aa, Piromyces finnis
  Glyco_10
MNPSAILDQQASIDNIMNGNEDPILNFSNIVDGLDFAYKNGLNIRGHALVWHTQVPEWFFRDGYYSNTEFVSRDVMEYRLDSYIRKFLGFVQFNYPGTVDVWDVVNEAIEITDGQYDETTGWYTRTANNKTPNPWYEIFGPDYVAIAFRIARKYALPNVKLIYNDHNTFQIQPHDKTQAIIDLANILQQENLIDGIGMQSYIGVTWPNLDDYFNGLERLITSTGLEIQITELTITPPIGDNWLGAQAEQYYEYFNRLLSYIKNGYNISSVTVYGLQDGYRFYTKDSTKTRLLDHDLKKKPNFNAIINV

SEQ ID NO: 10855 - protein, 148 aa, Piromyces finnis
  Glyco_10
MKPLFVLDQAGCQKNFKNGSNEIALNFTPFVDGLDYAQKNGLHIRGHVLVWHKQFPDWFFREEFDDAKEYVSEEVIYERLENYIKQYLGFVNYNYPGVVDVWDVVNEAVEVLEGKFDNSTGWYTRTITYEGDRNIWYDFVGPDYVVKT

SEQ ID NO: 10856 - protein, 276 aa, Piromyces finnis
  Glyco_10
CKFYTIQGTQTFNTKQCDDSIAFAKKFGAKFRGHNLFWPANSPDWFKNYSDDIEEVKAYYLDYVAKVLDHYKDEEDIIYWDVVNESVTDDSTIDKYKLRYGSDRSNEFKGWDTYTEDIFTLAREHTNPNVKLIYNDYNAENNNGNFNGKTGAVYKYIKEMKEKGIPIDGVGLQMHISCNYTPNYEQLTELIDMYKEIGVEVHVTEIDVSMKNCKTHDQQRKLYMDVFRACFDNENCKVFTVWGAYDTESWIGASNVPLPFDDDMYPKDIYFDMLEY

SEQ ID NO: 10857 - protein, 268 aa, Piromyces finnis
  Glyco_10
CKLSGIQQRQGNYDFSDCDNHYKKAKELGMAFRGHALIWHAYMPSWFENANASTLKNAIVEHVTKVLQHYEGKIDTWDVVNEAIDDSSNGNGWKMRNSFLYQKVPNFVDLAFETARKVSPNTKLFYNDYNTEGIYGKTESVFQFVKDMKSRGIPIDGVGIQYHVSVDSQPQYNKIDDLISRYCGLGLEVHITELDVKCGSQCSSSNVESKQATVFTNALKACLNNSCCTGYLVWGVGDSDSWLGANEKGLLFNSNYQPKSQYTAVLNV

SEQ ID NO: 10858 - protein, 268 aa, Piromyces finnis; identical to SEQ ID NO: 10857
  Glyco_10

SEQ ID NO: 10859 - protein, 354 aa, Neocallimastix californiae
  Glyco_18
KIIVGYFSEWKNANYPISRVDLSKITHLNYAFGVIDPNSYAVTGYDSNILSQVVTAAHSQGVKVLMSVGGWYGSRYFTQMTSSKSNIEKFVDSCQSLISNYGVDGIDIDWEYPGREGACNSPDMANDAENYLTLLKILREKIGNALISAAVSVIPFEKNGQPISDLSEYEKYFDYINVMAYDFAGSWTPTVSHHSALYDPEAGEKLSLSSGVKNWLSRGFPANKIVVGVPAYGKSWIAASSNRNGLYQSVANGNPKGDHEDSNSPWTNYCGVLESAYSGNWKYKNIRSEILKSDYTTASGSWVRSWDDKVKGPYLFNKETKQIITYDDPETIQYKAKYIIDNNFGGMMIWELEN

SEQ ID NO: 10860 - protein, 351 aa, Neocallimastix californiae
  Glyco_18
KSIIIYYPEWKYYNYPPRNLPFNKLTHINYAFGEIDPTNYSLKYDSTKFLELIETARSRNKNVKIIMSVGGWTGSRYFSVMSSNPANRSKFISSVKSMLESTGADGIDIDWEHPGVPGAFYDSFDAQNDTYNLLKLMQELREAIGKSKIISTAVTFNLFVVNYQPLQDLSKFAEILDYINLMCYDFNGSWSNIISHQSSLYPTGGNDSGFSVEGAVKNWMNAKFPSNKIVIGIPSYGISWISSTSNNNGLLQIPSNSFPKGDEEDVMNAESGRYSGIWKYKNLRKQILQSSFKDATGDWIRVWDSKSSVPYLYNKVSRQFITYDDPESVKIKADYVIERNLGGMMMWEIEE

SEQ ID NO: 10861 - protein, 351 aa, Neocallimastix californiae
  Glyco_18
KSIIVYYPEWKYYDFPPKNIPFNKLTHINYAFAEIDSNDYSLDYDSSRFLELVETAHEKNKNIKVLMSIGGWTGSKYYSKMASSSSRRSKFVKSVKRMLEASDADGIDIDWEYPGTSGAYDDNFDAENDTNNLLKLLKELREAIGSSKIISAAVPFNTFEVDSRPLKDMSEFAELFDYVNIMAYDFAGSWSTVTSHQSSLYSISEDDNGYSLSGAVSNWINANFPSSKIVVGIPAYGRSWISGSSSNNGYLQRPSNSHPKGDEEDYIDSSSKRYSSTWKYKNIRKAIVKSTYKNSSGDWIRIWDSKSSVPFLFNTNTRQFITYDDPESVSLKADYVINKNLGGMMMWEIEE

SEQ ID NO: 10862 - protein, 351 aa, Neocallimastix californiae
  Glyco_18
KSIIVYYPEWKYYNFPPKNIPFNKLTHINYAFAEINSSDYSLEYDSSKFLELVETAHEYNKNIKVLMSIGGWTGSRYYSKMASSSSNRSKFVKSVKRMLEASGADGIDIDWEYPGTSGAYDDNFDAKNDTNNLLKLLQELRASIGYSKIISAAVPYNTFEVNYKPLEDMSEFAELFDYINIMAYDFAGSWSSVTSHHSSLYSTVEDDSGYSLAGAVKNWMNARFPATKIVVGIPAYGRSWISGSSSNNGYLQRPSNSHPKGDEEDYIDPNSKRYSSTWKYKNIRKAIMKSTYKDSTGNWIRVWDSKSSVPFLFNKNTRQFITYDDPESVSIKADYVIKYNLGGMMMWEIEE

SEQ ID NO: 10863 - protein, 355 aa, Anaeromyces robustus
  Glyco_18
KKIVGYFSEWRNSNYPISRVDLSKITHLNYAFGLIDPSTYAVTGYESWILTQVVEAAHKQGVKVLMSIGGWYGSRYFTKMTSSKSNMERFADSCKNLIDTYKIDGIDIDWEYPGREGACNTPDLANDTDNYLTLLEILRKKIGNDSLITAAVSAIPFEKNGQPVSNLSAYAKYFDFINLMAYDFAGSWSSVTSHHSGLYDPEAGDKLSVSTGVKNWLNAQFPASKIVVGVPAYGKSWIAASSDKNGLYQSIANKSPKGDQDDSNDAWTNYCGVVESTYSSNWKYKNLRKEILTSDYTSASGSWVRTWDDTVMAPYLFNKDTKQIISYDDPKAIENKAKYVLSNNFAGMMVWELEN

SEQ ID NO: 10864 - protein, 351 aa, Anaeromyces robustus
  Glyco_18
KSIIVYYPEWKYYDFPPKDIPFSKLTHINYAFAEINPDDFSLEYDSNKFLELIDTAHKKNKSIKVLMSIGGWTGSRYFSKMASSSSNRTKFVKSVKRMIDASNADGIDIDWEYPGSSGAYDDNYDSENDTNNLLKLLKELRETIGTSKLITAAVPFNTFEVDHKPLSDMTEFAKLFDFINIMAYDFSGSWSSVTAHQSALYSTHEDDSGYSLSGAVKNWMNANFPAKKIVVGIPAYGRSWIAGSSTNHGYLQRPSNSYPKGDEEDYIDSDSKRYSSTWKYKNIRKQVLKSDYSKSTGSWERIWDSKSSAPFLFNKDTKQFITYDDPKSVGLKADYVIENNLGGMMMWEIEE

SEQ ID NO: 10865 - protein, 350 aa, Piromyces finnis
  Glyco_18
YFSEWRYSSYPVSRIDFSKFTHLNYAFAVIDPNTYALTGYEGWILNEVVTAAHNQDVKVLMSVGGWYGSRYFTKMTSSENNMKKFAESCKNLIDTYHIDGIDIDWEYPGREGACNNPDYANDTDNYLKLLKILREYIGNENIISAAVSITPFEKNGQPITNLAPYAEYFDFINIMGYDFAGSWSSVTSHHAALYDPEAGDILSISSGVNNWLNGQFPADKIVIGVPTYGKSWIVSSTSRNGLYQSIVNGNPRGDHEDSSDSWTNYCGIVESGFSGSWKYKNIRNEILLSSYNTSSGSWIRTWDDNVKCPYLFNKDTKQIISYDDPESIGYKAKFVLENGFAGMMVWELEN

SEQ ID NO: 10866 - protein, 232 aa, Neocallimastix californiae
  Glyco_hyd_65N_2
LWYDSPARAWTDALPVGNSHLGGMVYGGAQRDEIQLNEDTFWAGGPHNNIPRNAASALPQARRMIFEGRFGQAQDYIDKNFFTGQNGMGYLTLGSLFINFSDVSGFSNYYRDLDLNNAIATSKFTANGSNIERSLFASMADDVIVYNIATDGKPLNFSVNHKCPLQTNASSSGNRLILKIRGKDQEGVGAKLNAYVIVEIVSDGRVSASGSSLNVSNAKEATILISAATNFV

SEQ ID NO: 10867 - protein, 25 aa, Neocallimastix californiae
  Glyco_hyd_65N_2
LWYNSPATTWTEALPVGNSHLGGMV

SEQ ID NO: 10868 - protein, 231 aa, Anaeromyces robustus
  Glyco_hyd_65N_2
LWYNNPAGEWTEALPVGNSHLGAMIYGGAQRDELQLNEDTFWAGGPHNNIPGNAANALPQARQMIFEGRFGQAENYINQNFFTGQNGMGYLTLGSLFINFSDIKDYSNYYRELDISNAIATTTFNANGGSMERTLFASMTDDVLVYHISSEKATSFSLSHKCALSTSVSSSGNRLIIQVRGKDQEGVRGQLSAYGIAEVVTDGRVSASGSSLSVSGAKEAMIIFSAATNFV

SEQ ID NO: 10869 - protein, 234 aa, Anaeromyces robustus
  Glyco_hyd_65N_2
LWYDIPAREWTEALPVGNSHLGAMIYGGVQRDELQLNEETFWGGGPHNNVVNNAFPKIQQARQMIFDGKFMQAENYINQNCLSGIDGMPYLPLGSLFINYSDIKEYSNYYRELDISNAMTTTKFTANGVNMERTLFASMTDDVLVYHITSDPKKPISFSLSYQFPRLTNSISTSGNRLIIKVNGKDHEGVKGRVTAYGIAEVVTDGKVNGNGSTLSVSGANEAIIFFSAATNFV

SEQ ID NO: 10870 - protein, 231 aa, Piromyces finnis
  Glyco_hyd_65N_2
LWYNSPANAWTEALPVGNSHLGGMVFGGAQTDEIQLNEETFWAGGPHNNIPQRANSVLSQARQLIFSSKFGDAQNLIDKNFFSGQNGMGYLTLGSLYIKFSDVKDVSNYYRDLDLNTAIATSKFTSNGMNVERSLFASMADNVLAYKITNENKPISFTVSHKCQLSTSVSTSNNRMILKIRGKDQEGVGSKLSAYGIVEIVTDGRVSASGSSLSVSGAYDTVIYITAATNF

SEQ ID NO: 10871 - protein, 224 aa, Neocallimastix californiae
  Glyco_hydr_30_2
RKFEGFGTSFCWWANRLGYSDILSEKAATLFYDKKEGLGLTIIRYNIGGGDNPSHNHITRTDSNMPGYAINPRYNGNGSYTWDYNWNSDFNQRNALLKAIAKNKEEIIVEGFSNSPPYFMTNSGCSTGNTDPNKDNLKSDAYPAFAKYLADVAEHFSKSWGVTFQSMTPVNEPFTNYWGANSKKQEGCHFDQGNSESKIIVELRKAIDQKGLKSIQISGTDETS

SEQ ID NO: 10872 - protein, 217 aa, Anaeromyces robustus
  Glyco_hydr_30_2
NRKFEGFGTSFCWWANRLGYSDSLSEKAATLFYDKEKGLGLTVIRYNIGGGDDPTHNHITRTDSNMPGYAINPKYDGRSYTWDYNWNSDSNQRNVLLKSVAKNKDEIIVEAFSNSPPYFMTYSGCSTGNFDPGKDNLRSDAYPAFAKYLADVAEHFKTHWGVYFQSITPTNEPYTNFWGANSYKQEGCHFDQGESESKIIVELRKAIDQKGLKEMQI

SEQ ID NO: 10873 - protein, 216 aa, Anaeromyces robustus
  Glyco_hydr_30_2
RFEGFGTSFCWWANRLGYSDSLAEKAATLFYDKVNGLGLTVIRYNIGGGDDPTHHHITRTDSNMPGYAINPRYDGRSYTWDYNWNSDANQRNVLLKSVAKNRDEIIVEAFSNSPPYFMTNSGCSTGNFDANKDNLKSDAYPAFAKYLADVAEHFKTSWGVGFQSITPVNEPFTNYWGANSKKQEGCHFDQGNSESKIIVELKKAIDQRGLRDMQIS

SEQ ID NO: 10874 - protein, 306 aa, Neocallimastix californiae
  Glyco_hydro_10
LKNYSKGFRIGAATNTIHYNNANYVNAMKAFNYMVAENACKFVSIQGTKGRFNFNDCDAHYNKAKELGMDFRGHALIWHSMAPKWLEYEDSNTMRNSIVNHITTVLKHYEGKIDTWDVVNEAIDDDSNGNGWKYRNSFLYQKNRDFIDLAFKTARQVAPKVKLFYNDYNTEGIWGKSESVYQFVADLKKRNIPIDGVGLQYHVSVQNQPQFNKINDLIGRYCKLGLEVHITELDVSCVNSCNAGDVESRQSQVFTNALKACLNNSCCTAFLVWGIGDPDSWLGNDKKGLLFNGNYQPKSQYNALLN

SEQ ID NO: 10875 - protein, 314 aa, Neocallimastix californiae
  Glyco_hydro_10
QQVRPDFYFGVSTASHFFANPKYNDIISTYNLQVAGNECKFYTFNGSQTFNTKPCDDTVAFAKKYGAKFRGHNLFWPAYSPQWFQDAHDGSDPEAVKEYILDYVAKVLDHYKDEEDIIYWDVINESVTDDSTAKNIKLRTGSDNSNEFEGWDTYTEDIFKVAREHTNENVKLFYNDYNAEANNGNFDGKTGAVFEYIRSMREKGVPIDGVGLQMHVSCNWTPNYEQLTKLISQYEEIGVEVHITEIDVKRTQCKSAEAQKEVFMNVFKACFDHENCKVFTVWGSYDEESWVGVENEPVLFDVDMYPKDIYFDML

SEQ ID NO: 10876 - protein, 306 aa, Neocallimastix californiae
  Glyco_hydro_10
LKDYSNGFRIGAATNTRFYNNGNYVNAMKAFNYMVAENACKFVSIQGTKGKFNFNDCDNHLKKAKELGMDFRGHALVWHSMAPDWLKNEDSKTMRQSIVNHITKVLQHYDGKIDTWDVVNEAIDDDSNGNGWKYRNSFLYQKNRDFIDLAFKTARQVAPKVKLFYNDYNTEGIWGKSESVYQFIADLKKRNIPIDGVGIQYHVSVKNQPQLNKITDLIGRYCKLGLEVHITEIDVSCEGACNNGDVQNRQAQVFTNALKACLANSCCTAYLVWGIGDNDSWLGADKKGLLFDGSYKPKAQYTALLN

SEQ ID NO: 10877 - protein, 327 aa, Neocallimastix californiae
  Glyco_hydro_10
STVLSKKMREIIAYQFNSVTYSNLMKAENILDKAASQANAKKGDDMPVLKFDTIVDGLEFCKENNIKMRGHTLVWHVQTPEWFFRTDFSDSGSYVNAAKMEKRMESYIKQMLEFVQYYYPGIVDVWDVVNEAVEIEGGSYDASTGWNTRTRYNGSPNPWYTTMGADYVIKAFRIARKYADKNVKLIYNDYNTFMSQKTTAICNLIKKLKAENLVDGVGLQSYLNADWPNRNDYKTAIQKFAALGVEVQATELTIRTDGTANKYNTQAKHYEEVFKIYKDLKKSGVNITSVTVFGLQDGYLFYNNDSTDTRLWDHNLKKKPVYNSIMK

SEQ ID NO: 10878 - protein, 334 aa, Neocallimastix californiae
  Glyco_hydro_10
GTNKSSSPVFSKKMREIIKYQFNSVTFTNLMKAEFMLDKSASQANARNGNDMPVLKFDTIVDGLEFCKENNIKMRGHTLVWHTQAPEWFFRTGFNDNGSYVDKNKMEKRMESYIKQMLEFIQYYYPGVIDVWDVVNEAVEIANGSYDASSGWNTRTKFDNNKTNPWYATMGPDYVFKAFRFARKYADKNVKLIYNDFNTFQYPKTDNICNLVKKLKAENLIDGVGLQSYLGPSWPNRNDYKNAIQKFGALGVEVQITELTISVENGNNKFTTQANQYRDVFKIYKDLKKSGVNITSVTVFGLQDHYLFYDNDNTETRLWDGNLKKKPVYNAIMN

SEQ ID NO: 10879 - protein, 305 aa, Neocallimastix californiae
  Glyco_hydro_10
DAAKGFRIGAATNTIHYNNPNYINAMKAFNYMVAENACKFVSIQYTKGKFNFDDCDNHLKKAKELGMAFRGHALIWHAMAPGWLEREDGNTMKQSIINHITTVLKHYEGKIDTWDVVNEALDDSSNGNGWKLRNSFLYQKVPDFIDIAFQTARKVSPNTKLFYNDYNTEGIWGKSESCYQFIADMKKRNIPIDGVGIQYHVGINVQPKFEKINNLISRYCKLGVEVHITELDVSCDDNCRDADGGESKQGQVYTNALKACLNNSCCTGFLVWGIGDKDSWRGVESKPLLFDANYQPKGQYTAILN

SEQ ID NO: 10880 - protein, 229 aa, Neocallimastix californiae
  Glyco_hydro_10
HAMAPGWLEREDGNTMKQSIINHITTVLKHYEGKIDTWDVVNEAIDDGSNGNGWKLRNSFLYQKVPDFIDIAFQTARKVSPNTKLFYNDYNTEGIWGKSESCYQFIADMKKRNIPIDGVGIQYHVGINVQPKFEKINDLISRYCKLGVEVHITELDVSCDDNCRDADGGDSKQGQVYTNALKACLNNSCCTGFLVWGIGDNDSWRGAENKPLLFNTNYQPKGQYTAVLN

SEQ ID NO: 10881 - protein, 305 aa, Neocallimastix californiae
  Glyco_hydro_10
DAANGFRIGAATNTIHYNNPNYINAMKAFNYMVAENACKFVSIQYNKGRYNFDDCDNHLKKAQELGMAFRGHALIWHAMAPGWLEREDGNTMKQSIIDHITTVLKHYEGKIDTWDVVNEAIDDGSNGNGWKLRNSFLYQKVPNFIDIAFQTARKVSPKTKLFYNDYNTEGIWAKSESVYQFVADMKRRNIPIDGVGIQYHVGINVQPQFQKINDLIGRYCKLGVEVHITELDVSCDDNCRDWDGGESKQGQVYTNALKACLGNSCCTGFLVWGIGDKDSWRGEENKPLLFNSNYQPKGQYTAILN

SEQ ID NO: 10882 - protein, 302 aa, Neocallimastix californiae
  Glyco_hydro_10
ANGFRIGAAANTMYFNNQSYINALKSFNYMVAENGCKLSGIQQQKGVYNFNDCDNHLKKAQELGMDFRGHCLIWHAYQPSWFENADANTLKNAIVDHITKTLQHYEGKIDTWDVVNEAIDDSSNGNGWKMRNSFLYQKVPNFIDLAFQTARKVSPNTKLFYNDYNTEGIYGKSESVYQFVKDLVSRNIPIDGVGIQYHVSVQSQPQYNKINDLISRYCKLGLEVHITELDVKCDNQCYSGNVEQQQATVFTNALKACLSNSCCTGYLVWGVGDNNSWLGSDKKGLLFDGNYRPKSQYTAVLN

SEQ ID NO: 10883 - protein, 305 aa, Neocallimastix californiae
  Glyco_hydro_10
LKDYANGFRIGVAANTMKFNNQAYNEALKAFNYMVAENGCKLSGIQQQKGVYNFSDCDNHLKKAKELGMDFRGHCLIWHSYQPSWFENADANTLKNAIVDHITKTLQHYEGKIDTWDVVNEAIDDSSNGNGWKMRNSFLYQKVPNFVDLAFQTARKVSPNTKLFYNDYNTEGIYGKSESVYQFVKDMISRNIPIDGVGIQYHVSVSSQPKYEKINDLISRYCKLGIEVHITELDVKCDNQCNSNNVEQQQATVFTNALKACFSNSCCTGYLVWGVGDNDSWLGSDKKGLLFNSNYKPKSQYTAIL

SEQ ID NO: 10884 - protein, 337 aa, Neocallimastix californiae
  Glyco_hydro_10
NGASIENSTVSSKTMREVIKHQFNSVTYSNLMKSLFILNQEGSIKNLKEGKQDPALDFSGIVDGLDFCQKNGIHMRGHVLVWHNQVPRWFFTKDYSEDGEFVDPETMEYRLDSFIRQYLGFVQYYYPGVVDVWDVVNEAVEVVGEQYDNSTGWYTRTLYDEVKPNMWYDMFGPDYVVKTFRIARKYALPNVKLVYNDYCTYVTKPISKRDAIVKLLGILQKEDLVDAIGMQSYINPEEDVNDHLAAIEVYQQTGLEIQITELTIRVKNTDDWEEYNIQQYSQLFEGIMKYVRKGYNIGSVTVFGLQDGYRFYENDSTKTRLFDHDLQKKKVYRAIMD

SEQ ID NO: 10885 - protein, 337 aa, Neocallimastix californiae
  Glyco_hydro_10
NGGAISTSTTTSKKMREVIKYQFNSMTYTNLMKPEFVLDKEGCLKNAENGSEEVVLKFDDIVDGLDFALKNNIHVRGHVLVWHTQTPDWFFRKGFNSENEFADVETIYQRLESYIRQYLGFVQHNYPGVIDVWDVVNEAIEINDGYFDNSTGWYTRVSTQTEESLWYKIVGPDYVKKTFEIARKYALPNVKLVYNDYNTFQTYPHDKTQAIIDLMNILRKDNLVDALGMQSYIGETWPKIEEYVRAIERFTEAGLELQITELTITPPSGEGWLEKQAQQYREFFEKVMEQINKGANITSVTVFGIQDGYRFYTSDSTKTRLLDHDLQKKPNYEAIME

SEQ ID NO: 10886 - protein, 335 aa, Neocallimastix californiae
  Glyco_hydro_10
YGTSKTNSPIFSKKMRDVIAYQFNSVTFTNLMKADQMLDKAASQANARSGNDMPVLKFDSIVDGLEYCKANNIKMRGHTLVWHVQAPEWFFRTGFNDNGNYVDKNKMEKRMESYIKQMFEFVQHYYPGVVDVWDVVNEAVEITNGSFDASSGWNTRTKYDNNKTNPWYATMGPDYVFKAFRFARKYANKDVKLVYNDFNTFMSQKTNAICNLVKKLKAENLIDGVGLQSYLGPSWPNRNDYKNAIQKFSALGVEIQITELTISVEESNNKFNAQANHYRDVFKIYKDLKKSGVNITSVTVFGLQDHYLFYDNDKTETRLWDRNLKKKQAYNSVMS

SEQ ID NO: 10887 - protein, 314 aa, Neocallimastix californiae
  Glyco_hydro_10
QQVRPDFYFGVATQKTFFANPKYKDIMSTFNLEVGGNECKFYTINGSETFNTKACDESIAFAKKQGAKYRGHNLFWPANSPSWFKSAYDGKDPEEVKEYILDYITKVLDHYKDEEDIIYWDVINESVTDDSTPENIKLRTGSDTSNEFKGWDTYTEDIFKLAREHTNENVKLIYNDYNAEANGGNFGGKTGAVFQYIKSMKENGVPIDGVGLQMHISCNWTPNYEELTKLISQYEEIGVEVHVTEIDVKMENCKTHDDQRKVYMNIFKACFDHENCKVFTVWGAYDSESWVGAENEPLIFDEDMYPKDIYFDML

SEQ ID NO: 10888 - protein, 337 aa, Neocallimastix californiae
  Glyco_hydro_10
NGGAIENSTTSSKTMREVIKHQFNSVTYSNLMKAVFVLNQEGSIKNLKKGKQDPVLDFSTFVDGLDFCQKNGIHMRGHVLVWHNQAPRWFFTKNYEEDGEYVDAKTMEYRLESYIKQYLSFVQFNYPGVVDVWDVVNEAIEVVDNQYDKSTGWYTRTLYGNNSPNMWYDIFGPDYVVKTFRIARKYALPNVKLVYNDYSTFVTKPVSKRDAIIKLLGILKKEDLVDAIGMQSYINPDEDINEYLAAVDEYQKTGLEIQITELTIRVKSTDDWEEYNIQQYSQLFEGLMKRVKKGYNIGSVTVFGLQDGYRFYENDTQKFRLFDHDLKKKKVYHAIMK

SEQ ID NO: 10889 - protein, 341 aa, Neocallimastix californiae
  Glyco_hydro_10
GVDINNYTPSSKKMMELIKYQFNSMTYSNGMKSIKIMDEEGSRKNIAEGREEVAVDFSGIIDGLEFAKKNGIHIRGHVLVWHKQTPDWFFRKDFDTEKEYADVETIFVRLESYMKAFFDFLNFNYPGVVDVFDVVNEAIEVREGKFDNSTGWYTRTESLEGDDNIWNTLVGPSYVVRAFRIARKYALPTTKLVYNDVDTFMTKPHDKTQAVIDLMNILRAEDLVDALGMESYIDQDLVNVDAPEDYARAIERFTEAGLEIQITEFTIYNDDREDWLETQTKRYRDFFQVVIDHVKKGYDNISSFTVFGLQDGYRFYDNDTQKTRLFDHDLQKKPNYYAIME

SEQ ID NO: 10890 - protein, 312 aa, Neocallimastix californiae
  Glyco_hydro_10
QQVRPDFYFGVATSIAYSSNPKYKDIVSSFNLHVGGNECKFYTIQASKTRNFYQCDQSLSYAKKFGAKYRGHNLFWPANSPNWFKTYSDDIEVTKSYIIDYIKSVLNHYRDDDSIIYWDVINESVMDESTSNDIQLRTGSKTSDEFLGWDTYTEDIFKLARDNINENVKLIYNDYYCEANNGNFDGKTGAVFNYIKNMKEKEVPIDGVGLQMHVSCNDAPSYDDLYLLISRYEEIGVEVHVTEIDVTMARCNSLKDQKDVYMNIFKACFNHNNCKVFTVWGAYDTESWIGAENTPLIFDSDMYPKDIYFEML

SEQ ID NO: 10891 - protein, 327 aa, Neocallimastix californiae
  Glyco_hydro_10
STVLSKKMRQLIAYQFNSVTYSNLMKAEHILDKSASQANANKGNDMPVLKFDTIIDGLEFCKENNIKMRGHTLVWHVQTPEWFFRTNFSDSGSYVNAQKMEKRMESYIKQMLEFVQYYYPGVVDVWDVVNEAVEIEGGSYDSSTGWNTRTKYNGSANPWYATMGPDYVFKAFRFARKYADKNVKLIYNDYNTFMSQKTNAIYNLVKKLKSENLIDGVGLQSYLNADWPNRNDYKNAMQRFASLGVEIQATELTIKTDGSSNKFNNQAKHYQEVFKIYKDLKKSGVNITSVTVFGLQDGYLFYSNDSTDTRLWDHNLKKKPVYYSIMN

SEQ ID NO: 10892 - protein, 337 aa, Neocallimastix californiae
  Glyco_hydro_10
TGTNLQVSTTVSEKMRDIIKHQFNSMTYTNLMKPLYILDKEGSIQNIKNGIQDPKLNFTSIVDGLEFAYKNGIHIRGHVLIWHTQTPDWFFNEGYTDDGKKVSPEVMESRLDSYIKQYLSFVQFNYPGVVDVWDVVNEAIEITDGQYDANTGWYTRTMLNNTPNPYYDMFGPDYVIKAFRIARKYALPNVKLVYNDFNTFQVWPHNKTQAIMDLAGILQKEDLIDGIGLQSYLGVTWPSLDEYFRGVERLATTGLELQITELTITAPDGDNWLEAQAEQYRDFFERLMKHVEEGYNIGSVTVFGLQDGYLFYASDSTKTRLLDHDLQKKPNFEAIMS

SEQ ID NO: 10893 - protein, 305 aa, Neocallimastix californiae
  Glyco_hydro_10
RDYSKGFRIGAATNTIHYSNSNYNNAMKAFNYMVAENACKFVSIQGTKGKFNFNDCDNHLKKAQELGMDFRGHALVWHSMAPKWLENEDANTMKNSIINHITTVLKHYEGKIDTWDVVNEAIDDSSNGNGWNMRKSFLYNKVPNFIDIAFQTARQVSPKTKLFYNDYNTEGIWGKSESVYQFVADLKKRNIPIDGVGIQYHVSLENNPRFDKINDLISRYCKLGVEVHITEMDVSCDKNCWASDVEQQQGKVFTNALQACLNNSCCTGFLVWGIGDNDSWIGGDKKGLLFNSNYQPKSQYTAVLN

SEQ ID NO: 10894 - protein, 337 aa, Neocallimastix californiae
  Glyco_hydro_10
NGGALSTSTTTSKTMREVIKYQFNSMTYTNIMKPEYIFDKEGCLKNAENGSEEMALKFDDIVDGLDFALKNNIHIRGHVLVWHKQTPDWFFRKGFNSENEFADVDTIYYRLESFIKQYLGFIQFNYPGVIDVWDVVNEAVEINDGSFDNSTGWYTRTMTGDEESLWYKVVGPDYVKKTFEIARKYALPNVKLVYNDYNTFQTYPHDKTQAIIDLIDILRKDNLIDAIGMQSYIGVNWPSVDEYIRAIERFTEAGLEIQITELTITAPSGDDWLEKQAQQYGELFERIMEQIKKGANISSVTVFGLQDGYRFYSSDSTKTRLLDHDLQKKPNYEAIMK

SEQ ID NO: 10895 - protein, 89 aa, Neocallimastix californiae
  Glyco_hydro_10
IGRYCKLGLEVHITELDVKCDNVCNSGNVEQQQATVFTNALKACLNNSCCTGYLVWGIGDNDSWLGGDKKGLLFNSQYKPKSQYTAVLN

SEQ ID NO: 10896 - protein, 332 aa, Neocallimastix californiae
  Glyco_hydro_10
KTSTILSKKMVDIINHQFNSVTLTNLMKPSYLLDQNGSQKNIMKGIQDPSVNFQSAIDTLEYCKKNNIKMRGHTLVWHTQTPSWFFKKDYDDKNDYVDSEVMELRIESYIKQVMQFVQYYYPGVVDVWDVVNEAVEIDEGYYDEKVSWKTRTKCNESSNPWYETMGPDYVIKAFRFARKYAAPGVKLIYNDYNTFMSEKTTAIINLLKILKEENLIDGIGMQSYLTPTFPERSTYANAIKKFGELGIEVQITELTISIDDKLSEEEMYEKQAEQYKEVFEIYLKAYHNGINIGSVTVFGLQDGYLFYTNDSTKTRLWDKDLQKKKNYYSILE

SEQ ID NO: 10897 - protein, 306 aa, Neocallimastix californiae
  Glyco_hydro_10
LKDYSKGFRIGAATNTIHYNNANYVNAMKAFNYMVAENACKFVSIQGTKGKFNFNDCDAHLNKAKQLGMDFRGHALIWHSMAPKWLENEDSNSMKNSIVNHITNVLKHYEGKIDTWDVVNEAIDDSSNGNGWKMRNSFLYQKVPNFIDLSFQTARKVSPKTKLFYNDYNTEGIWGKSESVYQFIADLKKRNIPIDGVGLQYHVSVQHQPQFNKINDLIGRYCKLGVEVHITELDVSCVESCYAGDVEKKQSDVFTNALKACLGNSCCTGFLVWGIGDPDSWLGSDKKGLLFNSNYQPKSQYTAVLN

SEQ ID NO: 10898 - protein, 219 aa, Neocallimastix californiae
  Glyco_hydro_10
VKEYYLDYVAKVLDHYKDEEDIIYWDVINESVTDDSTVDNIKLRYGSDDSNEFKGWDTYTEDIFKVAREHTNKNVKLFYNDYNAENNNGNYNGKTGAVFNYIKSMREKDVPIDGVGLQMHISCNYYPNYDQLYELISQYEEIGVEVHITEIDVSMKSCSTLEDQKKLYMDVFKACFDHSNCKVFTVWGAYDSESWVGAENVPLIFDEDMYPKDIYFDML

SEQ ID NO: 10899 - protein, 305 aa, Anaeromyces robustus; identical to SEQ ID NO: 10893
  Glyco_hydro_10

SEQ ID NO: 10900 - protein, 312 aa, Anaeromyces robustus
  Glyco_hydro_10
QQVRPDFYFGVATTKSFFANPKYKDIMSTYNLQVGGNECKFYTFQGTETFNTKPCDDSIAFAKKLGAKFRGHNLFWPAYSPSWFKTYSSDIEEVKEYYLDYVAKVLDHYKDEEDIIYWDVINESVTDDSTVDNIKLRYGSDDSNEFKGWDTYTEDIFKVAREHTNKNVKLFYNDYNAENNNGNYNGKTGAVFNYIKSMREKDVPIDGVGLQMHISCNYYPNYDQLYELISQYEEIGVEVHITEIDVSMKSCSTLEDQKKLYMDVFKACFDHSNCKVFTVWGAYDSESWVGAENVPLIFDEDMYPKDIYFDML

SEQ ID NO: 10901 - protein, 305 aa, Anaeromyces robustus
  Glyco_hydro_10
RDYANGFRIGAATNTMHYNNQNYVNAMKSFNYMVAENACKLSGIQQQKGVYNFNDCDNHYKKAKELGMDFRGHCLIWHAYQPSWFQNADANTLKNAIVDHITKVLQHYDGKIDAWDVVNEAIDDSSNGNGWKMRNSFLYQKVPNFIDLAFQTARKVAPNVKLFYNDYNTEGVYAKTESVYQFIQDMIKRNIPIDGVGIQYHVAVNQQPSYQKINDLIGRYCKLGLEVHITELDVKCDNVCNSGNVEQQQATVFTNALKACLNNSCCTGYLVWGIGDNDSWLGGDKKGLLFNSQYKPKSQYTAVLN

SEQ ID NO: 10902 - protein, 305 aa, Anaeromyces robustus
  Glyco_hydro_10
DAANGFRIGAATNTIHYSNRNYIEAMKSFNYMVAENACKFVSIQGTKGRYNFDDCDNHLKKAQELKMDFRGHALIWHSMAPQWLEREDSNTMKQSIIDHITTVLKHYEGKIDTWDVVNEAIDDGSNGNGWKLRNSFLYQKVPNFIDIAFQTARKVSPNTKLFYNDYNTEGIWAKSESVYQFVADMKKRNIPIDGVGIQYHVGVNVQPQFDKINNLISRYCKLGVEVHITELDVSCDDNCNDRDGGEGKQSQVYINALKACLNNSCCTGFLVWGIGDSDSWRGAENKPLLFNSNYQPKGQYNAILE

SEQ ID NO: 10903 - protein, 325 aa, Anaeromyces robustus
  Glyco_hydro_10
VLSKKMCQLIAYQFNSVTYSNLMKAEHMLDKTASQNNAKNGNDMPVLKFDTIIDGLEFCQKNNVKMRGHTLVWHTQTPSWFFRTNFQDNGSFVNASKMEKRMESYIKQMLEFIQYYYPGVVDVWDVVNEAVEITNGSYDSSTGWNTRTKFDGGDNLWYKTMGADYVFKAFRFARKYADKNVKLIYNDYNTFMSQKTNAISNLIKKLKAENLVDGVGLQSYLNADWPNRNDYKSAIQKFSSLGVEIQITELTIKTDGSGNKFNNQATHYQQVFQIYKDLKKSGVNITSVTVFGLQDGYLFYSNDSTDTRLWDHNLKKKPVYNAIMK

SEQ ID NO: 10904 - protein, 338 aa, Anaeromyces robustus
  Glyco_hydro_10
NGGNISNYTPSSKKMMELINYQFNSMTYSNGMKSLFIMDQEKSLKNLAEGKEEVGINFSGVIDGLEFSAKNNLNIRGHVLVWHKQTPEWFWRKDFDETKEYVDRETIFKRLDSFMKNYFDFLNFNYPGVVDVVDVVNEAVEVLEGKYDNSTGWYTRTESYEGDENIWYNLVGPDYVKEAFRIARKYALPTTKLVYNDYDTWRTTPHDKTEAIINLMKILKAEDLVDVIGMESYITPGEPTPEEYGKAIERYAAEGLEIQITEFTIYVTDGDDWLEQQTIHYRDMFKAIMEAYKKGANITSFTVFGLQDGYRFYDSDSTRTRLYDHDLQKKPNFQAIMD

SEQ ID NO: 10905 - protein, 334 aa, Piromyces finnis
  Glyco_hydro_10
LAMSTITSEKMRKVIKYQFNSMTYTNLMNPSAILDQQASIDNIMNGNEDPILNFSNIVDGLDFAYKNGLNIRGHALVWHTQVPEWFFRDGYYSNTEFVSRDVMEYRLDSYIRKFLGFVQFNYPGTVDVWDVVNEAIEITDGQYDETTGWYTRTANNKTPNPWYEIFGPDYVAIAFRIARKYALPNVKLIYNDHNTFQIQPHDKTQAIIDLANILQQENLIDGIGMQSYIGVTWPNLDDYFNGLERLITSTGLEIQITELTITPPIGDNWLGAQAEQYYEYFNRLLSYIKNGYNISSVTVYGLQDGYRFYTKDSTKTRLLDHDLKKKPNFNAIIN

SEQ ID NO: 10906 - protein, 185 aa, Piromyces finnis; identical to SEQ ID NO: 126
  Glyco_hydro_10

SEQ ID NO: 10907 - protein, 36 aa, Piromyces finnis
  Glyco_hydro_10
LVWGVGDPDSWLGQDKRGLLFDGSYKPKAQYNALLN

SEQ ID NO: 10908 - protein, 312 aa, Piromyces finnis
  Glyco_hydro_10
QQVRPDFYYGVATTKSFFSNPKYKDIISTYNLHTGGNECKFYTIQGTQTFNTKQCDDSIAFAKKFGAKFRGHNLFWPANSPDWFKNYSDDIEEVKAYYLDYVAKVLDHYKDEEDIIYWDVVNESVTDDSTIDKYKLRYGSDRSNEFKGWDTYTEDIFTLAREHTNPNVKLIYNDYNAENNNGNFNGKTGAVYKYIKEMKEKGIPIDGVGLQMHISCNYTPNYEQLTELIDMYKEIGVEVHVTEIDVSMKNCKTHDQQRKLYMDVFRACFDNENCKVFTVWGAYDTESWIGASNVPLPFDDDMYPKDIYFDML

SEQ ID NO: 10909 - protein, 306 aa, Piromyces finnis
  Glyco_hydro_10
LKDYAKDFRIGVAANTMRFNNQAYNEALKAFNYMVAENGCKLSGIQQRQGNYDFSDCDNHYKKAKELGMAFRGHALIWHAYMPSWFENANASTLKNAIVEHVTKVLQHYEGKIDTWDVVNEAIDDSSNGNGWKMRNSFLYQKVPNFVDLAFETARKVSPNTKLFYNDYNTEGIYGKTESVFQFVKDMKSRGIPIDGVGIQYHVSVDSQPQYNKIDDLISRYCGLGLEVHITELDVKCGSQCSSSNVESKQATVFTNALKACLNNSCCTGYLVWGVGDSDSWLGANEKGLLFNSNYQPKSQYTAVLN

SEQ ID NO: 10910 - protein, 306 aa, Piromyces finnis; identical to SEQ ID NO: 10909
  Glyco_hydro_10

SEQ ID NO: 10911 - protein, 63 aa, Piromyces finnis
  Glyco_hydro_10
SNVESKQATVFTNALKACLNNSCCTGYLVWGVGDSDSWLGANEKGLLFNSNYQPKSQYTAVLN

SEQ ID NO: 10912 - protein, 64 aa, Piromyces finnis
  Glyco_hydro_10
SSNVESKQATVFTNALKACLNNSCCTGYLVWGVGDSDSWLGANEKGLLFNSNYQPKSQYTAVLN

SEQ ID NO: 10913 - protein, 63 aa, Piromyces finnis; identical to SEQ ID NO: 10911
  Glyco_hydro_10

SEQ ID NO: 10914 - protein, 166 aa, Neocallimastix californiae
  Glyco_hydro_11
ACFKASWNNAGDFLGRVGLVWDNKPNYKNLGGDLIANYSYKKSGNDGGTYSYVGIYGWMDNPQIEYYVVDDWLHNRGAPGGSYMGSQKGTINVDGGTYKVWTGTRTGASKWGQSTFTQIFSVRTQQRTCGQINISEHFRQWEKLGIRVGQLMEAQILAESGGGSGY

SEQ ID NO: 10915 - protein, 188 aa, Neocallimastix californiae
  Glyco_hydro_11
NGNYRYEIWRDGNGGELTLYPKDACFKASWNNAGDYLGRVGLVWDQYINYKNLDGDLVAKYNYKKSGNDGGTYSYVGVYGWMDNPQIEYYVVDDWLHNRGAPGGSYMGSQKGTITVDGGTYKVWSGTRTGASKWGQSTFTQIFSVRTEQRTCGQINISEHFRQWEKLGLRIGSVMEAQILAESGGGSG

SEQ ID NO: 10916 - protein, 83 aa, Neocallimastix californiae
  Glyco_hydro_11
WRPGDWVGNKKHGDFTIDGAKYTVYENTRYGPSIDGDTTFKQFFSIRQQARDCGTIDITAHFEQWEKLGMKLGKMHEAKVLGE

SEQ ID NO: 10917 - protein, 174 aa, Neocallimastix californiae
  Glyco_hydro_11
GSVDYEIWADGGNNSADFYKDGSFSCAFNNSKDYLCRSGVNIRPAKYPSEIGKIKAEYKVVKQNAQNVGYSYVGVYGWTLESGISGVFEFYIVDNWLSQYRPGDWVGNQKKGDFTIDGAVYTVYKNVNGNLTQYFSLRREPRTCGTIDVTAHFDQWEKLGLKMGKISEIKVLGE

SEQ ID NO: 10918 - protein, 185 aa, Neocallimastix californiae
  Glyco_hydro_11
IGGVGYELWADSGNNSATFYSDGSFSCTFQNAKDYLCRSGLSFDSTKTHQQIGHMYADFKLVKQNIRNVDYSYIGIYGWTRNPLVEFYVVDNWLSQYRPGDWVGNKKHGDFTIDGARYTVYENTRYGPSIDGNTNFKQYFSIRQTARDCGTIDITAHFQQWEKLGMTMGKMHEAKVLGEAGSNGA

SEQ ID NO: 10919 - protein, 125 aa, Neocallimastix californiae
  Glyco_hydro_11
INGIGYELWADSGNNSATFYSDGSFSCTFQKAKDYLCRSGLSFDSTKTHDQLGHMYADFKLVKQNIQNVDYSYVGIYGWSKDPLVEFYVVDNWLSQWRPGDWVGNKKHGDYVIDGATYTVYENER

SEQ ID NO: 10920 - protein, 105 aa, Neocallimastix californiae
  Glyco_hydro_11
DPLVEFYVVDNWLSQWRPGDWVGNKKHGDYVIDGATYTVYENERYGPSIVGDTNFKQFFSIRKEARDCGTIDITAHFLQWEKLGMKLGKMYEAKVLGEAGSNSSG

SEQ ID NO: 10921 - protein, 186 aa, Neocallimastix californiae
  Glyco_hydro_11
INGIGYELWADSGNNSATFYEDGSFSCSFNNAKDYLCRSGLSFDSTKTHKEIGHIYADFKLVKQNIRNVDYSYVGIYGWTRNPLVEFYVVDNWLSQWRPGDWVGNKKHGDFTIDGAKYTVYENTRYGPSIDGDTNFKQFFSIRQTARDCGTIDITAHFEQWEKLGMKLGKMHEAKVLGEAGSTGSG

SEQ ID NO: 10922 - protein, 173 aa, Neocallimastix californiae
  Glyco_hydro_11
GYELWSDSGDNSATFYADGSFSCSFKNAKDYLCRSGLSFDSTKTHKEIGHIYADFKLVKQDIKDVDYSYIGIYGWTREPLVEYYVVDNWLSQYRPGDWVGNKKYGDFEIDGAEYTVYENTRTGPSIDGDNVTFKQYFSIRKEARDCGTIDITAHFEKWEELDLVLGKMHEAKV

SEQ ID NO: 10923 - protein, 173 aa, Neocallimastix californiae
  Glyco_hydro_11
GYELWSDSGDNSATFYADGSFSCSFKNAKDYLCRSGLSFDSTKTHKEIGHIYADFKLVKQDIQDVDYSYIGIYGWTREPLVEYYVVDNWLSQYRPGDWVGNKKYGDFEIDGAEYTVYENTRTGPSIDGDNVTFKQYFSIRKEARDCGTIDITAHFEKWEELDLVLGKMHEAKV

SEQ ID NO: 10924 - protein, 184 aa, Neocallimastix californiae
  Glyco_hydro_11
KGIGYELWADSGNNSATFYEDGSFSCSFSRAKDYLCRSGLSFDSTKTHDQIGHIYADFKLVKQNIQNVDYSYVGIYGWTRNPLVEFYVVDNWLSQWRPGDWVGNKKHGDFVIDGATYTVYENTRYGPSIDGDTNFKQFFSIRQQARDCGTIDITAHFQQWEKLGMKLGKMHEAKVLGEAGSNGQ

SEQ ID NO: 10925 - protein, 189 aa, Neocallimastix californiae
  Glyco_hydro_11
NGNYRYEIWRDGNGGELTLYPKDACFKASWNNAGDYLGRVGLVWDNKINYKNAGGDIIANYAYKKSGSDGGTYSYIGIYGWMDNPQIEYYVVDDWLHNRGAPGGSWMGQQKGTINVDGGTYKVWSGQRTGASKWGQSTFTQIFSVRTSQRQCGQINISEHFRQWEKLGLRIGQVMEAQILAEAGGGSGY

SEQ ID NO: 10926 - protein, 189 aa, Neocallimastix californiae
  Glyco_hydro_11
NGNYRYEIWRDGNGGELTLYPKDACFKASWNNAGDYLGRVGLVWDNKINYKNAGGDIVAKYAYKKSGSDGGTYSYIGIYGWMDNPQIEYYVVDDWLHNRGAPGGSWMGQQKGTINVDGGTYKVWSGQRTGASKWGQSTFTQIFSVRTSQRQCGQINISEHFRQWEKLGLRIGQVMEAQILAEAGGGSGY

SEQ ID NO: 10927 - protein, 187 aa, Neocallimastix californiae
  Glyco_hydro_11
INGIGYELWADSGNNSATFYSDGSFSCSFQNAKDYLCRSGLSFDSTKTHQQLGHMYADFKLVKQGISNVDYSYVGIYGWTRSPLVEFYVVDNWLSQWRPGDWVGNKKYGDYTIDGAKYTVYENSRYGPSIDGDTNFKQFFSIRQQARDCGTIDITAHFEQWEKLGMKMGKMHEAKVLGEAGSTGSGT

SEQ ID NO: 10928 - protein, 174 aa, Neocallimastix californiae
  Glyco_hydro_11
IGYELWSDSGDNSATFYSDGSFSCSFKNAKDYLCRSGLSFDSTKTHKEIGHIYADFKLVKQDIKDVDYSYIGIYGWTRKPLVEYYVVDNWLSQYRPGDWVGNKKFGDFEIDGAEYTVYENTRTGPSIDGDNVTFKQYFSIRKEARDCGTIDITAHFEKWEELGLTLGKMHEAKV

SEQ ID NO: 10929 - protein, 174 aa, Neocallimastix californiae
  Glyco_hydro_11
IGYELWSDSGDNSATFYSDGSFSCSFKNAKDYLCRSGLSFDSTKTHKEIGHIYADFKLVKQDIKDVDYSYIGIYGWTREPLVEYYVVDNWLSQYRPGDWVGNKKYGDFEIDGAEYTVYENTRTGPSIDGDNVTFKQYFSIRKEARDCGTIDITAHFEKWEELGLTLGKMHEAKV

SEQ ID NO: 10930 - protein, 173 aa, Neocallimastix californiae
  Glyco_hydro_11
GYELWSDSGDNSATFYSDGSFSCSFKNAKDYLCRSGLSFDSTKTHKEIGHIYADFKLVKQDIQDVDYSYIGIYGWTREPLVEYYVVDNWLSQYRPGDWVGNKKYGDFEIDGAEYTVYENTRTGPSIDGDNVTFKQYFSIRKEARDCGTIDITAHFKKWEELGLTLGKMHEAKV

SEQ ID NO: 10931 - protein, 185 aa, Neocallimastix californiae
  Glyco_hydro_11
SGYHYEIWYQGGNNSMTYYDNGTFKASWGGTNDFLARVGLKYNEDKTHQQLGQIDAYFKWTKSGSAGGYNYIGIYGWTVDPLVEYYIVDDWYNKPGSYLGQKKGEFTVDGDTYEIFQNTRVNQPSIKGTSTFPQFFSVRRSARSCGHIDISAHFKKWESLGMKLGKMYEAKVLVEAGGGSGSFDV

SEQ ID NO: 10932 - protein, 184 aa, Neocallimastix californiae
  Glyco_hydro_11
VGYELWSDSGYNSATFYSDGSFSCSFSNAKDYLCRSGLSFDSTQTHDQIGHMYADFKLVKQNIRNVDYSYIGVYGWSRDPLVEYYVVDNWLSQYRPGDWVGNKKHGDFTIDGAKYTVYENTRYGPSIDGDTQFKQYFSIRQQARDCGTIDITAHFQQWEKLGMKLGKMHEAKVLGEAGSNGSGT

SEQ ID NO: 10933 - protein, 172 aa, Neocallimastix californiae
  Glyco_hydro_11
VGYELWSDSGYNSATFYSDGSFSCSFNNAKDYLCRSGLSFDSTKTHDQIGHMYADFKLVKQNIRNVDYSYVGVYGWTRNPLVEYYIVDNWLSQYRPGDWVGNKKHGDFTIDGAQYTVYENTRYGPSIDGDTQFKQYFSIRQQARDCGTIDITAHFQQWEKLGMKLGKMHEAK

SEQ ID NO: 10934 - protein, 174 aa, Neocallimastix californiae
  Glyco_hydro_11
GSVDYEVWADGGNNSAVFYSDGSFSCSFSNTKDYLCRTGVSFSQAKYPSEIGHIKAEYKVVKQNAQNVGYSYVGVYGWTLNSGISGVFEFYIVDNWLSPGRPGDWVGNEKKGDFTIDGGKYTVYKNVNGNLTQYFSLRTSPRTCGTIDVTAHFEQWEKIGLKMGKITEVKVLGE

SEQ ID NO: 10935 - protein, 185 aa, Anaeromyces robustus; identical to SEQ ID NO: 10931
  Glyco_hydro_11

SEQ ID NO: 10936 - protein, 179 aa, Anaeromyces robustus
  Glyco_hydro_11
GGIGYELWADSGSNSATFYSDGSFSCSFSRAKDYLCRSGLSFDSTKTHQQIGHIYADFKLVKQNIQSVDYSYVGIYGWTRNPLVEFYVVDNWLSQYRPGDWVGNKKHGDFTIDGAKYTVYENTRYGPSIDGDTQFKQFFSIRQQARDCGTIDITAHFEQWEKLGMKLGKMHEAKVLGEA

SEQ ID NO: 10937 - protein, 174 aa, Anaeromyces robustus; identical to SEQ ID NO: 10934
  Glyco_hydro_11

SEQ ID NO: 10938 - protein, 179 aa, Anaeromyces robustus
  Glyco_hydro_11
IGYELWADSGNNSATFYADGSFSCSFRQAKDYLCRSGLSFDSTQTHQQIGHMYADFKLVKQNIQSVDYSYVGIYGWTRNPLVEFYVVDNWLSQWRPGDWVGNKKHGDFTIDGAKYTVYENTRYGPSIDGDTNFKQYFSIRQQPRDCGTIDITAHFQQWEKLGMTMGKMHEAKVLGEAGS

SEQ ID NO: 10939 - protein, 181 aa, Anaeromyces robustus
  Glyco_hydro_11
IGGVGYELWSDSGSNSATFYSDGSFSCSFRSAKDYLCRSGLSFDSTKTHQQIGHIYADFKLVKQNIQNVDYSYVGIYGWTRNPLVEFYVVDNWLSQYRPGDWVGNKKHGDFTIDGAKYTVYENTRYGPSIDGNTNFKQYFSIRQQARDCGTIDITAHFEQWEKLGMTMGKMHEAKVLGEAG

SEQ ID NO: 10940 - protein, 180 aa, Anaeromyces robustus
  Glyco_hydro_11
GSVGYELWSDSGNNSATFYSDGSFSCSFRSAKDYLCRSGLSFDSTKTHQQIGHIYADFKLVKQNIQNVDYSYVGIYGWTRNPLVEFYVVDNWLSQYRPGDWVGNKKHGEFTIDGAKYTVYENTRYGPSIDGDTSFKQYFSIRQQARDCGTIDITAHFEQWEKLGMTMGKMHEAKVLGEAG

SEQ ID NO: 10941 - protein, 179 aa, Anaeromyces robustus
  Glyco_hydro_11
IGGVGYELWFEGGNNSATFYSDGSFSCSFQGSKDYLCRTGLSFNSDKTYQQIGHMFADFKLVKQGISNVDYSYVGIYGWTRNPLVEFYIVDNWLSPSRPGDWVGNRKHGDFTIDGAKYTVYENTRNGPSIDGNTNFKQYFSIRQQARDCGTIDINAHFEQWEKLGMQMGKMHEAKILGE

SEQ ID NO: 10942 - protein, 188 aa, Anaeromyces robustus
  Glyco_hydro_11
NIGGVGYELWADSGNNSATFYSDGSFSCTFQNAKDYLCRSGLSFDSTQTHDQIGHIYADFKLVKQNINNVDYSYVGIYGWTRNPLVEFYVVDNWLSQYRPGDWVGNKKHGDFTIDGAQYTVYENTRYGPSIDGDTQFKQYFSIRQQARDCGTIDITAHFQQWEKLGMTLGKMHEAKVLGEAGSNGSGT

SEQ ID NO: 10943 - protein, 187 aa, Anaeromyces robustus
  Glyco_hydro_11
NIGGVGYELWADSGNNSATFYSDGSFSCTFQNAKDYLCRSGLSFDSTQTHDQIGHIYADFKLVKQNINNVDYSYVGIYGWTRNPLVEFYVVDNWLSQYRPGDWVGNKKHGDFTIDGAQYTVYENTRYGPSIDGDTQFKQYFSIRQQARDCGTIDITAHFQQWEKLGMTLGKMHEAKVLGEAGSNGAG

SEQ ID NO: 10944 - protein, 184 aa, Anaeromyces robustus
  Glyco_hydro_11
GVGYELWADSGNNSATFYSDGSFSCTFQSAKDYLCRSGLSFDSTQTHDQIGHIYADFKLVKQNINNVDYSYVGIYGWTRNPLVEFYVVDNWLSQYRPGDWVGNKKHGDFTIDGAQYTVYENTRYGPSIDGDTQFKQYFSIRQQARDCGTIDITAHFQQWEKLGMTLGKMHEAKVLGEAGSNGAG

SEQ ID NO: 10945 - protein, 46 aa, Piromyces finnis
  Glyco_hydro_11
SIRKEARDCGTIDITAHFQQWEKLGMKLGKMHEAKVLGEAGSNGSG

SEQ ID NO: 10946 - protein, 186 aa, Piromyces finnis
  Glyco_hydro_11
SGIGYELWADSGNNSATFYSDGSFSCSFQNAKDYLCRSGLSFDSTKTHDQIGHMYADFKLVKQNIQNVDYSYVGIYGWTRSPLVEFYVVDNWLSQWRPGDWVGNKKHGDFVIDGATYTVYENTRYGPSIDGDTQFKQYFSIRQQARDCGTIDITAHFQQWAKLGMNLGKMHEAKVLGEAGSTGSGT

SEQ ID NO: 10947 - protein, 187 aa, Piromyces finnis
  Glyco_hydro_11
IGGIGYELWADSGNNSATFYSDGSFSCSFQNAKDYLCRSGLSFDSTKTHDQIGHMYADFKLVKQNIQNVDYSYVGIYGWTRSPLVEFYVVDNWLSQWRPGDWVGNKKHGDFVIDGATYTVYENTRYGPSIDGDTQFKQYFSIRQQARDCGTIDITAHFQQWEKLGMKLGKMHEAKVLGEAGSTGSGT

SEQ ID NO: 10948 - protein, 187 aa, Piromyces finnis; identical to SEQ ID NO: 10947
  Glyco_hydro_11

SEQ ID NO: 10949 - protein, 158 aa, Piromyces finnis
  Glyco_hydro_11
SNAKDYLCRTGLSFDSTKTHDQLGHMYADFKLVKQNIRNVDYSYVGIYGWTRNPLVEFYVVDNWLSQWRPGDWVGNKKHGDFTIDGAQYTVYENTRYGPSIDGDTQFKQYFSIRQQARDCGTIDITAHFQQWEKLGMKLGKMHEAKVLGEAGSTGSGT

SEQ ID NO: 10950 - protein, 175 aa, Neocallimastix californiae
  Glyco_hydro_11/12
DACFKASWNNAGDFLGRVGLVWDNKPNYKNLGGDLIANYSYKKSGNDGGTYSYVGIYGWMDNPQIEYYVVDDWLHNRGAPGGSYMGSQKGTINVDGGTYKVWTGTRTGASKWGQSTFTQIFSVRTQQRTCGQINISEHFRQWEKLGIRVGQLMEAQILAESGGGSGYVDFTYATV

SEQ ID NO: 10951 - protein, 204 aa, Neocallimastix californiae
  Glyco_hydro_11/12
NKNETGRGNGNYRYEIWRDGNGGELTLYPKDACFKASWNNAGDYLGRVGLVWDQYINYKNLDGDLVAKYNYKKSGNDGGTYSYVGVYGWMDNPQIEYYVVDDWLHNRGAPGGSYMGSQKGTITVDGGTYKVWSGTRTGASKWGQSTFTQIFSVRTEQRTCGQINISEHFRQWEKLGLRIGSVMEAQILAESGGGSGYVDYTYAT

SEQ ID NO: 10952 - protein, 104 aa, Neocallimastix californiae
  Glyco_hydro_11/12
QWRPGDWVGNKKHGDFTIDGAKYTVYENTRYGPSIDGDTTFKQFFSIRQQARDCGTIDITAHFEQWEKLGMKLGKMHEAKVLGEAGSNGGGTTGTADFPYAKVY

SEQ ID NO: 10953 - protein, 203 aa, Neocallimastix californiae
  Glyco_hydro_11/12
KVSTTGNKTGRIGSVDYEIWADGGNNSADFYKDGSFSCAFNNSKDYLCRSGVNIRPAKYPSEIGKIKAEYKVVKQNAQNVGYSYVGVYGWTLESGISGVFEFYIVDNWLSQYRPGDWVGNQKKGDFTIDGAVYTVYKNVNGNLTQYFSLRREPRTCGTIDVTAHFDQWEKLGLKMGKISEIKVLGEAGNTGGGCTGRVDFPYA

SEQ ID NO: 10954 - protein, 209 aa, Neocallimastix californiae
  Glyco_hydro_11/12
VKVTSNKVGSIGGVGYELWADSGNNSATFYSDGSFSCTFQNAKDYLCRSGLSFDSTKTHQQIGHMYADFKLVKQNIRNVDYSYIGIYGWTRNPLVEFYVVDNWLSQYRPGDWVGNKKHGDFTIDGARYTVYENTRYGPSIDGNTNFKQYFSIRQTARDCGTIDITAHFQQWEKLGMTMGKMHEAKVLGEAGSNGAGTTGTADFPYAKVY

SEQ ID NO: 10955 - protein, 118 aa, Neocallimastix californiae
  Glyco_hydro_11/12
DPLVEFYVVDNWLSQWRPGDWVGNKKHGDYVIDGATYTVYENERYGPSIVGDTNFKQFFSIRKEARDCGTIDITAHFLQWEKLGMKLGKMYEAKVLGEAGSNSSGTTGTADFPYAKVY

SEQ ID NO: 10956 - protein, 135 aa, Neocallimastix californiae
  Glyco_hydro_11/12
VKVTSNKVGSINGIGYELWADSGNNSATFYSDGSFSCTFQKAKDYLCRSGLSFDSTKTHDQLGHMYADFKLVKQNIQNVDYSYVGIYGWSKDPLVEFYVVDNWLSQWRPGDWVGNKKHGDYVIDGATYTVYENER

SEQ ID NO: 10957 - protein, 200 aa, Neocallimastix californiae
  Glyco_hydro_11/12
EINGIGYELWADSGNNSATFYEDGSFSCSFNNAKDYLCRSGLSFDSTKTHKEIGHIYADFKLVKQNIRNVDYSYVGIYGWTRNPLVEFYVVDNWLSQWRPGDWVGNKKHGDFTIDGAKYTVYENTRYGPSIDGDTNFKQFFSIRQTARDCGTIDITAHFEQWEKLGMKLGKMHEAKVLGEAGSTGSGTTGTADFPYAKVY

SEQ ID NO: 10958 - protein, 209 aa, Neocallimastix californiae
  Glyco_hydro_11/12
KETSNKVGAIGDIGYELWSDSGDNSATFYADGSFSCSFKNAKDYLCRSGLSFDSTKTHKEIGHIYADFKLVKQDIQDVDYSYIGIYGWTREPLVEYYVVDNWLSQYRPGDWVGNKKYGDFEIDGAEYTVYENTRTGPSIDGDNVTFKQYFSIRKEARDCGTIDITAHFEKWEELDLVLGKMHEAKVLGEAGSIHDGTSGTADFPYAKVY

SEQ ID NO: 10959 - protein, 209 aa, Neocallimastix californiae
  Glyco_hydro_11/12
KETSNKVGAIGDIGYELWSDSGDNSATFYADGSFSCSFKNAKDYLCRSGLSFDSTKTHKEIGHIYADFKLVKQDIKDVDYSYIGIYGWTREPLVEYYVVDNWLSQYRPGDWVGNKKYGDFEIDGAEYTVYENTRTGPSIDGDNVTFKQYFSIRKEARDCGTIDITAHFEKWEELDLVLGKMHEAKVLGEAGSIHDGTSGTADFPYANVY

SEQ ID NO: 10960 - protein, 209 aa, Neocallimastix californiae
  Glyco_hydro_11/12
VKVTSNKVGNIKGIGYELWADSGNNSATFYEDGSFSCSFSRAKDYLCRSGLSFDSTKTHDQIGHIYADFKLVKQNIQNVDYSYVGIYGWTRNPLVEFYVVDNWLSQWRPGDWVGNKKHGDFVIDGATYTVYENTRYGPSIDGDTNFKQFFSIRQQARDCGTIDITAHFQQWEKLGMKLGKMHEAKVLGEAGSNGQGTSGTADFPYAKVY

SEQ ID NO: 10961 - protein, 205 aa, Neocallimastix californiae
  Glyco_hydro_11/12
NKNETGRGNGNYRYEIWRDGNGGELTLYPKDACFKASWNNAGDYLGRVGLVWDNKINYKNAGGDIIANYAYKKSGSDGGTYSYIGIYGWMDNPQIEYYVVDDWLHNRGAPGGSWMGQQKGTINVDGGTYKVWSGQRTGASKWGQSTFTQIFSVRTSQRQCGQINISEHFRQWEKLGLRIGQVMEAQILAEAGGGSGYVDFTYATV

SEQ ID NO: 10962 - protein, 204 aa, Neocallimastix californiae
  Glyco_hydro_11/12
NKNETGRGNGNYRYEIWRDGNGGELTLYPKDACFKASWNNAGDYLGRVGLVWDNKINYKNAGGDIVAKYAYKKSGSDGGTYSYIGIYGWMDNPQIEYYVVDDWLHNRGAPGGSWMGQQKGTINVDGGTYKVWSGQRTGASKWGQSTFTQIFSVRTSQRQCGQINISEHFRQWEKLGLRIGQVMEAQILAEAGGGSGYVDFTYAT

SEQ ID NO: 10963 - protein, 209 aa, Neocallimastix californiae
  Glyco_hydro_11/12
VRVTSNKVGQINGIGYELWADSGNNSATFYSDGSFSCSFQNAKDYLCRSGLSFDSTKTHQQLGHMYADFKLVKQGISNVDYSYVGIYGWTRSPLVEFYVVDNWLSQWRPGDWVGNKKYGDYTIDGAKYTVYENSRYGPSIDGDTNFKQFFSIRQQARDCGTIDITAHFEQWEKLGMKMGKMHEAKVLGEAGSTGSGTSGTADFPYAKVY

SEQ ID NO: 10964 - protein, 209 aa, Neocallimastix californiae
  Glyco_hydro_11/12
KETSNKVGTIGDIGYELWSDSGDNSATFYSDGSFSCSFKNAKDYLCRSGLSFDSTKTHKEIGHIYADFKLVKQDIKDVDYSYIGIYGWTREPLVEYYVVDNWLSQYRPGDWVGNKKYGDFEIDGAEYTVYENTRTGPSIDGDNVTFKQYFSIRKEARDCGTIDITAHFEKWEELGLTLGKMHEAKVLGEAGSIHDGTSGTADFPYAKVY

SEQ ID NO: 10965 - protein, 209 aa, Neocallimastix californiae
  Glyco_hydro_11/12
KETSNKVGTIGDIGYELWSDSGDNSATFYSDGSFSCSFKNAKDYLCRSGLSFDSTKTHKEIGHIYADFKLVKQDIKDVDYSYIGIYGWTRKPLVEYYVVDNWLSQYRPGDWVGNKKFGDFEIDGAEYTVYENTRTGPSIDGDNVTFKQYFSIRKEARDCGTIDITAHFEKWEELGLTLGKMHEAKVLGEAGSIHDGTSGTADFPYAKVY

SEQ ID NO: 10966 - protein, 209 aa, Neocallimastix californiae
  Glyco_hydro_11/12
KETSNKVGAIGDIGYELWSDSGDNSATFYSDGSFSCSFKNAKDYLCRSGLSFDSTKTHKEIGHIYADFKLVKQDIQDVDYSYIGIYGWTREPLVEYYVVDNWLSQYRPGDWVGNKKYGDFEIDGAEYTVYENTRTGPSIDGDNVTFKQYFSIRKEARDCGTIDITAHFKKWEELGLTLGKMHEAKVLGEAGSIHDGTSGTADFPYAKVY

SEQ ID NO: 10967 - protein, 194 aa, Neocallimastix californiae
  Glyco_hydro_11/12
KIGSSGYHYEIWYQGGNNSMTYYDNGTFKASWGGTNDFLARVGLKYNEDKTHQQLGQIDAYFKWTKSGSAGGYNYIGIYGWTVDPLVEYYIVDDWYNKPGSYLGQKKGEFTVDGDTYEIFQNTRVNQPSIKGTSTFPQFFSVRRSARSCGHIDISAHFKKWESLGMKLGKMYEAKVLVEAGGGSGSFDVTYFKM

SEQ ID NO: 10968 - protein, 190 aa, Neocallimastix californiae
  Glyco_hydro_11/12
VQETSNKVGQIGDVGYELWSDSGYNSATFYSDGSFSCSFNNAKDYLCRSGLSFDSTKTHDQIGHMYADFKLVKQNIRNVDYSYVGVYGWTRNPLVEYYIVDNWLSQYRPGDWVGNKKHGDFTIDGAQYTVYENTRYGPSIDGDTQFKQYFSIRQQARDCGTIDITAHFQQWEKLGMKLGKMHEAKVLGEA

SEQ ID NO: 10969 - protein, 209 aa, Neocallimastix californiae
  Glyco_hydro_11/12
IKITNNNVGQIGDVGYELWSDSGYNSATFYSDGSFSCSFSNAKDYLCRSGLSFDSTQTHDQIGHMYADFKLVKQNIRNVDYSYIGVYGWSRDPLVEYYVVDNWLSQYRPGDWVGNKKHGDFTIDGAKYTVYENTRYGPSIDGDTQFKQYFSIRQQARDCGTIDITAHFQQWEKLGMKLGKMHEAKVLGEAGSNGSGTSGTADFPYAKVY

SEQ ID NO: 10970 - protein, 198 aa, Neocallimastix californiae
  Glyco_hydro_11/12
RLGKIGSVDYEVWADGGNNSAVFYSDGSFSCSFSNTKDYLCRTGVSFSQAKYPSEIGHIKAEYKVVKQNAQNVGYSYVGVYGWTLNSGISGVFEFYIVDNWLSPGRPGDWVGNEKKGDFTIDGGKYTVYKNVNGNLTQYFSLRTSPRTCGTIDVTAHFEQWEKIGLKMGKITEVKVLGEAGNVGGGCSGTVDFPYAKI

SEQ ID NO: 10971 - protein, 48 aa, Neocallimastix californiae; identical to SEQ ID NO: 6408
  Glyco_hydro_11/12

SEQ ID NO: 10972 - protein, 194 aa, Anaeromyces robustus; identical to SEQ ID NO: 10967
  Glyco_hydro_11/12

SEQ ID NO: 10973 - protein, 209 aa, Anaeromyces robustus
  Glyco_hydro_11/12
VKVTSNKVGSIGGIGYELWADSGSNSATFYSDGSFSCSFSRAKDYLCRSGLSFDSTKTHQQIGHIYADFKLVKQNIQSVDYSYVGIYGWTRNPLVEFYVVDNWLSQYRPGDWVGNKKHGDFTIDGAKYTVYENTRYGPSIDGDTQFKQFFSIRQQARDCGTIDITAHFEQWEKLGMKLGKMHEAKVLGEAGSNGGGTSGTADFPYAKVY

SEQ ID NO: 10974 - protein, 198 aa, Anaeromyces robustus; identical to SEQ ID NO: 10970
  Glyco_hydro_11/12

SEQ ID NO: 10975 - protein, 209 aa, Anaeromyces robustus
  Glyco_hydro_11/12
VTVTSNKVGKIGDIGYELWADSGNNSATFYADGSFSCSFRQAKDYLCRSGLSFDSTQTHQQIGHMYADFKLVKQNIQSVDYSYVGIYGWTRNPLVEFYVVDNWLSQWRPGDWVGNKKHGDFTIDGAKYTVYENTRYGPSIDGDTNFKQYFSIRQQPRDCGTIDITAHFQQWEKLGMTMGKMHEAKVLGEAGSTGGGTSGTADFPYAKVY

SEQ ID NO: 10976 - protein, 209 aa, Anaeromyces robustus
  Glyco_hydro_11/12
VTCNSNRVGSIGGVGYELWSDSGSNSATFYSDGSFSCSFRSAKDYLCRSGLSFDSTKTHQQIGHIYADFKLVKQNIQNVDYSYVGIYGWTRNPLVEFYVVDNWLSQYRPGDWVGNKKHGDFTIDGAKYTVYENTRYGPSIDGNTNFKQYFSIRQQARDCGTIDITAHFEQWEKLGMTMGKMHEAKVLGEAGSNGGGTSGTADFPYAKVY

SEQ ID NO: 10977 - protein, 209 aa, Anaeromyces robustus
  Glyco_hydro_11/12
VTCNSNKVGSIGSVGYELWSDSGNNSATFYSDGSFSCSFRSAKDYLCRSGLSFDSTKTHQQIGHIYADFKLVKQNIQNVDYSYVGIYGWTRNPLVEFYVVDNWLSQYRPGDWVGNKKHGEFTIDGAKYTVYENTRYGPSIDGDTSFKQYFSIRQQARDCGTIDITAHFEQWEKLGMTMGKMHEAKVLGEAGSNGGGTSGTADFPYAKVY

SEQ ID NO: 10978 - protein, 208 aa, Anaeromyces robustus
  Glyco_hydro_11/12
KETGNKVGSIGGVGYELWFEGGNNSATFYSDGSFSCSFQGSKDYLCRTGLSFNSDKTYQQIGHMFADFKLVKQGISNVDYSYVGIYGWTRNPLVEFYIVDNWLSPSRPGDWVGNRKHGDFTIDGAKYTVYENTRNGPSIDGNTNFKQYFSIRQQARDCGTIDINAHFEQWEKLGMQMGKMHEAKILGEAGSNGGGTSGTADFPYAKVY

SEQ ID NO: 10979 - protein, 197 aa, Anaeromyces robustus
  Glyco_hydro_11/12
GVGYELWADSGNNSATFYSDGSFSCTFQSAKDYLCRSGLSFDSTQTHDQIGHIYADFKLVKQNINNVDYSYVGIYGWTRNPLVEFYVVDNWLSQYRPGDWVGNKKHGDFTIDGAQYTVYENTRYGPSIDGDTQFKQYFSIRQQARDCGTIDITAHFQQWEKLGMTLGKMHEAKVLGEAGSNGAGTSGTADFPYAKVY

SEQ ID NO: 10980 - protein, 208 aa, Anaeromyces robustus
  Glyco_hydro_11/12
KETSNKVGNIGGVGYELWADSGNNSATFYSDGSFSCTFQNAKDYLCRSGLSFDSTQTHDQIGHIYADFKLVKQNINNVDYSYVGIYGWTRNPLVEFYVVDNWLSQYRPGDWVGNKKHGDFTIDGAQYTVYENTRYGPSIDGDTQFKQYFSIRQQARDCGTIDITAHFQQWEKLGMTLGKMHEAKVLGEAGSNGAGTSGTADFPYAKVY

SEQ ID NO: 10981 - protein, 208 aa, Anaeromyces robustus
  Glyco_hydro_11/12
KETSNKVGNIGGVGYELWADSGNNSATFYSDGSFSCTFQNAKDYLCRSGLSFDSTQTHDQIGHIYADFKLVKQNINNVDYSYVGIYGWTRNPLVEFYVVDNWLSQYRPGDWVGNKKHGDFTIDGAQYTVYENTRYGPSIDGDTQFKQYFSIRQQARDCGTIDITAHFQQWEKLGMTLGKMHEAKVLGEAGSNGSGTSGTADFPYAKVY

SEQ ID NO: 10982 - protein, 58 aa, Piromyces finnis
  Glyco_hydro_11/12
SIRKEARDCGTIDITAHFQQWEKLGMKLGKMHEAKVLGEAGSNGSGTTGTADFPYAKV

SEQ ID NO: 10983 - protein, 208 aa, Piromyces finnis
  Glyco_hydro_11/12
TEYSNKVGSISGIGYELWADSGNNSATFYSDGSFSCSFQNAKDYLCRSGLSFDSTKTHDQIGHMYADFKLVKQNIQNVDYSYVGIYGWTRSPLVEFYVVDNWLSQWRPGDWVGNKKHGDFVIDGATYTVYENTRYGPSIDGDTQFKQYFSIRQQARDCGTIDITAHFQQWAKLGMNLGKMHEAKVLGEAGSTGSGTSGTADFPYAKVY

SEQ ID NO: 10984 - protein, 208 aa, Piromyces finnis
  Glyco_hydro_11/12
TERSNKVGSIGGIGYELWADSGNNSATFYSDGSFSCSFQNAKDYLCRSGLSFDSTKTHDQIGHMYADFKLVKQNIQNVDYSYVGIYGWTRSPLVEFYVVDNWLSQWRPGDWVGNKKHGDFVIDGATYTVYENTRYGPSIDGDTQFKQYFSIRQQARDCGTIDITAHFQQWEKLGMKLGKMHEAKVLGEAGSTGSGTSGTADFPYAKVY

SEQ ID NO: 10985 - protein, 209 aa, Piromyces finnis
  Glyco_hydro_11/12
VKVTSNKVGSIGGIGYELWADSGNNSATFYSDGSFSCSFQNAKDYLCRSGLSFDSTKTHDQIGHMYADFKLVKQNIQNVDYSYVGIYGWTRSPLVEFYVVDNWLSQWRPGDWVGNKKHGDFVIDGATYTVYENTRYGPSIDGDTQFKQYFSIRQQARDCGTIDITAHFQQWEKLGMKLGKMHEAKVLGEAGSTGSGTSGTADFPYAKVY

SEQ ID NO: 10986 - protein, 170 aa, Piromyces finnis
  Glyco_hydro_11/12
SNAKDYLCRTGLSFDSTKTHDQLGHMYADFKLVKQNIRNVDYSYVGIYGWTRNPLVEFYVVDNWLSQWRPGDWVGNKKHGDFTIDGAQYTVYENTRYGPSIDGDTQFKQYFSIRQQARDCGTIDITAHFQQWEKLGMKLGKMHEAKVLGEAGSTGSGTSGTADFPYAKVY

SEQ ID NO: 10987 - protein, 68 aa, Neocallimastix californiae
  Glyco_hydro_114
AIWLPSQGMTWNYVLGNDIDVNSETANVVDIDIRKTEAINKLHKKGIKVICYFSVGTLESFRDDYPQF

SEQ ID NO: 10988 - protein, 67 aa, Neocallimastix californiae
  Glyco_hydro_114
IWLPSQDMTWNYVLGNDIDVNSEKANVVDIDIRKSETKIKNLQKKGIKVICYFSVGTLESFRDDYPQ

SEQ ID NO: 10989 - protein, 70 aa, Piromyces finnis
  Glyco_hydro_114
NAIWIPPQGIKWNYVLGSDINENTETANVVDIDIRKDQSKIDNLHKRGIKVICYFSGGTLEYFREDYKDF

SEQ ID NO: 10990 - protein, 97 aa, Neocallimastix californiae
  Glyco_hydro_13_b
SRYIRPGYTIIGCYNNSVAAYDSVGKKLVIVATNTANTTKTVDFNLSEFTSVGYNIRVIRTSGSVSNGEKWAELKPLIPYGKGFNADLKGNSITTFI

SEQ ID NO: 10991 - protein, 97 aa, Anaeromyces robustus
  Glyco_hydro_13_b
SRYIRPGYTIIGSYNNSVAAYDNEGKKLVIVATNTAGSNKIVDFDLSTFTSVGYNVRVIRTSGSMSNGEHWAELTPLIPYGKGFNAELKANSITTFI

SEQ ID NO: 10992 - protein, 155 aa, Neocallimastix californiae
  Glyco_hydro_16
SCPGSGNGGRMRTNVRYKSGKFEVRAKMPIASGLVPAIYFASTPDNTNGNQDEFDFELIGSNRMQTNLFIYGNGGREQVWNPPTDLSKDFHLYTFEWNSNSIVLKVDNQVIRTFNNPMPQQPCYFILTNWMCVGCDGWTGPADWSRQPYDFIVDY

SEQ ID NO: 10993 - protein, 179 aa, Neocallimastix californiae
  Glyco_hydro_16
MYGTSTDHTHVYLKENTVVLFAKRINWDEGKSTSNPHPAIHYHSGAIHSKQTFTVNDQYPNYEIKGEFMVPTNSGTWPAFWLNGAKTWPPEIDIVEFKGSNVNWFNTFRTSSDVSTYKTTINNKGAWHEYRIWITKVSNTNIDIHFYIDGVWKAKHTANHVGKPFHLIMNLQMEGSSGG

SEQ ID NO: 10994 - protein, 172 aa, Neocallimastix californiae
  Glyco_hydro_16
YGAPDDHNHVYLENNSVVLQACRINWDEGKSTANPHPVIHYHSGAIHSIQTFTINDQYPNYEIRGEFIAPTTGGTWPAFWLNGAWTWPPEIDILEFKGTTTNWFNTFRTSSDVSTYKEAISNPNTWHEYRLWISKVSDVNMDIHFYIDGKWRAKHTANHVGKPFHLIMNLQM

SEQ ID NO: 10995 - protein, 148 aa, Neocallimastix californiae
  Glyco_hydro_16
GEYKLTDEEKKSCTNNNENSCGWTQSVTSGRIRTYKSGHAWKYGKVRVKAKLPAGPYLWPAIWMLPQDDVYGTWAASGEIDIMEARGQVPDAVGHAIHYGGQWPNNVFSSETASVKDVINDFHVYGLDWEENFLIFSVDEVEYFTVDL

SEQ ID NO: 10996 - protein, 179 aa, Neocallimastix californiae
  Glyco_hydro_16
MYGASDDHNHVYLENNTVVLKASRINWDEGKSTANPHPVIHYHSGAIHSKQTFTINDQYPNYEIRGEFQAPTNGGTWPAFWLNGAWTWPPEIDILEFKGTTTNWFNTFRTSSDVSTYKEAISNPSGWHEYRLWITKVSNTDMDIHFYIDNKWKAKHTANHVGKPFHLIMNLQMEGSASG

SEQ ID NO: 10997 - protein, 136 aa, Neocallimastix californiae
  Glyco_hydro_16
IDSVSQSCPGSGNGGRMRTNVRYKSGKFEVRAKMPIASGLVPAIYFASTPDNTNGDQDEFDFELIGSNRMQTNLFIHGNGGREQIWNPPTDLSKDFHLYTFEWSSNAIVLKVDNEVIRTFNNPMPDQPSYFILTNW

SEQ ID NO: 10998 - protein, 154 aa, Anaeromyces robustus
  Glyco_hydro_16
RGSGNGGRMRTNVRYKSGKFEVRAKMPIASGLVPAIYFASTPDNTNGSQDEWDFELIGSNRMQTNLFINGQGGREEVWNPPYDLSRDFHTYTFEWTSNSIVLKVDNQVVRTFNNPMPTQPSYFILTNWMCVGCDGWTGPADWSRQPYDFIVDYV

SEQ ID NO: 10999 - protein, 156 aa, Anaeromyces robustus
  Glyco_hydro_16
VKNGQLHIKAVPKGQYKLTDQEMKTCTNNNEDSCGWTQSTTSGRIRTYKSGNAWKYGKIRVKAKLPAGPYLWPAIWMLPQDDVYGTWAASGEIDIMEARGQVSNAIGNAIHFGGQWPNNDFVDKTYNLSNIINDFHVYGLDWEEDYLLFSVDEEVT

SEQ ID NO: 11000 - protein, 163 aa, Anaeromyces robustus
  Glyco_hydro_16
VKNGQLHIKAVPKGQYKLTDQEMKTCTNNNENSCGWTQSTTSGRIRTYKSGNAWKYGKIRVKAKLPAGPYLWPAIWMLPQDDVYGTWAASGEIDIMEARGQVPDAVGHAIHFGGQWPDNDFMSETASIKNVINDFHVYGLDWEENFLIFTVDEKPYYTVDLRK

SEQ ID NO: 11001 - protein, 75 aa, Piromyces finnis
  Glyco_hydro_16
PGSGNGGRMRTNVRYKSGKFEVRAKMPIASGLVPAIYFASTPDNTNGSQDEFDFELIGSNRMQTNLFIYGNGGRE

SEQ ID NO: 11002 - protein, 353 aa, Neocallimastix californiae
  Glyco_hydro_18
IIVGYFSEWKNANYPISRVDLSKITHLNYAFGVIDPNSYAVTGYDSNILSQVVTAAHSQGVKVLMSVGGWYGSRYFTQMTSSKSNIEKFVDSCQSLISNYGVDGIDIDWEYPGREGACNSPDMANDAENYLTLLKILREKIGNALISAAVSVIPFEKNGQPISDLSEYEKYFDYINVMAYDFAGSWTPTVSHHSALYDPEAGEKLSLSSGVKNWLSRGFPANKIVVGVPAYGKSWIAASSNRNGLYQSVANGNPKGDHEDSNSPWTNYCGVLESAYSGNWKYKNIRSEILKSDYTTASGSWVRSWDDKVKGPYLFNKETKQIITYDDPETIQYKAKYIIDNNFGGMMIWELEN

SEQ ID NO: 11003 - protein, 350 aa, Neocallimastix californiae
  Glyco_hydro_18
SIIIYYPEWKYYNYPPRNLPFNKLTHINYAFGEIDPTNYSLKYDSTKFLELIETARSRNKNVKIIMSVGGWTGSRYFSVMSSNPANRSKFISSVKSMLESTGADGIDIDWEHPGVPGAFYDSFDAQNDTYNLLKLMQELREAIGKSKIISTAVTFNLFVVNYQPLQDLSKFAEILDYINLMCYDFNGSWSNIISHQSSLYPTGGNDSGFSVEGAVKNWMNAKFPSNKIVIGIPSYGISWISSTSNNNGLLQIPSNSFPKGDEEDVMNAESGRYSGIWKYKNLRKQILQSSFKDATGDWIRVWDSKSSVPYLYNKVSRQFITYDDPESVKIKADYVIERNLGGMMMWEIEE

SEQ ID NO: 11004 - protein, 350 aa, Neocallimastix californiae
  Glyco_hydro_18
SIIVYYPEWKYYDFPPKNIPFNKLTHINYAFAEIDSNDYSLDYDSSRFLELVETAHEKNKNIKVLMSIGGWTGSKYYSKMASSSSRRSKFVKSVKRMLEASDADGIDIDWEYPGTSGAYDDNFDAENDTNNLLKLLKELREAIGSSKIISAAVPFNTFEVDSRPLKDMSEFAELFDYVNIMAYDFAGSWSTVTSHQSSLYSISEDDNGYSLSGAVSNWINANFPSSKIVVGIPAYGRSWISGSSSNNGYLQRPSNSHPKGDEEDYIDSSSKRYSSTWKYKNIRKAIVKSTYKNSSGDWIRIWDSKSSVPFLFNTNTRQFITYDDPESVSLKADYVINKNLGGMMMWEIEE

SEQ ID NO: 11005 - protein, 350 aa, Neocallimastix californiae
  Glyco_hydro_18
SIIVYYPEWKYYNFPPKNIPFNKLTHINYAFAEINSSDYSLEYDSSKFLELVETAHEYNKNIKVLMSIGGWTGSRYYSKMASSSSNRSKFVKSVKRMLEASGADGIDIDWEYPGTSGAYDDNFDAKNDTNNLLKLLQELRASIGYSKIISAAVPYNTFEVNYKPLEDMSEFAELFDYINIMAYDFAGSWSSVTSHHSSLYSTVEDDSGYSLAGAVKNWMNARFPATKIVVGIPAYGRSWISGSSSNNGYLQRPSNSHPKGDEEDYIDPNSKRYSSTWKYKNIRKAIMKSTYKDSTGNWIRVWDSKSSVPFLFNKNTRQFITYDDPESVSIKADYVIKYNLGGMMMWEIEE

SEQ ID NO: 11006 - protein, 355 aa, Anaeromyces robustus; identical to SEQ ID NO: 10863
  Glyco_hydro_18

SEQ ID NO: 11007 - protein, 350 aa, Anaeromyces robustus
  Glyco_hydro_18
SIIVYYPEWKYYDFPPKDIPFSKLTHINYAFAEINPDDFSLEYDSNKFLELIDTAHKKNKSIKVLMSIGGWTGSRYFSKMASSSSNRTKFVKSVKRMIDASNADGIDIDWEYPGSSGAYDDNYDSENDTNNLLKLLKELRETIGTSKLITAAVPFNTFEVDHKPLSDMTEFAKLFDFINIMAYDFSGSWSSVTAHQSALYSTHEDDSGYSLSGAVKNWMNANFPAKKIVVGIPAYGRSWIAGSSTNHGYLQRPSNSYPKGDEEDYIDSDSKRYSSTWKYKNIRKQVLKSDYSKSTGSWERIWDSKSSAPFLFNKDTKQFITYDDPKSVGLKADYVIENNLGGMMMWEIEE

SEQ ID NO: 11008 - protein, 125 aa, Piromyces finnis
  Glyco_hydro_18
LFYYRSWIVSSTSRNGLYQSIVNGNPRGDHEDSSDSWTNYCGIVESGFSGSWKYKNIRNEILLSSYNTSSGSWIRTWDDNVKCPYLFNKDTKQIISYDDPESIGYKAKFVLENGFAGMMVWELEN

SEQ ID NO: 11009 - protein, 126 aa, Piromyces finnis
  Glyco_hydro_18
FLFYYRSWIVSSTSRNGLYQSIVNGNPRGDHEDSSDSWTNYCGIVESGFSGSWKYKNIRNEILLSSYNTSSGSWIRTWDDNVKCPYLFNKDTKQIISYDDPESIGYKAKFVLENGFAGMMVWELEN

SEQ ID NO: 11010 - protein, 350 aa, Piromyces finnis; identical to SEQ ID NO: 10865
  Glyco_hydro_18

SEQ ID NO: 11011 - protein, 114 aa, Neocallimastix californiae; identical to SEQ ID NO: 1304
  Glyco_hydro_2

SEQ ID NO: 11012 - protein, 114 aa, Neocallimastix californiae; identical to SEQ ID NO: 1307
  Glyco_hydro_2

SEQ ID NO: 11013 - protein, 114 aa, Piromyces finnis; identical to SEQ ID NO: 1309
  Glyco_hydro_2

SEQ ID NO: 11014 - protein, 295 aa, Neocallimastix californiae
  Glyco_hydro_2_C
ITINGKRLLIKGVNRHDSDPFNGRAVPQQTLREDIALMKKHNINAIRTSHYSNDSYLYWLCNKYGMYVMGETNLESHALQNNHDAKAKFYELGMDRTETAYKRLKNNPSIFAWSIGNEMAYTNNPNDAGGLFRDMIWYFKKNDSSRPVHSEGQGSSMGVDMSSNMYPGSDGLGVHAGRGKMPYIMCEYDIASGNAIGALKEYWDVIRSADNMLGGFIWDWVDQSRAKTLNGGWDYYSQSYAITNLYSEEIKGKFYAYGGDWGDWPNDNSFCVNGLINPDRTPQPELAEVKFQYQS

SEQ ID NO: 11015 - protein, 295 aa, Neocallimastix californiae
  Glyco_hydro_2_C
ITINGKRLLLKGVNRHDTDPFNGKAIPQATMEMDITLMKTNNINAIRTSHYSNDSYLYWLCNKYGMYVMGETNMESHALMDNNDAKALFYEVGLDRTETAYKRLKNHPSIVAWSIGNEMAYTSNPSDAGGLFRDMIWYFKKNDNSRPVHSEGQGGSMGVDMSSNMYPSSDGIRGNAGKGKMPYVMCEYDHAMGNSVGALKEYWDGIRSADNMLGGFIWDWVDQSRATPLKGGWDYYSESYAKTNLYAEEIKGKFYGYGGDWGDWPNDNSFCVNGLISPDRTPQPELAEVKYQYQS

SEQ ID NO: 11016 - protein, 297 aa, Piromyces finnis
  Glyco_hydro_2_C
PITINGKRLLLKGVNRHDTDPFNGKAIPQETMREDITLMKKNNINAIRTSHYSNDSYLYWLCNKYGMYVMGETNMESHALMDNNDGKALFYELGLDRTETAYKRLKNNPSIVAWSIGNEMAYTGNPSDAGGLFRDMIWYYKKNDNTRPVHSEGQGGGMGVDMSSNMYPSSDGIRGNAGKGKMPYVMCEYDHAMGNSVGALKEYWDAIRSADNMLGGFIWDWVDQSRAVPIKSGGWDYYSESYAKTNLYSSEIKGKFYGYGGDWGDRPNDNSFCVNGLINPDRTPQPELAEVKFQYQS

SEQ ID NO: 11017 - protein, 180 aa, Neocallimastix californiae; identical to SEQ ID NO: 9677
  Glyco_hydro_2_N

SEQ ID NO: 11018 - protein, 180 aa, Neocallimastix californiae; identical to SEQ ID NO: 9690
  Glyco_hydro_2_N

SEQ ID NO: 11019 - protein, 178 aa, Piromyces finnis; identical to SEQ ID NO: 9705
  Glyco_hydro_2_N

SEQ ID NO: 11020 - protein, 98 aa, Neocallimastix californiae
  Glyco_hydro_2/20_Ig-like
DASQLDNKQVSVYNENNFLNLNDFDVSWTLLKNGIAIKTGNVKNANVAPLTKGTLKVPFEIPQDSLAGDEFYLDMSVKVKNGSDLLPEGTEISYGQFH

SEQ ID NO: 11021 - protein, 126 aa, Neocallimastix californiae
  Glyco_hydro_2/20_Ig-like
IFRDVFLVSAPDVQIRDYTVRTDLDSSFTNANLEISMDIRNLSGGEKSGWGVIAEAYDEAGNNILKGASIKLDRLNTNKDNTFVLKTSVNSPKLWSAEIPNLYALVLKLTDNSGNVQEILSTQLGF

SEQ ID NO: 11022 - protein, 126 aa, Neocallimastix californiae
  Glyco_hydro_2/20_Ig-like
IFRDVFLVSAPSVQIRDYTVRTDLDSSFSNASLEISMDIRNLSGGAKSGWSVTAEAYDEAGKNILSGATVKLDNLANGRDTTSVLKTSVKSPKLWSAETPNLYALVLKLTDDKGTVQEILSAQLGF

SEQ ID NO: 11023 - protein, 98 aa, Neocallimastix californiae
  Glyco_hydro_2/20_Ig-like
DASQLEKQEVSVYNENNFLNINEFDITWTVLKNGIAISNGVVQNANVGPLTKGTLKVPFEVPEKPLAGDEFFLDMSVKVKKGTKMLPEGTEIAYGQIP

SEQ ID NO: 11024 - protein, 99 aa, Piromyces finnis
  Glyco_hydro_2/20_Ig-like
DASQLDNQEVSVYNENNFLNINQFDVTWTLLKNGIAIDSGIVRNANVAPLSKGTLKVPFVIPMDSLAGDEYYLDMSVKVKNGTDMLPEGTEIAYGQIAL

SEQ ID NO: 11025 - protein, 126 aa, Piromyces finnis
  Glyco_hydro_2/20_Ig-like
IFRDVFLVSAPAVQIRDYTVRTDLDNSFSTANLEISMEIRNLSGSSKNGWSVIAEAYDEAGYNILSGASVKLGGLSNGKDSNAVLKTSVKSPKLWSAETPNIYALVLKLIDENGRTQEILSTQLGF

SEQ ID NO: 11026 - protein, 301 aa, Neocallimastix californiae
  Glyco_hydro_26
VNPKAIPAAKKLYDFLKSNYGKRILSGQVGAAGQAGDEGEEFKRIMNATGKKPAVWNMDFIFESNDCTWRPTNPDITEMAINWWKKYQGKGIMSAQWHWNIAGRTGNFAFYKKDTTFDLEKAVTEGTWEYEKIIKDIDRVSGLIKKLQAINMPLIWRPLHENNGDWFWWGNNPKACAKLWKILYERMVNYHGLNNLIWLWNGNNDEYTPIEYIDIIGVDIYANDHGPQTTAYNTHFDFYGGKKMVVLSENGRIPDIQQCVDQGAWWGYFQTWNNEFILQNHYHTDAQLKEYFNHKIVMNMD

SEQ ID NO: 11027 - protein, 229 aa, Neocallimastix californiae
  Glyco_hydro_26
NPDITEMAINWWKKYQGKGIMSAQWHWNIAGKTGNFAFYKKDTTFDLEKAVTEGTWEYKKIIKDIDRVSGFIKKLQAINMPLIWRPLHENNGDWFWWGNNPKACAKLWKILYERMVNYHGLNNLIWLWNGNNDEYTPIEYIDIIGVDIYANDHGPQTTAYNTHFDFYGGKKMVVLSENGRIPDIQQCVDQGAWWGYFQTWNSEFILQNSYHTDAQLKEYFNHKIVMNMD

SEQ ID NO: 11028 - protein, 114 aa, Neocallimastix californiae
  Glyco_hydro_26
YIDTFVKGVKDFGEEIWLRPLHEANGDWYTWGTGADRINNSEDKLAAAYRHIVDRFRDANVTNVKWIWTTNCSNSGVATLTGSYPGDDYIDYTSIDGYNWGTAQSWSRWNTFEE

SEQ ID NO: 11029 - protein, 299 aa, Neocallimastix californiae
  Glyco_hydro_26
NPNSTSSTKLLYNYLVNNFGKKIISGQVGSAGYLETEEFDYIKKITGKTPAMFNVDFIFESLDHDWKPDDSIADMVLAWWKKYEGKGILHAQWHWNKKGSDGQVSFYTKNVDFDITKALIEGTNEYKSIMADMDYIASQIKILQDKDIPIIWRPLHEASGGWFWWGAKGPEPCVALYKMMYERFTKVHKLNNLIWCWNGGIGNWYPGDEYVDIISEDVYDKHSSFASKYNSLLNQVGNKKIIALSENGSLPDIESCMKERITWSFFCTWNNEYILNNSDNIYNTPEYIKSVYNSNYVIT

SEQ ID NO: 11030 - protein, 301 aa, Anaeromyces robustus
  Glyco_hydro_26
VNPKAIPAAKKLYDFLKTNYGKRILSGQVGAAGQAGDEGEEFKRIINATGKKPAVWNMDFIFESNDCTWRPTNPDITEMALDWWKKYQGKGIMSAQWHWNIAGQTGNFAFYKKDTTFDLEKAVTEGTWEYNKIIKDIDRVSGLIKKLQAVNMPLLWRPLHENNGDWFWWGNNPKACAKLWKILYERMVNYHGLNNLIWLWNGNNDEYTPIEYIDLIGVDIYADDHGPQTTAFNTHFDFYDGKKMVVLSENGRIPDIQKCVAQGAWWGYFQTWNSEFILQDSYHTTAQLKEYFSNKVVMNMD

SEQ ID NO: 11031 - protein, 301 aa, Piromyces finnis
  Glyco_hydro_26
VNPKAIPAARKLYDFLKSNYGKRILSGQVGAAGKAGDEGQEFQRIKNASGKLPAVWNMDFIFESNDCTWRPENPDITEMAINWWKKYEGKGIMAAQWHWNIAGKTGNFAFYSKDTTFSLENAVTKGTWEYEKIIKDIDRVSGHIKKLQAVNMPLIWRPLHENNGDWFWWGNNPKACAKLWKILYERMVNYHGLNNLIWLWNGNNDEYTPVDYIDIIGVDIYANDHGPQTTAFNTHFDFYGGKKMVVLSENGRIPDIQQCVDQDAWWGYFQTWNSEFILQESYHTNAQLKEYFNHEIVMNMD

SEQ ID NO: 11032 - protein, 301 aa, Piromyces finnis; identical to SEQ ID NO: 11031
  Glyco_hydro_26

SEQ ID NO: 11033 - protein, 274 aa, Neocallimastix californiae
  Glyco_hydro_3
EEMTLDEKIGMVTGSQNSFGPCVGYIEPIERLGFKGMCFQDGPAGVRSAKHTTTLPSGLNIASTFDPEIMKKIGVVLGEESRAKGVNAILGPAMNMYRSPAAGRNWEGYGEDTYLASVASKNVVAGIASQGVLATIKHFAGNEQETNRETSNSEIDERVLQEVYFPPFKAGIVSGAGGVMAAYNDLNGIPSANNTWLLNKVLKKQMLFHGFVTSDWWGTKDKYEIMNGLDINMPGGKQWGPTVTESYWGEELKEAVESGEIDVSYVDEACTRIL

SEQ ID NO: 11034 - protein, 265 aa, Neocallimastix californiae
  Glyco_hydro_3
GYMNNQGSCVGNVKPLSRKNFKGICLQDGPAGVRFNDGTSTTWQVGINNAATFNKELLYKIGKDQGAEFKAKGINIALAPSMNILRAPASGRVWENFGEDPYLSGVCGTEMTKGYQDSGCIVSAKHYVANDVEHNREASTSNMDEQTLMEIHVEPFYRTVTEGQAGSVMASYNAVNDVYVVQNKKVLTEILKEKMNFQGFVMSDWWAIHDLEGSFNAGVDLNMPGGKAWGPDYINDSFWGNNISTAIRNGKVSSARLDDAVRRII

SEQ ID NO: 11035 - protein, 273 aa, Neocallimastix californiae
  Glyco_hydro_3
KMTLDEKIGMITGSKNSFGPCVGYIEPIERLDFKGMCLQDGPAGVRNANHSTTFPSGLNIASTFDPEIMKKLGVALGEECRAKGVNALLGPAMNMYRSPAAGRNWEGYGEDTYLASVTSKNVVAGVVSQGVLATVKHFAGNEQETRREHSNSVVDERVLQEVYFPPFKAAIVSGAGGVMAAYNDLNGIPAANNTWLLNKVLKKQMMFHGFVTSDWWGTKDKYEIMNGLDINMPGGTDWGESVTESYWGEELKASVESGEIDVSYVDDACVRIM

SEQ ID NO: 11036 - protein, 258 aa, Neocallimastix californiae
  Glyco_hydro_3
NSFGPCVGYLEPIERLGFKGLCLQDGPAGVRSAKHSTTFPSGLNIASTFDPELMKSLGVALGEEVRAKGVNAILGPAMNMYRSPVGGRNWEGYGEDTYLASVAAKNVVAGITSQGVIATIKHFVGNEQETKRESSNSIIDERVLQEVYFPPFKAAIVSGAGGAMAAYNDLNGIPCANNTWLLNKVLKKQMLFHGFVTSDWWGVKDKYGIMNGLDLNMPGGKEWGPTVKDSYWGEELKEAVESGEIDEMYLDEACIRVM

SEQ ID NO: 11037 - protein, 264 aa, Anaeromyces robustus
  Glyco_hydro_3
MVTGSQNSFGPCVGYLEPIERLGFKGLCLQDGPAGVRSAKHSTTFPSGLNIASTFDPELMKSLGVALGEEVRAKGVNAILGPAMNMYRSPVGGRNWEGYGEDTYLASVAAKNVVAGITSQGVIATIKHFVGNEQETKRESSNSIIDERVLQEVYFPPFKAAIVSGAGGAMAAYNDLNGIPCANNTWLLNKVLKKQMLFHGFVTSDWWGVKDKYGIMNGLDLNMPGGKEWGPTVKDSYWGEELKEAVESGEIDEMYLDEACIRVM

SEQ ID NO: 11038 - protein, 265 aa, Anaeromyces robustus
  Glyco_hydro_3
GYMNMQGTCVGNIKPNSRKNFKGLCLQDGPAGVRFNEGTSTTWQTGINSAATFNKDLLYKIGKDQGAEFYAKGINVALAPSMNILRAPASGRVWENFGEDPYLSGVCGTQITKGMQDSGVIVSAKHYVANDIEHNREASTSNMDEQTLMEIHVEPFYRTVTEGEAGSVMASYNAVNGVYVVQNKKVLTEILKEGMNFQGFIVSDWWAIHDLEGSFNAGVDMNMPGGKAWGPNYINDSFWGSNISNAIRSGKVSSARLDDAVKRII

SEQ ID NO: 11039 - protein, 277 aa, Anaeromyces robustus
  Glyco_hydro_3
EFVSQMTLDEKIGMVTGSQNSFGPCIGYLEPIERLGFKGLCLQDGPAGVRSAKHSTTFPSGLNIASTFDVELMHDLGVALGEECRAKGVNVILGPAMNMYRSPAAGRNWEGYGEDTYLASVASKNVVAGIQSQGVLATAKHFVGNEQEYKRDSSNSIIDERVLQEVYLPPFKAAVVSGAGAFMASYNSINGIPATNHTQLLNKVLKKQFLFHGFVTSDWWGTKDKIEITNGLDMNMPGGKVWGPTVKESYWGEELKDAIENEEIDISYLDESCERIM

SEQ ID NO: 11040 - protein, 260 aa, Piromyces finnis
  Glyco_hydro_3
SENSFGPCVGYIPPIERLGFKGLCLQDGPAGVRSAKHSTTFPSGLNIASTFDQNLMKKLGVALGEECRAKGVNVILGPAMNMYRSPAAGRNWEGYGEDTFLATVASKNVVAGIQSQGVFATAKHFAGNEQEYKRESSNSIIDERVLQEVYFPPFKAAVVSGAGAFMSAYNDLNGIPSANNTYLLNQVLKKQFKFHGFVTSDWWGTKDKYEITNGLDVNMPGGKQWGPTEKESYWGEELKAAIESEEIDISYLDEACERIL

SEQ ID NO: 11041 - protein, 260 aa, Piromyces finnis; identical to SEQ ID NO: 11040
  Glyco_hydro_3

SEQ ID NO: 11042 - protein, 231 aa, Neocallimastix californiae
  Glyco_hydro_3_C
VVLLKNDEDILPISGDKYKKIAIIGDGALPTKQCTDNGCSEGKMSGVVALGWGSGTTNMENISDPLSALTERAEKDGITITSFTDDDSDTDKAAEVAADADLAIVVVVADSGEEYISVEGNKGDRKNLDLWHNGNELVSAVAAANKNTVVVIYSPGVVNLPFIDEVNGLVYAGMPGQEAGHGLADILFNDVAPSGKLPFTWGKKREDYCCDVVTGGKGKTQVPYEEGYYIG

SEQ ID NO: 11043 - protein, 268 aa, Neocallimastix californiae
  Glyco_hydro_3_C
EGHAEVVREAAAASVVLLKNDEDILPISGDKYKKIAIIGDGALPTKQCTDNGCSEGKMSGVVALGWGSGTTNMENISDPLSALTERAEKDGITITSFTDDDSDTDKAAEVAADADLAIVVVVADSGEEYISVEGNKGDRKNLDLWHNGNELVSAVAAANKNTVVVIYSPGVVNLPFIDEVNGLVYAGMPGQEAGHGLADILFNDVAPSGKLPFTWGKKREDYCCDVVTGGKGKTQVPYEEGYYIGYKWFDKKNIEPHFSFGHGLTYAK

SEQ ID NO: 11044 - protein, 265 aa, Neocallimastix californiae
  Glyco_hydro_3_C
MHAETNRQAAIESTVLLKNADSILPLTNKYKKIAIIGKDADKAQKCNDSACTNGNIIQGWGSGTTDFVGVSDPFSAIKNRASKDGISVVSSLSDNSSEGANAARGADVALVFVRASSGEEYIVVDNNKGDRNNLDLWHGGNDLVKSVAAVNKNTIVVIHAPATVNLPFLDNVKAVIHAGMPGAESGNAIASILFGDSNPSGHLPFTWAPREDYCCDVSYPGELPKGGNSKTVYDYKEGLFVGYRWFDKKGIVPTFPFGHGLSYTT

SEQ ID NO: 11045 - protein, 229 aa, Neocallimastix californiae
  Glyco_hydro_3_C
TVLLKNADSILPLTNKYKKIAIIGKDADKAQKCNDSACTNGNIIQGWGSGTTDFVGVSDPFSAIKNRASKDGISVVSSLSDNSSEGANAARGADVALVFVRASSGEEYIVVDNNKGDRNNLDLWHGGNDLVKSVAAVNKNTIVVIHAPATVNLPFLDNVKAVIHAGMPGAESGNAIASILFGDSNPSGHLPFTWAPREDYCCDVSYPGELPKGGNSKTVYDYKEGLFVG

SEQ ID NO: 11046 - protein, 264 aa, Neocallimastix californiae
  Glyco_hydro_3_C
EGHAEIAREAAAASVVLLKNDEEILPISADKYKKIAIIGNGALPTEVCTDNGCKSQISGVVALGWGSGTTNMENISDPLSALTERAEKDGITITSFTEDDSDTEKAAEVAADADLAIVVVVADSGEGYLTVEGNSGDRKDLDLWHNGNDLVAAVAAANKNTVVVIYSPGVVNLPFLDDINGLVYAGMPGQEAGHGLADVLFNDVAPSGKLPFTWGKKREDYCCDIVPGRGNEITQVKYTEGYYIGYKWFDKEKIEPHFSFGHGL

SEQ ID NO: 11047 - protein, 231 aa, Neocallimastix californiae
  Glyco_hydro_3_C
VVLLKNDEEILPISADKYKKIAIIGNGALPTEVCTDNGCKSQISGVVALGWGSGTTNMENISDPLSALTERAEKDGITITSFTEDDSDTEKAAEVAADADLAIVVVVADSGEGYLTVEGNSGDRKDLDLWHNGNDLVAAVAAANKNTVVVIYSPGVVNLPFLDDINGLVYAGMPGQEAGHGLADVLFNDVAPSGKLPFTWGKKREDYCCDIVPGRGNEITQVKYTEGYYIG

SEQ ID NO: 11048 - protein, 264 aa, Neocallimastix californiae
  Glyco_hydro_3_C
EGHAEIVRKAAANSVVILKNDDDVLPISPKKYKKIAIIGDGALPMKLCEDNGCKDKISGVVALGWGSGTTNMENISDPLSAITERAEKDGITITSFTEDDDDTDKAAEVAADADLAIVVVVADSGEGYLTVEGNSGDRKDLDLWHNGNELVAAVAAANKNTVVVIYSPGVVNLPFVDDVKTILYAGMPGQEAGHGLADILFNDVAPTGKLPFTWGKKREDYCCDVVKGKGNSITQVEYSEGYYIGYKWFDKQNIKPLFPFGHGL

SEQ ID NO: 11049 - protein, 251 aa, Neocallimastix californiae
  Glyco_hydro_3_C
VVILKNDDDVLPISPKKYKKIAIIGDGALPMKLCEDNGCKDKISGVVALGWGSGTTNMENISDPLSAITERAEKDGITITSFTEDDDDTDKAAEVAADADLAIVVVVADSGEGYLTVEGNSGDRKDLDLWHNGNELVAAVAAANKNTVVVIYSPGVVNLPFVDDVKTILYAGMPGQEAGHGLADILFNDVAPTGKLPFTWGKKREDYCCDVVKGKGNSITQVEYSEGYYIGYKWFDKQNIKPLFPFGHGLT

SEQ ID NO: 11050 - protein, 251 aa, Anaeromyces robustus; identical to SEQ ID NO: 11049
  Glyco_hydro_3_C

SEQ ID NO: 11051 - protein, 264 aa, Anaeromyces robustus; identical to SEQ ID NO: 11048
  Glyco_hydro_3_C

SEQ ID NO: 11052 - protein, 228 aa, Anaeromyces robustus
  Glyco_hydro_3_C
ILLKNDDNVLPLTKKYRKIAVIGKDADKAESCTDTACTNGNIIQGFGSGTTDFTGITDPYSSIKNRASKEGITVVGSISDSANEGANAARDADVAIVFVRATSGEEYIVVDNNKGDRNNLDLWHGGNDLVKSVAAVNKNTIVVIHAPATVNLPFINNVKAIIHAGMPGAESGNAIASVLFGDHNPSGHLPFTWAKREEYCCDVSYPGELPHGGDSKTTYDYKEGLFVG

SEQ ID NO: 11053 - protein, 265 aa, Anaeromyces robustus
  Glyco_hydro_3_C
MHTETHRQAATESQILLKNDDNVLPLTKKYRKIAVIGKDADKAESCTDTACTNGNIIQGFGSGTTDFTGITDPYSSIKNRASKEGITVVGSISDSANEGANAARDADVAIVFVRATSGEEYIVVDNNKGDRNNLDLWHGGNDLVKSVAAVNKNTIVVIHAPATVNLPFINNVKAIIHAGMPGAESGNAIASVLFGDHNPSGHLPFTWAKREEYCCDVSYPGELPHGGDSKTTYDYKEGLFVGYRWFDKKGTKPIYPFGHGLSYTT

SEQ ID NO: 11054 - protein, 252 aa, Anaeromyces robustus
  Glyco_hydro_3_C
VVLLKNDEDILPISPKKYKKIAIIGDGARPTKPCTDNGCAQGKMSGVVVLGWGSGTTNMENISDPLSALTERAEKDGITITSFTEDDSDTDKAAEVAADADLAIVVVTASSGEEYITVEGNQGDRKNLDLWHNGNELVSAVAAANKNTVVVIYSPGVVNLPFLDDIKGLVYAGMPGQEAGHGLADILFNDVAPSGKLPFTWGKKREDYCCDIVYGNDKIIDIPYSEGFYLGYKWFDKEKIEPHFSFGHGLTY

SEQ ID NO: 11055 - protein, 268 aa, Anaeromyces robustus
  Glyco_hydro_3_C
EGHTELVRKAAAASVVLLKNDEDILPISPKKYKKIAIIGDGARPTKPCTDNGCAQGKMSGVVVLGWGSGTTNMENISDPLSALTERAEKDGITITSFTEDDSDTDKAAEVAADADLAIVVVTASSGEEYITVEGNQGDRKNLDLWHNGNELVSAVAAANKNTVVVIYSPGVVNLPFLDDIKGLVYAGMPGQEAGHGLADILFNDVAPSGKLPFTWGKKREDYCCDIVYGNDKIIDIPYSEGFYLGYKWFDKEKIEPHFSFGHGLTYAK

SEQ ID NO: 11056 - protein, 264 aa, Piromyces finnis
  Glyco_hydro_3_C
EGHTELVREAAAASVVLLKNDKDILPISGKKYGKIAIIGDGALPTKLCTDNGCTQGKMSGVVALGWGSGTTNMEDISDPLSALTERAEKDGITVTSFTDDDEDTEKAAQVASDADLAIVVVTANSGEGYLTVEGNSGDRKNLDLWHNGNELVAAVAAANPNTVVVIYSPGVVNLPFIDDVDGLVYAGMPGKEAGHGLADILFHDVSPSGKLPFTWGKKREDYCCDVVYGNDKIIDVPYTEGFYLGYKWFDKEKIEPHFSFGHGL

SEQ ID NO: 11057 - protein, 251 aa, Piromyces finnis
  Glyco_hydro_3_C
VVLLKNDKDILPISGKKYGKIAIIGDGALPTKLCTDNGCTQGKMSGVVALGWGSGTTNMEDISDPLSALTERAEKDGITVTSFTDDDEDTEKAAQVASDADLAIVVVTANSGEGYLTVEGNSGDRKNLDLWHNGNELVAAVAAANPNTVVVIYSPGVVNLPFIDDVDGLVYAGMPGKEAGHGLADILFHDVSPSGKLPFTWGKKREDYCCDVVYGNDKIIDVPYTEGFYLGYKWFDKEKIEPHFSFGHGLT

SEQ ID NO: 11058 - protein, 264 aa, Piromyces finnis
  Glyco_hydro_3_C
EGHTELVREAAAASVVLLKNDKDILPISGKKYGKIAIIGDGALPTKLCTDNGCTQGKMSGVVALGWGSGTTNMEDISDPLSALTERAEKDGITVTSFTDDDEDTEKAAQVASDADLAIVVVTANSGEGYLTVEGNSGDRKNLDLWHNGNELVAAVAAANPNTVVVIYSPGVVNLPFIDDVDGLVYAGMPGKEAGHGLADILFHDVSPSGKLPFTWGKKREDYCCDIVSNNDVYPKIEYSEGFYLGYKWFDKEKIEPHFSFGHGL

SEQ ID NO: 11059 - protein, 231 aa, Piromyces finnis
  Glyco_hydro_3_C
VVLLKNDKDILPISGKKYGKIAIIGDGALPTKLCTDNGCTQGKMSGVVALGWGSGTTNMEDISDPLSALTERAEKDGITVTSFTDDDEDTEKAAQVASDADLAIVVVTANSGEGYLTVEGNSGDRKNLDLWHNGNELVAAVAAANPNTVVVIYSPGVVNLPFIDDVDGLVYAGMPGKEAGHGLADILFHDVSPSGKLPFTWGKKREDYCCDIVSNNDVYPKIEYSEGFYLG

SEQ ID NO: 11060 - protein, 298 aa, Neocallimastix californiae
  Glyco_hydro_3_N
WSESEDLAKALVEEMTLDEKIGMVTGSQNSFGPCVGYIEPIERLGFKGMCFQDGPAGVRSAKHTTTLPSGLNIASTFDPEIMKKIGVVLGEESRAKGVNAILGPAMNMYRSPAAGRNWEGYGEDTYLASVASKNVVAGIASQGVLATIKHFAGNEQETNRETSNSEIDERVLQEVYFPPFKAGIVSGAGGVMAAYNDLNGIPSANNTWLLNKVLKKQMLFHGFVTSDWWGTKDKYEIMNGLDINMPGGKQWGPTVTESYWGEELKEAVESGEIDVSYVDEACTRILTMLYKYRQFDDY

SEQ ID NO: 11061 - protein, 304 aa, Neocallimastix californiae
  Glyco_hydro_3_N
FATTWEEADQKAKTFMSDLTESEKIDIVTGYMNNQGSCVGNVKPLSRKNFKGICLQDGPAGVRFNDGTSTTWQVGINNAATFNKELLYKIGKDQGAEFKAKGINIALAPSMNILRAPASGRVWENFGEDPYLSGVCGTEMTKGYQDSGCIVSAKHYVANDVEHNREASTSNMDEQTLMEIHVEPFYRTVTEGQAGSVMASYNAVNDVYVVQNKKVLTEILKEKMNFQGFVMSDWWAIHDLEGSFNAGVDLNMPGGKAWGPDYINDSFWGNNISTAIRNGKVSSARLDDAVRRIIRTLYRFDQMS

SEQ ID NO: 11062 - protein, 298 aa, Neocallimastix californiae
  Glyco_hydro_3_N
WSESEDLAKAFVEKMTLDEKIGMITGSKNSFGPCVGYIEPIERLDFKGMCLQDGPAGVRNANHSTTFPSGLNIASTFDPEIMKKLGVALGEECRAKGVNALLGPAMNMYRSPAAGRNWEGYGEDTYLASVTSKNVVAGVVSQGVLATVKHFAGNEQETRREHSNSVVDERVLQEVYFPPFKAAIVSGAGGVMAAYNDLNGIPAANNTWLLNKVLKKQMMFHGFVTSDWWGTKDKYEIMNGLDINMPGGTDWGESVTESYWGEELKASVESGEIDVSYVDDACVRIMTMLYKYRQFDDY

SEQ ID NO: 11063 - protein, 281 aa, Neocallimastix californiae
  Glyco_hydro_3_N
DEKINMVTGSQNSFGPCVGYLEPIERLGFKGLCLQDGPAGVRSAKHSTTFPSGLNIASTFDPELMKSLGVALGEEVRAKGVNAILGPAMNMYRSPVGGRNWEGYGEDTYLASVAAKNVVAGITSQGVIATIKHFVGNEQETKRESSNSIIDERVLQEVYFPPFKAAIVSGAGGAMAAYNDLNGIPCANNTWLLNKVLKKQMLFHGFVTSDWWGVKDKYGIMNGLDLNMPGGKEWGPTVKDSYWGEELKEAVESGEIDEMYLDEACIRVMTMLYKYRQFDDY

SEQ ID NO: 11064 - protein, 298 aa, Anaeromyces robustus
  Glyco_hydro_3_N
WSESEDLAKAFVEEMTLDEKINMVTGSQNSFGPCVGYLEPIERLGFKGLCLQDGPAGVRSAKHSTTFPSGLNIASTFDPELMKSLGVALGEEVRAKGVNAILGPAMNMYRSPVGGRNWEGYGEDTYLASVAAKNVVAGITSQGVIATIKHFVGNEQETKRESSNSIIDERVLQEVYFPPFKAAIVSGAGGAMAAYNDLNGIPCANNTWLLNKVLKKQMLFHGFVTSDWWGVKDKYGIMNGLDLNMPGGKEWGPTVKDSYWGEELKEAVESGEIDEMYLDEACIRVMTMLYKYRQFDDY

SEQ ID NO: 11065 - protein, 303 aa, Anaeromyces robustus
  Glyco_hydro_3_N
SWEEADKKASSFVSDLSEAEKIDIVTGYMNMQGTCVGNIKPNSRKNFKGLCLQDGPAGVRFNEGTSTTWQTGINSAATFNKDLLYKIGKDQGAEFYAKGINVALAPSMNILRAPASGRVWENFGEDPYLSGVCGTQITKGMQDSGVIVSAKHYVANDIEHNREASTSNMDEQTLMEIHVEPFYRTVTEGEAGSVMASYNAVNGVYVVQNKKVLTEILKEGMNFQGFIVSDWWAIHDLEGSFNAGVDMNMPGGKAWGPNYINDSFWGSNISNAIRSGKVSSARLDDAVKRIIRSMYKMNQMGNF

SEQ ID NO: 11066 - protein, 298 aa, Anaeromyces robustus
  Glyco_hydro_3_N
WSESEDLAKEFVSQMTLDEKIGMVTGSQNSFGPCIGYLEPIERLGFKGLCLQDGPAGVRSAKHSTTFPSGLNIASTFDVELMHDLGVALGEECRAKGVNVILGPAMNMYRSPAAGRNWEGYGEDTYLASVASKNVVAGIQSQGVLATAKHFVGNEQEYKRDSSNSIIDERVLQEVYLPPFKAAVVSGAGAFMASYNSINGIPATNHTQLLNKVLKKQFLFHGFVTSDWWGTKDKIEITNGLDMNMPGGKVWGPTVKESYWGEELKDAIENEEIDISYLDESCERIMTMLYKYKQMDDF

SEQ ID NO: 11067 - protein, 298 aa, Piromyces finnis
  Glyco_hydro_3_N
WSESEDLAKAFVEEMTLDEKINMVTGSENSFGPCVGYIPPIERLGFKGLCLQDGPAGVRSAKHSTTFPSGLNIASTFDQNLMKKLGVALGEECRAKGVNVILGPAMNMYRSPAAGRNWEGYGEDTFLATVASKNVVAGIQSQGVFATAKHFAGNEQEYKRESSNSIIDERVLQEVYFPPFKAAVVSGAGAFMSAYNDLNGIPSANNTYLLNQVLKKQFKFHGFVTSDWWGTKDKYEITNGLDVNMPGGKQWGPTEKESYWGEELKAAIESEEIDISYLDEACERILTMMYKYKQMDDF

SEQ ID NO: 11068 - protein, 298 aa, Piromyces finnis; identical to SEQ ID NO: 11067
  Glyco_hydro_3_N

SEQ ID NO: 11069 - protein, 85 aa, Neocallimastix californiae
  Glyco_hydro_39
KSGLTNWYGLEIWNEPDGTWDNANGSFNDMWKKTYDLIRQADPGEKIIGPCFSWYEENKMKNFLQYCKQNNCIPDIISWHELSGI

SEQ ID NO: 11070 - protein, 83 aa, Neocallimastix californiae
  Glyco_hydro_39
KKASGLKNWYGYEIWNEAENTWRDSNGLSFFEMWKETYRVIREMDPDEKIIGPCDGLYSEQRMRPFLEYCLKNDVMPDIMCWH

SEQ ID NO: 11071 - protein, 95 aa, Neocallimastix californiae
  Glyco_hydro_39
KWLELVRQFIRDKKAAGIKNFYGYEIWNEAENTWRDSNGYTFFEMWKETYKVIREMDPDEKIIGPCDGLYSEERMRPFLQYCLDNDVMPDIMCWH

SEQ ID NO: 11072 - protein, 89 aa, Neocallimastix californiae
  Glyco_hydro_39
EIWNEPDVTWKDSNGLSFNQMWKQTYDLLRQIDPNEKIIGPSFSWYEENKMKNFLQFSKQNNCLPDIIAWHELSGIDGVSSHFRSYRNL

SEQ ID NO: 11073 - protein, 91 aa, Neocallimastix californiae
  Glyco_hydro_39
KKSGLTNWYGLEIWNEPDGTWKDSNGSFNQMWKQTYDVIRQADPGEKIIGPCYSWYQENKMKDFLQFCKQNNCLPDIISWHELSGIEGVSS

SEQ ID NO: 11074 - protein, 96 aa, Neocallimastix californiae
  Glyco_hydro_39
  MOD_RES (5)..(5): Any amino acid
FINDXKKSGLTNWYGLEIWNEPDGTWRDSNGSFNQMWKQTYDLIRQADPGEKIIGPCYSWYQENKMKDFLQFCKQNNCIPDIISWHELSGIEGVSS

SEQ ID NO: 11075 - protein, 94 aa, Neocallimastix californiae
  Glyco_hydro_39
WLELVRQFIRDKKASGLTNWYGYEIWNEAENTWRDSNGYTFLEFWKETYKVIREMDPDEKIIGPCDGLYVESRMRPFLEFCKENDVMPDIMCWH

SEQ ID NO: 11076 - protein, 86 aa, Neocallimastix californiae
  Glyco_hydro_39
NWYGYEIWNEPDGTWKDSNGMNFNEFWKQTYQFIRQKDPNEKIIGPCISWYNENNIRSFLQFAKANNCLPDIISWHELSGIDGMSS

SEQ ID NO: 11077 - protein, 96 aa, Anaeromyces robustus
  Glyco_hydro_39
EKWLELVRQFIRDKKASGLTNWYGYEIWNEAENTWRDSNGYTFLEFWKETYKVIREMDPDEKIIGPCDGLYVESRMRPFLEFCKENDVMPDIMCWH

SEQ ID NO: 11078 - protein, 85 aa, Anaeromyces robustus
  Glyco_hydro_39
NWYGYEIWNEPDGTWKDSNGMNFNEFWKQTYQFIRQKDPNEKIIGPCISWYNENNIRSFLQFAKANNCLPDIISWHELSGIDGMS

SEQ ID NO: 11079 - protein, 80 aa, Anaeromyces robustus
  Glyco_hydro_39
GLTNWYGYEIWNEAENTWRDSNGYNFLEFWKETYKVIREMDPDEKIIGPCDGLYSEERMRPFLQFCKENNVLPDIMCWHE

SEQ ID NO: 11080 - protein, 83 aa, Anaeromyces robustus
  Glyco_hydro_39
SGLTNWYGYEIWNEPDGTWKDPNGLNFNEFWKQTYQYLRQIDPNEKIIGPALSWYNEDRIRSFLQYAKANNCLPDIICWHELS

SEQ ID NO: 11081 - protein, 97 aa, Piromyces finnis
  Glyco_hydro_39
FIADKKKSGLTNWYGLEIWNEPDGTWKDSNGLNFNEFWKQTYQVIRQNDPNEKIIGPCDSWYNESRMRSFLQFCKTNNVIPDIMCWHELSGIENVSN

SEQ ID NO: 11082 - protein, 278 aa, Neocallimastix californiae
  Glyco_hydro_43
HNPIITQKYSADPGVMVYNGRVYVYATNDGDAGTRYNSENTYGQINTINVMSSADLVNWMDHGSIPAAGGGGAARWASNSWAPCAAWKKINGKDKFFLYFANNASGIGVLTADSPTGPFKDPIGRALISRQTPNSNVEWLFDPAVIVDTDGTGYLYYGGGVPQGQNANPRTIRVAKLGNDMTSIQGTPQMIDAPWVFEDSGINKIGNTYVYSYCTNWAGGPYGNARIAYMTSNNPMSGFKYQGTCFNNPGDFFQTTGNNHHTIIEFKNKYYIFYHAEW

SEQ ID NO: 11083 - protein, 270 aa, Neocallimastix californiae
  Glyco_hydro_43
NNPIIWADVPDPDIIRVDDTYYMVSTTMYFTPGAPIMKSKDLVSWEIVTYTYDILANGDVQTLSRGQHDYSHGSWAASLRYNKGIFYVFFGSYGTNKSYIFKTKDIESGKWERFEINGMYHDASILFDDDGRNYLVYGGGGEIKIKEFNAEMTNFKWGGLDKTLFRTNLSGLAGEGSHVMKINGYYYVFIIAWPSGKGRIEICYRSKDLTGYYENKTVLDSGLGSYGSGVAQGGIVDTPDGKKWFGLLFQDHGAVGRIPVLVPVNWQNGW

SEQ ID NO: 11084 - protein, 280 aa, Neocallimastix californiae
  Glyco_hydro_43
NPINTIKYSADPGVMVYDGRVYVYGTNDGYAGELGRNPQDNTYGQINTINVMSSDDLVNWIDHGTIPAAGRNGAAKWAGNSWAPCATHKKINGKEKFFLYFANSGNGIGVLTSDSPTGPFVDPIGHALISRSTPNCSNIVWLFDPAVFVDDDGTGYLYFGGGVPDNQSSNPKTVRAVKLGNDMTSLAGNPVTIDAPWVFEDSGINKSGDTYFYSYCTNWNGGPYGNAKIAYMTSKNPLGPFTMQGTVLNNPGDFFGTTGNNHHTIIEFKDQWYIFYHAEW

SEQ ID NO: 11085 - protein, 277 aa, Neocallimastix californiae
  Glyco_hydro_43
NPTITHRYSADPGVMVYNGRVYVYATNDGDAATRYNSENTYAQINTINVMSSADLVNWMDHGSINATGGGGAAKWAKNSWAPAAAWKKINGKDKFFLYFADNASGIGVLTADSPTGPFRDPIGRALISRQTPNSNVEWLFDPAVFVDSDGTGYLYYGGGVPKGREANPNTIRVAKLGGDMTSISGTPANIDAPWVFEDSGINKIGNTYVYSYCTNWNGGPYGNARIAYMTSNNPMGKFTFQGTCFNNPGDFFQTTGNNHHTIIEFKNKYYIFYHAEW

SEQ ID NO: 11086 - protein, 341 aa, Neocallimastix californiae
  Glyco_hydro_43
SVHDPSIVKSGNKYYIFGSHMDAAYTTDLWKFTKLYTGVDENNKMFTNLFSKSNYDAFKFVGKNSDGGYSVWAADVMYNKKMKKWVQYFCTSSTYIKSSLCYGIADKVEGPYTYKSCFLHSGMDSGSVGKTNLRAITGTEDKNRYYPNNRYNNKVYPNAIDPNAFYDFNGRLWLAYGSWSGGIYILELDESTGLPKHNISNGNNVDKYYGKKLAGGGHQSIEGPYILPYKAAGYYYLFVSYGTLTSNGGYQIRLFRSKNPDGPYTDVAGKEFMSGTNSNFGVKIMGNYGIPGREKAYMAPGHNSVLIDDDGKILLCYHTRFNDGQEYHEPRVHQMFLNKEG

SEQ ID NO: 11087 - protein, 284 aa, Neocallimastix californiae
  Glyco_hydro_43
NPIIKDMYTADPAPMVYGDTLYLYTSHDETELKNNFYTMENWYVFSTKDMVNWTNHGQILSLDDIEWADERAWAPQTVEKNGKFYFYFPAHKIDGGMAIGVAVADSPIGPFKEIGHPIVYEDDWNDFDPTVFIDDDGKAYLYFGNPELRYVVLNDDMISYDEEIGVVKVPMTEESFGKGSHDTGTSYAEGPYFYKRNGLYYLVYAAFREGSQTESLAYATSEKPTGPWKYGGVLMTEGTAFTNHPGIADFNGKSYFFYHTDELPGGGDFHRSVCVTEFEYKEDG

SEQ ID NO: 11088 - protein, 282 aa, Neocallimastix californiae
  Glyco_hydro_43
NPIIKDMYTADPAPMVYGDTLYLYTTHDEDVLKNNFYTMENWYVFSTKDMVNWTNHGQILSLDDIEWADERAWAPQTVEKDGKFYFYFPAHKIDGGMAIGVAVADSPIGPFKEIGHPIVYEDDWNDFDPTVFIDDDGKAYLYFGNPELRYVVLNDDMISYDEEIGVVKVPMTAESFGKNGDRTTYGEGPYFYKRNGLYYMVFAAFREGAFTESLGYATSEKPTGPWKYGGVLMTEGTAFTNHPGIADFNGKSYFFYHTDELPGGGDFHRSVCVTEFEYKEDG

SEQ ID NO: 11089 - protein, 219 aa, Neocallimastix californiae
  Glyco_hydro_43
NPIIKDMYTADPAPMVYGDTLYLYTTHDEDVLKNNFYTMENWYVFSTKDMVNWTNHGQILSLDDIEWADERAWAPQTVEKDGKFYFYFPAHKIDGGMAIGVAVADSPIGPFKEIGHPIVYEDDWNDFDPTVFIDDDGKAYLYFGNPELRYVVLNDDMISYDEEIGVVKVPMTEESFGKGSHDTGTSYAEGPYFYKRNGLYYMVYAAFREGSHTESLAYS

SEQ ID NO: 11090 - protein, 284 aa, Neocallimastix californiae
  Glyco_hydro_43
NPIIKDMYTADPAPMVYGDTLYLYTTHDEDVLKNNFYTMENWYVFSTKDMVNWTNHGQILSLDDIEWADERAWAPQTVEKDGKFYFYFPAHKIDGGMAIGVAVADSPIGPFKEIGHPIVYEDDWNDFDPTVFIDDDGKAYLYFGNPELRYVVLNDDMISYDEEIGVVKVPMTEESFGKGGHDTGTSYAEGPYFYKRNGLYYMVYAAFREGSHTESLAYSTSEKPTGPWKYGGVLMTEGTAFTNHPGIADFNGKSYFFYHTDELPGGGDFHRSVCVTEFEYKEDG

SEQ ID NO: 11091 - protein, 303 aa, Neocallimastix californiae
  Glyco_hydro_43
NPLFTHRYSADPGVMVYNNRVYVYATNDGDVATKFTDDNTYSHINSLNVMSSEDLVNWTDHGSILVAGNNGAAKWAGNSWAPCATYKKINGKDKFFLYFANNANGIGVLTSDSPTGPFKDPIGKALITRQTPNCGDVAWLFDPAVLVDTDGTGYLYFGGGVPDGKDAAPKTIRVVKLGADMVSLAGTPQLIDTPYVFEDSGINKIGNTYYYSYCTNWSAGEPYGQARIVYMTSSNPMGPFTYQGVCLNNPGEDFQTYGNNHHTIIEFKNKYYIFYHTEWLNKQVFGTQKGYRTSFVNEITFSN

SEQ ID NO: 11092 - protein, 269 aa, Neocallimastix californiae
  Glyco_hydro_43
RNPIIWADVPDDDIIRVDDTYYMVSTTMFFSPGAPIMKSKDLFSWEICNYVYDILADGDVQTLKNGKHDYSHGQWAASLRYHEGTFYVFFGSYGTNKSYIFKTKDIEKGTWTRNEIFGMYHDASILFDDDGRKYLVYGGSGEIKIKEFNNEMTDFKRGGADKVLFRTGLSGLAGEGSHIQKIGKYYYIFIIAWPNGKGRIEICYRSRDLLGNYENKIVLDSGLGSYGSGVAQGGIVDTPDGKWYGLLFQDHGSVGRIPVLVPVNWQNDW

SEQ ID NO: 11093 - protein, 136 aa, Neocallimastix californiae
  Glyco_hydro_43
VGTGCLRDPYIFKGEDGFYYLLATDMKSSLGWNSNRNLLSAKSMDLIHWTGITIIEIANKYPLMKGADRAWAPQAIYDREKGSYMIYYAARVPGRDNRTIMYYAYSKDMKRLETDPQVLFAPANGNDAIDSDIIFQ

SEQ ID NO: 11094 - protein, 278 aa, Neocallimastix californiae
  Glyco_hydro_43
KNPLITHRYSADPGVMVYNGRVYVYATNDGDVANRNVGENKYDQINTINCMSSDDLINWMDHGPIPAAGGNGAAKWAKNSWAPTAAWKKINGKDKFFLYFANNASGIGVLTADSPTGPFKDPIGRALISRQTPNSNVEWLFDPAVFVDTDGTGYLYYGGGVPQGQNANPRTIRVAKLGNDMTSIQGTPQMIDAPWVFEDSGINKIGNTYVYSYCTNWAGGPYGNARIAYMTSNNPMSGFKYQGTCFNNPGDFFQTTGNNHHTIIEFKNKYYIFYHAEW

SEQ ID NO: 11095 - protein, 136 aa, Neocallimastix californiae
  Glyco_hydro_43
VGTGCIRDPFILKGQDGYYYMLATDMRSYSGWDSNRNILSAKSKDLIHWNDVTSIEIANKYPLTQGADRAWAPQAIYDHEKNSYMIYFAVRVPNRGNKTIMYYAYSKDMKKLDTAPALLFQPRNGNEAIDSDIIFQ

SEQ ID NO: 11096 - protein, 280 aa, Neocallimastix californiae
  Glyco_hydro_43
NPINVLKYSADPGVMVYDGRVYVYATNDGIGENIGNNPRDNDYSHINTINVMSSSDMVNWVDHGTIPAAGNSGAAKWAGNSWAPCAAHKKINGKEKFFLYFANSGNGIGVLTSDSPTGPFVDPIGGPLVSRSTLNCNSIVWLFDPAVMVDDDGTGYLYFGGGVPENAKSNPKTVRAVKLGNDMISLAGTPQTIDAPWVFEDSGINKAGNTYFYSYCTNWDNGPYGNAKIAYMTSSSPLGPFQYQGTVLNNPGDFFGTVGNNHHTIINFKNKWYIFYHAEW

SEQ ID NO: 11097 - protein, 122 aa, Neocallimastix californiae
  Glyco_hydro_43
SVHDPSVVKYGNKYYIFGSHMDTAYTTDLWKFTKLYTGVNDNNKMFTNLFSKSNYGAFNFVGKNSDGGYSVWAPDIIYNNRMKKWVQYFCTSSTYIKSSICYALADNVEGPYTYKNCFIFSG

SEQ ID NO: 11098 - protein, 185 aa, Neocallimastix californiae
  Glyco_hydro_43
PNAIDPNAFYDFKGKLWLVYGSWSGGIYILELDESTGLPKHNISNGNNTDRYYGKKLAGGNHQSIEGPFILPHKAVGYYYLFVSYGSLTSNGGYQIRMFRSKNPDGPYTDVAGKEFMSGNNSSFGVKVMGNYNIPGREQAYMAPGHNSALLDDDGKVLIFYHTRFNDGQEYHEPRIHQMFLNKEG

SEQ ID NO: 11099 - protein, 274 aa, Neocallimastix californiae
  Glyco_hydro_43
SNMYTADPAPMVYGDTLYLFTSHDENNIQNNFYTMLNWHLFSTKDMINWTSHGQVFSLDDISWADDRAWAPQAIARNDKFYLYVPVHKRNGGMAIAVGVSDKPTGPYKDIGHPLVDEGDWNDIDPTVFIDDDGQAYLYFGNPELRYVLLNEDMVSYNKSVGVKKIPMTADSFGRGEGSRTTYGEGPFFYKRKDMYYMAYAAFRPNKGSEHLAYSYSNSPTGPWKYGGVLMTEDGGTYTNHPGIARFKGRSYLFYHTGQLPGGGAYHRSVCFTEF

SEQ ID NO: 11100 - protein, 280 aa, Anaeromyces robustus; identical to SEQ ID NO: 11096
  Glyco_hydro_43

SEQ ID NO: 11101 - protein, 280 aa, Anaeromyces robustus
  Glyco_hydro_43
SNMYTADPAPMVYGDTLYLFTSHDENNIQNNFYTMLNWHLFSTKDMINWTSHGQVFSLDDISWADDRAWAPQAIARNDKFYLYVPVHKRNGGMAIAVGVSDKPTGPYKDIGHPLVDEGDWNDIDPTVFIDDDGQAYLYFGNPELRYVLLNEDMVSYNKSVGVKKIPMTADSFGRGEGSRTTYGEGPFFYKRKDMYYMAYAAFRPNKGSEHLAYSYSNSPTGPWKYGGVLMTEDGGTYTNHPGIARFKGRSYLFYHTGQLPGGGAYHRSVCFTEFKYNKDG

SEQ ID NO: 11102 - protein, 268 aa, Anaeromyces robustus
  Glyco_hydro_43
NPIIWADVPDPDIIRVDDTYYMVSTTMFFNPGAPIMKSKDLVSWKICNYVYDKLADGDVQNLARGQHDYSHGQWATSLRYHKGTFYVFFGSYGTNKSYIFKTKDIENGPWTRTELGGMYHDASMIFDDDGRNYLVYGAGGEIRIKEFNSEMTDFKRGGADKILFRTNLSGLAGEGSHVQKINNYYYIFIIAWPNGKGRIEICYRSKDILGNYESRTVLDSGVGSYGSGVAQGGIVDTPEGKWYGLLFQDHGSVGRIPVLVPVNWQSDW

SEQ ID NO: 11103 - protein, 301 aa, Anaeromyces robustus
  Glyco_hydro_43
HNPVVSHRYSADPGAMVYDGRVYIYGSNDGNVAERQGKTNDYSQIKTINLLSSSDLVNWMDHGPIPATGQSGIAKFASNSWAPAACHKKINGKEKFFVYFANNASGICVLESDSPTGPFKDPLGKPLITRQTPNSNVEWLFDPACLVDDDGTGYLYFGGGVPNGQAANPRTVRVVKLGADMKSLAGTPQTIDAPWVFEDSGINKVGNTYYYNYCTNFNGGPYGNGRIAYMSSNSPMGPFSYKGTCFNNQGDFLQDGGGNNHHTIIEFKNKFYMVYHAQWLDMKVKGKSNGYRTTHIDELPM

SEQ ID NO: 11104 - protein, 341 aa, Anaeromyces robustus
  Glyco_hydro_43
SVHDPSVIKNGNKYYIFGSHMDTAYTTDLWKFTKLYTGVNENNRMFTNLFSKSNYGAFNFVGKNSEGGYSVWAPDVMYNKKMRKWVQYFCTSSTYIKSSICYALADNVEGPYTYQSCFIFSGMDSGSVGKTNLRAVTGTEDGNRYYPGNKYNNRVYPNAIDPNVFYDFNGRLWLAYGSWSGGIYILELDESTGLPKHNISNGTNIDKYYGKKLAGGGHQSIEGPYILPYKAAGYYYLFVSYGTLTSNGGYQIRLFRSKNPDGPYTDPAGNEFMGGTNSNFGLKLMGNYNIPGRSQAYMAPGHNSAMIDDNGKVLMFYHTRFNDGQEYHEPRVHQLFLNKEG

SEQ ID NO: 11105 - protein, 132 aa, Anaeromyces robustus
  Glyco_hydro_43
CLRDPYIFKGEDGLYYLLATDMKSALGWNSNRNLLSAKSKDLINWYDTTSIEIANKYPLMQGADRAWAPQAIYDPEKKSYMIYYAARVPGRDNRTIMYYAYSKDMKKLDTAPALLFAPSNGNDAIDSDIIFQ

SEQ ID NO: 11106 - protein, 277 aa, Anaeromyces robustus
  Glyco_hydro_43
NPLITHRYSADPGVMIYNDRVYVYSTNDGDVDLNNKNVNGNTYDHIKSLNVMSSSDLVNWQDHGSINVAGGAAKWAQYSWAPCATYKKINGKDKFFLYFANNANGVGVLTSDSPTGPFTDPIGKALISRDTPNCGDVTWLFDPAVLVDDDGTGYLYFGGGVPNGMDANPKTIRVVKLGSDMISLAGQPQLIDAPYVFEDSGINKIGNTYFYSYCTNWTGGQYGGANIAFMTSNSPMGPFKAGSSCFKNPGEFLGNYGNNHHTIIQFKNKWYIFYHTE

SEQ ID NO: 11107 - protein, 154 aa, Anaeromyces robustus
  Glyco_hydro_43
VGTGCLRDPFILKGEDGTYFLLATDMRSYSGWDSNRNILTARSTDLIHWTNVSLIEVCNKYPIFQRGDRAWAPQAIYDPEKQAYMIYFAVRVPSNGNKTIMYYAHSKDMTRFDTTPQLLFAPKNGNEAIDADIIYQGGRYYMYYKDETRKTINL

SEQ ID NO: 11108 - protein, 283 aa, Anaeromyces robustus
  Glyco_hydro_43
KNPLITHRYSADPGVMVYNDRVYVYATNDGDVANRNVGDNTYEQINTINCMSSDDLVNWTDHGPIAAAGQGGAAKWAKNSWAPTAAHKTINGKEKFFLYFANSGAGIGVLVSDSPTGPFTDPIGKALITPQTPNCASVTWLFDPAVLVDTDGTGYLYFGGGVPQGQDANPKTIRVVKLGPDMTSLAGNPETIDAPWVFEDSGINKIGNTYVYSYCTNWANGPHGNARIGYMTSNSPMGPFTFQGTCFNNPGDFFQTTGNNHHTIIEFKGKYYIFYHTEWLNKQ

SEQ ID NO: 11109 - protein, 297 aa, Anaeromyces robustus
  Glyco_hydro_43
KNPIITHRYSADPGVMVYNGRVYVYATNDGDVANRNVGDNTYEQINTINCMSSDDLVNWTDHGPIKAAGQGGAAKWAKNSWAPHAAHKTINGKEKFFLYFANSGAGIGVLVSDSPTGPFTDPIGKALVTPQTPNCSSVTWLFDPAVLVDSDGTGYLYFGGGVPQGQNSNPKTIRVVKLGPDMTSLAGNPQTIDAPWVFEDSGINKVGNTYVYSYCTNWANGPYGNARIAYMTSNSPMGPFQYQGTCFNNPGDFFQTTGNNHHTIIEFKDKYYIFYHTEWLNKQVLGSQKGYRTTHVN

SEQ ID NO: 11110 - protein, 280 aa, Anaeromyces robustus
  Glyco_hydro_43
SMYTADPAPLIVDDTLYIYTTHDEDVLINNFYTMRDWYVFSTKDMVNWTNHGPILSLDDITWADDRAWAPQTIERNGKYYFYYPAHKIDGGMAVGVAIGDSPVGPFKDIGEPLVYQDDWIDFDPTVFIDDDGQAYLYFGNPQLRYVLLNEDMVSYNEEVGIVDVELTVEGFGEGNNNPTSYDEGPFFYKRNGIYYMLFSGFRKGYESEYIGYATSTSPTGPWKYGGILMEEHEDKTFTNHSSIVEFNGHTYFFFHTGDLPDGGDFHRSVAYIEFEYNEDG

SEQ ID NO: 11111 - protein, 280 aa, Anaeromyces robustus; identical to SEQ ID NO: 11110
  Glyco_hydro_43

SEQ ID NO: 11112 - protein, 145 aa, Piromyces finnis
  Glyco_hydro_43
VWLFDPAVFVDDDGTGYLYFGGGVPEGQASDPRTTRAAKLGDDMISIDGIPQTIEAPWVFEDSGINKVGDSYVYSYCVNWDNGPYGNAKIAYMTSENPLGPFTFQGTLLNNPGDFFGTTGNNHHTIIEFKGKWYIFYHAEWLNVQ

SEQ ID NO: 11113 - protein, 193 aa, Piromyces finnis
  Glyco_hydro_43
VGTGCLRDPYIFKGKDGYYYLLATDMKSALGWNSNRNILSAKSSDLIHWTNESSIEIANKYPLMQGADRAWAPQAIYDPEKDSYMIYFAARVPGRDNRTIMYYAYSKNMQKLDTAPQLLFAPSNGNDAIDSDIIFQNNKYYMYYKNETNKRIYLATASHASGPYSEIKQVSEGNIGVEGPNIYQLQGTNKWLM

SEQ ID NO: 11114 - protein, 136 aa, Piromyces finnis
  Glyco_hydro_43
VGTGCIRDPFILKGQDDYYYLLATDMKSYLGWDSNRNILTAKSKDLIHWNDVTSIEIANKYPLTQAADRAWAPQAIYDPEKKSYMIYFAVRTPGNGNKTIMYYAYSKDMKKLDTAPALLFAPRNGNEAIDSDIIFQ

SEQ ID NO: 11115 - protein, 282 aa, Piromyces finnis
  Glyco_hydro_43
ITNMYTADPAPMVYGDTLYLYTTHDENNLKNNFYTMLDWYVFSTKDMVNWTNHGKIFSLDDISWADDRAWAPQAIERNGKFYLYCPVHKTNGGMAIAVGVSDKPTGPFKDIGHPLVDEGDWNDIDPTVFIDDDGQAYLYFGNPELRYVLLNEDMISINKSVGVKKIKMTEEAFGKGSHDTGTTYGEGPYFYKRNGIYYMAYAAFRQGKNIESLGYSTSTSPTGPWKYGGPLMTEEGGAFTVHPGIVDFKGHSYLFYHTGELPGGGDFHRSVGFAEFRYNKDG

SEQ ID NO: 11116 - protein, 341 aa, Piromyces finnis
  Glyco_hydro_43
SVHDPSVVKNGNKYYIFGSHMDTAFTTDLWKFTKLYTGVNENNKMFSNLFSKSNYGAFNFVGKNSEGGFSVWAPDVMFNKRMNKWVQYFCTSSTYIKSSICYALADNIEGPYTYKDCFIFSGMDSGSVGKTNIRAITGSDNGNRYFPGNKYNNKVYPNAIDPNAFYDFNGKLWLAYGSWSGGIYILELDESTGLPKHNINNGNNIDKYYGKKLAGGNHQSIEGPYILPHKAAGYYYLFVSYGTLTSNGGYQIRLFRSKNPDGPYTDAAGREFMSGTNSNFGVKIMGNYNIPGRSQAYMAPGHNSALIDDNGKILLFYHTRFNDGQEYHEPRIHQMFLNKEG

SEQ ID NO: 11117 - protein, 279 aa, Piromyces finnis
  Glyco_hydro_43
NPVNTLKFSADPGVMVYDGRVYVYATDDGHVDQLGNNPETNTYGQINTINVMSSDDLVNWIDHGSIPAAGRNGAAKWANNSWAPTAAHKKINGKEKFFLYFANSGNGVGVLSSDSPTGPFVDPIGGPLVSFDVPNCGDIVWLFDPAVFVDDDGKGYLYFGGGVPTGQDANPKTIRVVQLGDDMTSIVGTPQLIDAPYVFEDSGINKIGNTYIYSYCTNWANGPYGSANIAYMTSSSPMGPFKMQKSCFKNPGEYFGNYGNNHHTMIEFKGKNYIFYHTE

SEQ ID NO: 11118 - protein, 283 aa, Piromyces finnis
  Glyco_hydro_43
NPLMTYRYGADPGVFVYDGRVYVFTTNDGDVDLTNKNIAENTYSHIQTLNLISSADLVNWTDHGSISVAGNNGAAKWAQYSWAPCATYKKINGKDKFFLYFANNANGIGVLTSDSPTGPWKDPIGKALITRQTPNCNVEWLFDPAVFVDDDGTGYLYFGGGVPEGQASDPRTTRAAKLGDDMISIDGIPQTIEAPWVFEDSGINKVGDSYVYSYCVNWDNGPYGNAKIAYMTSENPLGPFTFQGTLLNNPGDFFGTTGNNHHTIIEFKGKWYIFYHAEWLNVQ

SEQ ID NO: 11119 - protein, 281 aa, Piromyces finnis
  Glyco_hydro_43
KNPLITHRYSADPGVMVYDGRVYVYGTNDGHADELGDNPEDNTYQQINTINVMSSDDLINWVDHGSIPAAGENGAAKWAVNSWAPAAAHKKINGKEKFFLYFANSGNGVGVLSSDSPTGPFVDPIGGPLVSFDVPNCGDIVWLFDPAVFVDDDGKGYLYFGGGVPTGQDANPKTIRVVQLGDDMTSIVGTPQLIDAPYVFEDSGINKIGNTYIYSYCTNWANGPYGSANIAYMTSSSPMGPFKMQKSCFKNPGEYFGNYGNNHHTMIEFKGKNYIFYHTEW

SEQ ID NO: 11120 - protein, 284 aa, Piromyces finnis
  Glyco_hydro_43
NPVNTLKFSADPGVMVYDGRVYVYATDDGHVDQLGNNPETNTYGQINTINVMSSDDLVNWIDHGSIPAAGRNGAAKWANNSWAPTAAHKKINGKEKFFLYFANSGNGVGVLSSDSPTGPFVDPIGGPLVSFDVPNCGDIVWLFDPAVFVDDDGTGYLYFGGGVPEGQASDPRTTRAAKLGDDMISIDGIPQTIEAPWVFEDSGINKVGDSYVYSYCVNWDNGPYGNAKIAYMTSENPLGPFTFQGTLLNNPGDFFGTTGNNHHTIIEFKGKWYIFYHAEWLNVQ

SEQ ID NO: 11121 - protein, 279 aa, Piromyces finnis; identical to SEQ ID NO: 11117
  Glyco_hydro_43

SEQ ID NO: 11122 - protein, 283 aa, Piromyces finnis; identical to SEQ ID NO: 11118
  Glyco_hydro_43

SEQ ID NO: 11123 - protein, 285 aa, Piromyces finnis
  Glyco_hydro_43
KNPLITHRYSADPGVMVYDGRVYVYGTNDGHADELGDNPEDNTYQQINTINVMSSDDLINWVDHGSIPAAGENGAAKWAVNSWAPAAAHKKINGKEKFFLYFANSGNGIGVLSSDSPTGPFTDPLGGPIISRSLPNCNNIVWLFDPAVFVDDDGTGYIYFGGGVPEGQSSNPKTVRAAKLSDDMIRISGTPQTIDAPWVFEDSGIHKYGDTYFYSYCTNWDNGPYGNAKIAYMTSKSPLGPFTYQGTLFNNPGEFFGTTGNNHHTIIEFKGKWYIFYHAEWLNVQ

SEQ ID NO: 11124 - protein, 278 aa, Piromyces finnis
  Glyco_hydro_43
NPLMTYRYGADPGVFVYDGRVYVFTTNDGDVDLTNKNIAENTYSHIQTLNLISSADLVNWTDHGSISVAGNNGAAKWAQYSWAPCATYKKINGKDKFFLYFANNANGIGVLTSDSPTGPWKDPIGKALITRQTPNCNVEWLFDPAVFVDDDGKGYLYFGGGVPTGQDANPKTIRVVQLGDDMTSIVGTPQLIDAPYVFEDSGINKIGNTYIYSYCTNWANGPYGSANIAYMTSSSPMGPFKMQKSCFKNPGEYFGNYGNNHHTMIEFKGKNYIFYHTE

SEQ ID NO: 11125 - protein, 280 aa, Piromyces finnis
  Glyco_hydro_43
NPVNTLKFSADPGVMVYDGRVYVYATDDGHVDQLGNNPETNTYGQINTINVMSSDDLVNWIDHGSIPAAGRNGAAKWANNSWAPTAAHKKINGKEKFFLYFANSGNGVGVLSSDSPTGPFVDPIGGPLVSFDVPNCGDIVWLFDPAVFVDDDGKGYLYFGGGVPTGQDANPKTIRVVQLGDDMTSIVGTPQLIDAPYVFEDSGINKIGNTYIYSYCTNWDNGPYGNARIAYMTSNSPMGPFSYKGTCFNNPGDFFQTTGNNHHTIIEFKNKYYIFYHTEW

SEQ ID NO: 11126 - protein, 284 aa, Piromyces finnis; identical to SEQ ID NO: 11120
  Glyco_hydro_43

SEQ ID NO: 11127 - protein, 284 aa, Piromyces finnis
  Glyco_hydro_43
NPLSTLKYSADPGVMVYDGRVYVYGTNDGHADELGDNPEDNTYQQINTINVMSSDDLINWVDHGSIPAAGENGAAKWAVNSWAPAAAHKKINGKEKFFLYFANSGNGVGVLSSDSPTGPFVDPIGGPLVSFDVPNCGDIVWLFDPAVFVDDDGTGYLYFGGGVPEGQASDPRTTRAAKLGDDMISIDGIPQTIEAPWVFEDSGINKVGDSYVYSYCVNWDNGPYGNAKIAYMTSENPLGPFTFQGTLLNNPGDFFGTTGNNHHTIIEFKGKWYIFYHAEWLNVQ

SEQ ID NO: 11128 - protein, 285 aa, Piromyces finnis; identical to SEQ ID NO: 11123
  Glyco_hydro_43

SEQ ID NO: 11129 - protein, 280 aa, Piromyces finnis; identical to SEQ ID NO: 11125
  Glyco_hydro_43

SEQ ID NO: 11130 - protein, 198 aa, Neocallimastix californiae
  Glyco_hydro_45
GKTTRYWDCCLASCSWQENTKKAGASGVVRSCSKDGMTPFTDLSNLWRVKSGCEGGSVYMCNDQQPWAVNDNVAYGFVASHEKCCTCQRLKFTSGPVAGKQMIVQTTNTGGDLSSNHFDIQMPGGGFGIFDGCTSQFGGGHNWGERYGGIKSASECANLPSVLKQGCEWRFNWFKNADNPNVVFERVQCPKELTDITG

SEQ ID NO: 11131 - protein, 200 aa, Neocallimastix californiae
  Glyco_hydro_45
KGTTTRYWDCCKPSCAWPGKFEYKTNIKLCAADGSALLDNNLISGCEGGPTYTCEDQTPWAVDDVTAYGYAAANIPGLTEADWCCTCYALTFTSFPIKGKQMIVQITNTGGDLGEGHFDLQIPGGGFGLFNGCSPRYPDIPDEDWGDRNGGVTSREGCYKLPVSMQEGCLFKFDWFRGADNPEVTYVKVDCPQELIDVSG

SEQ ID NO: 11132 - protein, 200 aa, Neocallimastix californiae
  Glyco_hydro_45
EGTTTRYWDCCKPSCSWPDKAPVSAPVRQCKADGFTALTNYNAKSGCEGGESYMCSDQRPWAVSEVLSYGYAAASIKGLTEKEWCCRCYALTFTSGPVKGKQMVVQVTNTGGDLGDNHFDIQIPGGGFGIFNGCSAQFNTPDEVWGTRYGGVASRDDCEGLPEAIKESCYWRFDWFLNADNPTMVFDEVECPVELTRNTD

SEQ ID NO: 11133 - protein, 203 aa, Neocallimastix californiae
  Glyco_hydro_45
GVTTRYYDCCKPSCSWPGKADVFHPVRHCTVDGTTLIEDQEAPSACQKDVVGTAHMCENQQPWAVSDSLSYGFAAAALPGGESVSCCKCYALTFIDPPIRGKQLVVQVTNTGADVGSNQFDLQIPGGGVGIFDACTNMYGLPAGSNGWGKQYGGITGIEDCETFPESLKEGCKWRFNWLLGADNPRMKFAEVDCPKELTDITG

SEQ ID NO: 11134 - protein, 204 aa, Neocallimastix californiae
  Glyco_hydro_45
KGVTTRYYDCCKPSCSWPGKADVTQPVRQCAVDGKTLLTDFSAPSACQTDVEGISHMCEDQQPWAVSDVLSYGFAAAALPGGESKSCCACYAITFSEPPIRGKQIVVQVTNTGSDVGSNQFDLQIPGGGVGIFDACTNMYGLPAGSNGWGKKYGGISSIEDCDSFPEALQAGCRWRFEFLLGADNPKMTFVEVECPKVLTDITG

SEQ ID NO: 11135 - protein, 199 aa, Neocallimastix californiae
  Glyco_hydro_45
GKTTRYWDCCKPSCAWNYKANVSKEVNSCYRDGSIVSIPWITSGCGGGDAFMCNDQQPWAINDKLSYGFAAANISGSDEEHWCCACFKITFTSTSIAGKEMIVQVTNTGGDLGENHFDIQMPGGGLGLFDGCSPQFGVDASKWGERYGGLTSEAGCDNLPKVLQPGCHWRFGWFENADNPAMEFEEVECPAELIKITGC

SEQ ID NO: 11136 - protein, 203 aa, Neocallimastix californiae
  Glyco_hydro_45
GVTTRYYDCCKPSCSWPGKADVFHPVRHCKVDGTTLIEDQEAPSACQKDVVGTAHMCENQQPWAVSDSLSYGFAAAALPGGESVSCCKCYALTFTDPPIRGKQLVVQVTNTGSDVGSNQFDLQIPGGGVGIFDACTNMYGLPAGSNGWGKQYGGITGIEDCESFPESLKEGCKWRFNWLLGADNPKMKFAEVECPKVLTDITG

SEQ ID NO: 11137 - protein, 201 aa, Neocallimastix californiae
  Glyco_hydro_45
GKTTRYWDCCLASCSWSENTNASHPVNACQKDGKTVFNKFDWTIGSACSGGQGYMCTDNQPWAINDNVSYGFVAAGFSSGSQKDWCCTCQRLEFTSGPVAGKQMVVQITNTGGDLSNNHFDIQMPGGGVGIFNGCQSQFGAPSDGWGERYGGVKSASDCSSLPAELQDGCKWRFDWFKNADNPSVTFERVQCPKELTDITG

SEQ ID NO: 11138 - protein, 200 aa, Neocallimastix californiae
  Glyco_hydro_45
EGTTTRYWDCCKPSCSWPDKAPVSAPVRQCKADGFTALTNYNAKSGCEGGESYMCSDQRPWAVSEVLSYGYAAASIKGLTEKEWCCRCYALTFTSGPVKGKQMVVQVTNTGGDLGDNHFDIQIPGGGFGIFNGCSAQFNTPDEVWGTRYGGVASRDDCEGLPKEIQESCYWRFDWFLNADNPTMVFDEVECPAELTKNTD

SEQ ID NO: 11139 - protein, 201 aa, Neocallimastix californiae
  Glyco_hydro_45
GKTTRYWDCCLASCSWSENTNAKHPVNACQKDGKTVINNFSYLIGSACSGGSGYMCSNNQPWAINDNVSYGFVAAGFSSGSQKDWCCTCQRLEFTSGPIAGKQMVVQITNTGGDLSNNHFDIQMPGGGVGIFNGCSSQFGAPNDGWGERYGGVKSAADCSQLPTELQEGCKWRFNWFKNADNPSVTFERVQCPKELTDITG

SEQ ID NO: 11140 - protein, 195 aa, Neocallimastix californiae
  Glyco_hydro_45
GTTTGYWDCCVASCSWDGNVEGSKPVKACKKDGVSLITEELWKVKSVCDNEGDGYMCNDNQPIVINDNLALGFAASHEKCCSCQLLQFTSSNVKGKKMIVQVTNTGSDIGSNHFDLQIPGAGVGIFNGCSKQWGAPGDGWGRRYGGVTTKAECSQLPAQLRAGCEWRFGWFASSDNPGVVYERVQCPKQLTDITG

SEQ ID NO: 11141 - protein, 200 aa, Neocallimastix californiae
  Glyco_hydro_45
KGTTTRYWDCCKPSCAWPGKFEYKTNIKLCAADGSPLLDNNLISGCEGGPTYTCEDQTPWAVDDVTAYGYAAANIPGLTEADWCCTCYALTFTSFPIKGKQMIVQITNTGGDLGDGHFDLQIPGGGFGLFNGCSPRYPDIPDEDWGDRNGGVISREGCYKLPKSMQEGCLFKFDWFRGADNPDVTYVKVDCPQELLDVSG

SEQ ID NO: 11142 - protein, 194 aa, Neocallimastix californiae
  Glyco_hydro_45
GKTTGYWDCCVASCSWDANVPGAKPVRACRKNGVSLITEELWKVKSVCDNGEGYMCNNNQPIVINDKLAYGFAASHEKCCTCQRLQFTSGNVKGKQMIVQITNTGSDLGSNHFDLQIPGAGVGIFNGCTKQWGAPNDGWGRRYGGVTSKSQCSQLPSQLRAGCEWRFGWFEGSDNPDVVFERVRCPKALTDITG

SEQ ID NO: 11143 - protein, 203 aa, Neocallimastix californiae
  Glyco_hydro_45
GKTTRYWDCCLASCSWSENVGASHPVNACKKDGTTLITDISNLWRIKSGCQGGEAYMCNAQQPWIINDKVSYGFVAAGFDSGNQKQWCCSCQKLQFTSGPVAGKQMIVQVTNTGTDLSENHFDIQMPGGGVGIFNGCSSQWNAGSDGWGQRFGGISSVSECSQLPAELRDGCKWRFDWFKNADNPAVVFERVQCPKELTDITG

SEQ ID NO: 11144 - protein, 203 aa, Anaeromyces robustus; identical to SEQ ID NO: 11143
  Glyco_hydro_45

SEQ ID NO: 11145 - protein, 199 aa, Anaeromyces robustus
  Glyco_hydro_45
GQTTRYWDCCKPSCAWNYKAKVTHEVYSCRKDGSIEPVVYATSGCGGGQAFMCNDQQPWEINDKLSYGFAAANISGSDEEHWCCACFKLTFTSTSIAGKQMIVQVTNTGGDLGNNHFDIQMPGGGLGLFDGCSPQFGVDASKWGNKYGGLTSESQCSLLPKVLQPGCHWRYGWFEDADNPAMEFEEVQCPQELVDITGC

SEQ ID NO: 11146 - protein, 200 aa, Anaeromyces robustus
  Glyco_hydro_45
KGTTTRYWDCCKPSCAWPGKFEYKTNIKLCNADNSPLLDNNLKSGCEGGPTYTCEDQTPWAVDEVTAYGFAAASIPNQTEADWCCTCYALTFTSFPIKGKQMIVQVTNTGGDLGEGHFDIQIPGGGFGLFNGCSPRYPEIPDEDWGDRNGGVTSRENCYKLPKTMQEGCLFKFDWFRGADNPDVTYVKVDCPKELLEVSG

SEQ ID NO: 11147 - protein, 200 aa, Anaeromyces robustus
  Glyco_hydro_45
KGNTTRYWDCCKPSCSWPEKALVSQPVQQCKKDGITPITNFNAKSGCEGGESFMCLNQQPWAVSEVLSYGYAAASIAGLTEADWCCRCYALTFTTGPAKGKQIVVQVTNTGGDLGENHFDLQIPGGGVGIFNGCSTQFNTDTDGWGERYGGIGKRSDCEMLPEEIRQACYWRFDWFLGSDNPEMVFDEVECPIELTQNTG

SEQ ID NO: 11148 - protein, 203 aa, Anaeromyces robustus
  Glyco_hydro_45
GVTTRYYDCCKPSCSWPGKADVFHPVRHCAVDGTTLIDDQEAPSACQKDVKGTAHMCENQQPWAINDHLSFGFAAAALPGGESVSCCKCYALTFTDPPIRGKQLVVQVTNTGADVGSNQFDLQIPGGGVGIFDACTNMYGLPAGSNGWGKQYGGITSIEDCESFPESLKEGCKWRFNWLLGADNPKMKFAEVDCPKELTDITG

SEQ ID NO: 11149 - protein, 199 aa, Anaeromyces robustus
  Glyco_hydro_45
GQTTRYWDCCKPSCAWNYKAKVTHEVYSCRKDGSIEPVVYATSGCGGGEAFMCNDQQPWAINDKLSYGFAAANISGSDEEHWCCACFKLTFTSTSIAGKQMIVQVTNTGGDLGNNHFDIQMPGGGLGLFDGCSPQFGVDASKWGNKYGGLTSESQCSLLPKVLQPGCHWRYGWFEDADNPAMEFEEVQCPQELVDITGC

SEQ ID NO: 11150 - protein, 195 aa, Anaeromyces robustus
  Glyco_hydro_45
GTTTGYWDCCVASCSWENNVKGGGQPVKACKKDGMTLVTEELWKVKSVCDNGDAYMCNDQQPIVVNDQLALGFAASHEPCCTCQLLQFTSSNVKGKKMIVQVTNTGDDIGNNHFDLQIPGAGVGIFNGCSKQWGAGNDGWGRRYGGVTSQAECSQLPSELRAGCEWRFGWFASSDNPTVTYERVQCPQQLTSITG

SEQ ID NO: 11151 - protein, 100 aa, Piromyces finnis; identical to SEQ ID NO: 1149
  Glyco_hydro_45

SEQ ID NO: 11152 - protein, 203 aa, Piromyces finnis
  Glyco_hydro_45
GVTTRYYDCCKPSCSWPGKADVTQPVRQCAMDGKTLLTDFSSPSACQTDVEGISHMCEDQQPWAVSDVLSYGFAAAALPGGESVSCCACYAITFSEPPIRGKQIVVQVTNTGADVGSNQFDLQIPGGGVGIFDACTNMYGLPSGSNGWGKKYGGIDKIEDCDSFPEALQAGCRWRFEFLLGADNPKMTFVEVECPKVLTDITG

SEQ ID NO: 11153 - protein, 204 aa, Piromyces finnis
  Glyco_hydro_45
KGVTTRYYDCCKPSCSWPGKADVTQPVRQCAMDGKTLLTDFSSPSACQTDVEGISHMCEDQQPWAVSDVLSYGFAAAALPGGESVSCCACYAITFSEPPIRGKQIVVQVTNTGADVGSNQFDLQIPGGGVGIFDACTNMYGLPSGSNGWGKKYGGIDKIEDCDSFPEALQAGCRWRFEFLLGADNPKMTFVEVECPKVLTDITG

SEQ ID NO: 11154 - protein, 621 aa, Neocallimastix californiae
  Glyco_hydro_48
YAQRAIEHYNVVTGNGSYSSEYFSPENVPYHSIETMMVEAPDHGHESVSETYSFWVWLEAVNGKLTGNYDGVETAWSYLEKHLIPDSKNQPGNSRYNASSPATYAPEDDDIENYPAQLVFQDGIVGQDPIAKELQQAYGTWDIYAMHWIIDGDNWYGYGQQGDGKSKPSFINTFQRGASESAWKTVPHPCWESMKWGGRNGFLDLFTGDNSYAKQWRYTAAPDADARAIQAAYFGYIWAEEDGQDLSSVASKAAKLGDYLRYSHYDKYFKKIGNCIDYQRCAAGSGKNSAHYLISWYFAWGGGLQGDWAWRISSSHTHSGYQNPLAAWILSTESAFKPKGSTAVKDWSTSLDRQLELFRWLQSAEGCIAGGATNSWQGHYAQPPSDITTFYGMYYDWQPVYHDPPSNNWTGMQGWGMERVCSLYYLSGNEKAGKVCQEWAKWIKANTRVNGGEVVHATNLEWTGNPDEWKSSNFNKNGLNASLHGTVSSEGTDLGSIASMIKALMWVSLKDGDTEGLQLVLDVMDAIENYKDDLGYAVEEAREDYIKFNEDVYIPSGWTGKNAQGANIRSGVKFIDIRPKYKEDPDWAQVEDFLNGGSAPRFTYHRFWGQTEIMVANGLIS

SEQ ID NO: 11155 - protein, 621 aa, Neocallimastix californiae
  Glyco_hydro_48
YAERAIEHYNKVTGNGSYQSEYFSPENVPYHSIETMMVEAPDQGHESVSETYSFWVWLEAVNGKLTGNYEGVETAWSFLEKHLIPDSKNQPGNSRYNASSPATYAPEDDDIENYPAQLVFQDGIVGQDPIAKELQQAYGTWDIYAMHWIIDGDNWYGYGQQGDGKTKPSFINTFQRGASESAWKTVPHPCWETMKWGGSNGFLDLFTGDNSYAKQWRYTAAPDADARAIQAAYFGYIWAEEDGQDLSSVASKAAKLGDYLRYSHYDKYFKKIGNCIDYQRCAAGSGKNSAHYLISWYFAWGGGLQGDWAWRISSSHTHSGYQNPLAAWILSTESAFKPKGSTAVKDWSTSLDRQLELFRWLQSAEGCIAGGATNSWQGHYAQPPSDITTFYGMYYDWQPVYHDPPSNNWTGMQGWGMERVCSLYYLSGNEKAGKVCQEWAKWIKQNTRVNGGEVVHATNLEWSGNPDEWNASNFDKSGLNASLHGTVSSEGTDLGSIASMIKALMWVSLKDGDTEGLQLVLDVMDAIENYKDDLGYAVEEAREDYIKFNEEVYIPSGWSGKNAQGAQLKSGIKFIDIRPKYKEDPDWAQVEDFLNGGSAPRFTYHRFWGQTEIMVANGLIS

SEQ ID NO: 11156 - protein, 220 aa, Neocallimastix californiae
  Glyco_hydro_48
HDPPSNNWTGMQGWGMERVCSLYYLSGNEKAGKVCQEWAKWIKKNTRVNGGEIVHATNLAWTGNPDEWKSSNFNKSGLNASLHGTVSSEGTDLGSIASMIKALMWVSLKDEDTEGLQLVLDVMDAMENYRDDLGYAVEEAREDYIKFNEDVYIPSGWTGKNAQGANIRSGVKFIDIRPKYKEDPDWAQVEDFLNGGSAPRFTYHRFWGQTEIMVANGLIS

SEQ ID NO: 11157 - protein, 360 aa, Neocallimastix californiae
  Glyco_hydro_48
YSHYDKYFKKIGNCIDYQRCAAGSGKNSAHYLISWYFAWGGGLQGDWAWRISSSHTHSGYQNPLAAWILSTESAFKPKGSTAVKDWSTSLDRQLELFRWLQSAEGCIAGGATNSWQGHYAQPPSDITSFYGMYYDWQPVYHDPPSNNWTGMQGWGMERVCSLYYLSGNEKAGKVCQEWAKWIKETTRVNGGEIVHATNLEWSGNPDEWKSSNFNKSGLNASLHGTVSSEGTDLGSIASIIKGLMWVSMKDGDEEGLRLVLDVMDAIENYKDDLGYAVEEAREDYIKFNEEVYIPSGWSGKNAQGANIKSGVKFIDIRPKYKEDKDWAQVEDFLNGGSAPRFTYHRFWGQTEIMVANGLIS

SEQ ID NO: 11158 - protein, 224 aa, Neocallimastix californiae
  Glyco_hydro_48
QPVYHDPPSNNWTGMQGWGMERVCSLYYLSGNEKAGKVCQEWAKWIKKNTRVNGGEIVHATNLAWTGNPDEWKSSNFNKSGLNASLHGTVSSEGTDLGSIASMIKALMWVSLKDEDTEGLQLVLDVMDAMENYRDDLGYAVEEAREDYIKFNEDVYIPSGWTGKNAQGANIRSGVKFIDIRPKYKEDPDWAQVEDFLNGGSAPRFTYHRFWGQTEIMVANGLIS

SEQ ID NO: 11159 - protein, 621 aa, Neocallimastix californiae
  Glyco_hydro_48
YGNRVTELYNKVTGNGSYSSEYFSAEKVPYHSVETLMVEAPDHGHESVSETFSFWIWLEAVNGKITGNYDGVEEAWSYLEKHIIPDSKNQPGNSRYNPSSPATYAAEHDDIDGYPSQLVFQDGIVGEDPIAKELQQAYGNWDIYIMHWIIDGDNWYGYGQQGDGKTKPSFINTFQRGPSESTWKTVPHPCWESMKWGGSNGFLDLFTIDNSYAKQWRYTAAPDADARAIQAAYFAYIWAEEDGVNLSSVASKAAKLGDYLRYAQYDKYFKKVGNCVGYQQCQAGRGKNSAHYLISWYFAWGGGLQGDWAWRIGSSHTHTGYQNPLAAWVLSTQSAFKPKSSTGAKDWATSLDRQLELFRWLQSAEGCIAGGATNSWQGSYAQPSSDITSFYGMWYDWQPVYHDPPSNNWTGMQGWGMERVCSLYYLSGNEKAGKICQEWAKWVKNTTRVSGGEVVHATNLEWSGNPDEWNSSNFNKSNLNRSLHGTVSSDGIDIGTIASIIKGLMWVSMKDGDQEGINLSIDVMDAIENYKDDLGYGTTEARGDYDKFGGEVYIPRGWSGKNAQGANIRNGVTFIDIRPKYKQDPDWEQVEAYLNGGEPPVFTYHRFWAQTEIAVANGLIS

SEQ ID NO: 11160 - protein, 621 aa, Neocallimastix californiae
  Glyco_hydro_48
YAQRAINTYNTVTGNGSYKSSYFSPEVVPYHSIETLMVEAPDQGHESVSETFSFWVWLEAVNGKLTGDYSGVEKAWSYLEKHMIPDSKNQPGMSRYNPSSPATYAPEDDDITNYPARLVFQDGIVGQDPIAQELQQAYGTWDIYAMHWIIDGDNWYGYGQQGDGTSKPSFINTFQRGASESAWKTVPHPCWETFKWGGSNGFLDLFTLDNNYSKQWRYTDAPDADARAIQGAYFAWLWAKEDGKNLSSLASKAAKLGDYLRYSHYDKYFKKIGNCVGYQQCQAGSGKNSAHYLISWYFSWGGGLQGDWSWRIGSSHTHSGYQSPLAAWILSTESAFKPKSASGAKDWATSLERQIELFRWLQTSEGCIAGGATNSWQGHYAQPDSSITSFYGMWYDWQPVYHDPPSNNWTGMQGWGMERTCCYYYLSGDEKAGLVCQNWAKWVKANTRVSGGQIVHATNLSWEGSPDEWNSSNFNKANLNASLHGTVSAEGIDLGSIASIIKGLMWVSMKDNDQEGINLVIDVMDAIENYKDDEGYCADEAREDYAKFSSEVYIPSGWSGKNAQGANIKNGVTFIDIRPKYKQDPDWAQVENFINGGEPPRFRYHRFWGQTEIMVANGLIS

SEQ ID NO: 11161 - protein, 621 aa, Neocallimastix californiae
  Glyco_hydro_48
YSQRAIEHYNIVTGNGSYQSEYFSPENVPYHSIETMMVEAPDHGHESVSETYSFWVWLEAVHGKLTGNYDGVSTAWSYLEKHLIPDSKNQPGNSRYNASSPATYAPEDDDIENYPAQLVFQDGIVGQDPIAKELQQAYGTWDIYAMHWIIDGDNWYGYGQQGDGKSKPSFINTFQRGASESAWKTVPHPCWETMKWGGPNGFLDLFTGDNSYAKQWRYTAAPDADARAIQAAYFGYIWAKEDGVDLSSVASKAAKLGDYLRYSHYDKYFKKIGNCIDYQRCAAGSGKNSAHYLISWYFAWGGGIQGDWSWRIGSSHTHSGYQNPLAAWVLSTESAFKPKGSTAVKDWSTSLDRQLELFRWLQSAEGCIAGGATNSWQGHYAQPDSDITTFYGMFYDWQPVYHDPPSNNWTGMQGWGMERVCSLYYLSGNEKAGKICQEWAKWVKENTRVIGGEVVHATNLEWTGNPDEWKSSNFNKNGLNSQLHGTVSSEGTDLGSIASIIKALMWVSLKDEDSEGLRLVIDVMDAIENYRDDLGYAVEEAREDYNKFEENVYIPSGWTGKNAQGANIRSGVKFIDIRPKYKQDKDWAQVEDYLNGGNPPKFTYHRFWGQTEIMVANGLIS

SEQ ID NO: 11162 - protein, 227 aa, Neocallimastix californiae
  Glyco_hydro_48
YDWQPVYHDPPSNNWTGMQGWGMERVCSLYYLSGNEKAGKVCQEWAKWVKKNTRVNGGEVVHATNLEWTGNPDEWKSSNFNKNGLNSQLHGTVSSEGTDLGSIASIIKALMWVSLKDEDSEGLRLVIDVMDAIENYRDDLGYAVEEAREDYIKFNEDVYIPSGWTGKNAQGANIRSGVKFIDIRPKYKQDKDWAQVEDFLNGGSAPRFTYHRFWGQTEIMVANGLIS

SEQ ID NO: 11163 - protein, 621 aa, Neocallimastix californiae
  Glyco_hydro_48
YAQRVIDTYNAVTGNGSYNSDYFSPENVPYHSIETMMVEAPDYGHESVSETYSFWVWLEAINGKMTGDYKGVETAWSFLEKHLIPNSKNQPGMSRYNTSSPATYAPEDDDITNYPARLVFQDGIVGEDPIAKELQQAYGTWDIYAMHWIIDGDNWYGYGQNGDGTSKPSFINTFQRGASESAWKTVPHPCWEEMKWGGRNGFLDLFTGDNSYSKQWRYTAAPDADSRAIQAAYFAYIWAKEDGQNLSSLASKAAKLGDYLRYAQYDKYFKKIGNCIGYQQCQAGRGKNSAHYLISWYFSWGGGLQGDWSWRIGSSHTHTGYQNPLAAWILSTQSAFKPKGSTAVKDWTTSLDRQLELFRWLQAAEGCIAGGATNSWQGHYAQPPSEITSFYGMYYDWQPVYHDPPSNNWTGMQGWGMERVCSLYYLSGNEKAGKVCQEWAKWVKNNVRVNGSEIVHATNFEWSGNPDEWKASNFNKSGLNASLHGAVSSEGIDLGSIASIIKGLMWVSMKDNDQEGIDLSVQVMDAIEQYKDQYGYGVEEAREDYIKFNEEVYIPSGWTGKNAQGANIRNGVKFIDIRPKYKEDPDWAQVENFLNGGEAPRFTYHRFWAQTEIAVANGLIS

SEQ ID NO: 11164 - protein, 621 aa, Neocallimastix californiae
  Glyco_hydro_48
YAQRVIDTYNAVTGNGNYNSEYFSPENVPYHSVETMMVEAPDYGHESVSETYSFWVWLEAINGKMTGDYKGVETAWSYLEKHLIPDSRNQPGMSRYNSSSPATYAPEDDDIENYPARLIFQDGIVGEDPLARELQQAYGTWDIYAMHWIIDGDNWYGYGQQGDGRSKPSFINTFQRGASESAWKTVPHPCWETMKWGGRNGFLDLFTGDNSYSKQWRYTAAPDADARAIQAAYFAYIWAKEDGTNLSSLASKAAKLGDYLRYSHYDKYFKKIGNCIGYQQCQAGRGKNSAHYLISWYFSWGGGLQGDWSWRIGSSHTHTGYQNPLAAWVLSTESAFKPKSSTAVKDWATSMDRQLELFRWLQASEGCIAGGATNSWQGHYAEPPSDITTFYGMYYDWQPVYHDPPSNNWTGMQGWGMERVCSLYYLSGNEKAGKVCQEWAKWVKKNVRVNGNEITHATNFSWSGNPDEWNPSNFNKSGLNASLHGTVSSEGIDIGSLASIIKGLMWVSMKDKDQEGINLSIKVMDAIENYRDDLGYSVEEAREDYIKFNEEVYIPYGWTGKNAQGATLEHGVKFIDIRPKYKQDKDWAQVENFLNGGEAPRFTYHRFWAQTEIAVANGLIS

SEQ ID NO: 11165 - protein, 622 aa, Neocallimastix californiae
  Glyco_hydro_48
YAQRAIDHYNKMTNGGQYNTDYFSPETVPYHSIETLMVEAPDHGHESVSETYSFWIWLEAVNGKLTGNYDGINTAWSYLEKHMIPDAKNQPGNSKYNPSSPATYAPEDDDITNYPAQLVFQDGLVGEDPIAKELQQAYNTWDIYAMHWIIDGDNWYGYGQQADGKTKPSFINTFQRGSSESTWKTVPHPCWEEFKWGGRNGFLDLFTGDNNYAKQWRYTAAPDADARAIQAAYFGYMWAEEDGVDLSDLASKAAKLGDYIRYAQYDKYFKKIGNCIGHDRCSAGRGKNSAHYLISWYFAWGGGLQGDWAWRIGSSHTHTGYQNPLAAWVLSTQSAFKPKSRTGADDWATSLDRQLELFRWLQASEGCIAGGATNSWQGHYAQPSSDITTFYGMYYDWQPVYHDPPSNNWTGMQGWGMERVCSLYYISGNEKAGTICRDWAKWVKNTVRVNGNEVIHSTNLEWSGNPDEWNSNNFNKSGRNRSLHGTSSSDGLDLGTLASIIKGLLWVSAKDNDAEGIQLVLDVMNAIEQYSDDLGYAAEEPRGDYSKFGEEVYIPSGWTGKNAQGANIRSGVTFIDIRPKYKQDPDWAQVENYLNGGSEPRFTYHRFWAQTEIMVANGLISI

SEQ ID NO: 11166 - protein, 622 aa, Neocallimastix californiae
  Glyco_hydro_48
YAQRAIEHYNKMTNGGQYNTEYFSPENVPYHSIETLMVEAPDHGHESVSETYSFWIWLEAVNGKLTGNYDGINTAWSYLEKHMIPDEKNQPGNSKYNPSSPATYAPEDDDITNYPAQLVFQDGLVGEDPIAKELQQAYRTWDIYAMHWIIDGDNWYGYGQQADGKSKPSFINTFQRGASESTWKTVPHPSWEEFKWGGRNGFLDLFTGDNNYAKQWRYTAAPDADARAIQAAYFGYIWAEEDGVDLSDLASKAAKLGDYLRYSHYDKYFKKIGNCVGYDKCSAGRGKNSAHYLISWYFAWGGGLQGDWAWRIGSSHTHTGYQNPLAAWILSTQSAFKPKGSTAVKDWQTSLDRQLELIRWLQATEGCIAGGATNSWQGHYAEPDSDITTFYGMYYDWQPVYHDPPSNNWTGMQGWGMERTCSLYYVSGNEKAGTICRDWAKWVKETVRVSGGQVIHATNLEWSGNPDEWNKNNFNKSGANRSLHGTVSAEGLDLGSIASIIKALLWVSAKDGDEEGIDLAIQVMDAIENYKDDLGYAAEEARADYSKFGDEVYIPSGWTGKNAQGANLKSGVTFIDIRPKYKQDPDWAQVENYLNGGSEPTFTYHRFWGQTEIMVANGLISI

SEQ ID NO: 11167 - protein, 499 aa, Neocallimastix californiae
  Glyco_hydro_48
LVGEDPIAKELQQAYNTWDMYAMHWIIDGDNWYGYGQQADGKSKPSFINTFQRGSSESTWKTVPHPCWEEFKWGGRNGFLDLFTGDNNYAKQWRYTAAPDADARAIQAAYFGYIWAEEDGVNLSDLASKAAKLGDYMRYAQYDKYFKKIGNCIGHDKCSAGRGKNSAHYLISWYFAWGGGLQGDWAWRIGSSHTHSGYQNPLAAWVLSTQSAFKPKSKSGADDWATSLDRQLELFRWLQASEGCIAGGATNSWQGHYAKPGSDITTFYGMYYDWQPVYHDPPSNNWTGMQGWGMERVCSLYYVSGNEMAGTVCRDWAKWVKNTVRVSGGQVVHATNLEWSGNPDEWNKSNFNKSGLNRSLHGTVSAEGLDLGSIASIIKGLLWVSAKDGDEEGIDLSLQVMDAIENYKDDLGYAAEEARADYDKFGGEVYIPSGWTGKNAQGANLKSGVTFIDIRPKYKQDPDWAQVENYLNGGSAPTFKYHRFWGQTEIMVANGLISI

SEQ ID NO: 11168 - protein, 479 aa, Neocallimastix californiae
  Glyco_hydro_48
YAMHWIIDGDNWYGYGQQADGKSKPSFINTFQRGSSESTWKTVPHPCWEEFKWGGRNGFLDLFTGDNNYAKQWRYTAAPDADARAIQAAYFGYIWAEEDGVNLSDLASKAAKLGDYMRYAQYDKYFKKIGNCIGHDKCSAGRGKNSAHYLISWYFAWGGGLQGDWAWRIGSSHTHSGYQNPLAAWVLSTQSAFKPKSKSGADDWATSLDRQLELFRWLQASEGCIAGGATNSWQGHYAKPGSDITTFYGMYYDWQPVYHDPPSNNWTGMQGWGMERVCSLYYVSGNEMAGTVCRDWAKWVKNTVRVSGGQVVHATNLEWSGNPDEWNKSNFNKSGLNRSLHGTVSAEGLDLGSIASIIKGLLWVSAKDGDEEGIDLSLQVMDAIENYKDDLGYAAEEARADYDKFGGEVYIPSGWTGKNAQGANLKSGVTFIDIRPKYKQDPDWAQVENYLNGGSAPTFKYHRFWGQTEIMVANGLISI

SEQ ID NO: 11169 - protein, 584 aa, Neocallimastix californiae
  Glyco_hydro_48
YKNHYNKLNLHNSTSSFYNLDSIPYTTLETLYIDQTVDYGHITTIKEFSYKLWIEAIQGKISGKWKSFVNAWNIFEMNMIPKEENQRGSYIYYSNNHNSQNNQDTLYKSLNEYYQTWSIYLPHYKIDTDNWNMYFSKSNEKRFINTYKNNNKDSIWSSLTYPSLINSKDFVNPYVKADSPEMKQWEYISDSKYVSKIIETIYWAYCWSNEQKKRKFMDTILKKVLRMSDYMLYFINSNESLQEFNVESKDDDLNYLVSRYFSWKGDIHGKWLTKKVSSNIIGIGSQNPLVAYILSNIKEFKSDNEDIILKWKKTYKRQIEFIRWLQSSEGAIVGNAIYISSSIEINKVPTFYNLVFSNNSNEEENNLFSTQCFVFESIAELYYITKDKDIETILFKWLDWVLTVFHLTSDRSFRIPNRLSFEGQPEKWIPNTKIKDHKNKHLNVIIEDFNNDLGVAASLSKILLWVGKKINNEDYLTLGREILERQEILNKDEDGYATEEKFYQYRLFNKKLPIQKDFKGVYGRSTKINDKSSFLSIRPYYKRDKNWKKIQTFLDKGTPVPKFRYHRFWEQCEILSAQGLYSLL

SEQ ID NO: 11170 - protein, 621 aa, Neocallimastix californiae
  Glyco_hydro_48
YAKRVTDTYNAVTGNGSYNSDYFSPENVPYHSIETMMVEAPDYGHESVSETYSFWVWLEAINGKMTGNYKGVETAWSYLEKHLIPNSKNQPGMSKYNTSSPATYAPEDDDITNYPAQLVFQDGIVGEDPIAKELQQAYGTWDIYAMHWIIDGDNWYGYGQNGDGTSKPSFINTFQRGASESAWKTVPHPCWEEMKWGGRNGFLDLFTGDNNYSKQWRYTAAPDADARAIQAAYFAYIWAEEDGQNLSSLASKAAKLGDYLRYSHYDKYFKKIGNCIGYQQCQGGRGKNSAHYLISWYFSWGGGLQGDWSWRIGSSHTHTGYQNPLAAWVLSTQAAFKPKGSSAVKDWSTSLDRQLELFRWLQAAEGCIAGGATNSWQGHYAQPPSDITSFYGMYYDWQPVYHDPPSNNWTGMQGWGMERVCSLYFISGNEKAGKVCQEWAKWVKNNVRVNGSEIVHATNFEWSGNPDEWKPSNFNKSGLNASLHGTVSSEGVDLGSLASIIKGLMWVSMKDNDQEGIDLSVQVMDAIEQYKDKYGYGVEEAREDYIKFNEEVYIPSGWTGKNAQGANIRSGVKFIDIRPKYKEDPDWAQVENFLNGGEAPRFTYHRFWAQTEIAVANGLIS

SEQ ID NO: 11171 - protein, 341 aa, Anaeromyces robustus
  Glyco_hydro_48
SAGRGKNSAHYLISWYFAWGGGLQGDWAWRIGSSHTHTGYQNPLAAWVLSTQSAFKPKSRTGADDWATSLDRQLELFRWLQASEGCIAGGATNSWQGHYAQPSSDITTFYGMYYDWQPVYHDPPSNNWTGMQGWGMERVCSLYYISGNEKAGTICRDWAKWVKNTVRVNGNEVIHSTNLEWSGNPDEWNSNNFNKSGRNRSLHGTSSSDGLDLGTLASIIKGLLWVSAKDNDAEGIQLVLDVMNAIEQYSDDLGYAAEEPRGDYSKFGEEVYIPSGWTGKNAQGANIRSGVTFIDIRPKYKQDPDWAQVENYLNGGSEPRFTYHRFWAQTEIMVANGLISI

SEQ ID NO: 11172 - protein, 344 aa, Anaeromyces robustus
  Glyco_hydro_48
TKCSAGRGKNSAHYLISWYFAWGGGLQGDWAWRIGSSHTHTGYQNPLAAWILSTQSAFKPKGSTAVKDWQTSLDRQLELIRWLQATEGCIAGGATNSWQGHYAEPDSDITTFYGMYYDWQPVYHDPPSNNWTGMQGWGMERTCSLYYVSGNEKAGTICRDWAKWVKETVRVSGGQVIHATNLEWSGNPDEWNKNNFNKSGANRSLHGTVSAEGLDLGSIASIIKALLWVSAKDGDEEGIDLAIQVMDAIENYKDDLGYAAEEARADYSKFGDEVYIPSGWTGKNAQGANLKSGVTFIDIRPKYKQDPDWAQVENYLNGGSEPTFTYHRFWGQTEIMVANGLISI

SEQ ID NO: 11173 - protein, 621 aa, Anaeromyces robustus
  Glyco_hydro_48
YAKRATEHYNIITGNGSYSSKYFSSEKVPYHSVETLMVEAPDHGHESVSETYSFWIWLEAVNGKLTGNYEGVDTAWSYLEKHLIPDSKNQPGNSKYNPSSPATYAPEDDDITNYPAQLVFQDGIVGQDPIAQELQQAYGNWDMYAMHWIIDGDNWYGYGQQGDGTSKPSFINTFQRGSSESTWKTIPHPCWEEFKWGGPNGFLDLFTGDNSYSKQWRYTAAPDADARAIQAAYFGYIWAKEDGQDLSAVAAKAAKLGDYMRYAQYDKYFKKIGNCIGYNKCAAGSGKNSAHYLISWYFAWGGGLQGDWAWRISSSHTHSGYQNPLAAWVLSSEPAFKPKSSTGAEDWATSLDRQLELFRWLQSSEGCIAGGATNSWQGHYAQPDSSITTFYGMFYDWQPVYHDPPSNNWSGMQGWGMERVCSLYYLSGDERAGKVCQEWAKWVKKNVRVSNGEITHCTNIKWEGNPDEWNSSNFNKANLNASLHGTSSSEGTDLGTVASIIKGLLWVSLKDNDQEGIDLVIDVMDAMENYKDSLGYAVKEAREDYAKFGGEVYVPSGWTGKNAQGANIKNGVTFIDIRPKYKQDPDWAQVENFLNGGDPPEFTYHRFWAQTEIMVANGILS

SEQ ID NO: 11174 - protein, 632 aa, Anaeromyces robustus
  Glyco_hydro_48
YAQRVIEQYEKLTNNGTYDTDYFSKDNYLPFYSIETLIVEEDNSFSRLDYGHLSTSETLSYWIWLEAVNGKITGNYEGVDWAWSVMEKFLIPYSEYQRGNNRYNSNEPSIYVPEYDGIQNYPIPLTFQTGIAGMDPIAKELQVTYGTWDMYSLHWLVDGDNWYGYGQQENGYTRPVLINTFRRGPSESVWQTIPHPSFDEFRWGGSNGFLDLFFIDNNFYYPKQYKYTTCPDADARAIQATYFAYLWAKEDGINLPYSIILRATRLGDYLRYSHYDKYFKKIGDCFNYKLCTPGSGKNSAHYLISWAYSWGGGIMGDWTWRRGSSYIHSGYQNPLVAWIFSTQSAFKLKSSTGNKDWSVSLDRQLEFMRWLQTPEGCIAGGATNSWEGQYNTPPQNITNFYGMYYDWQPVYHNPSSNNWIGMQARSIERVCSLYYLSGNQKAELICQTWVEWIKKNIQIHDYEIIHATKLTWEGNPDDWDSSSFYKSGINTSLHGTVFEMGFDLGSMASIVKSLLWVSMKDNDQEGLDLAIQIMDIIENYKDDLGYAVEEFHDNYSKFANPVYFPNDWKGRNPQGAYLKRGACFLDIRPKYKEDPDWYQVEYYLNGYENPPVFTYHRFWVQAEIMIANGLLS

SEQ ID NO: 11175 - protein, 364 aa, Anaeromyces robustus
  Glyco_hydro_48
VLNKITKMSDYMLYFINNDASLQSFNSDSTDENKNYLLSRYFSWKGSIHGKWLTKKIISNIIGIGSQNPFVAYILSNVKEFNSENPNSVNKWKKSYKRQIEFIRWLQSSEGAIVGNAKYPSNIDDINHKSSFYDLIFTSSNEEENDLFSTQCFVFESIAELYYITKDKDIEIILFKWLDWVLSVFHLTSDRSFRIPNKLSFEGHPEKWKPNTSIEDHENDNLNVIVEDYNNNIGVAASLSKILLLVGKKNNNDDYLTLGRDILEKIELINKDEYGYATEEIFYNYRLFNKKLPIQKDFKGVYGQSAKINDKSTFISIRPYYKKDKNWKIIKSYLNDGTPVPSFKYHRFWEQCEILLAQGLYSQY

SEQ ID NO: 11176 - protein, 585 aa, Piromyces finnis
  Glyco_hydro_48
YQNHYDKLNINNSSSIYYNADSIPYSTLETLYIDQNVDYGHLTTLKEISYKLWIEALQGKISGKWKPFVNAWNIFENNMIPKDESQKGNSKYYSTTNNSINTKDSLYKELYEQYQTWSLYLPHNIIDTDNWNKYFSSKNKKRFIKNHKNNDKDSIWCSLFYPSIINSNNYLNPYLDNEITEIKQWEYISDSRYISKIIESVYRAYCWSTEQKKNKFMKPILKKIIKMSDYMLYFINSDDSLQSFDSESNEDNKNYLLSRYFSWKGSMEGKWLEKEVTTDIIGIGSQNPLIAYVLSNDKNFNSENPEFVSKWKKSYQRQIEFIRWLQSSEGAIVGVAQYPSNHNLSSKKMPSFYNLIFSKNFEVEENNLFGTQCYVFESLAELYYITKDKDIEIIITKWLDWVLSVFHLTSDRLFKIPNKLTFEGQPKDWNQKDGIKNHKNDKLNVIVEDYNNSIGVAASLSKILLLIGKKNNNEDYLTLGRDILERIEISSKDSQGYSVTETFYQYRRFNKKLPIPEGFKGMYGRSSKINDKSTFISIRPYYKKDKDWKIINTFLNKGTTIPTFKYHRFWEQCEILLAQGLYSQY

SEQ ID NO: 11177 - protein, 200 aa, Piromyces finnis
  Glyco_hydro_48
MYYLSGNEKAGLVCKNWAQWVKDTTRVNGGEVIHATNLGWDGNPDEWKASNFNKSGLNKSLHGTVTSEGLDLGSIASIMKGLMWVSMKDGDEEGLSLAVSVMDAIENYKDDLGYATYEERLDYANFGQETYIPSGWSGKNAQGANIKSGATFIDIRPKYKEDPDWAQVEDFLNGGNPPAFTYHRFWGQTEIMVANGLIAI

SEQ ID NO: 11178 - protein, 621 aa, Piromyces finnis
  Glyco_hydro_48
GRRVTDLYDVMTGNGSYSSEYFSAEKVPYHSVETLMVEAPDHGHESVSETFSFWIWLEAVNGKITGNYDGVEEAWNYLEKHIIPDSKNQPGNSKYNPSSPATYAAEHDDIDGYPSKLIFQDGIVGEDPIAKELSQAYGNWDIYIMHWIIDGDNWYGYGQQGDGTSKPSFINTFQRGASESTWKTVPHPCWEAMKWGGRNGFLDLFTVDNSYAKQWRYTAAPDADARAVQAAYFAYIWAEEDGVNLSSVAAKAAKLGDYLRYAQYDKYFKKIGNCVGSDKCSAGRGKNSAHYLISWYFAWGGGLQGDWAWRIGSSHTHSGYQNPLAAWILSTQAAFKPKSSTGAKDWATSMDRQLELFRWLQTPEGCIAGGATNSWQGSYAQPSSDITTFYGMWYDWQPVYHDPPSNNWTGMQGWGMERVCSLYYVSGDERAGKVCQEWAKWVKDTTRVSGGEIVHATNLDWSGNPDEWNSSNFNKSNLNRSLHGTVSSEGVDLGSIASIIKGLMWVSMRDGDQEGINLSIEVMDAIENYKDDLGYATYEERLDYANFGQETYIPSGWSGKNAQGANIKSGATFIDIRPKYKEDPDWAQVEDFLNGGNPPAFTYHRFWGQTEIMVANGLIAI

SEQ ID NO: 11179 - protein, 620 aa, Piromyces finnis
  Glyco_hydro_48
GRRVTDLYDVMTGNGSYSSEYFSAEKVPYHSVETLMVEAPDHGHESVSETFSFWIWLEAVNGKITGNYDGVEEAWNYLEKHIIPDSKNQPGNSKYNPSSPATYAAEHDDIDGYPSKLIFQDGIVGEDPIAKELSQAYGNWDIYIMHWIIDGDNWYGYGQQGDGTSKPSFINTFQRGASESTWKTVPHPCWEAMKWGGRNGFLDLFTVDNSYAKQWRYTAAPDADARAVQAAYFAYIWAEEDGVNLSSVAAKAAKLGDYLRYAQYDKYFKKIGNCVGSDKCSAGRGKNSAHYLISWYFAWGGGLQGDWAWRIGSSHTHSGYQNPLAAWILSTQAAFKPKSSTGAKDWATSMDRQLELFRWLQTPEGCIAGGATNSWQGSYAQPSSDITTFYGMWYDWQPVYHDPPSNNWTGMQGWGMERVCSLYYVSGDERAGKVCQEWAKWVKDTTRVSGGEIVHATNLDWSGNPDEWNSSNFNKSNLNRSLHGTVSSEGVDLGSIASIIKGLMWVSMRDGDQEGINLSIEVMDAIENYKDDLGYAAEEQRLDYEKFGGEVYIPSGWTGKNAQGANIKSGVTFIDIRPKYKQDPDWAQVEEYLNGGNPPEFNYHRFWAQTEIAVANGLIS

SEQ ID NO: 11180 - protein, 199 aa, Piromyces finnis
  Glyco_hydro_48
MYYLSGNEKAGLVCKNWAQWVKDTTRVNGGEVIHATNLGWDGNPDEWKASNFNKSGLNKSLHGTVTSEGLDLGSIASIMKGLMWVSMKDGDEEGLSLAVSVMDAIENYKDDLGYAAEEQRLDYEKFGGEVYIPSGWTGKNAQGANIKSGVTFIDIRPKYKQDPDWAQVEEYLNGGNPPEFNYHRFWAQTEIAVANGLIS

SEQ ID NO: 11181 - protein, 199 aa, Piromyces finnis
  Glyco_hydro_48
MYYLSGNEKAGLVCKNWAQWVKDTTRVNGGEVIHATNLGWDGNPDEWKASNFNKSGLNKSLHGTVTSEGLDLGSIASIMKGLMWVSMKDGDEEGLSLAVSVMDAIENYKDDLGYATYEERLDYANFGQETYIPSGWSGKNAQGANIKSGATFIDIRPKYKEDPDWAQVEDFLNGGNPPAFTYHRFWGQTEIMVANGLIS

SEQ ID NO: 11182 - protein, 620 aa, Piromyces finnis
  Glyco_hydro_48
GRRVTDLYDVMTGNGSYSSEYFSAEKVPYHSVETLMVEAPDHGHESVSETFSFWIWLEAVNGKITGNYDGVEEAWNYLEKHIIPDSKNQPGNSKYNPSSPATYAAEHDDIDGYPSKLIFQDGIVGEDPIAKELSQAYGNWDIYIMHWIIDGDNWYGYGQQGDGTSKPSFINTFQRGASESTWKTVPHPCWEAMKWGGRNGFLDLFTVDNSYAKQWRYTAAPDADARAVQAAYFAYIWAEEDGVNLSSVAAKAAKLGDYLRYAQYDKYFKKIGNCVGSDKCSAGRGKNSAHYLISWYFAWGGGLQGDWAWRIGSSHTHSGYQNPLAAWILSTQAAFKPKSSTGAKDWATSMDRQLELFRWLQTPEGCIAGGATNSWQGSYAQPSSDITTFYGMWYDWQPVYHDPPSNNWTGMQGWGMERVCSLYYVSGDERAGKVCQEWAKWVKDTTRVSGGEIVHATNLDWSGNPDEWNSSNFNKSNLNRSLHGTVSSEGVDLGSIASIIKGLMWVSMRDGDQEGINLSIEVMDAIENYKDDLGYATYEERLDYANFGQETYIPSGWSGKNAQGANIKSGATFIDIRPKYKEDPDWAQVEDFLNGGNPPAFTYHRFWGQTEIMVANGLIS

SEQ ID NO: 11183 - protein, 199 aa, Piromyces finnis
  Glyco_hydro_48
MYYLSGNEKAGLVCKNWAQWVKDTTRVNGGEVIHATNLGWDGNPDEWKASNFNKSGLNKSLHGTVTSEGLDLGSIASIMKGLMWVSMKDGDEEGLSLAVSVMDAIENYKDDLGYSSHEARGDYDKFGGEVYIPSGWTGKNAQGANIKSGVTFIDIRPKYKQDPDWAQVEEYLNGGNPPEFNYHRFWAQTEIAVANGLIS

SEQ ID NO: 11184 - protein, 620 aa, Piromyces finnis
  Glyco_hydro_48
GRRVTDLYDVMTGNGSYSSEYFSAEKVPYHSVETLMVEAPDHGHESVSETFSFWIWLEAVNGKITGNYDGVEEAWNYLEKHIIPDSKNQPGNSKYNPSSPATYAAEHDDIDGYPSKLIFQDGIVGEDPIAKELSQAYGNWDIYIMHWIIDGDNWYGYGQQGDGTSKPSFINTFQRGASESTWKTVPHPCWEAMKWGGRNGFLDLFTVDNSYAKQWRYTAAPDADARAVQAAYFAYIWAEEDGVNLSSVAAKAAKLGDYLRYAQYDKYFKKIGNCVGSDKCSAGRGKNSAHYLISWYFAWGGGLQGDWAWRIGSSHTHSGYQNPLAAWILSTQAAFKPKSSTGAKDWATSMDRQLELFRWLQTPEGCIAGGATNSWQGSYAQPSSDITTFYGMWYDWQPVYHDPPSNNWTGMQGWGMERVCSLYYVSGDERAGKVCQEWAKWVKDTTRVSGGEIVHATNLDWSGNPDEWNSSNFNKSNLNRSLHGTVSSEGVDLGSIASIIKGLMWVSMRDGDQEGINLSIEVMDAIENYKDDLGYSSHEARGDYDKFGGEVYIPSGWTGKNAQGANIKSGVTFIDIRPKYKQDPDWAQVEEYLNGGNPPEFNYHRFWAQTEIAVANGLIS

SEQ ID NO: 11185 - protein, 557 aa, Piromyces finnis
  Glyco_hydro_48
LTGDYSGVETAWSYIEKHMIPDSKNQPGNSKYNPSSPATYAAEHDDIDGYPSKLIFQDGIVGEDPIAKELSQAYGNWDIYIMHWIIDGDNWYGYGQQGDGTSKPSFINTFQRGASESTWKTVPHPCWEAMKWGGRNGFLDLFTVDNSYAKQWRYTAAPDADARAVQAAYFAYIWAEEDGVNLSSVAAKAAKLGDYLRYAQYDKYFKKIGNCVGSDKCSAGRGKNSAHYLISWYFAWGGGLQGDWAWRIGSSHTHSGYQNPLAAWILSTQAAFKPKSSTGAKDWATSLDRQLELFRWLQTPEGCIAGGATNSWQGSYAQPSSDITTFYGMWYDWQPVYHDPPSNNWTGMQGWGMERVCSLYYVSGDERAGKVCQEWAKWVKDTTRVSGGEIVHATNLDWSGNPDEWNSSNFNKSNLNRSLHGTVSSEGVDLGSIASIIKGLMWVSMRDGDQEGINLSIEVMDAIENYKDDLGYSSHEARGDYDKFGGEVYIPSGWTGKNAQGANIKSGVTFIDIRPKYKQDPDWAQVEEYLNGGNPPEFNYHRFWAQTEIAVANGLIS

SEQ ID NO: 11186 - protein, 620 aa, Piromyces finnis
  Glyco_hydro_48
GRRVTDLYDVMTGNGSYSSEYFSAEKVPYHSVETLMVEAPDHGHESVSETFSFWIWLEAVNGKITGNYDGVEEAWNYLEKHIIPDSKNQPGNSKYNPSSPATYAAEHDDIDGYPSKLIFQDGIVGEDPIAKELSQAYGNWDIYIMHWIIDGDNWYGYGQQGDGTSKPSFINTFQRGASESTWKTVPHPCWEAMKWGGRNGFLDLFTVDNSYAKQWRYTAAPDADARAVQAAYFAYIWAEEDGVNLSSVAAKAAKLGDYLRYAQYDKYFKKIGNCVGSDKCSAGRGKNSAHYLISWYFAWGGGLQGDWAWRIGSSHTHSGYQNPLAAWILSTQAAFKPKSSTGAKDWATSLDRQLELFRWLQTPEGCIAGGATNSWQGSYAQPSSDITTFYGMWYDWQPVYHDPPSNNWTGMQGWGMERVCSLYYVSGDERAGKVCQEWAKWVKDTTRVSGGEIVHATNLDWSGNPDEWNSSNFNKSNLNRSLHGTVSSEGVDLGSIASIIKGLMWVSMRDGDQEGINLSIEVMDAIENYKDDLGYSSHEARGDYDKFGGEVYIPSGWTGKNAQGANIKSGVTFIDIRPKYKQDPDWAQVEEYLNGGNPPEFNYHRFWAQTEIAVANGLIS

SEQ ID NO: 11187 - protein, 365 aa, Neocallimastix californiae
  Glyco_hydro_53
YKGVDISSIISLENSGVQFYDTNGQPQDIFKTLASVGVNCIRVRIWNSPRSTDGKTYGGGNNDLEVAREIGSRAAKAGLPLFVDFHYSDFWADPAKQSIPKEWKGFDLNKRIFEIYRFTKGCLEWLLENGSYISMVQIGNETTCFMCGENEMVNVMKMMSNGIQAVRDINKNILIALHFTNPNKTDNMLWYASQLAEAKVDYDVFCTSYYPFWHGTTENLQWILGEIANKYGKKVMVAEFSYPYTEVAKTSDNCEYSHVNHKLEGTEFNYPLTLDGQIQCIKDVYSHIKNTKNGIGAFYWEPAWIAPKASNDLERRQLWEKYGSSWATKTAAEYDINADSSLTGESAWDNQAVFDQEGKPLKSIW

SEQ ID NO: 11188 - protein, 365 aa, Neocallimastix californiae
  Glyco_hydro_53
YKGVDISSIISLENSGIRFYDTNGQQIDIFKMFASVGVNCIRVRIWNNPKSANGKTYGGGNNDLEVAREIGSRAASAGLPLFVDFHYSDFWADPGKQTIPKDWKNFNLDKRVSEIYRFTKGCLEWLLQNGSLISMVQIGNETTCFMCGDKNMTNVMKMMSNGAKAVREINRDILIALHFTNPNKSDNMLWYASQLASARVDYDVYSTSYYPYWHGTTDNLKWVLGEIANKYGKKVMIAEYSYPYTEVAYTSDNCHYGVVDSKASGTVFRYPISVDGQIQCIRDMYSVMRNTKNGIGAFYWEPAWIAPKARNDMERRQIWEQYGSSWATKTAAEYDSNADRNLTGGTSWDNQAIFDQNGKVLKSIW

SEQ ID NO: 11189 - protein, 365 aa, Anaeromyces robustus
  Glyco_hydro_53
YKGVDISSIISLENSGVKFYNPLGQEQDLFQILANVGVNCIRVRIWNSPKNANGKTYGGGGNDLEVARAIGSRAARYGLSLFVNFHYSDFWADPSKQTIPKEWKNFDLDKRIFEIYRFTKGCLEWLLENGSIISMVQIGNETTSFMCGEKNMTNVMKMMSNGVKAVRDISKNIVVALHFTNPNKADTMLWYASQLASARVDYDVFATSYYPYWHGTLDNLKGVLNKIANQYGKKVLIAEYSYPYTNAALTDDRCHYELISSSTSNIQLRYPVSIDGQIQSIRDIYKTIKEIKNGIGAFYWEPAWIAPKARNDAERKQIWEKYGSGWASTPAAEYDSDVDRYQTGGTTWDNQAVFTQNGKPLDSLY

SEQ ID NO: 11190 - protein, 319 aa, Neocallimastix californiae
  Glyco_hydro_6
INPYYVEEVDGAIAQMSDSSLIAKAEKMKTYSNAIWLDTIKNMQSWLESNLQGAQSQHQSSGKDVLTVFVVYDLPGRDCHALASNGELLANDGDFTRYKSEYIDVIEGHLKTYKSQPVVLIVEPDSLANMVTNLDSTPACRDSEKYYMDGHAYLIKKFGVLPHVAMYLDIGHAFWLGWDDNREKAGKVYAKVISSGAPGKVRGFTDNVANYTPWEDPTLSRGPETEWNPCPDEKRYLQAIQKDFKSAGIQSVYFVCDTSRNGKKVDRKHPGEWCNQTGVGIGARPQASPVSGMEYLDAFYWIKPLGESDGTSDESAARF

SEQ ID NO: 11191 - protein, 303 aa, Neocallimastix californiae
  Glyco_hydro_6
PDYQKQVKSSYDKLMAEGETEIAELVAKVARYPTPTWLANTAASKLVPKVLAQVTEQMKKTGKKVLTSFIIYNLPNRDCSAVASRGELGIEHLGVYKEWIDEIAGYFAAHEGPIVAIIEPDALGNMVSNSNSELCAEAFETQMEALVYAITKLNLPNVGVYQDVAQVGWLGWGGNMNLLIPILEQLLNKVGTGVLRGFSSNISNNQPLVRPDPPERTLSGNSSQSEYEYSLKVRENLKKVGMVDFGWVVDTSRNGVPNIKTKGENWCNIKGAGIGRRPEASPADLPGLDAVYWFKPPGESDGS

SEQ ID NO: 11192 - protein, 90 aa, Neocallimastix californiae
  Glyco_hydro_6
INPYYVKEVEGAIAQMSDSSLIAKAEKMKTFSNAIWLDSIKNMQSWLESNLKGALAQQNASGKDVLTVFVVYDLPGRDCHALASNGELLA

SEQ ID NO: 11193 - protein, 318 aa, Neocallimastix californiae
  Glyco_hydro_6
INPYYTAEVDAAIAQMSDSSLIAKAEKMKTYSNAIWLDTIKNMNEWLEKNLKGALAQQSGSKKVLTVFVVYDLPGRDCHALASNGELLANDGDLARYKSEYIDVIEGHLKTYKSQPVVLIVEPDSLANLVTNLESTPACADSEKYYLDGHAYLIQKFGILPHVAMYLDIGHAFWLGWDDNREKAAKVYSKVISSGSPGKVRGFTDNVANYTPWEDPTLSRGPDTEWNPCPDEKRYLEAMHKDFKAAGISSVYFVCDTSRNGKKVDRKHPGEWCNQTGVGIGARPQASPVSGMEYLDAFYWIKPLGESDGTSDESAARF

SEQ ID NO: 11194 - protein, 313 aa, Neocallimastix californiae
  Glyco_hydro_6
INPYYVEEVDGAIAQMSDSSLIAKAEKMKTYSNAIWLDTIKNMQSWLESNLQGAQSQHQSSGKDILTVFVVYDLPGRDCHALASNGELLANDGDLARYKSEYIDVIEGHLKTYKSQPVVLIVEPDSLANLVTNLESTPACADSEKYYLEGHAYLIKKLGVLPHVAMYLDIGHAFWLGWDDNREKAGKVYAKVISSGAPGNVRGFTDNVSNYTPWEDPTLSRGPETEWNPCPDEKRYLEAISKDFKSAGIKSVYFVSDSSRNGKKVDRKHPGEWCNQTGVGVGARPQASPISSMEYLDAFYWIKPLGESDGTSD

SEQ ID NO: 11195 - protein, 283 aa, Neocallimastix californiae
  Glyco_hydro_6
NSQYQGEVQSSINKLSGELQQQANRVKYTPTAVWLAWDGAPGEVPKHLGAAGGNTAVFMMYWIPTRDCNSNASQGGASDLNSYKNYVDSVYNSFRSYGNSKIVVVVEPDTLGNMVTSQGNENCRRTAVIHKQALAYAINKFGSLNNVQVYLDAGHSQWLTGYEDETAEIIKEILDMAPQGKIRGFSTNVSNFQPVQREYEYHTRLYDALEKVGVKNMRFIVDTSRNGVDISEEFAKTKTWCNFVGTGFGERPKGNPDPVNMPLLDAYMWLKPPAESDGSSTGA

SEQ ID NO: 11196 - protein, 319 aa, Neocallimastix californiae
  Glyco_hydro_6
INPYYVEEVDNAISQMSDSSLIAKAEKMKTYSNAIWLDNIKNMQSWLQPNLEGALSQQNSGGTPVLTVFVVYDLPGRDCHALASNGELLANDSDMERYKSEYIDVIEGHLKTYKSQPVVLVIEPDSLANMVTNIESTPACADSQNYYFDGHAYLLKKLGVFPNVALYLDIGHAFWLGWDDNREKAAKVYAKVIQSGAPAKVRGFVDNVANYTPWEDPTLSRGPDTEWNPCPDEKRYLEAMHKDFTSAGIQSVYFFSDSSRNGKKTDRKHPGEWCNQTGCGIGARPKASPISGMEYLDAFYWVKPIGESDGTSDTSAKRY

SEQ ID NO: 11197 - protein, 192 aa, Neocallimastix californiae
  Glyco_hydro_6
INPYYVDEVDGAIAQMSDSSLIAKAEKMKTYSNAIWLDTIKNMQSWLESNLKGALAEHNSTGKDILTVFVVYDLPGRDCHALASNGELLANSGDMERYKSEYIDVIEGHLKEYNSQPVVLIVEPDSLANLVTNLESTPACRDSEKYYLDGHAYLIQKLGVLPHVAMYLDIGHAFWLGWDDNREKAGKVYAKV

SEQ ID NO: 11198 - protein, 281 aa, Neocallimastix californiae
  Glyco_hydro_6
INPYYVDEVNGAIAQMSDSSLIAKAEKMKTYSNAIWLDTIKNMQSWLESNLEGALSQQESTGKKVLTVFVVYDLPGRDCHALASNGELLANSGDMERYKTEYIDVIEGHLKKYKSQPVVLIVEPDSLANMVTNIETTPACADSQNYYYDGHAYLLKKFGVLPHVAMYLDIGHAFWLGWDDNREKAGKVYAKVIQSGSPGKVRGFTDNVSNYTPWEDPTLSRGPETEWNPCPDEKRYLEAMHKDFKAAGIESVYFVSDTSRNGHKTDRKHPGEWCNQTGVGI

SEQ ID NO: 11199 - protein, 134 aa, Neocallimastix californiae
  Glyco_hydro_6
INPYYVEEVDGAIAQMSDSSLIAKAEKMKTYSNAIWLDTIKNMQSWLESNLQGAQSQHQSSGKDILTVFVVYDLPGRDCHALASNGELLANDGDLARYKSEYIDVIEGHLKTYKSQPVVLIVEPDSLANLVTNL

SEQ ID NO: 11200 - protein, 282 aa, Neocallimastix californiae
  Glyco_hydro_6
SPNYVKEIESTIPDLSPELQAKAKNVEKVSSAVWLAYEGAPNDVAPHLKAAGSKTVTFILYMIPTRDCNSLASAGGVSDLDKYKGYVDKIANTIKKFPESKVVMVIEPDTLGNLITGETEACKNVHTLHKQALAYAANVFGNMSNVSAYLDAAHSKWLGWAADKVAAVVKEILDNAPNANIRGFSTNVSNYMPIEAEYEYHQKLHDALEEVGIKDKRFIVDTGRSGVDVREEFDVNQTWCNLIYAGLGEPSRGSPDPENMPLLDAFMWLKPPGEADGSDTGS

SEQ ID NO: 11201 - protein, 85 aa, Neocallimastix californiae
  Glyco_hydro_6
INPYYVEEVDGAIAQMSDSSLIAKAEKMKTYSNAIWLDTIKNMQSWLESNLQGAQSQHQSSGKDILTVFVVYDLPGRDCHALASN

SEQ ID NO: 11202 - protein, 319 aa, Neocallimastix californiae
  Glyco_hydro_6
INPYYVEEVDNAISQMSDSSLIAKAEKMKTYSNAIWLDNIKNMQSWLEPNLKGALSQQNSGGTPVLTVFVVYDLPGRDCHALASNGELLANDSDMERYKSEYIDVIEGHLKTYKSQPVVLVIEPDSLANMVTNIESTPACADSQTYYYDGHAYLLKKLGVFPNVALYLDIGHAFWLGWDDNREKAAKVYSKVIQSGSPAKVRGFVDNVANYTPWEDPTLSRGPDTEWNPCPDEKRYLEAMHKDFKAAGIQSVYFFSDSSRNGKKTDRKHPGEWCNQTGCGVGARPKASPISGMEYLDAFYWVKPIGESDGTSDTSAKRY

SEQ ID NO: 11203 - protein, 73 aa, Neocallimastix californiae
  Glyco_hydro_6
INPYYVEEIEGAIAQMSDSSLIAKAEKMKTYSNAIWLDSIKNMQSWLETNLKGALSQQNASGKDVLTVFVVYD

SEQ ID NO: 11204 - protein, 306 aa, Neocallimastix californiae
  Glyco_hydro_6
INPYYTTEVDAAITKISNASLIAKAEKMKEFSNAIWLDSIKNMNELLESSLNGALAQQESGYKKVLTVFVVYNLPGRDCHALASNGELLANDADFDRYKSEYIDVIEGHLKTYKSQPVVLIVEPNSLTNLVTNLESTPACSDSEKYYREGNAYLIKKFGVLPHVALYLDIGHAYLLGWDDTREKAARLYHDVIRSGAPGNIRGFADNIGGFVPWDDPNLSNGPETEWNPCPDEKRYLKAMYSDFVSAGIHSVKFVTDTSHNGKKFDYSDRELWCKSTSAGVGARPMAIPITTIDYLDAFYWIKPFG

SEQ ID NO: 11205 - protein, 301 aa, Neocallimastix californiae
  Glyco_hydro_6
YQKQVKSSYDKLIAEGETEVAEIVAKVARYPTPTWLANTAASKLVPKVLAQVTEQMKQTGKKILTSFIIYNLPNRDCSAVASRGELGTEHLGVYKEWIDEIAGYFAAHEGPIVAIIEPDALGNMVGNSNSELCAEAFETQMEALVYAITKLNLPNVSVYQDVAQVGWLGWGGNMRLLIPILEQLLNKVGTGVLRGFSSNISNNQPLTKPDPPEKTLSGCTSQSEYEYSLNVREALRKVGMVDFGWVVDTSRNGVPNIKTKGENWCNIKGAGIGRRPEATPEDLPGLDAVYWFKPPGESDGS

SEQ ID NO: 11206 - protein, 283 aa, Neocallimastix californiae
  Glyco_hydro_6
NFKFQGEVDSSIKKLSGNVKQKAEKVKYVPTAAWLAWEGAPNEVPQYLDEAGSKTVVFVLYMIPTRDCNANASAGGTANIDKYKSYVDKIYNTINKYPNSRIVMILEPDTIGNLVTANNANCRNVQNMHKQALSYAISKFGTQSNVRVYLDAAHGAWLNPHADKTAQVIKEILNNAGNGKLRGISTNVSNYQSVASEYKYHQNLNRALENLGVRGLKFIVDTSRNGANVEGAFNASGTWCNFKGAGLGERPKGNPNPGSMPLLDAYMWIKTPGEADGSSQGSR

SEQ ID NO: 11207 - protein, 282 aa, Neocallimastix californiae
  Glyco_hydro_6
NSQYQSEVQSSINKLSGELQQQASRVKYTPTAVWLAWYGAPNEVPKHLGAAGGNTAVFIMYWIPTRDCNSNASQGGASDLNSYKNYVDSVYNTFRSNGNSRIVIVIEPDTIGNIVTSQGNENCRRTAIIHKEALAYAVNKFGSLNNVQVYLDAGHSQWLTGYEDETAAIIKEILDMAPQGKIRGFSTNISNFQPVQREYEYHTRLYDALEKVGISNMRFIVDTSRNGVDISEAFAKTKTWCNFVGTGFGERPKGNPDPINMPLLDAYMWLKPPAESDGSSQG

SEQ ID NO: 11208 - protein, 319 aa, Neocallimastix californiae
  Glyco_hydro_6
INPYYVEEVDGAIAQMIDASLISKAEKMKTFSNAIWLDTIKNMQSWLEPNLKGALAQQKSAGKEVLTVFVVYDLPGRDCHALASNGELLANKGDWARYKSEYIDVIEEKLRTYKSQPVVLIVEPDSLANMVTNLDSTPACRDSERYYMDGHAYLIQKFGVLPHVAMYLDIGHAFWLGWDDNRQKAGKVYSKVIQSGAPGKVRGFTDNVANYTPWEDPTLSRGPETEWNPCPDEKRYLEAIHKDFTAVGIPSVYFVCDTSRNGKKVDRKHPGEWCNQTGVGIGARPQASPISGMPYLDAFYWIKPLGESDGTSDTSAARF

SEQ ID NO: 11209 - protein, 319 aa, Neocallimastix californiae
  Glyco_hydro_6
VNPYYVDKVDKAIAQMHDYDSSLKFKAEKMKEYSNAIWLDTINNMEAWLERNLKGALAQQNAEGSRVLTVFVVYDLPGRDCQALASNGELLANNGDMKRYKSEYIDIIDRRLSTYKSQPIVLVIEPNSLANLVTNLENIPACADSEKYYLDGHAYLIKKFGSHPHVAMYLDIGHAFWLGWDDKRASAAKIYSKVINPGAPGKVRGFASNVANYTPWEDPELSRGPDTEWNPCPDEKRYIKAMYKEFKAAGISSVYFIEDTSRNGHKTYRNHSGEWCNQMGSGIGARPKAYPVSGMEYLDAFYWVKPYGESDGTSDESDK

SEQ ID NO: 11210 - protein, 318 aa, Neocallimastix californiae
  Glyco_hydro_6
LNPYYVEEVENALNNLIDSSLRSKVEKMKTFSNAIWLDTINNMQSWLEPNLKGALAQHQSTGKDVLTVFVVYDLPGRDCHALASNGELLANDADAQRYKTEYIDVIESHLKQYTAQPVVLIIEPDSLANMVTNLDDPHCSQSESYYMDGHAYLLKKFGVLDHVAMYLDIGHAFWLGWDDNREKAAKLYKKVIDSASPGKVRGFVDNVANYTPWEDPTLSRGPDTDWNPCPDEKRYLEAVKKDFTSAGIKSVYFVSDTSRNGHKTDRKHPGEWCNQTGVGVGARPQASPVSGMDYLDAFYWIKPLGESDGTSDESAVRF

SEQ ID NO: 11211 - protein, 319 aa, Neocallimastix californiae
  Glyco_hydro_6
LNPYYVEEVENAIKQMTSSSLKAKAEKMKTYSNAIWLDNIKNMQSWLEPNLKGALAQHQSTGKDVLTVFVVYDLPGRDCHAMASNGELLANDSDAQRYKTEYIDVIESHLKKYTAQPVVLIIEPDSLANMVTNIENTPACAESETYYYDGHAYLLKKFGVLDHVAMYLDIGHAFWLGWDDNREKATKVYKKVIDSGSPGKVRGFVDNVANYTPWEDPTLSRGPDTEWNPCPDEKRYLEAMYKDFTSAGIKSVYFVSDSSRNGHKTDRKHPGEWCNQTGVGIGARPQASPISGMDYLDAFYWIKPLGESDGTSDESADRF

SEQ ID NO: 11212 - protein, 319 aa, Neocallimastix californiae
  Glyco_hydro_6
LNPYYVEEVENAIKQMTSSSLKAKAEKMKTYSNAIWLDNIKNMQSWLEPNLKGALSQHQSTGKDVLTVFVVYDLPGRDCHALASNGELLANDSDAQRYKTEYIDVIEKQLKQYTAQPVVLIIEPDSLANMVTNIETTPACAESQDYYFDGHAYLLKKFGVLDHVAMYLDIGHAFWLGWDDNREKASKVYKKVIDSGSPGKVRGFVDNVANYTPWEDPTLSRGPETEWNPCPDEKRYLQAMYKDFTAAGIKSVYFVSDSSRNGHKTDRKHPGEWCNQTGVGIGARPQASPISGMSYLDAFYWIKPLGESDGTSDESAARF

SEQ ID NO: 11213 - protein, 318 aa, Neocallimastix californiae
  Glyco_hydro_6
INPYYTAEVDAAIAQMSDSSLISKAEKMKTFSNAIWLDTIKNMNEWLEKNLKGALAQQTGNKKVLTVFVVYDLPGRDCHALASNGELLANDSDWARYKTEYIDVIEEKLKTYKSQPVVLIIEPDSLANLVTNLDSTPACRDSEKYYLDGHAYLIQKFGVLKHVAMYLDIGHAFWLGWDDNREKAAKVYSKVISSGAPGEVRGFTDNVANYTPWEDPTLSRGPDTEWNPCPDEKRYLEAIHKDFVSAGIKSVYFVSDTSRNGKKVDRKHPGEWCNQTGVGVGARPQANPVSGMDYLDAFYWIKPLGESDGTSDESAARF

SEQ ID NO: 11214 - protein, 318 aa, Neocallimastix californiae; identical to SEQ ID NO: 11213
  Glyco_hydro_6

SEQ ID NO: 11215 - protein, 319 aa, Neocallimastix californiae
  Glyco_hydro_6
INPYYVEEVDGAIAQMSDSSLISKAEKMKTYSNAIWLDSIKNMQSWLESNLKGALSQQNASGQDVLTVFVVYDLPGRDCHALASNGELLANDSDWARYKTEYIDVIEGHLKTYKSQPVVLIIEPDSLANMVTNLDSTPACRDSEKYYMDGHAYLIQKFGVLPHVAMYLDIGHAFWLGWDDNRQKAGKVYSKVISSGAPGKVRGFTDNVANYTPWEDPTLSRGPETEWNPCPDEKRYLEAMYKDFKAAGIESVYFVCDSSRNGKKVDRKHPGEWCNQTGAGVGYRPQANPISGMSYLDAFYWIKPLGESDGTSDESAARF

SEQ ID NO: 11216 - protein, 282 aa, Neocallimastix californiae
  Glyco_hydro_6
NFKFQGEVDTSIAKLSGQLQEKAKKVKYVPTAAWLAWEGATNEVPQYLNEAGDKTVVFVLYMIPTRDCNANASVGGSGSLDKYKGYVDNIYNTINRYPNSRIVMILEPDTIGNLVTANNDNCRNVQNMHKQALSYAISKFGTQSNVRVYLDAAHGAWLNSHADRTAQVIAEILRNAGNGKIRGISTNISNYQQVSDEYQYHQNLNRALESQGFRGMKFIVDTSRNGQNVTAAFSRNNTWCNFKGAGLGPRPQANPNPNMPLLDAYMWIKTPGEADGSATGSR

SEQ ID NO: 11217 - protein, 281 aa, Neocallimastix californiae
  Glyco_hydro_6
NQDYVKKIESTLKDMTPELQAKAKNVEKVATAVWLAWEGAPGEVEPHLKAAGNKTITFILYMIPTRDCNSLASAGGAADFEKYQGYVDSIAATIKKYPDAKVNMVIEPDTLGNLITGETEACKKVHDLHRKALSYAVNVFGNMSNVNAYLDAAHHKWLGWGTDKVAALIKDILDNAPDGDIRGISTNVSNYQSIDNEYQYHTDLHAALEAVGITGKKFIVDTGRSGVDVTEEFNVNQTWCNLIYAGLGEKSRGNPDPEKYPLLDAFMWLKPPAESDGSDVG

SEQ ID NO: 11218 - protein, 298 aa, Neocallimastix californiae
  Glyco_hydro_6
VKSSYDQLIAEGQNDVAEIVAKVARYPTPTWLANTQASKLVPKVLAQVTEQMKATGKKILTAFIIYNLPNRDCSAVASRGELGIEHLGVYKEWIDEIAGYFKAHEGPIVAIIEPDALGNMVSNSNSELCAEAFDTQMEAIVYAINKLSLPNVSVYQDVAQVGWLGWTGNMNILVPILEQILNKVGTGKLRGFSSNISNNQPLVKPDPPEATLSGNKSQSEYEYSLNVREALRKVGIADMGWVVDTSRNGRTNIKTRGENWCNIKGAGIGRRPEANPADLPELDAVYWFKPPGESDGSD

SEQ ID NO: 11219 - protein, 144 aa, Neocallimastix californiae
  Glyco_hydro_6
INPYYVDEVDKAIAQMNGSLRIKAEKLKEYSNAIWLDTIHKMEVRLERNLRGALAQQNAEGSRVLTVFVVYDLPGRDCQALASNGELLANDGDMKRYKTEYIDIIDSVLISYHSQPIVLVIEPNSLANLVTNLENIPACADSEK

SEQ ID NO: 11220 - protein, 101 aa, Anaeromyces robustus
  Glyco_hydro_6
LNPYYVEEVENAIKQMTSSSLKAKAEKMKTYSNAIWLDNIKNMQSWLEPNLKGALSQHQSTGKDVLTVFVVYDLPGRDCHALASNGELLANDSDAQRYKTE

SEQ ID NO: 11221 - protein, 319 aa, Anaeromyces robustus
  Glyco_hydro_6
INPYYVDEVDKAIAQMTNSSLKAKAEKMKTFSNAIWLDTIKNMNEWLERNLKGALAQQNASNKNVLTVFVVYDLPGRDCHALASNGELLANDSDFARYKSEYIDVIETHLKKYTAQPVVLIIEPDSLANMVTNIENTPACAESETYYYDGHAYLLKKFGVLDHVAMYLDIGHAFWLGWDDNREKATKVYKKVIDSGSPGKVRGFVDNVANYTPWEDPTLSRGPDTEWNPCPDEKRYLEAMYKDFTSAGIKSVYFVSDSSRNGHKTDRKHPGEWCNQTGVGIGARPQASPISGMSYLDAFYWIKPLGESDGTSDESAARF

SEQ ID NO: 11222 - protein, 282 aa, Anaeromyces robustus; identical to SEQ ID NO: 11216
  Glyco_hydro_6

SEQ ID NO: 11223 - protein, 86 aa, Anaeromyces robustus
  Glyco_hydro_6
LNPYYVEEVENALNNLIDSSLRSKVEKMKTFSNAIWLDTINNMQSWLEPNLKGALAQHQSTGKDVLTVFVVYDLPGRDCHALASNG

SEQ ID NO: 11224 - protein, 298 aa, Anaeromyces robustus; identical to SEQ ID NO: 11218
  Glyco_hydro_6

SEQ ID NO: 11225 - protein, 204 aa, Anaeromyces robustus
  Glyco_hydro_6
NQDYVKKIESSLKSMSPELQAKAKNVEKVATAVWLAWEGAPGEVAPHLKAAGNKTITFILYMIPTRDCNSLASAGGAADFEKYQGYVDSIAATIKKYPNAKVNMVIEPDTLGNLITGETEACKKVHDLHRKALSYAVNVFGNMSNVNAYLDAAHHKWLGWGTDKVAALIKDILDNAPDGDIRGISTNVSNYQSIENEYQYHSDL

SEQ ID NO: 11226 - protein, 281 aa, Anaeromyces robustus; identical to SEQ ID NO: 11217
  Glyco_hydro_6

SEQ ID NO: 11227 - protein, 237 aa, Anaeromyces robustus
  Glyco_hydro_6
INPYYVEEVDNAIAQMTDSSLKAKAEKMKTYPNAIWLDNIKNMQSWLQPNLEKALAQQSGSKKVLTVFVVYDLPGRDCHAMASNGELLANDSDAQRYKTEYIDVIEEQLKKYKSQPIVLIIEPDSLANMVTNIETTPACAESQDYYFDGHAYLLKKFGVLQHVAMYLDIGHAFWLGWDDNREKAAKVYKKVIDSGSPGKVRGFVDNVANYTPWEDPTLSRGPDTEWNPCPDEKRYLE

SEQ ID NO: 11228 - protein, 283 aa, Anaeromyces robustus
  Glyco_hydro_6
NYQYQSEVQSSINKLSGNLQQQANRVKYVPTAVWLAWDGAPKEVQRHLSSANGSTAVFIMYWIPTRDCNSNASQGGANDLNAYKSYVDDVANTFRSNQGSRIVIVVEPDTIGNMVTSQNNENCRRTAVIHKQALAYAVNRFGSLNNVQVYLDAGHSQWLTGYEDETAAVIKEILDMANQGKIRGFSTNVSNFQPIDKEYEYQTRLYDALENVGITDMRFVIDTSRNGQDISEAFAKTKTWCNLVGTGFGERPKGNPDPINMPLLDAYMWLKPPAESDGSSQGM

SEQ ID NO: 11229 - protein, 298 aa, Anaeromyces robustus
  Glyco_hydro_6
VKSSYDQLIAEGEPEIAEIVAKVAKYPTPTWLTNTDAAKLVPQVLSQVTKQMKKTGKKILTSFIIYNLPNRDCSAVASRGELGIEHLGVYKEWIDEIAGYFKNHEGPIVAVVEPDAFGNMINSNDNELCKEAFDTQMEALVYAITHLNAPNVGVYLDLAQVGWLGWSGNMRFLIPLLEEVLNKVGTGILRGFTSNISNYQPLVKPEVPEVTLSGNPSQSEYEYSLNVREALKKIGMVDFGWVVDTSRNGVSNIKTKGESWCNIKGAGIGRRPEANPPDLPGLDAVYWFKPPGESDGSD

SEQ ID NO: 11230 - protein, 303 aa, Anaeromyces robustus
  Glyco_hydro_6
VDPNYQQELDNLSSTIKDPTVIEKVEKMKQYSTGIWLDSIQSVNELLESNLDNAYAQQVESGKNVLTTFVLYNLPGRDCHAITTNGELLAKDSDLERYKHEYIDVIEEIIKKHNNQPIAFVVEPTSLPSIATFKKSTPACADTEKYYLEGHSYLIKKLGVLPNVFLYLDVGHAFWLGWDDLREETAKLYAKVIQSGAPGIVRGFADNISNYVPWDDANLTNGPNTEYNPYPDSKRYIESLRKDFVSVGIKNVNFISDTSLTTINNGSSPVEDWCYNAPLGIGARPQANPVSDMSYLDAFVWIK

SEQ ID NO: 11231 - protein, 282 aa, Anaeromyces robustus
  Glyco_hydro_6
NQDRKDRVQSSINRLSGELKAKAQKIQDAPTAIWLSWDKAPETVSFHLDEAGNQTAVFILYWIPTRDCNSIASQGGAQSMDEYHTYVNRIVNGFKSHPNSKIVVVVEPDTLGNMITSQSNDNCKKVHNLHKQAIAYAIDTFGQIDNVRTYIDAAHGRWLGSHADEAAAIIKEIIDMAPNSNVRGLSTNVSNYQPTEDEYAYHQKLSAELEKLGVHNMKFIVDTARNGVDVAESLVKTGTWCNVKGTGFGERPRGSPDPVNKPLLDAYMWLKPGGDSDGSSTG

SEQ ID NO: 11232 - protein, 158 aa, Piromyces finnis
  Glyco_hydro_6
IKSSYDKLIAEGENEVAEIVAKVARYPTPTWLASTDSVKLVPKVLAQVTEQMKKTGKKVLTSFIIYNLPNRDCSAQASRGELGIEHLGKYKEWIDEIAGYFAAHEGPIVAIVEPDAMGNMVSHNDNPVCEEAFDTQMEALVSAITKLNMKNVGVYMDL

SEQ ID NO: 11233 - protein, 296 aa, Piromyces finnis
  Glyco_hydro_6
KSSYDKLIAEGENEVAEIVAKVARYPTPTWLASTDSVKLVPKVLAQVTEQMKKTGKKVLTSFIIYNLPNRDCSAQASRGELGIEHLGKYKEWIDEIAGYFAAHEGPIVAIVEPDAMGNMVSHNDNPVCEEAFDTQMEALVYAITKLNMKNVGVYMDLAQVGWLGWSGNMRFLIPILEQLLNKVGTGVLRGFSSNISNTQPLVRPETLDVTLAGNPSQSEYEYSLNVREELKKIGMVDFGWVVDTSRNGVSNIKTKGEYWCNIKGSGIGRRPEANPADLPGLDAVYWFKPPGESDGS

SEQ ID NO: 11234 - protein, 296 aa, Piromyces finnis; identical to SEQ ID NO: 11233
  Glyco_hydro_6

SEQ ID NO: 11235 - protein, 207 aa, Piromyces finnis
  Glyco_hydro_6
SPRYVEEIESSMPDMSDELKAKAKNVMNVSSAVWLAWEGAPNEVEGHLKAAGSKTITFILYMIPTRDCNSLASAGGASDLKKYQGIVDKIANTISKYPDVKVAMVIEPDTLGNLITGSTEACKNVHTLHKNALSYAANVFGNMSNVSAYLDAAHGKWLGWAADKTAAVIKEILDNAPNANIRGFSTNVSNYQSIEKEYAYHEALNAA

SEQ ID NO: 11236 - protein, 280 aa, Piromyces finnis
  Glyco_hydro_6
NPRFIEEIDSSIPKLSGDLAAKAEKVKQVPTAVWLAWDGAPGEVEGHLAAAGSKTVVFILYMIPTRDCNSLASAGGASDLKKYQGIVDKIANTISKYPDVKVAMVIEPDTLGNLITGSTEACKNVHTLHKNALSYAANVFGNMSNVSAYLDAAHGKWLGWAADKTAAVIKEILDNAPNANIRGFSTNVSNYQSIEKEYAYHEALNAALEKLGITGKKFIVDTGRSGVDVTEEFDVNQTWCNFVYAGLGEPSRGSPDLEKMPLLDAYMWLKPPGEADGSDV

SEQ ID NO: 11237 - protein, 280 aa, Piromyces finnis
  Glyco_hydro_6
SPRYVEEIESSMPDMSDELKAKANNVMNVSSAVWLAWEGAPNEVEGHLKAAGSKTITFILYMIPTRDCNSLASAGGASDLKKYQGIVDKIANTISKYPDVKVAMVIEPDTLGNLITGSTEACKNVHTLHKNALSYAANVFGNMSNVSAYLDAAHGKWLGWAADKTAAVIKEILDNAPNANIRGFSTNVSNYQSIEKEYAYHEALNAALEKLGITGKKFIVDTGRSGVDVTEEFDVNQTWCNFVYAGLGEPSRGSPDLEKMPLLDAYMWLKPPGEADGSDV

SEQ ID NO: 11238 - protein, 280 aa, Piromyces finnis; identical to SEQ ID NO: 11237
  Glyco_hydro_6

SEQ ID NO: 11239 - protein, 172 aa, Piromyces finnis
  Glyco_hydro_6
EPDTLGNLVTGSSEACKTVHTLHKNALSYAVNVFGAMSNVSVYLDAAHGKWLGGVTDKVATVVKEILDGAPNGKIRGLSTNVSNYQPVSAEYGYHQKLASSLSAVGVSDMHFIVDTGRNGVDVSSTFSINETWCNFVGTGFGERPQGNPSGMPLLDAYMWLKPPGEADGSDV

SEQ ID NO: 11240 - protein, 319 aa, Piromyces finnis
  Glyco_hydro_6
INPYYTAEVDAAIAQMSNSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRY

SEQ ID NO: 11241 - protein, 319 aa, Piromyces finnis
  Glyco_hydro_6
INPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRY

SEQ ID NO: 11242 - protein, 319 aa, Piromyces finnis; identical to SEQ ID NO: 11240
  Glyco_hydro_6

SEQ ID NO: 11243 - protein, 319 aa, Piromyces finnis; identical to SEQ ID NO: 11240
  Glyco_hydro_6

SEQ ID NO: 11244 - protein, 319 aa, Piromyces finnis
  Glyco_hydro_6
INPYYTAEVDAAIAQMSNSSLIAKAEKMKEYSNAIWLDTIENMNNWLERNLKTALAEQNQTGKTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRY

SEQ ID NO: 11245 - protein, 319 aa, Piromyces finnis; identical to SEQ ID NO: 11240
  Glyco_hydro_6

SEQ ID NO: 11246 - protein, 319 aa, Piromyces finnis; identical to SEQ ID NO: 11244
  Glyco_hydro_6

SEQ ID NO: 11247 - protein, 319 aa, Piromyces finnis; identical to SEQ ID NO: 11241
  Glyco_hydro_6

SEQ ID NO: 11248 - protein, 319 aa, Piromyces finnis; identical to SEQ ID NO: 11241
  Glyco_hydro_6

SEQ ID NO: 11249 - protein, 319 aa, Piromyces finnis; identical to SEQ ID NO: 11241
  Glyco_hydro_6

SEQ ID NO: 11250 - protein, 319 aa, Piromyces finnis; identical to SEQ ID NO: 11240
  Glyco_hydro_6

SEQ ID NO: 11251 - protein, 319 aa, Piromyces finnis; identical to SEQ ID NO: 11241
  Glyco_hydro_6

SEQ ID NO: 11252 - protein, 319 aa, Piromyces finnis; identical to SEQ ID NO: 11240
  Glyco_hydro_6

SEQ ID NO: 11253 - protein, 319 aa, Piromyces finnis; identical to SEQ ID NO: 11240
  Glyco_hydro_6

SEQ ID NO: 11254 - protein, 319 aa, Piromyces finnis; identical to SEQ ID NO: 11240
  Glyco_hydro_6

SEQ ID NO: 11255 - protein, 319 aa, Piromyces finnis; identical to SEQ ID NO: 11241
  Glyco_hydro_6

SEQ ID NO: 11256 - protein, 319 aa, Piromyces finnis; identical to SEQ ID NO: 11240
  Glyco_hydro_6

SEQ ID NO: 11257 - protein, 319 aa, Piromyces finnis; identical to SEQ ID NO: 11244
  Glyco_hydro_6

SEQ ID NO: 11258 - protein, 282 aa, Piromyces finnis
  Glyco_hydro_6
NFKFQAEVQSSINKLSGSLAEKAKKVKYVPTAAWLAWEGAPAEVPQYLDEAGSNTVVFVLYMIPTRDCNANASAGGSSNIEKYKGYVDKIYNTINQYPNSRIVMILEPDTIGNLVTANNDNCRNVQNMHKQALSYAISKFGTQSNVRVYLDAAHGAWLSSHADKTAQVIKEILNNAGNGKLRGISTNVSNYQTVNDEYNYHMRLNSALENLGVRGMKFIVDTSRNGANISGAFNASGTWCNFKGAGLGARPQGSPDPSKPLLDAYMWIKTPGEADGSSSGSR

SEQ ID NO: 11259 - protein, 319 aa, Piromyces finnis
  Glyco_hydro_6
INPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRY

SEQ ID NO: 11260 - protein, 319 aa, Piromyces finnis
  Glyco_hydro_6
INPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNIESTPACAKSEKYYYDGHAYLIKKFGVLPHVSMYLDIGHAFWLGWDDNREKAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRY

SEQ ID NO: 11261 - protein, 319 aa, Piromyces finnis; identical to SEQ ID NO: 11259
  Glyco_hydro_6

SEQ ID NO: 11262 - protein, 319 aa, Piromyces finnis; identical to SEQ ID NO: 11260
  Glyco_hydro_6

SEQ ID NO: 11263 - protein, 319 aa, Piromyces finnis; identical to SEQ ID NO: 11260
  Glyco_hydro_6

SEQ ID NO: 11264 - protein, 319 aa, Piromyces finnis; identical to SEQ ID NO: 11259
  Glyco_hydro_6

SEQ ID NO: 11265 - protein, 319 aa, Piromyces finnis; identical to SEQ ID NO: 11259
  Glyco_hydro_6

SEQ ID NO: 11266 - protein, 319 aa, Piromyces finnis; identical to SEQ ID NO: 11259
  Glyco_hydro_6

SEQ ID NO: 11267 - protein, 319 aa, Piromyces finnis; identical to SEQ ID NO: 11259
  Glyco_hydro_6

SEQ ID NO: 11268 - protein, 319 aa, Piromyces finnis; identical to SEQ ID NO: 11259
  Glyco_hydro_6

SEQ ID NO: 11269 - protein, 319 aa, Piromyces finnis; identical to SEQ ID NO: 11260
  Glyco_hydro_6

SEQ ID NO: 11270 - protein, 319 aa, Piromyces finnis; identical to SEQ ID NO: 11259
  Glyco_hydro_6

SEQ ID NO: 11271 - protein, 308 aa, Neocallimastix californiae
  Glyco_hydro_8
VNNNDVRSEGMSYGMMICVQTDHREEFDKIWNWAKNHMWHKSGSWDGYFAWKRGSNGYGGDDNCAPDGEMYFMMSLLFAANRWNNKQYMDDAQYILKRMWDNSQHSLFNPRYNVITFQPQGNENNFSDPSYDLPAFVDLFSRWSTTNQGKWKAAASATRDHLYKSSNTKSGLFSDYNNFDGTPHSVSYNSNAQKYMYDAMRCAMNFGMDYYLFGADAKRQTEMARRLIDFFEKDGYQHARFNWDGSNPSEQYTLGEVGANAVATYALMGVNGYEDIIKKNLKMAWDGEPMTGQYRYYDGLVHYLSMLH

SEQ ID NO: 11272 - protein, 304 aa, Neocallimastix californiae
  Glyco_hydro_8
NNNDVRSEGMSYGMMIAVQTNHKEEFDKLWNWAKNHMWHKGGGWDGYFAWQRNTSGNGGDDNCAPDGEMYFMMSLLFAANRWNNKQYMDDAQYIIKRMWDNPQHKLFNQQNNIITFQPQGTGNNFSDPSYDLPAFVDLISRWSTTNQNRWKSAAQATRDHLYKSSNTRSGLFSDYNNFDGTPHSESYNQNASKYMYDAMRCAMNFGMDYYLFGSDAKRETEMAKRIIDFFEKDGYKHARFNWDGSGASEQYTQGETGANAVACFALMGTQGYESIIKKNLQMAWDVKPMTGQYRYYDGLVHYLA

SEQ ID NO: 11273 - protein, 304 aa, Anaeromyces robustus; identical to SEQ ID NO: 11272
  Glyco_hydro_8

SEQ ID NO: 11274 - protein, 305 aa, Piromyces finnis
  Glyco_hydro_8
NNNDVRSEGMSYGMMIAVQTDHQKEFDKLWNWAKNHMWHKSGSWDGYFAWKRGSNGSGGDDNCAPDGEMYFMMSLLFAANRWNDKKYMDDAQYILKRMWDNSQHSLFNPAYNVITFQPQGNENNFSDPSYDLPAFVDLFSRWSTTNQNKWKAAASATRDHLYKSSNPQSGLFSDYNNFDGTPHSVSYNSNAQKYMYDAMRCAMNFGMDYYLFGTDAKRQTEMAKRIINHFEKDGYQHARFNWDGTGGSEQYTLGETGANAVATYALMGIAGYEDIIKKNLKMAWDGKPMTGQYRYYDGLVHYLSM

SEQ ID NO: 11275 - protein, 305 aa, Piromyces finnis; identical to SEQ ID NO: 11274
  Glyco_hydro_8

SEQ ID NO: 11276 - protein, 262 aa, Piromyces finnis
  Glyco_hydro_8
WDGYFAWKRGSNGSGGDDNCAPDGEMYFMMSLLFAANRWNDKKYMDDAQYILKRMWDNSQHSLFNPAYNVITFQPQGNENNFSDPSYDLPAFVDLFSRWSTTNQNKWKAAASATRDHLYKSSNPQSGLFSDYNNFDGTPHSVSYNSNAQKYMYDAMRCAMNFGMDYYLFGTDAKRQTEMAKRIINHFEKDGYQHARFNWDGTGGSEQYTLGETGANAVATYALMGIAGYEDIIKKNLKMAWDGKPMTGQYRYYDGLVHYLSM

SEQ ID NO: 11277 - protein, 246 aa, Neocallimastix californiae
  Glyco_hydro_88
TWNYIDGVFLNSVINLYKKTNNEKYKDFFIKYVNYYVSEDGTFVHYTADGVKTVDNEMGWVNGELDTVCESKILFDAYEMTGDKRYLTAIEFTYKKLMEMPYCYNSPNFWHKTFYINQIWLDGMYMYAPFLARYALLKNDLSILDDIKNQYAFIHDNMRDENGLYHHGFDTTKTIFWSKNNDGKSENFWLRSMGWFAVSLADILEYYPEGENKEYLKSILEELLNGILPYQDKTTKMFYQVIDRPE

SEQ ID NO: 11278 - protein, 247 aa, Neocallimastix californiae
  Glyco_hydro_88
GKWNYIDGVFLNSVVNLYKKTNNEKYKEFFIKYINYYVAEDGTFVHYTEDGVKTVDNDLGWVTGELDTVCESKILFDAYEMTGDKRYLTAIEFTYQKLMEMPLCYNSPNFWHKTFYINQIWLDGMYMYAPFLARYAVLKNDLSILDNIKEQYAFIHDNMRDENGLYHHGFDTTKTIFWSKNNDGKSENFWLRSMGWFAVSLADILEYYPEGENKEYLKNVLEELLNGILPFQDKTTKMFYQVIDKPE

SEQ ID NO: 11279 - protein, 432 aa, Neocallimastix californiae
  Glyco_hydro_9
YARHIELSLLFYEAQRSGKLPEDNRIYWRHDSELEAGADHGVDLTGGYYDAGDNAKFNFPAASTMTLLAWSGIDYAEGYKNAGQWKYILDAVRWGADYFIKCHTGKTELYAQVGDGNTDHSFWYPPEYVQYDYPSFKVTAQEPGSEVAGETAAFLAAASILFKDEDPSYSATLLKHSKEIYDFADKYRGDYTVAVPAVSFYNTYSGYMDELAWGAAWLLRATGDESYLDKYNVIANKKYESYDPKKFTGATGPISWDDKRPGCYILMAMITGDEKRINEAYSYCDAVLTQPRTKGGLWYDDGLSIWGSNRYASNAASMLGMFANYLPKSDPKRAKYVEFVKQQTDYILGDNPAKINYVVGAEANSPKAVHHRGASGVFDSQDKAAKPDENIYTLWGALAGGPDKNDKFVDSRKDYQMSEVALDYNAAFQMNL

SEQ ID NO: 11280 - protein, 434 aa, Neocallimastix californiae
  Glyco_hydro_9
YARHIELSLLFYEAQRSGKLPENNRIYWRHDSLLDAGADNKVDLTGGYYDAGDNVKFNFPAAAALTLLAWSGIDYADGYKKAGQWDYLLDAVKWGADYFLKCHTGKNELYVQVGKGATDHGFWYPPEYVQYEYPSYKITSSAPGSEVAGDTASFLAASSILFKDVDSSYSATLLKHAKEIYDFADTYRGEYIKAVPDAQGFYSNWSGCDDELAFGALWLYRATKDESYMNKFKKIADASYGEQDTKAYGTCSGPISWDDKRPGAYILAAMLTGDEKRKSKAYSYCDAILTQPKTPGGLWYDANLSKWGSNRYASNAAAMVAMFANSLPASDSKRSKYVDFVQKQTDYILGNNPAKVNYVVGAEANSPKAVHHRAASGTYDSQDKNAKPTDYNVFTLWGALAGGPGSKDEYTDTRKNYEMNEVALDYNAAFQMNL

SEQ ID NO: 11281 - protein, 434 aa, Neocallimastix californiae
  Glyco_hydro_9
YARHIELSLLFYEAQRSGKLPENNRIYWRHDSMLDAGADNGVDLTGGYYDAGDNVKFNFPAAAALTLLAWSGVDYADGYKKAGQWDYLLDAVRWGADYFIKCHTGKNELYAQVGRGTTDHGYWYPPEYIQYDHPSYKVTASSPGSEVAGDTASFLAATSILFKDEDPSYSKKCLQHATEIYDFADTYRGDYTGSIPDVSGFYSTWSGYNDELAFGALWLYRATGDESYYEKFKKIADAEYGAQDSKAYGTCTGPISWDDKRPGAYVLAAIITGDEDRLKQAYWYCDNVLTQPRTKGGLWYDSNLSKWASNRYASNAAAMLAMMANYLPKGDARRAKYVDFVKSQTDYILGDNPAGVNFVVGAEANSPKAVHHRGASGTYDSQDVHARPTDYNIFTLWGALAGGPSKDDTYSDTRKDYEMNEVALDYNAAFQTNL

SEQ ID NO: 11282 - protein, 142 aa, Neocallimastix californiae
  Glyco_hydro_9
VNYKTTPGGLWFDTNLSAWGSNRYASNAAYTVAMVASTMDASDAKRKQYVKFIQKQIDYIQGDNPAKVDYVVGADPSSPKSVHHRGSSGTMNAMAEPPFNVFPLYGALAGGPDGNDKYTDDRTNYNSNEVALDYNAAYTGLL

SEQ ID NO: 11283 - protein, 430 aa, Neocallimastix californiae
  Glyco_hydro_9
DYARILNLNLRFYECNWSGKAPEHKQVYWRYDSALEDGADVGLDLTGGYYDAGDHVKFNLPMSYAMTMLAWGGIDLYDNYVAAGQIDYLVQIVNHGADYFVKCHPEKEVIYAQVGLGDVDHCFWVPPELMTMERPAVCKLTPENGASDVTAQMAAALASASILNKMVGNTEKSELYLKHAIEIYDFADKYRDVYGNPCPEGASFYPSASYKDELVWGAAWVYRASGDEKYYEKADSYYDSLGLSGRVLIGPISWDDASSGIIFLMSKPGFGSNWKRYLGEAQTYVDQYLNDKSARTDAGMLWYSAVSGWGSARHAMAGVFLYCIFNTYHKPTDPKYFNFIQQQADYILGNNPFNRSLVVGSIPGHDPLNVHHRGSHGGYSPISLPEHNMYTLYGALAGGPLQDDSWDDDRNNYITNEVSCDYNAGVTGVM

SEQ ID NO: 11284 - protein, 432 aa, Neocallimastix californiae
  Glyco_hydro_9
YARHIELSLLFYEAQRSGKLPENNRIYWRHDSELEAGADNGVDLTGGYYDAGDNAKFNFPGAATMTLLAWSGVDYAEGYKNAGQWEYLLDAVRWGADYFMKCHTGKTELYAQVGDGNTDHSFWYPPEYVQYEYPSFKVTADAPGSEVAGETAAFLAAASILFKDEDPTYSATLLKHSKEIYDFADKYRGDYTVAVPAVSFYNTYSGYMDELAWGAAWLLRATGDESYLEKYNVIANKKYESYDPKKFTGSTGPISWDDKRPGCYILIAMITGDEKRINEAYNYCDAVLTQPRTAGGLWYDDGLSIWGSNRYASNAASMVAMFANYLPESDPKRAKYVEFVKQQTDYILGDNPAKINYVVGAEANSPKSVHHRGASGVFDSQDKAAKPDENIYTLWGALAGGPDKNDKFVDSRKDYQMSEVALDYNAAFQMNL

SEQ ID NO: 11285 - protein, 430 aa, Neocallimastix californiae
  Glyco_hydro_9
DYARILNLNLRFYECQWSGKAPEHKQVYWRYDSALEDGADVGLDLTGGFYDAGDHVKFNLPMSYAMTMLAWGGIDLYDNYVAAGQIDYLLQMVNHGADYFVRCHPEKEVIYAQVGVGDVDHCFWVPPELMTMERPTVCKLTPENGASDVTGQMAAALASASILNKKYGNTEKAELYLKHAIEIFDFADKYRDVYNNPCPEGASFYPSASYKDELVWGAAWVYRASGDEKYYQKADEYYDSLALSGRNLIGPITWDDASSGIVFLMSKPGFGSNWERYLGEAQHYVDQYLNDKGARTDGGMLWYSSVSGWGSARHAMAGTFLYCIFNTYHKPTDPKYFNFIQEQADYILGNNPFNRSLVVGSIPGYEPLNVHHRGSHGGYSPLSPPEHNMYPLYGALAGGPLQNDFWDDDRNNYVTNEVACDYNAGITGVM

SEQ ID NO: 11286 - protein, 430 aa, Neocallimastix californiae
  Glyco_hydro_9
DYARHLELSILFYEAQRSGKLPDNNRIYWRGDSMLEAGSDNKVDLTGGYYDAGDNIKFNFPQASSLTLLSWSAVEWKDGYKQAGQWEYMKDLIKWGMDYFIKCHTDKYVLYGQVGNAKLDHNSWVSPENISYDYPSYKITDSSPGSDLAAETSAALVAASMVFRDEDPNYADLLLKHGKELYEFADKYRGSYDESIPEANDYYHSNSYNDELVWGAAWLFRATGEEYYKSKVDAIWDYPYDENDSNKFLDSKNPISWDDKKASSYTLMAMITGDQKYLKEATTHSDLMVNHTTTPGGLWYNENLSVWGSNRYASNAAFTVAMMTSIMNDDDSKRQEYIDFVKKQTDYILGDNPAKIDYVVGAAPNSPKAVHHRGASGTKDVYENPDENTYVLYGALAGGPGPKDEYKDIREDYQKNEVALDYNAAFQGLL

SEQ ID NO: 11287 - protein, 421 aa, Neocallimastix californiae
  Glyco_hydro_9
YARHLELNFLFYEAQRSGPLPSTNRIPWRGDSGLDHGSDVGVDLTGGYYDAGDNVKFNFPQAFSMTAISWMGIEFAKGVEMANQTEYLKDTVKWGCDYLLKCHEKGTDVFYMQVGDGDIDHQYWKAYENIDYPTPTFFVDSKNPGTEVTGETAAAFAAASILFKDSDPEYSATLLDQAKEWYEFADKYQFDYSQSVPAAGSYYKSYNGYNDELAWAAIWLYRALGDEAYLEKAKSLVANYKLSEVGIDWDSKYQGVIVILAQLGVKEYVEKVEAWVKDICTNGKFSPGGLYINKDSEWGSNRRATAMAASLIYYTHNLPEGNELREMAKKFAKSQADYIQGANPLGIDYVVGADETSPRSVHHRTASGAACIECDPVQNVHIIYGALAGGPDVEDNYLDDRADYKKNEVALDYNVCYAAVL

SEQ ID NO: 11288 - protein, 431 aa, Neocallimastix californiae
  Glyco_hydro_9
DYARHLELSILFYEAQRSGKLPANNRIFWRHDSMVDAGKDNNVDLTGGYYDAGDNVKFNFPQASALTLLAWSAVDWKDGYKEAGQWGYMKDLLKWGMDYFIKCHTSKYELYGQVGNGSLDHGAWVPPEEIDYEYPSYKITASAPGSDLAAETSASMVAASMAFRDDDPEYADILLKHGKELYDFAEKYQGTYDKSITDAKGYYRSYSGFNDELVWGAAWLYRATGDKTYKDKVDKIWDTPYGDLDPDKFLGSGGPISWDDKKAAAYALMALTTGESKYVDESTKHSELMVNYKTTPGGLWYDTNLSMWGSNRYASNAAFTVAMLATSMDANDAKRKEYVKFIKKQIDYIIGDNPAKVDYVVGADPSSPKAVHHRGASGSKGADKGPSENVFVLYGALAGGPGANDNFKDARDNYEMNEVALDYNAAFQGLL

SEQ ID NO: 11289 - protein, 431 aa, Neocallimastix californiae; identical to SEQ ID NO: 11288
  Glyco_hydro_9

SEQ ID NO: 11290 - protein, 434 aa, Neocallimastix californiae
  Glyco_hydro_9
YARHIELSLLFYEAQRSGKLPENNRIYWRHDSMLDAGSDHGVDLTGGYYDAGDNVKFNFPGAASLTLLAWSAIDYADGYKKADQWKYILDAVRWGADYFVKCHTGKNELYVQVGDGQIDHGYWYPPEYIQYKHSSYKITASAPGSEVAGDTASFLAASSILFKEENPTYSATLLKHAIEIYDFADKYRGEYTKAVPDAQGFYANWSGFLDELAFGALWLYRATGDESYMQKFSTIADAKYGEQDSKAYGISTGPISWDDKRPGAYILAAMVTGEEKRLQQAYWYCDSILTQPKTRGGLWYDASLSQWGSNRYASNAAAMLAMFANYLPKSDPKRSKYVDFVKKQTDYILGDNPAKINYVVGAEASSPKAVHHRAASGTYDSQDTNAKPTDYNIFTLWGALAGGPGPKDEYTDSRKNYQMNEVALDYNAGFQMNL

SEQ ID NO: 11291 - protein, 194 aa, Neocallimastix californiae
  Glyco_hydro_9
DYARILNLNLRFYECQWSGKAPEHKQVYWRYDSALDDGADVGLDLTGGFYDAGDHVKFNLPMSYAMTMLAWGGIDLYDNYVAAGQLDYLLQMVNHGADYFVRCHPEKEVIYAQVGLGAIDHCFWVPPELMTMERPAACKLTPDNGASDVTAQMAAALASASILNKMYGNKEKAELYLKHAIEIYDFADKYRDVY

SEQ ID NO: 11292 - protein, 100 aa, Anaeromyces robustus
  Glyco_hydro_9
SKYVDFVKKQTDYILGDNPAKINYVVGAEASSPKAVHHRAASGTYDSQDTNAKPTDYNIFTLWGALAGGPGPKDEYTDSRKNYQMNEVALDYNAGFQMNL

SEQ ID NO: 11293 - protein, 33 aa, Anaeromyces robustus
  Glyco_hydro_9
GGPGARDDYKDDRTNYNSNEVALDYNAAYTGLL

SEQ ID NO: 11294 - protein, 431 aa, Anaeromyces robustus
  Glyco_hydro_9
DYARHLELSILFYEAQRSGKLPANNRIFWRHDSMVDAGKDNNVDLTGGYYDAGDNVKFNFPQASALTLLAWSAVEWKDGYKEAGQWEYMKDLLKWGMDYFVKCHTGKTELYGQVGNGSLDHGAWVPPEDIDYKYPSYKITASAPGSDLAGETAAALVASSLAFREDDPEYADLLLKHGKEIYDFADKYRGSYDKSIEDAKGYYRSYSGYMDELVWGAAWLYKATGDETYKKKVDAIWDYPYGDLDPDKFLGSTGPISWDDKKASSYALMAMITGEDKYVKESTTHSDLMVNYKTTPGGLWYDTNLSMWGSNRYASNAAFTVAMLASSMDPNDSKRKQYVKFVQKQIDYIIGNNPAKVDYVVGADPSSPKAVHHRGASGSKGADKGPDENVFVLYGALAGGPGARDDYKDTRNNYEMNEVALDYNAAFQGLL

SEQ ID NO: 11295 - protein, 434 aa, Anaeromyces robustus
  Glyco_hydro_9
YARHIELSLLFYEAQRSGKLPENNRIYWRHDSLLDAGADNGVDLTGGYYDAGDNVKFNFPAAATLTLLAWSGIDYAQGYKEAGQWDYLLDAVRWGADYFMKCHTGKNELYVQVGSGRVDHAYWYPPEYVNYDHPSFKITASAPGSEVAGDTASFLAAASILFKDVDSSYSQKCLKHAKEIYDFADTYRGEYTKAVEDAQQFYANWSGFLDELAFGALWLYRATGDESYHNKFKKIADDSYGEQDTKAYGICTGPISWDDKRPGSYILAAMITGEEKRLQQAYWYCDEVLTQPKTPGGLWYNDNLSKWGSNRYASNAAAMLGMFANYLPKSDPKRSKYIDFVKSQTNYILGDNPAKVNYVVGAEANSPKAVHHRGSSGTYDSQDNNAKPTDYNIYTLWGALAGGPGKSDDYSDTRKNYEMNEVALDYNAAFQMNL

SEQ ID NO: 11296 - protein, 312 aa, Anaeromyces robustus
  Glyco_hydro_9
DYARILNLNLRFYECQWSGKAPEHKQVYWRYDSALDDGADVGLDLTGGFYDAGDHVKFNLPMSYAMTMLAWGGIDLYDNYVAAGQLDYLLQMVNHGADYFVRCHPEKEVIYAQVGLGAIDHCFWVPPELMTMERPAACKLTPDNGASDVTAQMAAALASASILNKMYGNKEKAELYLKHAIEIYDFADKYRDVYNNPCPEGASFYPSASYKDELVWGAAWVYRASGDEKYYKKADEYYDSLALSGRNLIGPITWDDASSGIVFLMSKPGFGSNWERYLGEAQHYVDQYLNDMGARTDGGMLWYSSVSGWGSA

SEQ ID NO: 11297 - protein, 435 aa, Anaeromyces robustus
  Glyco_hydro_9
YARHIELSLLFYEAQRSGKLPENNRIYWRFDSQLDAGADHGVDLTGGYYDAGDNVKFNFPAAAALTLLAWSGVDYADGYKKAGQWDYFLDAIRWGADYFMKCHTGKNELYFQVGDGKIDHTYWYPPEYTVYEHPSLKLTTSKPGSEVASDTASFLAATYMIFKDIDPTYAKKCLQHSKEIYEFADKYRGDYSKSFGNYVNDFYKNWGTINDELAFGALWLYRATGDESYLAKYKVIADASYDSRDESAYPNCSGPISWDDKRPGAYVLGAIVTGEDKYLDKAISYCDAVLTQPKTRGGLWYNNNLSKWGSNRYASNAASMLGMLANYLPKDHPKRSKYIDFVKSQTNYILGDNPAKVNFVVGAEKNSPKAVHHRGASGTYDSQDTNAKPTDHNVYTIWGALAGGPGKDDSYTDTRKNYEMNEVALDYNAAFQMNL

SEQ ID NO: 11298 - protein, 31 aa, Anaeromyces robustus
  Glyco_hydro_9
PGARDDYKDDRTNYNSNEVALDYNAAYTGLL

SEQ ID NO: 11299 - protein, 430 aa, Anaeromyces robustus
  Glyco_hydro_9
DYARILNLNLRFYECNWSGKAPEHKQVYWRYDSALEDGADVGLDLTGGFYDAGDHVKFNLPMSYAMTMLAWGGIDLYENYVAAGQIDYLVQIVNHGADYFVKCHPEKEVIYAQVGLGDVDHCFWVPPELMEMERPAVCKLTPENGASDVTAQMAAALASASILNKKVGNTEKAELYLKHAIEIYDFADKYRDVYGNPCPEGASFYPSASYKDELVWGAAWVYRASGDEKYYDKADEYYDSLGLSGRVLIGPISWDDASSGIIFLMSKPGFGKNWERYLNEAQIYVDQYLNDKGSRTDAGMLWYSSVSGWGSARHAMAGVFLYCIFNTYHKPEDPKYFNFIQQQADYILGNNPFNRSLVVGSIPGHDPLNVHHRGSHGGYSPISPPEHNMYTLYGALAGGPLQDDSWDDDRNNYITNEVSCDYNAGITGVM

SEQ ID NO: 11300 - protein, 419 aa, Anaeromyces robustus
  Glyco_hydro_9
YARHLELNFLFYEAQRSGHLPANNRIPWRSDSGLDHGADNGVDLTGGYYDAGDNVKFNFPQAFSMTAIAWYGLEFAKGVEMAGQTEYLKDTVKWGCDYLLKCHKKGTDVFYMQVGDGDIDHLYWKAVEDIDYPTPSFYVDSKNPGTEVTGETAAAFAAASLLFKESDPEYSATLLDQAVEWFNFANTYRFDYSVSVPKVASYYKSWGGYKDELAWAAIWLYKALGEEKYLELAKDLVKDYKLGELGFDWDSKYQSTIVILAQLGVKEYVEKVENWVREICTKGKLSPGGLYINKDSEWGSCRRATSMAASLIFYTHTLPEGNELREMAKKFAQSQADYVQGNNPLGIDFVVGADASSPRSVHHRTASGADCIECDPVENAHIIYGALAGGPDENDQYEDIRADYQKNEVALDYNVCYAA

SEQ ID NO: 11301 - protein, 435 aa, Piromyces finnis
  Glyco_hydro_9
DYARHLELSLLFYEAQRSGKLPENNRIYWRHDSLVDAGADNGVDLSGGYYDAGDNAKFNFPGAATMTLLAWSGIDYAEGYKEAGQWKYLLDAVRWGADYFMKCHTGKNELYAQVGKGTTDHSYWYPPEYASYDHPSFKLTASAPGTEVSADTASFLAASYLLFKDEDPSYASKCLQHSKEIYDFADTYRGDYIGSIPDVSGFYSTWSGYNDELAFGALWLYRATGSESYMKKFEAIADAVYGAQDTKAYGTCTGPISWDDKRPGAYILAAIITGDEKRMKQASWYCDNVLTQPKTPGGLWYDANLSKWASNRYASNAAAMVAMYANYLPSSDSKRSKYVDFVKKQTDYILGDNPAKINYVVGAEANSPKAVHHRGASGTYDSQDTNAKPTDYNIFTLWGALAGGPGPDDEYTDSRKNYEMNEVALDYNAAFQMNL

SEQ ID NO: 11302 - protein, 434 aa, Piromyces finnis
  Glyco_hydro_9
DYARHLELSLLFYEAQRSGKLPENNRIYWRHDSLVDAGADNGVDLSGGYYDAGDNAKFNFPGAATMTLLAWSGIDYAEGYKSAGQWEYILDAVRWGADYFMKCHTGKNELYAQVGDGNTDHAFWYPPEYVKYDYPSFKVTAEKPGSEVAGETAAFLAAASILFKDEDSSYSAKLLKHAKEIYEFADTYRGDYTGAIPGVVSFYSTYSGYNDELAWGAAWLLRATGDESYLNKYNVIANKKYESYDPKKFSGATGPISWDDKRPGCYILIAMVTGDENRIKEAYNYCDAVLTQPKTPGGLWYDDGLSMWGSNRYASNAASMLAMFANYLPKSDPKRAKYVEFVQQQTNYILGDNPAKINYVVGAEANSPKAVHHRGSSGVFDSQDKAAKPDENIYTLWGALAGGPDETDSYIDTRSNFRTNEVALDYNAAFQMNL

SEQ ID NO: 11303 - protein, 434 aa, Piromyces finnis
  Glyco_hydro_9
YARHIELSLLFYEAQRSGKLPENNRVYWRHDSLLDAGADNGVDLTGGYYDAGDNVKFNFPGAAALTLLAWSGIDYADGYKEAGQWDYILDAVRWGADYFVKCHTGKNELYVQVGKGATDHGFWYPPEYVQYDHPSYKITAAAPGSEVAGDTASFLAAASILFKDIDSSYSSNLLKHAIEIYDFADSYRGEYIKAVPDAQGFYSNWSGYNDELAFGALWLYRATGESKYMDKFSKIADASYGEQDTKAYGTCTGPISWDDKRPGAYILAAIITGDEKRMKQASWYCDNVLTQPKTPGGLWYDANLSKWASNRYASNAAAMVAMYANYLPSSDSKRSKYVDFVKKQTDYILGDNPAKINYVVGAEANSPKAVHHRGASGTYDSQDTNAKPTDYNIFTLWGALAGGPGPDDEYTDSRKNYEMNEVALDYNAAFQMNL

SEQ ID NO: 11304 - protein, 435 aa, Piromyces finnis; identical to SEQ ID NO: 11301
  Glyco_hydro_9

SEQ ID NO: 11305 - protein, 434 aa, Piromyces finnis; identical to SEQ ID NO: 11302
  Glyco_hydro_9

SEQ ID NO: 11306 - protein, 434 aa, Piromyces finnis; identical to SEQ ID NO: 11303
  Glyco_hydro_9

SEQ ID NO: 11307 - protein, 431 aa, Piromyces finnis
  Glyco_hydro_9
DYARHLELSILFYEAQRSGKLPANNRIFWRHDSMVDAGKDNKVDLTGGYYDAGDNVKFNFPQASALTLLAWGAYKWKDGYKEAGQWDYMKDLLKWGMDYFIRCHTDKYVLYGQVGNGSLDHGAWVAPEDIDYEYPSYKITASAPGSDLAAETSASMVAASLAFRDEDPTYADTLLKHGRELYEFAEKYQGTYDKSITDAKGYYRSYSGFNDELVWGAAMLYAATGEQTYKDKVDKIWNTPYGELDPDRFLGSTGPISWDDKKAAAYALMAITTGESKYIEESTRHSDLMVNYPTTPGGLWYDTNLSMWASNRYAANAAFTVAMLATSMDANDSKRKEYVAFVKKQIDYILGDNPAKVDYVVGADPSSPKAVHHRGASGSKGADKGPDENVFILYGALAGGPGAKDNYKDARNNYEMNEVALDYNAAFQGLL

SEQ ID NO: 11308 - protein, 301 aa, Piromyces finnis
  Glyco_hydro_9
SLKLTTGAPGSEVAGDTASFLAATYIIFKDIDPSYAKKCLQHSKEIYEFADTYRGDYSKSFGDYVNSFYKNWGTIYDELAFGALWLYRATNDESYLKKYKAIADASYDTRDENAYGNCKGPISWDDKRPGGYVLGAIVTGEEKYIEKALSYCDMVLTQPRTPGGLWYDSNLSKWGSNRYASNAASMVAMMADFLPKDDARRAKYVDFVKSQTDYILGDNPAGVNYVVGAEENSPKAVHHRAASGTYDSQDRNAKPNDHNVYTIWGALAGGPAKDDSYEDTRKNYEMNEVALDYNAAFQMNL

SEQ ID NO: 11309 - protein, 37 aa, Piromyces finnis
  Glyco_hydro_9
GALAGGPDANDKYTDDRTNYNSNEVALDYNAAYTGLL

SEQ ID NO: 11310 - protein, 37 aa, Piromyces finnis
  Glyco_hydro_9
GALAGGPDGNDKYTDDRTNYNSNEVALDYNAAYTGLL

SEQ ID NO: 11311 - protein, 397 aa, Piromyces finnis
  Glyco_hydro_9
DYARILNLNLRFYECQWSGKAPENKQVYWRYDSALEDGADVGLDLTGGFYDAGDHVKFNLPMSYAMTMLAWGGIDLYDNYVAAGQIDYLIQMVNHAADYFVRCHPEKEVIYAQVGLGDVDHCFWVPPELMEMERPAVCKLTPENGASDVTAQMAAALASASILNKKYGNEEKAELYLKHAIEIYDFADKYRDVYGNPCPEGASFYPSASYKDELVWGAAWVYRASGDEKYYEKADSYYDSLGLSGRVLIGPISWDDASSGIIFLMSKPGFGSNWKRYLGEAQTYVDQYLNDKSARTDAGMLWYSAVSGWGSARHAMAGTFLYCIFNTYHNPTDPKYFNFIQQQADYILGNNPFDRSLVVGSIPGHDPLNVHHRGSHGGYSPISPPEHNMYTLYGALA

SEQ ID NO: 11312 - protein, 397 aa, Piromyces finnis; identical to SEQ ID NO: 8998
  Glyco_hydro_9

SEQ ID NO: 11313 - protein, 246 aa, Neocallimastix californiae
  Glyco_hydro_97
SWVAPGVSSWSWVAHWGYGESDQSNPNTHKKWIDLASTMGWRFYILDEGWQPDSYDNDGSYYSGWFDWWPEVRDYAKRKGVQLIAWVHKNDVDTPEKRRKRFKEWSEEGIVGIKVDFFFNEAQSTLQLHQDIYKEAARYHLLVNVHGSNPPSGEIRTYPNVLAREGIRGQEAGGITAYQYTILPFTRGAIGTTDVTEELRSKDPEVTTMGFQIALSTLFENGIHSLGSAPDVYYSNTEGSDYYKDF

SEQ ID NO: 11314 - protein, 302 aa, Neocallimastix californiae
  Glyco_hydro_beta-prop
SNHNPIITQKYSADPGVMVYNGRVYVYATNDGDAGTRYNSENTYGQINTINVMSSADLVNWMDHGSIPAAGGGGAARWASNSWAPCAAWKKINGKDKFFLYFANNASGIGVLTADSPTGPFKDPIGRALISRQTPNSNVEWLFDPAVIVDTDGTGYLYYGGGVPQGQNANPRTIRVAKLGNDMTSIQGTPQMIDAPWVFEDSGINKIGNTYVYSYCTNWAGGPYGNARIAYMTSNNPMSGFKYQGTCFNNPGDFFQTTGNNHHTIIEFKNKYYIFYHAEWLNKQILGGQKGYRTTHVDELPV

SEQ ID NO: 11315 - protein, 104 aa, Neocallimastix californiae
  Glyco_hydro_beta-prop
FEDSGINKIGNTYVYSYCTNWAGGPYGNARIAYMTSNNPMSGFKYQGTCFNNPGDFFQTTGNNHHTIIEFKNKYYIFYHAEWLNKQILGGQKGYRTTHVDELPV

SEQ ID NO: 11316 - protein, 282 aa, Neocallimastix californiae
  Glyco_hydro_beta-prop
TVNNPIIWADVPDPDIIRVDDTYYMVSTTMYFTPGAPIMKSKDLVSWEIVTYTYDILANGDVQTLSRGQHDYSHGSWAASLRYNKGIFYVFFGSYGTNKSYIFKTKDIESGKWERFEINGMYHDASILFDDDGRNYLVYGGGGEIKIKEFNAEMTNFKWGGLDKTLFRTNLSGLAGEGSHVMKINGYYYVFIIAWPSGKGRIEICYRSKDLTGYYENKTVLDSGLGSYGSGVAQGGIVDTPDGKKWFGLLFQDHGAVGRIPVLVPVNWQNGWPMMGVNGKAP

SEQ ID NO: 11317 - protein, 304 aa, Neocallimastix californiae
  Glyco_hydro_beta-prop
KNHNPINTIKYSADPGVMVYDGRVYVYGTNDGYAGELGRNPQDNTYGQINTINVMSSDDLVNWIDHGTIPAAGRNGAAKWAGNSWAPCATHKKINGKEKFFLYFANSGNGIGVLTSDSPTGPFVDPIGHALISRSTPNCSNIVWLFDPAVFVDDDGTGYLYFGGGVPDNQSSNPKTVRAVKLGNDMTSLAGNPVTIDAPWVFEDSGINKSGDTYFYSYCTNWNGGPYGNAKIAYMTSKNPLGPFTMQGTVLNNPGDFFGTTGNNHHTIIEFKDQWYIFYHAEWLNKQEFGSQKGYRTSHVDVLP

SEQ ID NO: 11318 - protein, 302 aa, Neocallimastix californiae
  Glyco_hydro_beta-prop
SNHNPTITHRYSADPGVMVYNGRVYVYATNDGDAATRYNSENTYAQINTINVMSSADLVNWMDHGSINATGGGGAAKWAKNSWAPAAAWKKINGKDKFFLYFADNASGIGVLTADSPTGPFRDPIGRALISRQTPNSNVEWLFDPAVFVDSDGTGYLYYGGGVPKGREANPNTIRVAKLGGDMTSISGTPANIDAPWVFEDSGINKIGNTYVYSYCTNWNGGPYGNARIAYMTSNNPMGKFTFQGTCFNNPGDFFQTTGNNHHTIIEFKNKYYIFYHAEWLNKQILGGQKGYRTTHVDELPV

SEQ ID NO: 11319 - protein, 347 aa, Neocallimastix californiae
  Glyco_hydro_beta-prop
SGVSVHDPSIVKSGNKYYIFGSHMDAAYTTDLWKFTKLYTGVDENNKMFTNLFSKSNYDAFKFVGKNSDGGYSVWAADVMYNKKMKKWVQYFCTSSTYIKSSLCYGIADKVEGPYTYKSCFLHSGMDSGSVGKTNLRAITGTEDKNRYYPNNRYNNKVYPNAIDPNAFYDFNGRLWLAYGSWSGGIYILELDESTGLPKHNISNGNNVDKYYGKKLAGGGHQSIEGPYILPYKAAGYYYLFVSYGTLTSNGGYQIRLFRSKNPDGPYTDVAGKEFMSGTNSNFGVKIMGNYGIPGREKAYMAPGHNSVLIDDDGKILLCYHTRFNDGQEYHEPRVHQMFLNKEGWLT

SEQ ID NO: 11320 - protein, 224 aa, Neocallimastix californiae
  Glyco_hydro_beta-prop
VNPIIKDMYTADPAPMVYGDTLYLYTTHDEDVLKNNFYTMENWYVFSTKDMVNWTNHGQILSLDDIEWADERAWAPQTVEKDGKFYFYFPAHKIDGGMAIGVAVADSPIGPFKEIGHPIVYEDDWNDFDPTVFIDDDGKAYLYFGNPELRYVVLNDDMISYDEEIGVVKVPMTEESFGKGSHDTGTSYAEGPYFYKRNGLYYMVYAAFREGSHTESLAYSTSEK

SEQ ID NO: 11321 - protein, 284 aa, Neocallimastix californiae
  Glyco_hydro_beta-prop
VNPIIKDMYTADPAPMVYGDTLYLYTTHDEDVLKNNFYTMENWYVFSTKDMVNWTNHGQILSLDDIEWADERAWAPQTVEKDGKFYFYFPAHKIDGGMAIGVAVADSPIGPFKEIGHPIVYEDDWNDFDPTVFIDDDGKAYLYFGNPELRYVVLNDDMISYDEEIGVVKVPMTAESFGKNGDRTTYGEGPYFYKRNGLYYMVFAAFREGAFTESLGYATSEKPTGPWKYGGVLMTEGTAFTNHPGIADFNGKSYFFYHTDELPGGGDFHRSVCVTEFEYKEDGS

SEQ ID NO: 11322 - protein, 286 aa, Neocallimastix californiae
  Glyco_hydro_beta-prop
VNPIIKDMYTADPAPMVYGDTLYLYTTHDEDVLKNNFYTMENWYVFSTKDMVNWTNHGQILSLDDIEWADERAWAPQTVEKDGKFYFYFPAHKIDGGMAIGVAVADSPIGPFKEIGHPIVYEDDWNDFDPTVFIDDDGKAYLYFGNPELRYVVLNDDMISYDEEIGVVKVPMTEESFGKGGHDTGTSYAEGPYFYKRNGLYYMVYAAFREGSHTESLAYSTSEKPTGPWKYGGVLMTEGTAFTNHPGIADFNGKSYFFYHTDELPGGGDFHRSVCVTEFEYKEDGS

SEQ ID NO: 11323 - protein, 285 aa, Neocallimastix californiae
  Glyco_hydro_beta-prop
NPIIKDMYTADPAPMVYGDTLYLYTSHDETELKNNFYTMENWYVFSTKDMVNWTNHGQILSLDDIEWADERAWAPQTVEKNGKFYFYFPAHKIDGGMAIGVAVADSPIGPFKEIGHPIVYEDDWNDFDPTVFIDDDGKAYLYFGNPELRYVVLNDDMISYDEEIGVVKVPMTEESFGKGSHDTGTSYAEGPYFYKRNGLYYLVYAAFREGSQTESLAYATSEKPTGPWKYGGVLMTEGTAFTNHPGIADFNGKSYFFYHTDELPGGGDFHRSVCVTEFEYKEDGS

SEQ ID NO: 11324 - protein, 307 aa, Neocallimastix californiae
  Glyco_hydro_beta-prop
ANHNPLFTHRYSADPGVMVYNNRVYVYATNDGDVATKFTDDNTYSHINSLNVMSSEDLVNWTDHGSILVAGNNGAAKWAGNSWAPCATYKKINGKDKFFLYFANNANGIGVLTSDSPTGPFKDPIGKALITRQTPNCGDVAWLFDPAVLVDTDGTGYLYFGGGVPDGKDAAPKTIRVVKLGADMVSLAGTPQLIDTPYVFEDSGINKIGNTYYYSYCTNWSAGEPYGQARIVYMTSSNPMGPFTYQGVCLNNPGEDFQTYGNNHHTIIEFKNKYYIFYHTEWLNKQVFGTQKGYRTSFVNEITFSNG

SEQ ID NO: 11325 - protein, 280 aa, Neocallimastix californiae
  Glyco_hydro_beta-prop
TVRNPIIWADVPDDDIIRVDDTYYMVSTTMFFSPGAPIMKSKDLFSWEICNYVYDILADGDVQTLKNGKHDYSHGQWAASLRYHEGTFYVFFGSYGTNKSYIFKTKDIEKGTWTRNEIFGMYHDASILFDDDGRKYLVYGGSGEIKIKEFNNEMTDFKRGGADKVLFRTGLSGLAGEGSHIQKIGKYYYIFIIAWPNGKGRIEICYRSRDLLGNYENKIVLDSGLGSYGSGVAQGGIVDTPDGKWYGLLFQDHGSVGRIPVLVPVNWQNDWPIMGVNGKA

SEQ ID NO: 11326 - protein, 301 aa, Neocallimastix californiae
  Glyco_hydro_beta-prop
NKNPLITHRYSADPGVMVYNGRVYVYATNDGDVANRNVGENKYDQINTINCMSSDDLINWMDHGPIPAAGGNGAAKWAKNSWAPTAAWKKINGKDKFFLYFANNASGIGVLTADSPTGPFKDPIGRALISRQTPNSNVEWLFDPAVFVDTDGTGYLYYGGGVPQGQNANPRTIRVAKLGNDMTSIQGTPQMIDAPWVFEDSGINKIGNTYVYSYCTNWAGGPYGNARIAYMTSNNPMSGFKYQGTCFNNPGDFFQTTGNNHHTIIEFKNKYYIFYHAEWLNKQVFGSQKGYRTTHVDELPV

SEQ ID NO: 11327 - protein, 194 aa, Neocallimastix californiae
  Glyco_hydro_beta-prop
TGCIRDPFILKGQDGYYYMLATDMRSYSGWDSNRNILSAKSKDLIHWNDVTSIEIANKYPLTQGADRAWAPQAIYDHEKNSYMIYFAVRVPNRGNKTIMYYAYSKDMKKLDTAPALLFQPRNGNEAIDSDIIFQNNKYYMYYKDETRKTICLATADHASGPYQEIKQLSDNGIEVEGCNIYNIIGTNKWLMMSD

SEQ ID NO: 11328 - protein, 307 aa, Neocallimastix californiae
  Glyco_hydro_beta-prop
KNHNPINVLKYSADPGVMVYDGRVYVYATNDGIGENIGNNPRDNDYSHINTINVMSSSDMVNWVDHGTIPAAGNSGAAKWAGNSWAPCAAHKKINGKEKFFLYFANSGNGIGVLTSDSPTGPFVDPIGGPLVSRSTLNCNSIVWLFDPAVMVDDDGTGYLYFGGGVPENAKSNPKTVRAVKLGNDMISLAGTPQTIDAPWVFEDSGINKAGNTYFYSYCTNWDNGPYGNAKIAYMTSSSPLGPFQYQGTVLNNPGDFFGTVGNNHHTIINFKNKWYIFYHAEWLNKQVFGSQKGFRTSHVDELPFSN

SEQ ID NO: 11329 - protein, 347 aa, Neocallimastix californiae
  Glyco_hydro_beta-prop
SGVSVHDPSVVKYGNKYYIFGSHMDTAYTTDLWKFTKLYTGVNDNNKMFTNLFSKSNYGAFNFVGKNSDGGYSVWAPDIIYNNRMKKWVQYFCTSSTYIKSSICYALADNVEGPYTYKNCFIFSGMDSKTVGKTNLKAVIGYEDMNRYYPNNKYNNRVYPNAIDPNAFYDFKGKLWLVYGSWSGGIYILELDESTGLPKHNISNGNNTDRYYGKKLAGGNHQSIEGPFILPHKAVGYYYLFVSYGSLTSNGGYQIRMFRSKNPDGPYTDVAGKEFMSGNNSSFGVKVMGNYNIPGREQAYMAPGHNSALLDDDGKVLIFYHTRFNDGQEYHEPRIHQMFLNKEGWLC

SEQ ID NO: 11330 - protein, 43 aa, Neocallimastix californiae
  Glyco_hydro_beta-prop
SGVSVHDPSVVKYGNKYYIFGSHMDTAYTTDLWKFTKLYTGVN

SEQ ID NO: 11331 - protein, 282 aa, Neocallimastix californiae
  Glyco_hydro_beta-prop
TCKSPLVSNMYTADPAPMVYGDTLYLFTSHDENNIQNNFYTMLNWHLFSTKDMINWTSHGQVFSLDDISWADDRAWAPQAIARNDKFYLYVPVHKRNGGMAIAVGVSDKPTGPYKDIGHPLVDEGDWNDIDPTVFIDDDGQAYLYFGNPELRYVLLNEDMVSYNKSVGVKKIPMTADSFGRGEGSRTTYGEGPFFYKRKDMYYMAYAAFRPNKGSEHLAYSYSNSPTGPWKYGGVLMTEDGGTYTNHPGIARFKGRSYLFYHTGQLPGGGAYHRSVCFTEFK

SEQ ID NO: 11332 - protein, 307 aa, Anaeromyces robustus; identical to SEQ ID NO: 11328
  Glyco_hydro_beta-prop

SEQ ID NO: 11333 - protein, 288 aa, Anaeromyces robustus
  Glyco_hydro_beta-prop
TCKSPLVSNMYTADPAPMVYGDTLYLFTSHDENNIQNNFYTMLNWHLFSTKDMINWTSHGQVFSLDDISWADDRAWAPQAIARNDKFYLYVPVHKRNGGMAIAVGVSDKPTGPYKDIGHPLVDEGDWNDIDPTVFIDDDGQAYLYFGNPELRYVLLNEDMVSYNKSVGVKKIPMTADSFGRGEGSRTTYGEGPFFYKRKDMYYMAYAAFRPNKGSEHLAYSYSNSPTGPWKYGGVLMTEDGGTYTNHPGIARFKGRSYLFYHTGQLPGGGAYHRSVCFTEFKYNKDGS

SEQ ID NO: 11334 - protein, 281 aa, Anaeromyces robustus
  Glyco_hydro_beta-prop
TVYNPIIWADVPDPDIIRVDDTYYMVSTTMFFNPGAPIMKSKDLVSWKICNYVYDKLADGDVQNLARGQHDYSHGQWATSLRYHKGTFYVFFGSYGTNKSYIFKTKDIENGPWTRTELGGMYHDASMIFDDDGRNYLVYGAGGEIRIKEFNSEMTDFKRGGADKILFRTNLSGLAGEGSHVQKINNYYYIFIIAWPNGKGRIEICYRSKDILGNYESRTVLDSGVGSYGSGVAQGGIVDTPEGKWYGLLFQDHGSVGRIPVLVPVNWQSDWPMMGVNGRAP

SEQ ID NO: 11335 - protein, 303 aa, Anaeromyces robustus; identical to SEQ ID NO: 1027
  Glyco_hydro_beta-prop

SEQ ID NO: 11336 - protein, 348 aa, Anaeromyces robustus
  Glyco_hydro_beta-prop
SGVSVHDPSVIKNGNKYYIFGSHMDTAYTTDLWKFTKLYTGVNENNRMFTNLFSKSNYGAFNFVGKNSEGGYSVWAPDVMYNKKMRKWVQYFCTSSTYIKSSICYALADNVEGPYTYQSCFIFSGMDSGSVGKTNLRAVTGTEDGNRYYPGNKYNNRVYPNAIDPNVFYDFNGRLWLAYGSWSGGIYILELDESTGLPKHNISNGTNIDKYYGKKLAGGGHQSIEGPYILPYKAAGYYYLFVSYGTLTSNGGYQIRLFRSKNPDGPYTDPAGNEFMGGTNSNFGLKLMGNYNIPGRSQAYMAPGHNSAMIDDNGKVLMFYHTRFNDGQEYHEPRVHQLFLNKEGWFCV

SEQ ID NO: 11337 - protein, 213 aa, Anaeromyces robustus
  Glyco_hydro_beta-prop
CLRDPYIFKGEDGLYYLLATDMKSALGWNSNRNLLSAKSKDLINWYDTTSIEIANKYPLMQGADRAWAPQAIYDPEKKSYMIYYAARVPGRDNRTIMYYAYSKDMKKLDTAPALLFAPSNGNDAIDSDIIFQNGKYYMYYKNETNKRIYLATSDHANGPYKEIKQVSEGNIGVEGPNIYKLLNSNKWLLMSDAYYDHYYVMQETTDLQNFKTV

SEQ ID NO: 11338 - protein, 308 aa, Anaeromyces robustus; identical to SEQ ID NO: 1032
  Glyco_hydro_beta-prop

SEQ ID NO: 11339 - protein, 215 aa, Anaeromyces robustus
  Glyco_hydro_beta-prop
VGTGCLRDPFILKGEDGTYFLLATDMRSYSGWDSNRNILTARSTDLIHWTNVSLIEVCNKYPIFQRGDRAWAPQAIYDPEKQAYMIYFAVRVPSNGNKTIMYYAHSKDMTRFDTTPQLLFAPKNGNEAIDADIIYQGGRYYMYYKDETRKTINLALAEHASGPYQEIKQLSDNGIEVEGCNIYPVVGTNKWLMMSDAYVNGYFVLQETTDLVNFR

SEQ ID NO: 11340 - protein, 303 aa, Anaeromyces robustus
  Glyco_hydro_beta-prop
SNKNPLITHRYSADPGVMVYNDRVYVYATNDGDVANRNVGDNTYEQINTINCMSSDDLVNWTDHGPIAAAGQGGAAKWAKNSWAPTAAHKTINGKEKFFLYFANSGAGIGVLVSDSPTGPFTDPIGKALITPQTPNCASVTWLFDPAVLVDTDGTGYLYFGGGVPQGQDANPKTIRVVKLGPDMTSLAGNPETIDAPWVFEDSGINKIGNTYVYSYCTNWANGPHGNARIGYMTSNSPMGPFTFQGTCFNNPGDFFQTTGNNHHTIIEFKGKYYIFYHTEWLNKQVLGSQKGYRTTHVNEMPV

SEQ ID NO: 11341 - protein, 304 aa, Anaeromyces robustus
  Glyco_hydro_beta-prop
SNKNPIITHRYSADPGVMVYNGRVYVYATNDGDVANRNVGDNTYEQINTINCMSSDDLVNWTDHGPIKAAGQGGAAKWAKNSWAPHAAHKTINGKEKFFLYFANSGAGIGVLVSDSPTGPFTDPIGKALVTPQTPNCSSVTWLFDPAVLVDSDGTGYLYFGGGVPQGQNSNPKTIRVVKLGPDMTSLAGNPQTIDAPWVFEDSGINKVGNTYVYSYCTNWANGPYGNARIAYMTSNSPMGPFQYQGTCFNNPGDFFQTTGNNHHTIIEFKDKYYIFYHTEWLNKQVLGSQKGYRTTHVNEMPMN

SEQ ID NO: 11342 - protein, 285 aa, Anaeromyces robustus
  Glyco_hydro_beta-prop
HIITSMYTADPAPLIVDDTLYIYTTHDEDVLINNFYTMRDWYVFSTKDMVNWTNHGPILSLDDITWADDRAWAPQTIERNGKYYFYYPAHKIDGGMAVGVAIGDSPVGPFKDIGEPLVYQDDWIDFDPTVFIDDDGQAYLYFGNPQLRYVLLNEDMVSYNEEVGIVDVELTVEGFGEGNNNPTSYDEGPFFYKRNGIYYMLFSGFRKGYESEYIGYATSTSPTGPWKYGGILMEEHEDKTFTNHSSIVEFNGHTYFFFHTGDLPDGGDFHRSVAYIEFEYNEDGS

SEQ ID NO: 11343 - protein, 285 aa, Anaeromyces robustus; identical to SEQ ID NO: 11342
  Glyco_hydro_beta-prop

SEQ ID NO: 11344 - protein, 162 aa, Piromyces finnis
  Glyco_hydro_beta-prop
VWLFDPAVFVDDDGTGYLYFGGGVPEGQASDPRTTRAAKLGDDMISIDGIPQTIEAPWVFEDSGINKVGDSYVYSYCVNWDNGPYGNAKIAYMTSENPLGPFTFQGTLLNNPGDFFGTTGNNHHTIIEFKGKWYIFYHAEWLNVQVYGSQKGYRTTHVDELP

SEQ ID NO: 11345 - protein, 202 aa, Piromyces finnis
  Glyco_hydro_beta-prop
TGCLRDPYIFKGKDGYYYLLATDMKSALGWNSNRNILSAKSSDLIHWTNESSIEIANKYPLMQGADRAWAPQAIYDPEKDSYMIYFAARVPGRDNRTIMYYAYSKNMQKLDTAPQLLFAPSNGNDAIDSDIIFQNNKYYMYYKNETNKRIYLATASHASGPYSEIKQVSEGNIGVEGPNIYQLQGTNKWLMMSDAYGNGYYV

SEQ ID NO: 11346 - protein, 194 aa, Piromyces finnis
  Glyco_hydro_beta-prop
TGCIRDPFILKGQDDYYYLLATDMKSYLGWDSNRNILTAKSKDLIHWNDVTSIEIANKYPLTQAADRAWAPQAIYDPEKKSYMIYFAVRTPGNGNKTIMYYAYSKDMKKLDTAPALLFAPRNGNEAIDSDIIFQNNKYYMYYKDETKKTICLATADHASGPYQEIKQLSDRGIEVEGCNIYPVVGTNKWLMMSD

SEQ ID NO: 11347 - protein, 289 aa, Piromyces finnis
  Glyco_hydro_beta-prop
KSPLITNMYTADPAPMVYGDTLYLYTTHDENNLKNNFYTMLDWYVFSTKDMVNWTNHGKIFSLDDISWADDRAWAPQAIERNGKFYLYCPVHKTNGGMAIAVGVSDKPTGPFKDIGHPLVDEGDWNDIDPTVFIDDDGQAYLYFGNPELRYVLLNEDMISINKSVGVKKIKMTEEAFGKGSHDTGTTYGEGPYFYKRNGIYYMAYAAFRQGKNIESLGYSTSTSPTGPWKYGGPLMTEEGGAFTVHPGIVDFKGHSYLFYHTGELPGGGDFHRSVGFAEFRYNKDGSIP

SEQ ID NO: 11348 - protein, 348 aa, Piromyces finnis
  Glyco_hydro_beta-prop
SGVSVHDPSVVKNGNKYYIFGSHMDTAFTTDLWKFTKLYTGVNENNKMFSNLFSKSNYGAFNFVGKNSEGGFSVWAPDVMFNKRMNKWVQYFCTSSTYIKSSICYALADNIEGPYTYKDCFIFSGMDSGSVGKTNIRAITGSDNGNRYFPGNKYNNKVYPNAIDPNAFYDFNGKLWLAYGSWSGGIYILELDESTGLPKHNINNGNNIDKYYGKKLAGGNHQSIEGPYILPHKAAGYYYLFVSYGTLTSNGGYQIRLFRSKNPDGPYTDAAGREFMSGTNSNFGVKIMGNYNIPGRSQAYMAPGHNSALIDDNGKILLFYHTRFNDGQEYHEPRIHQMFLNKEGWLVA

SEQ ID NO: 11349 - protein, 302 aa, Piromyces finnis; identical to SEQ ID NO: 1046
  Glyco_hydro_beta-prop

SEQ ID NO: 11350 - protein, 305 aa, Piromyces finnis
  Glyco_hydro_beta-prop
PLTNHNPLMTYRYGADPGVFVYDGRVYVFTTNDGDVDLTNKNIAENTYSHIQTLNLISSADLVNWTDHGSISVAGNNGAAKWAQYSWAPCATYKKINGKDKFFLYFANNANGIGVLTSDSPTGPWKDPIGKALITRQTPNCNVEWLFDPAVFVDDDGTGYLYFGGGVPEGQASDPRTTRAAKLGDDMISIDGIPQTIEAPWVFEDSGINKVGDSYVYSYCVNWDNGPYGNAKIAYMTSENPLGPFTFQGTLLNNPGDFFGTTGNNHHTIIEFKGKWYIFYHAEWLNVQVYGSQKGYRTTHVDELP

SEQ ID NO: 11351 - protein, 302 aa, Piromyces finnis; identical to SEQ ID NO: 1048
  Glyco_hydro_beta-prop

SEQ ID NO: 11352 - protein, 304 aa, Piromyces finnis; identical to SEQ ID NO: 1049
  Glyco_hydro_beta-prop

SEQ ID NO: 11353 - protein, 302 aa, Piromyces finnis; identical to SEQ ID NO: 1046
  Glyco_hydro_beta-prop

SEQ ID NO: 11354 - protein, 305 aa, Piromyces finnis; identical to SEQ ID NO: 11350
  Glyco_hydro_beta-prop

SEQ ID NO: 11355 - protein, 304 aa, Piromyces finnis; identical to SEQ ID NO: 1052
  Glyco_hydro_beta-prop

SEQ ID NO: 11356 - protein, 303 aa, Piromyces finnis
  Glyco_hydro_beta-prop
PLTNHNPLMTYRYGADPGVFVYDGRVYVFTTNDGDVDLTNKNIAENTYSHIQTLNLISSADLVNWTDHGSISVAGNNGAAKWAQYSWAPCATYKKINGKDKFFLYFANNANGIGVLTSDSPTGPWKDPIGKALITRQTPNCNVEWLFDPAVFVDDDGKGYLYFGGGVPTGQDANPKTIRVVQLGDDMTSIVGTPQLIDAPYVFEDSGINKIGNTYIYSYCTNWANGPYGSANIAYMTSSSPMGPFKMQKSCFKNPGEYFGNYGNNHHTMIEFKGKNYIFYHTEWLNKEVFGTQKGYRTSHVDE

SEQ ID NO: 11357 - protein, 305 aa, Piromyces finnis; identical to SEQ ID NO: 1054
  Glyco_hydro_beta-prop

SEQ ID NO: 11358 - protein, 304 aa, Piromyces finnis; identical to SEQ ID NO: 1049
  Glyco_hydro_beta-prop

SEQ ID NO: 11359 - protein, 304 aa, Piromyces finnis; identical to SEQ ID NO: 1056
  Glyco_hydro_beta-prop

SEQ ID NO: 11360 - protein, 304 aa, Piromyces finnis; identical to SEQ ID NO: 1052
  Glyco_hydro_beta-prop

SEQ ID NO: 11361 - protein, 305 aa, Piromyces finnis; identical to SEQ ID NO: 1054
  Glyco_hydro_beta-prop

SEQ ID NO: 11362 - protein, 221 aa, Neocallimastix californiae
  Glyco_hydro_catalytic_dom
AKKILVAIWKQIAAEFADYDEHLIFEGMNEPRKVGDPAEWNGGDYEGWNFVNEMNDLFVKTIRSTGGNNALRHLMIPTYAACINDGAINNFKFPRGDDKVIVSLHSYSPYNFALNNGAGAVSNFYDGSEIDWAMNTINSNFISKGIPVIIGEFGAMNRNNENDRERWAEYYIKKATSIGVPCVIWDNGYFEGEGERFGLINRSTLQVVFPKLINGLIKGLG

SEQ ID NO: 11363 - protein, 304 aa, Neocallimastix californiae
  Glyco_hydro_catalytic_dom
QYTGVNESGAEFGQGEYPGTYNKHYIYPDVKAIQASIDQGMNIFRVGFAWERLQRSLNAEFDATEFGRLDEVINYITSNGAVAIINPHNFARYKNAVIGTSQVPNSAFSNLWKRLAQKYKNNQKVWFGLVNEPHDMPTAQWFAAARDAVDTIRATGANNNVLVPGNAYTGAWNWKETFYGESNASVALRYFSSADKNIIFETHQYFDSDYSGTHEQCVQRPCNKLFVNFVEWLKANNLKGFIGEFGAAINRDCKACVEEAINYLEQNSANIVGWAWWAAGPWWGNYMYSLEPKGNKFPEQMTWL

SEQ ID NO: 11364 - protein, 126 aa, Neocallimastix californiae
  Glyco_hydro_catalytic_dom
EANADVSLRYFSSEDENILFEVHQYFDTDYSGSHDTCVQRPCQNNLKEFVEWLKTNNLKGWVGEIGGLANDECKECIEEVLEYLQENRDVIKGVQWWAAGPWWGHNALSIEPNAEKAFPGQMAWLK

SEQ ID NO: 11365 - protein, 215 aa, Neocallimastix californiae
  Glyco_hydro_catalytic_dom
PGYLSTKGHNIVDSKGRKVQLSGLSWFGGETTNLSPHGLWTNSLANFIKIVKDNGYNHLRYPWTNEMFFEGAKTQSIDQMNNPDLVDLSPLEVMDAVINECGKAGLKVYLDRHRPLSGGQSELWYVDEVDEAKWIEDWQFLAKRYKGNPTVIGADLHNEPHGKACWGCGEEERDWRLAAERCGNAIHEVNPDWLIIVEGNDHYGEEGWQKGESYW

SEQ ID NO: 11366 - protein, 344 aa, Neocallimastix californiae
  Glyco_hydro_catalytic_dom
PGFLSTKGHNIVDSKGRKVQLSGLSWFGGETTNLSPHGLWANSLANFIKIVKDNGYNHLRYPWTNEMFFEGAKTQSVDQVNNPDLADLSPLEIMDAVINECGKAGLKVYLDRHRPLSGGQSELWYVDEVDEAKWIEDWQFLAKRYKGNPTVIGADLHNEPHGKACWGCGEEERDWRLAAERCGNAIHEVNPDWLIIVEGNDHYGEEGWQKGESYWWGGMLKGVKEFPVRLNTPNKLVYSAHDYDKNVHMQDWFKEADFPDNMPPIWDDKWGYIVKEDIAPVLIGEFGSLLRDATDVKWLSNLIDYMKENEVHWTFWCLNPNSGDTEGILGYDWKTVNTKKDGIL

SEQ ID NO: 11367 - protein, 307 aa, Neocallimastix californiae
  Glyco_hydro_catalytic_dom
TLVNPKAIPAAKKLYDFLKSNYGKRILSGQVGAAGQAGDEGEEFKRIMNATGKKPAVWNMDFIFESNDCTWRPTNPDITEMAINWWKKYQGKGIMSAQWHWNIAGRTGNFAFYKKDTTFDLEKAVTEGTWEYEKIIKDIDRVSGLIKKLQAINMPLIWRPLHENNGDWFWWGNNPKACAKLWKILYERMVNYHGLNNLIWLWNGNNDEYTPIEYIDIIGVDIYANDHGPQTTAYNTHFDFYGGKKMVVLSENGRIPDIQQCVDQGAWWGYFQTWNNEFILQNHYHTDAQLKEYFNHKIVMNMDELPS

SEQ ID NO: 11368 - protein, 232 aa, Neocallimastix californiae
  Glyco_hydro_catalytic_dom
PDITEMAINWWKKYQGKGIMSAQWHWNIAGKTGNFAFYKKDTTFDLEKAVTEGTWEYKKIIKDIDRVSGFIKKLQAINMPLIWRPLHENNGDWFWWGNNPKACAKLWKILYERMVNYHGLNNLIWLWNGNNDEYTPIEYIDIIGVDIYANDHGPQTTAYNTHFDFYGGKKMVVLSENGRIPDIQQCVDQGAWWGYFQTWNSEFILQNSYHTDAQLKEYFNHKIVMNMDELPS

SEQ ID NO: 11369 - protein, 358 aa, Neocallimastix californiae
  Glyco_hydro_catalytic_dom
LSLLSLAVIGSKAMKNISSKELVKDLTIGWSLGNTLDATCFETLDYNKNPIASETCWGNVKTTQELYYKLSDLGFNTFRIPTTWSGHFGDAPDYKINDQWMKRVREIVDYALNTGGYAILNIHHETWNHAFQKNLDSAKKILVAIWKQIAAEFADYDEHLIFEGMNEPRKVGDANEWNGGDYEGWSFVNEMNDLFVKTIRATGGNNALRHLMIPTYAACVMDNAVNNFKFPSGDDKVIVSLHSYSPYNFALNNGAGAISNFNDGSEIDWVMNIINSNFISKGIPVIIGEFGAMNRNNEDDRERWAEYYIKKATSLGIPCVIWDNGYFEGEGERFGLINRSTLQVVYPKLVNGLIKGLG

SEQ ID NO: 11370 - protein, 39 aa, Neocallimastix californiae
  Glyco_hydro_catalytic_dom
VIWDNGYFEGEGERFGLINRSTLQVVYPKLVNGLIKGLG

SEQ ID NO: 11371 - protein, 343 aa, Neocallimastix californiae
  Glyco_hydro_catalytic_dom
PGYLSTKGRHIVDEKGRKVRLAGISWFGGETTNLSPHGLWAKPLDHFIKVIKDHGYNHIRYPWTNEMLFPGAKTESINAMENPDLVDLTPLEVMDAVIDACGKAGLKVYLDRHRPLSGGQSELWYISKVDEKKWIEDWQFLAKRYKGNPTVIGADLHNEPHGTACWGCGETQRDWRLAAERCGNAIHEVNPDWLIIVEGNDHYGEEGWQKGEGYWWGGMLKGVKENPVRLKKPNKLVYSAHDYDKNVHMQDWFKVSSFPDNMPEIWDDKWGYIVKEDIAPVLIGEFGSLLRDKTDVKWLQNLISYMNKNTVHWTFWCLNPNSGDTEGILGYDWETVNTQKDGI

SEQ ID NO: 11372 - protein, 51 aa, Neocallimastix californiae
  Glyco_hydro_catalytic_dom
FYMEKVTAMGVPQIWWDNGVFEGTGERFGLLDRKNLKIVYPTIVAALQKGR

SEQ ID NO: 11373 - protein, 142 aa, Neocallimastix californiae
  Glyco_hydro_catalytic_dom
AACNENSFNNFIFPEDDDKVIASVHAYAPYNFALNNGEGAVDKFDAAGKRDLEWNINLMKKRFVDQGIPMILGEYGAMNRDNEEDRATWAEFYMEKVTAMGVPQIWWDNGVFEGTGERFGLLDRKNLKIVYPTIVAALQKGR

SEQ ID NO: 11374 - protein, 307 aa, Neocallimastix californiae
  Glyco_hydro_catalytic_dom
KNYSKGFRIGAATNTIHYNNANYVNAMKAFNYMVAENACKFVSIQGTKGRFNFNDCDAHYNKAKELGMDFRGHALIWHSMAPKWLEYEDSNTMRNSIVNHITTVLKHYEGKIDTWDVVNEAIDDDSNGNGWKYRNSFLYQKNRDFIDLAFKTARQVAPKVKLFYNDYNTEGIWGKSESVYQFVADLKKRNIPIDGVGLQYHVSVQNQPQFNKINDLIGRYCKLGLEVHITELDVSCVNSCNAGDVESRQSQVFTNALKACLNNSCCTAFLVWGIGDPDSWLGNDKKGLLFNGNYQPKSQYNALLNVL

SEQ ID NO: 11375 - protein, 320 aa, Neocallimastix californiae
  Glyco_hydro_catalytic_dom
IQQVRPDFYFGVSTASHFFANPKYNDIISTYNLQVAGNECKFYTFNGSQTFNTKPCDDTVAFAKKYGAKFRGHNLFWPAYSPQWFQDAHDGSDPEAVKEYILDYVAKVLDHYKDEEDIIYWDVINESVTDDSTAKNIKLRTGSDNSNEFEGWDTYTEDIFKVAREHTNENVKLFYNDYNAEANNGNFDGKTGAVFEYIRSMREKGVPIDGVGLQMHVSCNWTPNYEQLTKLISQYEEIGVEVHITEIDVKRTQCKSAEAQKEVFMNVFKACFDHENCKVFTVWGSYDEESWVGVENEPVLFDVDMYPKDIYFDMLDYVLE

SEQ ID NO: 11376 - protein, 59 aa, Neocallimastix californiae
  Glyco_hydro_catalytic_dom
STPSPIRDISSKELIKEMNFGWNLGNTMDAQCIEYLNYEKDQTASETCWGNPKTTEDMF

SEQ ID NO: 11377 - protein, 308 aa, Neocallimastix californiae
  Glyco_hydro_catalytic_dom
DYSNGFRIGAATNTRFYNNGNYVNAMKAFNYMVAENACKFVSIQGTKGKFNFNDCDNHLKKAKELGMDFRGHALVWHSMAPDWLKNEDSKTMRQSIVNHITKVLQHYDGKIDTWDVVNEAIDDDSNGNGWKYRNSFLYQKNRDFIDLAFKTARQVAPKVKLFYNDYNTEGIWGKSESVYQFIADLKKRNIPIDGVGIQYHVSVKNQPQLNKITDLIGRYCKLGLEVHITEIDVSCEGACNNGDVQNRQAQVFTNALKACLANSCCTAYLVWGIGDNDSWLGADKKGLLFDGSYKPKAQYTALLNTLKT

SEQ ID NO: 11378 - protein, 349 aa, Neocallimastix californiae
  Glyco_hydro_catalytic_dom
AKAAPFRMGVGLNGSDKSTSTVLSKKMREIIAYQFNSVTYSNLMKAENILDKAASQANAKKGDDMPVLKFDTIVDGLEFCKENNIKMRGHTLVWHVQTPEWFFRTDFSDSGSYVNAAKMEKRMESYIKQMLEFVQYYYPGIVDVWDVVNEAVEIEGGSYDASTGWNTRTRYNGSPNPWYTTMGADYVIKAFRIARKYADKNVKLIYNDYNTFMSQKTTAICNLIKKLKAENLVDGVGLQSYLNADWPNRNDYKTAIQKFAALGVEVQATELTIRTDGTANKYNTQAKHYEEVFKIYKDLKKSGVNITSVTVFGLQDGYLFYNNDSTDTRLWDHNLKKKPVYNSIMKVLS

SEQ ID NO: 11379 - protein, 337 aa, Neocallimastix californiae
  Glyco_hydro_catalytic_dom
GTNKSSSPVFSKKMREIIKYQFNSVTFTNLMKAEFMLDKSASQANARNGNDMPVLKFDTIVDGLEFCKENNIKMRGHTLVWHTQAPEWFFRTGFNDNGSYVDKNKMEKRMESYIKQMLEFIQYYYPGVIDVWDVVNEAVEIANGSYDASSGWNTRTKFDNNKTNPWYATMGPDYVFKAFRFARKYADKNVKLIYNDFNTFQYPKTDNICNLVKKLKAENLIDGVGLQSYLGPSWPNRNDYKNAIQKFGALGVEVQITELTISVENGNNKFTTQANQYRDVFKIYKDLKKSGVNITSVTVFGLQDHYLFYDNDNTETRLWDGNLKKKPVYNAIMNVLK

SEQ ID NO: 11380 - protein, 352 aa, Neocallimastix californiae
  Glyco_hydro_catalytic_dom
GFVQTDGTNFVVDGCKRYFSGSNTYYLMVSSHERVDLALEAYARHNLNVVRAWAFCDECEDATRLVDFSGPEVKLNSLNMEKVDYYLAAAAQRNIRVVLTLTNNWTDYGGMDVWVKKFGGKYHDEFYTNRKIIEGYKQYIKAMINRVNTYTGQLYKDDPTIFSWQLANEARCNNGPHGLPVKNCNTDTITKWMDEIATFIHKEDPNHLVSSGIEGIGLTPPAGVDPYTYVYTYTEGTDYEAISALDSIDYNTVHMYPVGWGLKDYAKDGVTWIQAHADVDKKFNKPTVVEEWGLSTSVDNVPIKERDPIYTQWMNAVLANDNIGMNMFWYVCGEDYYGTDGYLLEDDEITAV

SEQ ID NO: 11381 - protein, 306 aa, Neocallimastix californiae
  Glyco_hydro_catalytic_dom
AAKGFRIGAATNTIHYNNPNYINAMKAFNYMVAENACKFVSIQYTKGKFNFDDCDNHLKKAKELGMAFRGHALIWHAMAPGWLEREDGNTMKQSIINHITTVLKHYEGKIDTWDVVNEALDDSSNGNGWKLRNSFLYQKVPDFIDIAFQTARKVSPNTKLFYNDYNTEGIWGKSESCYQFIADMKKRNIPIDGVGIQYHVGINVQPKFEKINNLISRYCKLGVEVHITELDVSCDDNCRDADGGESKQGQVYTNALKACLNNSCCTGFLVWGIGDKDSWRGVESKPLLFDANYQPKGQYTAILNTL

SEQ ID NO: 11382 - protein, 231 aa, Neocallimastix californiae
  Glyco_hydro_catalytic_dom
HAMAPGWLEREDGNTMKQSIINHITTVLKHYEGKIDTWDVVNEAIDDGSNGNGWKLRNSFLYQKVPDFIDIAFQTARKVSPNTKLFYNDYNTEGIWGKSESCYQFIADMKKRNIPIDGVGIQYHVGINVQPKFEKINDLISRYCKLGVEVHITELDVSCDDNCRDADGGDSKQGQVYTNALKACLNNSCCTGFLVWGIGDNDSWRGAENKPLLFNTNYQPKGQYTAVLNTL

SEQ ID NO: 11383 - protein, 308 aa, Neocallimastix californiae; identical to SEQ ID NO: 22
  Glyco_hydro_catalytic_dom

SEQ ID NO: 11384 - protein, 291 aa, Neocallimastix californiae
  Glyco_hydro_catalytic_dom
PITINGKRLLIKGVNRHDSDPFNGRAVPQQTLREDIALMKKHNINAIRTSHYSNDSYLYWLCNKYGMYVMGETNLESHALQNNHDAKAKFYELGMDRTETAYKRLKNNPSIFAWSIGNEMAYTNNPNDAGGLFRDMIWYFKKNDSSRPVHSEGQGSSMGVDMSSNMYPGSDGLGVHAGRGKMPYIMCEYDIASGNAIGALKEYWDVIRSADNMLGGFIWDWVDQSRAKTLNGGWDYYSQSYAITNLYSEEIKGKFYAYGGDWGDWPNDNSFCVNGLINPDRTPQPELAEVK

SEQ ID NO: 11385 - protein, 202 aa, Neocallimastix californiae
  Glyco_hydro_catalytic_dom
YWPYKWPGMQSWLNQVKSFIDDKKKSGLTNWYGLEIWNEPDGTWDNANGSFNDMWKKTYDLIRQADPGEKIIGPCFSWYEENKMKNFLQYCKQNNCIPDIISWHELSGIEGVSSHLRGYRNLERSLGIKELPISINEYCDAEHELEGQPGSSARFIGKFERYKVDSAMITWWFVPHPGRLGSLMATDTQKGAGWYFYKWYGD

SEQ ID NO: 11386 - protein, 307 aa, Neocallimastix californiae
  Glyco_hydro_catalytic_dom
HANGFRIGAAANTMYFNNQSYINALKSFNYMVAENGCKLSGIQQQKGVYNFNDCDNHLKKAQELGMDFRGHCLIWHAYQPSWFENADANTLKNAIVDHITKTLQHYEGKIDTWDVVNEAIDDSSNGNGWKMRNSFLYQKVPNFIDLAFQTARKVSPNTKLFYNDYNTEGIYGKSESVYQFVKDLVSRNIPIDGVGIQYHVSVQSQPQYNKINDLISRYCKLGLEVHITELDVKCDNQCYSGNVEQQQATVFTNALKACLSNSCCTGYLVWGVGDNNSWLGSDKKGLLFDGNYRPKSQYTAVLNMLKE

SEQ ID NO: 11387 - protein, 59 aa, Neocallimastix californiae; identical to SEQ ID NO: 11376
  Glyco_hydro_catalytic_dom

SEQ ID NO: 11388 - protein, 162 aa, Neocallimastix californiae
  Glyco_hydro_catalytic_dom
KVARRLSKTPGALVSVDLADILPYWPYQWPGLDKWLDAVRSFIRDKKASGLKNWYGYEIWNEAENTWRDSNGLSFFEMWKETYRVIREMDPDEKIIGPCDGLYSEQRMRPFLEYCLKNDVMPDIMCWHELMGIELIPGRYKAYRKLEKSLGIKELPITINEY

SEQ ID NO: 11389 - protein, 109 aa, Neocallimastix californiae
  Glyco_hydro_catalytic_dom
IIFEVHQYFDSDYSGTHDTCVQRPCQNLLKEFVEWLKTNNLKGWLGETSSTLSEGCKECVQEVLEYLEENREHVLGVTWWAAGPWWGHTACAIEPNEEKAFPEQMAWLK

SEQ ID NO: 11390 - protein, 309 aa, Neocallimastix californiae
  Glyco_hydro_catalytic_dom
KLQYLGTNEAGGEFGDAVLPGVYNEHYIYPNINAIEASIEQGMNVFRMGLRWERFQHELFGDLTEFDLTEYKKIVDATTAKGAVLIIDPHNYARYNNNVIGSEEVPIEAFADFWAKLAEVFKDNEKVWFDLVNEPHDMETDDWFKAARAAVDAIRTTGAKNNILISGNGWDGAWSWGKEAWYGESNADVALRYFSSEDENIIFEVHQYFDSDYSGTHDTCVQRPCQNLLKEFVEWLKTNNLKGWLGETSSTLSEGCKECVQEVLEYLEENREHVLGVTWWAAGPWWGHTACAIEPNEEKAFPEQMAWLK

SEQ ID NO: 11391 - protein, 350 aa, Neocallimastix californiae
  Glyco_hydro_catalytic_dom
LLTLSAASSALALTTQQVIKEMGLGWNLGNTLEATGDWINGNNVNAYETAWGNPAATKELINAIKNNGFNSIRIPVSWSNLMSSDYTISEELLKRVNEVVSWVIENDMYAIINIHWDGGWIEKFGTNESTMANQKFVKIWNQVSDYFKNYGEHLIFESLNEEGCWNDVWNRYSNAGDKNKAYSTLNNINQQFVDIVRKSGGNNKSRHLLIAGYCTDIDLTVDSAFKMPTDSENRMMVSVHYYTPSTFTILEKDEDWGKFQGTWGTDADVNELITNFDKLKKRFVDNGVPVIIGEYATVLTNKDKASVHKYLFTCAQYATSLGICPMLWDNGEYFDRKGLQFKDSEIGEFY

SEQ ID NO: 11392 - protein, 50 aa, Neocallimastix californiae
  Glyco_hydro_catalytic_dom
IQYKAKYIIDNNFGGMMIWELENDTDDFEILTAINDNLGCKDSNKSSNSS

SEQ ID NO: 11393 - protein, 249 aa, Neocallimastix californiae
  Glyco_hydro_catalytic_dom
FTLCFDTSKKNSCIDSKIIVGYFSEWKNANYPISRVDLSKITHLNYAFGVIDPNSYAVTGYDSNILSQVVTAAHSQGVKVLMSVGGWYGSRYFTQMTSSKSNIEKFVDSCQSLISNYGVDGIDIDWEYPGREGACNSPDMANDAENYLTLLKILREKIGNALISAAVSVIPFEKNGQPISDLSEYEKYFDYINVMAYDFAGSWTPTVSHHSALYDPEAGEKLSLSSGVKNWLSRGFPANKIVVGVPAYG

SEQ ID NO: 11394 - protein, 311 aa, Neocallimastix californiae
  Glyco_hydro_catalytic_dom
GKLKYLGVNEAGGDFGEGHLPGVYNTHYTYPNIDAISTSIEQGMNAFRMGLRWERFQHELFGELTEFDLTEYKKIVDAVTAMGAVIIVDPHNYARYKDKLIGSEEVPTEAFVDFWKKMANVFKDNDKVWFGLVNEPHDMKTDDWFKIARAAVDGIRSTGANNTILIPGNGWDGAWSWGSQAWYGESNAEVALRYFSSEDENIAFEVHQYFDSDYSGGHGTCEKRPCQNNVKEFVQWLKDNNLKGWFGEFSGHISDSQCKECVQEFLEYLQLNNEYVLGATWWAAGPWWGQNSYTIEPNAKKEFPGQMAWLK

SEQ ID NO: 11395 - protein, 65 aa, Neocallimastix californiae
  Glyco_hydro_catalytic_dom
GEFSGHISDSQCKECVQEFLEYLQLNNEYVLGATWWAAGPWWGQNNYTIEPNAKKEFPGQMAWLK

SEQ ID NO: 11396 - protein, 349 aa, Neocallimastix californiae
  Glyco_hydro_catalytic_dom
LTLATASSALALTTQQVVKEMGLGWNLGNTLESTGDWINGRNVNAYETAWGNPAATKDLIKAIKNNGFNSIRIPVSWSNLMSSDYTISQELLKRVNEVVSWVIDTGMYAIINIHWDGGWIEKFGTNESTMANQKFNKIWTQVSDYFKNYGEHLIFESLNEEGCWNDVWNRYSNSGNKNKAYSTLNNINQQFVDIVRKSGGNNKNRHLLIAGYCTDIDLTVDSAFKMPSDSANRMMVSVHYYTPSTFTILEKDEDWGKFQGTWGTDAEIKTLMADFDKLKKRFVDNGVPVIIGEYATVLTNKDKASVHKYLFTCAQYATSLGICPMLWDNGDYFDRKALKFKDSEIGDFY

SEQ ID NO: 11397 - protein, 139 aa, Neocallimastix californiae
  Glyco_hydro_catalytic_dom
PYWPYQWPGMQKWLELVRQFIRDKKAAGIKNFYGYEIWNEAENTWRDSNGYTFFEMWKETYKVIREMDPDEKIIGPCDGLYSEERMRPFLQYCLDNDVMPDIMCWHELMGVELIPRRYKAYRELEASLGIKELPITINE

SEQ ID NO: 11398 - protein, 76 aa, Neocallimastix californiae
  Glyco_hydro_catalytic_dom
GIPMILSEYCAMNRDNEEDRATWAEFYMEKVTAMGVPQIWWDNGIFEGTGERFGLLDRKNLKIVYPTIIAALQKGR

SEQ ID NO: 11399 - protein, 205 aa, Neocallimastix californiae
  Glyco_hydro_catalytic_dom
ILPGWPYKWPGIQTWFNEIRSFINDKKKSGLTNFYGNEIWNEPDVTWKDSNGLSFNQMWKQTYDLLRQIDPNEKIIGPSFSWYEENKMKNFLQFSKQNNCLPDIIAWHELSGIDGVSSHFRSYRNLEKSMGISERPITINEYCDENHDLEGQPGSSARFIGRFERYKVDSGMITWWFVPHPGRLGSLLASDTQKGAGWYFYKWYG

SEQ ID NO: 11400 - protein, 368 aa, Neocallimastix californiae
  Glyco_hydro_catalytic_dom
SFYKGVDISSIISLENSGVQFYDTNGQPQDIFKTLASVGVNCIRVRIWNSPRSTDGKTYGGGNNDLEVAREIGSRAAKAGLPLFVDFHYSDFWADPAKQSIPKEWKGFDLNKRIFEIYRFTKGCLEWLLENGSYISMVQIGNETTCFMCGENEMVNVMKMMSNGIQAVRDINKNILIALHFTNPNKTDNMLWYASQLAEAKVDYDVFCTSYYPFWHGTTENLQWILGEIANKYGKKVMVAEFSYPYTEVAKTSDNCEYSHVNHKLEGTEFNYPLTLDGQIQCIKDVYSHIKNTKNGIGAFYWEPAWIAPKASNDLERRQLWEKYGSSWATKTAAEYDINADSSLTGESAWDNQAVFDQEGKPLKSIWA

SEQ ID NO: 11401 - protein, 306 aa, Neocallimastix californiae
  Glyco_hydro_catalytic_dom
PGYLSTKGHNIVDSKGRKVQLSGLSWFGGETTNLSPHGLWANSLANFIKIVKDNGYNHLRYPWTNEMFFEGAKTQSVDQVNNPDLADLSPLEIMDAVINECGKAGLKVYLDRHRPLSGGQSELWYVDEVDEAKWIEDWQFLAKRYKGNPTVIGADLHNEPHGTACWGCGETKRDWRLAAERCGNAIHKVNPDWLIIVEGNDHYGEEGWQKGEGYWWGGMLKGVKENPVRLNTPNKLVYSAHDYDKNVFMQDWFKESDFPDNMPPIWDDKWGYIVKEDIAPVLIGEFGSLLRDATDVKWLSNLIYYM

SEQ ID NO: 11402 - protein, 264 aa, Neocallimastix californiae
  Glyco_hydro_catalytic_dom
EAIDYFIAAASQRNIRLVLGFTNNWTDYGGMDEWVKGFGGKYHDDFYTNKEIRNAFKRYIKTVITRINRHTNIRYRDDPTIFSWQLANEPRCGNGPSGLPQSGKCTPEVITEWADDISSYIKELDPNHLVSVGVEGFGLEAPKGSKGLYAYKYDEGTDFEALTALPNVDYNTYHYYPIPWGMTDLISHTKDWIESHQAVGKKLNKPVVFEEWGLEVPTDCSKEERIQYYKTWTKQILDADVPMNMFWYTVGADYYGTDKYILKE

SEQ ID NO: 11403 - protein, 309 aa, Neocallimastix californiae
  Glyco_hydro_catalytic_dom
DYANGFRIGVAANTMKFNNQAYNEALKAFNYMVAENGCKLSGIQQQKGVYNFSDCDNHLKKAKELGMDFRGHCLIWHSYQPSWFENADANTLKNAIVDHITKTLQHYEGKIDTWDVVNEAIDDSSNGNGWKMRNSFLYQKVPNFVDLAFQTARKVSPNTKLFYNDYNTEGIYGKSESVYQFVKDMISRNIPIDGVGIQYHVSVSSQPKYEKINDLISRYCKLGIEVHITELDVKCDNQCNSNNVEQQQATVFTNALKACFSNSCCTGYLVWGVGDNDSWLGSDKKGLLFNSNYKPKSQYTAILNFLKEN

SEQ ID NO: 11404 - protein, 352 aa, Neocallimastix californiae
  Glyco_hydro_catalytic_dom
EEAPFRFGVGLNGASIENSTVSSKTMREVIKHQFNSVTYSNLMKSLFILNQEGSIKNLKEGKQDPALDFSGIVDGLDFCQKNGIHMRGHVLVWHNQVPRWFFTKDYSEDGEFVDPETMEYRLDSFIRQYLGFVQYYYPGVVDVWDVVNEAVEVVGEQYDNSTGWYTRTLYDEVKPNMWYDMFGPDYVVKTFRIARKYALPNVKLVYNDYCTYVTKPISKRDAIVKLLGILQKEDLVDAIGMQSYINPEEDVNDHLAAIEVYQQTGLEIQITELTIRVKNTDDWEEYNIQQYSQLFEGIMKYVRKGYNIGSVTVFGLQDGYRFYENDSTKTRLFDHDLQKKKVYRAIMDIIKA

SEQ ID NO: 11405 - protein, 356 aa, Neocallimastix californiae
  Glyco_hydro_catalytic_dom
KEAPFRFGVGLNGGAISTSTTTSKKMREVIKYQFNSMTYTNLMKPEFVLDKEGCLKNAENGSEEVVLKFDDIVDGLDFALKNNIHVRGHVLVWHTQTPDWFFRKGFNSENEFADVETIYQRLESYIRQYLGFVQHNYPGVIDVWDVVNEAIEINDGYFDNSTGWYTRVSTQTEESLWYKIVGPDYVKKTFEIARKYALPNVKLVYNDYNTFQTYPHDKTQAIIDLMNILRKDNLVDALGMQSYIGETWPKIEEYVRAIERFTEAGLELQITELTITPPSGEGWLEKQAQQYREFFEKVMEQINKGANITSVTVFGIQDGYRFYTSDSTKTRLLDHDLQKKPNYEAIMEVLKANKKS

SEQ ID NO: 11406 - protein, 344 aa, Neocallimastix californiae; identical to SEQ ID NO: 46
  Glyco_hydro_catalytic_dom

SEQ ID NO: 11407 - protein, 42 aa, Neocallimastix californiae
  Glyco_hydro_catalytic_dom
GVPQVWWDNGIFEGEGERFGIFDRSNLKIVYPGIVAALQKGR

SEQ ID NO: 11408 - protein, 320 aa, Neocallimastix californiae
  Glyco_hydro_catalytic_dom
IQQVRPDFYFGVATQKTFFANPKYKDIMSTFNLEVGGNECKFYTINGSETFNTKACDESIAFAKKQGAKYRGHNLFWPANSPSWFKSAYDGKDPEEVKEYILDYITKVLDHYKDEEDIIYWDVINESVTDDSTPENIKLRTGSDTSNEFKGWDTYTEDIFKLAREHTNENVKLIYNDYNAEANGGNFGGKTGAVFQYIKSMKENGVPIDGVGLQMHISCNWTPNYEELTKLISQYEEIGVEVHVTEIDVKMENCKTHDDQRKVYMNIFKACFDHENCKVFTVWGAYDSESWVGAENEPLIFDEDMYPKDIYFDMLDYVID

SEQ ID NO: 11409 - protein, 343 aa, Neocallimastix californiae
  Glyco_hydro_catalytic_dom
PGYLSTKGKYIVDEKGRKVKLAGLSWFGGETPNLSPHGLWAKPLAHFIKVIKDHGYNHIRYPWTNEMFVEGAKTESINAMENPDLVDLTPLEVMDAVIDACGKAGLKVYLDRHRPTAAGQSELWYISKVDEKKWIEDWKFLAKRYKGNPTVIGADLHNEPHGTACWGCGETERDWRLAAERCGNAIHEVNPDWLIIVEGNDHFGEEGWQKGESYWWGGMLKGVKENPVRLNKPNKLVYSAHDYDKNVHMQEWFKLSTFPDNMPEIWDDVWGYISKEDIAPVLISEFGSLLRDKTDVKWLENLVSYMNDNAVHWTFWCLNPNSGDTEGILGYDWETVNTQKDGI

SEQ ID NO: 11410 - protein, 363 aa, Neocallimastix californiae
  Glyco_hydro_catalytic_dom
KFEGFGTSFCWWANRLGYSDILSEKAATLFYDKKEGLGLTIIRYNIGGGDNPSHNHITRTDSNMPGYAINPRYNGNGSYTWDYNWNSDFNQRNALLKAIAKNKEEIIVEGFSNSPPYFMTNSGCSTGNTDPNKDNLKSDAYPAFAKYLADVAEHFSKSWGVTFQSMTPVNEPFTNYWGANSKKQEGCHFDQGNSESKIIVELRKAIDQKGLKSIQISGTDETSIDTQITSYEKLSNEAKNIITRIDTHTYSGSKRYELRVLAENSKKNLWMSEVDGGGVAGTNAGEMGAGLWLANRIIEDLNGLRSSAWVLWQVIDNHISKNGYNGKKDSGMVNLNGGYWGIAVADHDKNDIILTQKYYAFGQ

SEQ ID NO: 11411 - protein, 349 aa, Neocallimastix californiae
  Glyco_hydro_catalytic_dom
IFGCVGSSLALTTKEVIKDMGLGWNLGNTLEACGDWINGSTTKQYETAWGNPETTEAMIKGVKSYGFKSVRIPVAWSNLMSSDYTISPLLLKRVEEVVNYVVKNDMYAIMNIHWDGGWFEKFSTSEQEAFTKYKKVWEQLTDYFKSFDEHLIFESLNEEGCWDSIWNRYSKSGDKAKAYGLLNTINQNFVDIVRNSGGNNTNRHLLLAGYCTDIDLTVDEAYVVPKDDRVMVSVHYYTPSTFTLLEEDADWGKAAPTWGTDDEVNYLINDFNKLKTRFVDKGIPVIIGEYGTTAKNKDTESIHKYLMTCAEYALNLDMCPVVWDAGQYFDRNSLTFKDSEIGELYKSLS

SEQ ID NO: 11412 - protein, 353 aa, Neocallimastix californiae
  Glyco_hydro_catalytic_dom
GFVQTDGTNFVVDGCKRYFSGSNTYYLMVSNHERVDLALEAYARHNLNVVRAWAFCDECEDATRLVDFSGPEVTLNSENMEKVDYYLAAAAQRNIRVVLTLTNNWTDYGGMDVWVKQFGGKYHDEFYTNRKIVEGYKQYIKAMINRVNTYTGQLYKDDPTIFSWQLANEARCNNGPHGLPVKNCNTDTITNWMDEIASFIHQEDPNHLVSSGIEGIGLTPPSGVDPNTYVYRYDEGTDYEAISALDSIDYNTVHMYPVGWGLKDYSKDGVTWIKAHADVDKKFNKPTVVEEWGLSTSADNVPLEERDPIYTKWMDAVLANDNIGMNMFWYVCGEDYYGTDGYLLEDDEITAVI

SEQ ID NO: 11413 - protein, 204 aa, Neocallimastix californiae
  Glyco_hydro_catalytic_dom
LPGWPYNWPGMQSWLNQVKSFINDKKKSGLTNWYGLEIWNEPDGTWKDSNGSFNQMWKQTYDVIRQADPGEKIIGPCYSWYQENKMKDFLQFCKQNNCLPDIISWHELSGIEGVSSHLKAYRNLERSLGIKELPISINEYCDAEHELEGQPGSSARFIGKFERYKVDTAMITWWFVPHPGRLGSLMATDNQKGAGWYFYKWYGD

SEQ ID NO: 11414 - protein, 204 aa, Neocallimastix californiae
  Glyco_hydro_catalytic_dom
  MOD_RES (25)..(25): Any amino acid
LPGWPYNWPGMQSWLNQVKSFINDXKKSGLTNWYGLEIWNEPDGTWRDSNGSFNQMWKQTYDLIRQADPGEKIIGPCYSWYQENKMKDFLQFCKQNNCIPDIISWHELSGIEGVSSHLKAYRNLERSLGIKELPISINEYCDAEHELEGQPGSSARFIGKFERYKVDTAMITWWFVPHPGRLGSLMATDNQKGAGWYFYKWYGD

SEQ ID NO: 11415 - protein, 327 aa, Neocallimastix californiae
  Glyco_hydro_catalytic_dom
ILFSIIGWASTTLAALTTEDIIKGLTVGVNLGKTFEINRDWKSVENINQPWAEKNFTAKEIVESYKQLGFNAIRIPVKWAKTINSKTVIEPNLLKSVEEVVRQTLNNNMFAIINLETSNTFMTGFISEDDNIRSETYDGYKGIWKQISNYFKDYDEHLLFESMNDSGYWEDIWNTRTSDGDRQYALDILRQVNQEFINMVRSTGGSNEERYLLVSGYANDPILTQDNFYKIPSDPSHKLMVSLYYYVPNHFTIIDNYYTWGSQDDIKQLQTIMKNLSVRFVIQGVPVVITRYGTIVKNRSSANIHSYLTSIANNASSKNIPSFLSDS

SEQ ID NO: 11416 - protein, 368 aa, Neocallimastix californiae
  Glyco_hydro_catalytic_dom
NFYKGVDISSIISLENSGIRFYDTNGQQIDIFKMFASVGVNCIRVRIWNNPKSANGKTYGGGNNDLEVAREIGSRAASAGLPLFVDFHYSDFWADPGKQTIPKDWKNFNLDKRVSEIYRFTKGCLEWLLQNGSLISMVQIGNETTCFMCGDKNMTNVMKMMSNGAKAVREINRDILIALHFTNPNKSDNMLWYASQLASARVDYDVYSTSYYPYWHGTTDNLKWVLGEIANKYGKKVMIAEYSYPYTEVAYTSDNCHYGVVDSKASGTVFRYPISVDGQIQCIRDMYSVMRNTKNGIGAFYWEPAWIAPKARNDMERRQIWEQYGSSWATKTAAEYDSNADRNLTGGTSWDNQAIFDQNGKVLKSIWA

SEQ ID NO: 11417 - protein, 293 aa, Neocallimastix californiae
  Glyco_hydro_catalytic_dom
MHVQGSKLLDGNGNEFIFRGINIAHAWYTDKTEFSINEINALGANSARIVLACGAKYTKTSYTEVEKIIGWCEKAGLVCVLELHDFTGSDNPSDITTTALNYWKEMKDLVNTHKDYIIINIANEWQGSWNKGSLWGNTYSSAVKSMRNIGIQNAIMIDASGYGQETGPMINYAQSVLSADPNKNVIFSYHVYSVLGKDNTSLYSGFDGIKAKGVCWIVGEFGWWQNGGDVVYKSLMSYCNSNRIGWIAWSWSGNGGIDTCLDLTSSKTFSRNSLSDWGKYVFYSNDGIKYSSK

SEQ ID NO: 11418 - protein, 358 aa, Neocallimastix californiae
  Glyco_hydro_catalytic_dom
AKAAPFRFGVGLNGGAIENSTTSSKTMREVIKHQFNSVTYSNLMKAVFVLNQEGSIKNLKKGKQDPVLDFSTFVDGLDFCQKNGIHMRGHVLVWHNQAPRWFFTKNYEEDGEYVDAKTMEYRLESYIKQYLSFVQFNYPGVVDVWDVVNEAIEVVDNQYDKSTGWYTRTLYGNNSPNMWYDIFGPDYVVKTFRIARKYALPNVKLVYNDYSTFVTKPVSKRDAIIKLLGILKKEDLVDAIGMQSYINPDEDINEYLAAVDEYQKTGLEIQITELTIRVKSTDDWEEYNIQQYSQLFEGLMKRVKKGYNIGSVTVFGLQDGYRFYENDTQKFRLFDHDLKKKKVYHAIMKILKGESATD

SEQ ID NO: 11419 - protein, 330 aa, Neocallimastix californiae
  Glyco_hydro_catalytic_dom
FFFIIECASTALSIALKDVLNGMSVGVNLGKTFEIKKDWKTVENINQPWDKKSFTAKEIVESYKQLGFNAIRIPVNWATKINSKTIIEPNLLKSVEEIVHNTIDNNMFAIINLETSNSFMTGFISEDEELRSETYDGYKNIWKQVSNHFKDYDEHLLFESMNDSGYWEDIWNTRTTDGDRQAALDVLRQVNQEFINAVRSTGDNNEKRYLLVSGYANDPILTQDNFYKIPSDPSHKLLVSLYYYVPNHFTTIDNYYTWGSQEDVKQLQTIMKNLSIRFVIQGVPVIITRYGTIVKNRSSANINSYLTSIVNNASSQNMPSFLSDSGEFID

SEQ ID NO: 11420 - protein, 351 aa, Neocallimastix californiae
  Glyco_hydro_catalytic_dom
VPGYFHVKGSEIVDENDEPVRIAGVNWFGTETAQLSPHGLWSKNLTEILYLIVDHGYNTIRYPYCNDIFKPGASTVSIEYYRNPWAKGLSPLEVMDVVIREATDLGLKIILDRHRPDFQAQSALWYTSAVSEEQWISDWQKLAKRYKDNSGVIGADLHNEPHDEACWGCDDISIDWRLAAERCGNAIHEINPNWLIIVEGIHHIGETCWQCGDNYWWGGYLKKGVVDIINKPVNLKIPNRVVYSTHDYPREVFPQTWFDDPTFPDNMPDKWYNYWSWIKKDNIAPILVGEFGTKLEDDWDRVWLKTLVNYMKENRLHWTFWCLNENSSDTGGLITGGAWDGWHDEKDSMLE

SEQ ID NO: 11421 - protein, 245 aa, Neocallimastix californiae
  Glyco_hydro_catalytic_dom
KCKDSNLAKSIIIYYPEWKYYNYPPRNLPFNKLTHINYAFGEIDPTNYSLKYDSTKFLELIETARSRNKNVKIIMSVGGWTGSRYFSVMSSNPANRSKFISSVKSMLESTGADGIDIDWEHPGVPGAFYDSFDAQNDTYNLLKLMQELREAIGKSKIISTAVTFNLFVVNYQPLQDLSKFAEILDYINLMCYDFNGSWSNIISHQSSLYPTGGNDSGFSVEGAVKNWMNAKFPSNKIVIGIPSYG

SEQ ID NO: 11422 - protein, 39 aa, Neocallimastix californiae
  Glyco_hydro_catalytic_dom
VKIKADYVIERNLGGMMMWEIEEDTKDGELISTVYDNFI

SEQ ID NO: 11423 - protein, 357 aa, Neocallimastix californiae
  Glyco_hydro_catalytic_dom
AKEAPFRFGVGLNGVDINNYTPSSKKMMELIKYQFNSMTYSNGMKSIKIMDEEGSRKNIAEGREEVAVDFSGIIDGLEFAKKNGIHIRGHVLVWHKQTPDWFFRKDFDTEKEYADVETIFVRLESYMKAFFDFLNFNYPGVVDVFDVVNEAIEVREGKFDNSTGWYTRTESLEGDDNIWNTLVGPSYVVRAFRIARKYALPTTKLVYNDVDTFMTKPHDKTQAVIDLMNILRAEDLVDALGMESYIDQDLVNVDAPEDYARAIERFTEAGLEIQITEFTIYNDDREDWLETQTKRYRDFFQVVIDHVKKGYDNISSFTVFGLQDGYRFYDNDTQKTRLFDHDLQKKPNYYAIMEILK

SEQ ID NO: 11424 - protein, 305 aa, Neocallimastix californiae
  Glyco_hydro_catalytic_dom
KIQYTGVNESGAEFGEGKYPGVYNTDYIYPDVKAIQASIDQGMNIFRVGFSWERMQRTLNSAFDTTEFKRLDEVISYITKNGAVAILNPHNFARYRNSVVGSSQVPNSAFADFWKRMADKYKSNNKVWFGLVNEPHDMPTEQWFSAARDAVNAIRKAGANNNVLVPGNSYTGAWCWTKTHYGSPNSKVALEYFNASDKNIIYEVHQYFDSDYSGTHEQCVQRPCNKLFTDFVDWLKENNLKGFVGELGAAINNDCKACVEEALNYLEKNSDYVVGWTWWAAGPWWGNYMYSIEPKGNAFPEQMTW

SEQ ID NO: 11425 - protein, 318 aa, Neocallimastix californiae
  Glyco_hydro_catalytic_dom
IQQVRPDFYFGVATSIAYSSNPKYKDIVSSFNLHVGGNECKFYTIQASKTRNFYQCDQSLSYAKKFGAKYRGHNLFWPANSPNWFKTYSDDIEVTKSYIIDYIKSVLNHYRDDDSIIYWDVINESVMDESTSNDIQLRTGSKTSDEFLGWDTYTEDIFKLARDNINENVKLIYNDYYCEANNGNFDGKTGAVFNYIKNMKEKEVPIDGVGLQMHVSCNDAPSYDDLYLLISRYEEIGVEVHVTEIDVTMARCNSLKDQKDVYMNIFKACFNHNNCKVFTVWGAYDTESWIGAENTPLIFDSDMYPKDIYFEMLDYVLG

SEQ ID NO: 11426 - protein, 50 aa, Neocallimastix californiae
  Glyco_hydro_catalytic_dom
VENTTSSPIRDIPSKELIKEMKFGWNLGNTLDAQCIDNLDYEKDQTASET

SEQ ID NO: 11427 - protein, 344 aa, Neocallimastix californiae
  Glyco_hydro_catalytic_dom
PGFLSTKGRNIVDQKGRNVKLAGISWFGGETDNLSPHGLWSKSLAHFIKVIKDNGYNHIRYPWTNEMLLSGARTKSINAMENPDLANLTPLEVMDAVINAAGKAGLKVYLDRHRPTAAGQSELWYISKVDEKKWIEDWKFLAKRYKGNPTVIGADIHNEPHGTACWGCGETKRDWRLAAERCGNAIHEVNPDWLIIVEGNDHYGEEGWQKGESYWWGGMLKGVKQYPVRLNKKNKLVYSAHDYDKNVHLQDWFKVSNFPDNMPSIWDDKWGYIAKQNIAPVLISEFGSLLKDKTDVKWLQNLISYMNKNGVHWTFWCLNPNSGDTEGILGYDWETVNKQKDGIL

SEQ ID NO: 11428 - protein, 350 aa, Neocallimastix californiae
  Glyco_hydro_catalytic_dom
FSLLGCAGSTLALTSKEITKELGLGWNLGNTLEACGDWINGKTTKQYETAWGNPVTTEEMIKGVKSYGFSTVRIPVAWSNLMSSNYTISPLLLNRVEEVVNYVVKNDMYAIVNIHWDNGWFTKFATDEEEAFIKYKRIWGQISEHFKDYDEHLIFESLNEEGCWESIWNNYSNEGDKPKAFGLLNTINQNFVDIFRNSGGYNAERFLLLAGYCTGIDHTIDKNYILPKDDKVMVSVHYYGPSTFTILEEDADWGKAAYYWGTEEEINNITNDLIKVKTHFVDNNIPVIIGEYGTATTNKDPESVRKWLRTVAGKATELGICPIVWDAGQYFDRKALTFKDPQIGELYKEL

SEQ ID NO: 11429 - protein, 348 aa, Neocallimastix californiae; identical to SEQ ID NO: 68
  Glyco_hydro_catalytic_dom

SEQ ID NO: 11430 - protein, 353 aa, Neocallimastix californiae
  Glyco_hydro_catalytic_dom
AKEAPFRFGVGLTGTNLQVSTTVSEKMRDIIKHQFNSMTYTNLMKPLYILDKEGSIQNIKNGIQDPKLNFTSIVDGLEFAYKNGIHIRGHVLIWHTQTPDWFFNEGYTDDGKKVSPEVMESRLDSYIKQYLSFVQFNYPGVVDVWDVVNEAIEITDGQYDANTGWYTRTMLNNTPNPYYDMFGPDYVIKAFRIARKYALPNVKLVYNDFNTFQVWPHNKTQAIMDLAGILQKEDLIDGIGLQSYLGVTWPSLDEYFRGVERLATTGLELQITELTITAPDGDNWLEAQAEQYRDFFERLMKHVEEGYNIGSVTVFGLQDGYLFYASDSTKTRLLDHDLQKKPNFEAIMSILKS

SEQ ID NO: 11431 - protein, 283 aa, Neocallimastix californiae
  Glyco_hydro_catalytic_dom
DSMFIGAYVGGPEDHPKPTQKNIAAFESLQDRHLDVVHLFIHWDNKDEPWEWARNFVDIAKANGSIMMISWMPQPYTAQDILDGKGDEYIDTFVKGVKDFGEEIWLRPLHEANGDWYTWGTGADRINNSEDKLAAAYRHIVDRFRDANVTNVKWIWTTNCSNSGVATLTGSYPGDDYIDYTSIDGYNWGTAQSWSRWNTFEEVFDNAYKALIKIPKPIFLAEFSSSRFGGDKAGWFTDMFNLLPEKYPRIVGLVIFSRSKNETEADWALDSQEEAVEAWRKGV

SEQ ID NO: 11432 - protein, 308 aa, Neocallimastix californiae
  Glyco_hydro_catalytic_dom
DYSKGFRIGAATNTIHYSNSNYNNAMKAFNYMVAENACKFVSIQGTKGKFNFNDCDNHLKKAQELGMDFRGHALVWHSMAPKWLENEDANTMKNSIINHITTVLKHYEGKIDTWDVVNEAIDDSSNGNGWNMRKSFLYNKVPNFIDIAFQTARQVSPKTKLFYNDYNTEGIWGKSESVYQFVADLKKRNIPIDGVGIQYHVSLENNPRFDKINDLISRYCKLGVEVHITEMDVSCDKNCWASDVEQQQGKVFTNALQACLNNSCCTGFLVWGIGDNDSWIGGDKKGLLFNSNYQPKSQYTAVLNLLKS

SEQ ID NO: 11433 - protein, 350 aa, Neocallimastix californiae; identical to SEQ ID NO: 72
  Glyco_hydro_catalytic_dom

SEQ ID NO: 11434 - protein, 253 aa, Neocallimastix californiae
  Glyco_hydro_catalytic_dom
TSQSGIEGLCKNSKLSKSIIVYYPEWKYYDFPPKNIPFNKLTHINYAFAEIDSNDYSLDYDSSRFLELVETAHEKNKNIKVLMSIGGWTGSKYYSKMASSSSRRSKFVKSVKRMLEASDADGIDIDWEYPGTSGAYDDNFDAENDTNNLLKLLKELREAIGSSKIISAAVPFNTFEVDSRPLKDMSEFAELFDYVNIMAYDFAGSWSTVTSHQSSLYSISEDDNGYSLSGAVSNWINANFPSSKIVVGIPAYG

SEQ ID NO: 11435 - protein, 44 aa, Neocallimastix californiae
  Glyco_hydro_catalytic_dom
VSLKADYVINKNLGGMMMWEIEEDTQDSELISTIYEKFISLTCN

SEQ ID NO: 11436 - protein, 39 aa, Neocallimastix californiae
  Glyco_hydro_catalytic_dom
VSIKADYVIKYNLGGMMMWEIEEDTKDSELISTIHKKFK

SEQ ID NO: 11437 - protein, 245 aa, Neocallimastix californiae
  Glyco_hydro_catalytic_dom
EEECKNLSKSIIVYYPEWKYYNFPPKNIPFNKLTHINYAFAEINSSDYSLEYDSSKFLELVETAHEYNKNIKVLMSIGGWTGSRYYSKMASSSSNRSKFVKSVKRMLEASGADGIDIDWEYPGTSGAYDDNFDAKNDTNNLLKLLQELRASIGYSKIISAAVPYNTFEVNYKPLEDMSEFAELFDYINIMAYDFAGSWSSVTSHHSSLYSTVEDDSGYSLAGAVKNWMNARFPATKIVVGIPAYG

SEQ ID NO: 11438 - protein, 308 aa, Neocallimastix californiae
  Glyco_hydro_catalytic_dom
NLTNPNSTSSTKLLYNYLVNNFGKKIISGQVGSAGYLETEEFDYIKKITGKTPAMFNVDFIFESLDHDWKPDDSIADMVLAWWKKYEGKGILHAQWHWNKKGSDGQVSFYTKNVDFDITKALIEGTNEYKSIMADMDYIASQIKILQDKDIPIIWRPLHEASGGWFWWGAKGPEPCVALYKMMYERFTKVHKLNNLIWCWNGGIGNWYPGDEYVDIISEDVYDKHSSFASKYNSLLNQVGNKKIIALSENGSLPDIESCMKERITWSFFCTWNNEYILNNSDNIYNTPEYIKSVYNSNYVITQSDLPS

SEQ ID NO: 11439 - protein, 139 aa, Neocallimastix californiae
  Glyco_hydro_catalytic_dom
MEKWLELVRQFIRDKKASGLTNWYGYEIWNEAENTWRDSNGYTFLEFWKETYKVIREMDPDEKIIGPCDGLYVESRMRPFLEFCKENDVMPDIMCWHELMGVELIPRRYKAYRELERSLGIKELPITINEYCDIKHELE

SEQ ID NO: 11440 - protein, 96 aa, Neocallimastix californiae
  Glyco_hydro_catalytic_dom
RYCKLGLEVHITELDVKCDNVCNSGNVEQQQATVFTNALKACLNNSCCTGYLVWGIGDNDSWLGGDKKGLLFNSQYKPKSQYTAVLNVLKEYSASQ

SEQ ID NO: 11441 - protein, 348 aa, Neocallimastix californiae
  Glyco_hydro_catalytic_dom
PFRMGVGINGSLRKTSTILSKKMVDIINHQFNSVTLTNLMKPSYLLDQNGSQKNIMKGIQDPSVNFQSAIDTLEYCKKNNIKMRGHTLVWHTQTPSWFFKKDYDDKNDYVDSEVMELRIESYIKQVMQFVQYYYPGVVDVWDVVNEAVEIDEGYYDEKVSWKTRTKCNESSNPWYETMGPDYVIKAFRFARKYAAPGVKLIYNDYNTFMSEKTTAIINLLKILKEENLIDGIGMQSYLTPTFPERSTYANAIKKFGELGIEVQITELTISIDDKLSEEEMYEKQAEQYKEVFEIYLKAYHNGINIGSVTVFGLQDGYLFYTNDSTKTRLWDKDLQKKKNYYSILEVLK

SEQ ID NO: 11442 - protein, 309 aa, Neocallimastix californiae
  Glyco_hydro_catalytic_dom
KDYSKGFRIGAATNTIHYNNANYVNAMKAFNYMVAENACKFVSIQGTKGKFNFNDCDAHLNKAKQLGMDFRGHALIWHSMAPKWLENEDSNSMKNSIVNHITNVLKHYEGKIDTWDVVNEAIDDSSNGNGWKMRNSFLYQKVPNFIDLSFQTARKVSPKTKLFYNDYNTEGIWGKSESVYQFIADLKKRNIPIDGVGLQYHVSVQHQPQFNKINDLIGRYCKLGVEVHITELDVSCVESCYAGDVEKKQSDVFTNALKACLGNSCCTGFLVWGIGDPDSWLGSDKKGLLFNSNYQPKSQYTAVLNVLKT

SEQ ID NO: 11443 - protein, 226 aa, Neocallimastix californiae
  Glyco_hydro_catalytic_dom
EEVKEYYLDYVAKVLDHYKDEEDIIYWDVINESVTDDSTVDNIKLRYGSDDSNEFKGWDTYTEDIFKVAREHTNKNVKLFYNDYNAENNNGNYNGKTGAVFNYIKSMREKDVPIDGVGLQMHISCNYYPNYDQLYELISQYEEIGVEVHITEIDVSMKSCSTLEDQKKLYMDVFKACFDHSNCKVFTVWGAYDSESWVGAENVPLIFDEDMYPKDIYFDMLDYVMK

SEQ ID NO: 11444 - protein, 293 aa, Neocallimastix californiae
  Glyco_hydro_catalytic_dom
PITINGKRLLLKGVNRHDTDPFNGKAIPQATMEMDITLMKTNNINAIRTSHYSNDSYLYWLCNKYGMYVMGETNMESHALMDNNDAKALFYEVGLDRTETAYKRLKNHPSIVAWSIGNEMAYTSNPSDAGGLFRDMIWYFKKNDNSRPVHSEGQGGSMGVDMSSNMYPSSDGIRGNAGKGKMPYVMCEYDHAMGNSVGALKEYWDGIRSADNMLGGFIWDWVDQSRATPLKGGWDYYSESYAKTNLYAEEIKGKFYGYGGDWGDWPNDNSFCVNGLISPDRTPQPELAEVKYQ

SEQ ID NO: 11445 - protein, 221 aa, Neocallimastix californiae
  Glyco_hydro_catalytic_dom
LAQTPGALVSVDLADILPYWPYQFKGIQSWLNDIGSFIDDKKASGLTNWYGYEIWNEPDGTWKDSNGMNFNEFWKQTYQFIRQKDPNEKIIGPCISWYNENNIRSFLQFAKANNCLPDIISWHELSGIDGMSSHFRSYRNLEKSLGIKELPISINEYCDAEHELEGQPGSSARFIGKFERYKIDTAMITWWFVPQPGRLGSLMATDTQKGAGWYFYKWYGD

SEQ ID NO: 11446 - protein, 141 aa, Neocallimastix californiae
  Glyco_hydro_catalytic_dom
SCTENSFNNFIFPEDDDKVIAAVHAYSPYNFALNNGDGAVDTFDSAGKNELDWNINLMKKRFVDQGIPMILGEYGAMNRDNEEERAKWAEYYMEKVTALGIPQVWWDNGIFEGEGERFGIIDRTSLKIMYPDIVASLQKGR

SEQ ID NO: 11447 - protein, 308 aa, Anaeromyces robustus; identical to SEQ ID NO: 11432
  Glyco_hydro_catalytic_dom

SEQ ID NO: 11448 - protein, 160 aa, Anaeromyces robustus
  Glyco_hydro_catalytic_dom
LSRTPGALVSVILTDFLPYWPYQWPGMEKWLELVRQFIRDKKASGLTNWYGYEIWNEAENTWRDSNGYTFLEFWKETYKVIREMDPDEKIIGPCDGLYVESRMRPFLEFCKENDVMPDIMCWHELMGVELIPRRYKAYRELERSLGIKELPITINEYCDI

SEQ ID NO: 11449 - protein, 318 aa, Anaeromyces robustus
  Glyco_hydro_catalytic_dom
IQQVRPDFYFGVATTKSFFANPKYKDIMSTYNLQVGGNECKFYTFQGTETFNTKPCDDSIAFAKKLGAKFRGHNLFWPAYSPSWFKTYSSDIEEVKEYYLDYVAKVLDHYKDEEDIIYWDVINESVTDDSTVDNIKLRYGSDDSNEFKGWDTYTEDIFKVAREHTNKNVKLFYNDYNAENNNGNYNGKTGAVFNYIKSMREKDVPIDGVGLQMHISCNYYPNYDQLYELISQYEEIGVEVHITEIDVSMKSCSTLEDQKKLYMDVFKACFDHSNCKVFTVWGAYDSESWVGAENVPLIFDEDMYPKDIYFDMLDYVMK

SEQ ID NO: 11450 - protein, 314 aa, Anaeromyces robustus
  Glyco_hydro_catalytic_dom
RDYANGFRIGAATNTMHYNNQNYVNAMKSFNYMVAENACKLSGIQQQKGVYNFNDCDNHYKKAKELGMDFRGHCLIWHAYQPSWFQNADANTLKNAIVDHITKVLQHYDGKIDAWDVVNEAIDDSSNGNGWKMRNSFLYQKVPNFIDLAFQTARKVAPNVKLFYNDYNTEGVYAKTESVYQFIQDMIKRNIPIDGVGIQYHVAVNQQPSYQKINDLIGRYCKLGLEVHITELDVKCDNVCNSGNVEQQQATVFTNALKACLNNSCCTGYLVWGIGDNDSWLGGDKKGLLFNSQYKPKSQYTAVLNVLKEYSASQ

SEQ ID NO: 11451 - protein, 42 aa, Anaeromyces robustus
  Glyco_hydro_catalytic_dom
GIPQVWWDNGIFEGEGERFGIIDRTSLKIMYPDIVASLQKGR

SEQ ID NO: 11452 - protein, 345 aa, Anaeromyces robustus
  Glyco_hydro_catalytic_dom
PGYLSTKGRYIVDEKGRKVKLAGISWFGGETTNLSPHGLWAKPLSHFIKIIKDLGYNHIRYPWTNEMLFPGAKTQSVDQLQNPDLADLTPLEVMDAVIDACGKAGIKVYLDRHRPLSGGQSELWYVAKVDEDKWIEDWQFLAKRYKGNPTVIGADLHNEPHGTACWGCGETKRDWRLAAERCGNAIHKVNPDWLIIVEGNDHYGEEGWQKGEGYWWGGMLKGVKENPVRLNTPNKLVYSAHDYDKNVFMQDWFKVSNFPDNMPEIWDDKWGYIAKEDIAPVLIGEFGSLLMDNKDVKWLQNLISYMNKNDVHWTFWCLNPNSGDTEGILGYDWTTVNTKKDNILT

SEQ ID NO: 11453 - protein, 221 aa, Anaeromyces robustus; identical to SEQ ID NO: 11445
  Glyco_hydro_catalytic_dom

SEQ ID NO: 11454 - protein, 307 aa, Anaeromyces robustus; identical to SEQ ID NO: 97
  Glyco_hydro_catalytic_dom

SEQ ID NO: 11455 - protein, 222 aa, Anaeromyces robustus
  Glyco_hydro_catalytic_dom
RLSRTPGALVSVDLADILPYWPYKWPGMQKWLDEVRSFIRDKKASGLTNWYGYEIWNEAENTWRDSNGYNFLEFWKETYKVIREMDPDEKIIGPCDGLYSEERMRPFLQFCKENNVLPDIMCWHELMGVELIPRRQKAYRELERSLGIKELPITINEYCDVEHELEGQPGSSARFIGKFERYNVESALISWWFVPQPGRLGSLLATDSKKGAGWYFYKWYSD

SEQ ID NO: 11456 - protein, 348 aa, Anaeromyces robustus; identical to SEQ ID NO: 99
  Glyco_hydro_catalytic_dom

SEQ ID NO: 11457 - protein, 344 aa, Anaeromyces robustus
  Glyco_hydro_catalytic_dom
PIGFLSTKGHLIVDEKGRAVKLAGISWFGGETTNLSPHGLWAKPLSHFIKTIKDLGYNHIRYPWTNEMFKEGAKTESVDSVNNPDLADLTPLEVMDAVIEAAGAAGIKVYLDRHRPLAGGQSELWYIDEVPESQWIEDWQFLAKRYKGNPTVIGADLHNEPHGTACWGCGEEVRDWRLAAERCGNAIHEVNPDWLIIVEGNDHYGEEGWQKGESYWWGGMLKGVKENPVRLKVPNKLVYSAHDYDKNVHLQDWFTTSDFPDNMPEIWDDKWGYIVKEDIAPVLIGEFGSVLRDAVDVKWLTNLVTYMHENGVHWTFWCLNPNSGDTEGILGYDWETVNTKKDGI

SEQ ID NO: 11458 - protein, 308 aa, Anaeromyces robustus
  Glyco_hydro_catalytic_dom
PTLVNPKAIPAAKKLYDFLKTNYGKRILSGQVGAAGQAGDEGEEFKRIINATGKKPAVWNMDFIFESNDCTWRPTNPDITEMALDWWKKYQGKGIMSAQWHWNIAGQTGNFAFYKKDTTFDLEKAVTEGTWEYNKIIKDIDRVSGLIKKLQAVNMPLLWRPLHENNGDWFWWGNNPKACAKLWKILYERMVNYHGLNNLIWLWNGNNDEYTPIEYIDLIGVDIYADDHGPQTTAFNTHFDFYDGKKMVVLSENGRIPDIQKCVAQGAWWGYFQTWNSEFILQDSYHTTAQLKEYFSNKVVMNMDELPS

SEQ ID NO: 11459 - protein, 24 aa, Anaeromyces robustus
  Glyco_hydro_catalytic_dom
PIRDISSKELIKEMNFGWSLGNTL

SEQ ID NO: 11460 - protein, 11 aa, Anaeromyces robustus
  Glyco_hydro_catalytic_dom
TLACAIATASA

SEQ ID NO: 11461 - protein, 349 aa, Anaeromyces robustus
  Glyco_hydro_catalytic_dom
LTLAAASSALALTSQEVVNEMGLGWNLGNTLEAFGDWINGSTVNQFETAWGNPAATKQLITAIKNSGFNSIRIPVAWSNLMSSDYTISSELLKRVNEVVSWVIDSNMYAIINIHYDGGWIEKFGTSESTMANNKFNKIWTQVADYFKNYGEHLIFESLNEEGCWNDVWNRYSNSGDKNKAYSTLNNINQQFVDIVRKSGGNNKSRHLLIAGYCTDIDLTVDSAFKMPTDSANRMMVSVHYYTPSTFTILEKDESWGKFAGTWGTDAEVNALLADFDKLKKRFVDNGVPVIIGEYGTVLTNKDKDSVHKYLFTCAQYATSLGMCPMLWDNGDHFDRKGLKFKDSEVGDFY

SEQ ID NO: 11462 - protein, 304 aa, Anaeromyces robustus
  Glyco_hydro_catalytic_dom
QYTGVNESGAEFGQGKYPGEYNKDYIYPDVKAIQASIDQGMNVFRIGFSWERLQRSLNAELDSTEFDRLDEVVSYVTKNGAVAILNPHNFARYNGQIVGTSQVPNSAFADLWKRIAQKYKSNNKVWFGLVNEPHDMPTAQWFSAARDAVDSIRALGANNNVLVPGNAYTGAWNWKETFYGDSNASTALIYFSSSDKNIIFETHQYFDSDYSGTHKECVQRPCNNLFKNFVEWLKANNLKGFIGELGAAINDDCKACVEEAITYLEQNSDYIVGWAWWAAGPWWQDYMYSIEPKGERFPEQMTWL

SEQ ID NO: 11463 - protein, 372 aa, Anaeromyces robustus
  Glyco_hydro_catalytic_dom
SFYKGVDISSIISLENSGVKFYNPLGQEQDLFQILANVGVNCIRVRIWNSPKNANGKTYGGGGNDLEVARAIGSRAARYGLSLFVNFHYSDFWADPSKQTIPKEWKNFDLDKRIFEIYRFTKGCLEWLLENGSIISMVQIGNETTSFMCGEKNMTNVMKMMSNGVKAVRDISKNIVVALHFTNPNKADTMLWYASQLASARVDYDVFATSYYPYWHGTLDNLKGVLNKIANQYGKKVLIAEYSYPYTNAALTDDRCHYELISSSTSNIQLRYPVSIDGQIQSIRDIYKTIKEIKNGIGAFYWEPAWIAPKARNDAERKQIWEKYGSGWASTPAAEYDSDVDRYQTGGTTWDNQAVFTQNGKPLDSLYALGEI

SEQ ID NO: 11464 - protein, 362 aa, Anaeromyces robustus
  Glyco_hydro_catalytic_dom
KFEGFGTSFCWWANRLGYSDSLSEKAATLFYDKEKGLGLTVIRYNIGGGDDPTHNHITRTDSNMPGYAINPKYDGRSYTWDYNWNSDSNQRNVLLKSVAKNKDEIIVEAFSNSPPYFMTYSGCSTGNFDPGKDNLRSDAYPAFAKYLADVAEHFKTHWGVYFQSITPTNEPYTNFWGANSYKQEGCHFDQGESESKIIVELRKAIDQKGLKEMQISGTDETSIDTQITSFEKLSNEAKNIITRIDTHTYGGWKRDELRLLAENNHKNLWMSEVDGKGTEGTNAGEMGAAIWLANRIIGDLNGLRASAWVLWQVIDNHISKNGYNGRKDSGMININEGYWGVAVADHDNDNIILTQKYYGFGQ

SEQ ID NO: 11465 - protein, 349 aa, Anaeromyces robustus
  Glyco_hydro_catalytic_dom
PFRMGVGLNGGNISNYTPSSKKMMELINYQFNSMTYSNGMKSLFIMDQEKSLKNLAEGKEEVGINFSGVIDGLEFSAKNNLNIRGHVLVWHKQTPEWFWRKDFDETKEYVDRETIFKRLDSFMKNYFDFLNFNYPGVVDVVDVVNEAVEVLEGKYDNSTGWYTRTESYEGDENIWYNLVGPDYVKEAFRIARKYALPTTKLVYNDYDTWRTTPHDKTEAIINLMKILKAEDLVDVIGMESYITPGEPTPEEYGKAIERYAAEGLEIQITEFTIYVTDGDDWLEQQTIHYRDMFKAIMEAYKKGANITSFTVFGLQDGYRFYDSDSTRTRLYDHDLQKKPNFQAIMDILK

SEQ ID NO: 11466 - protein, 202 aa, Anaeromyces robustus
  Glyco_hydro_catalytic_dom
LPGWPYQFKSMQHWKDEIKSFVNDKKASGLTNWYGYEIWNEPDGTWKDPNGLNFNEFWKQTYQYLRQIDPNEKIIGPALSWYNEDRIRSFLQYAKANNCLPDIICWHELSGIDNMSAHFRSYRNLEKSLGIKELPISINEYCDAEHSLEGQPGSSARFIGKFERYKIDSAMITWWFVPLPGRLGSLMASDTQKGAGWYLYKW

SEQ ID NO: 11467 - protein, 326 aa, Anaeromyces robustus
  Glyco_hydro_catalytic_dom
LTTKEFMKSIGMGVNIGHTFDTIRDWSNIDISEINSDFKLWTDSEVKIKEAVEGYKNLGFHSIRIPVKWSTRPTTKTPIEPKLLKAVEEVVRVAIENDMYVIINLETDNFYMNGFISEDKAILTETYDSYKGTWKQIANYFKDYDEHLMFEALNESGYWETIWNTRTADGDRPEALAVLLKVNQEFINTVRSIEGYNQERYLLIEGYACDPILTQDHFYKTPSDPKSSGKLIVSLYYFIPYTFTVIEKYGIWGSSYDVHQLQEVVDDLRYRFVIQGVPVIFTRYGTNIRNRKREDIRSFLTSVANITTTGEIPSFFNDIGALIDRT

SEQ ID NO: 11468 - protein, 321 aa, Anaeromyces robustus
  Glyco_hydro_catalytic_dom
NHERVDLALEAYAKHNLNVVRAWAFCDECEDATRLVDFSGPEVKLNSENMEKVDYYLAAAAQRNIRVVLTLTNNWTDYGGMDVWVKQFGGKYHDEFYTNRKLIEGYKQYIKAMINRVNTYTGQRYKDDPTIFSWQLANEARCNNGPHGLPVKDCNTDTITKWMDEIATFIHEEDPNHLVSSGIEGIGLTPPAGVDPNTYVYTYVEGTDYEAISALDSIDYNTVHMYPVGWGLKDYAKDGVKWIQAHADVDKKFNKPTVVEEWGLSTSADNVPLEERDPIYTQWMDAVLANDNIGMNMFWYVCGEDYYGTDGYIVKDDEITK

SEQ ID NO: 11469 - protein, 227 aa, Anaeromyces robustus
  Glyco_hydro_catalytic_dom
IKVAQRLSQTPGAVVSVDFADILPNWPYRWPGLQKWLDEVKSFINDKKKSGLTNWYGYEIWNEPDGTWKDADGINFNELWRQTYQVMRQNDPNEKIIGPCDSWYNENRMRSFLQYAKTNNCLPDIMCWHELSGIENVSNHLKAYRNLEKSLGIKELPITINEYCDAKHEWEGQPGSSARFIGKFERYKVDSALISWWFVPHPGRLGSLLATDTQKGAGWYFYKWYGD

SEQ ID NO: 11470 - protein, 309 aa, Anaeromyces robustus
  Glyco_hydro_catalytic_dom
KLQYVGVNEAGGEFGENNLPGIYNKHYIYPNIESIRASVEQGMNVFRMGLRWERFQHELFGEFSEFDVTEYKKVVDATTSMGAVLIIDPHNYARYNDNIVGSKEVPIEAFADFWAKLANIFKDNEKVWFGLVNEPHDMETDDWFKAARAAVDAIRATGATNNILIPGNGWDGAWSWGKEAWYGEANADVALRYFSSEDKNIIFEVHQYFDEDYSGTHDTCIQRPCQNLLKEFVEWLKTNNLKGWVGEIGGTLNDECKECVHELIEYLQENRDYVLGLQWWAAGPWWGHNSYSIEPNSEKAFPGQMAWLK

SEQ ID NO: 11471 - protein, 263 aa, Anaeromyces robustus
  Glyco_hydro_catalytic_dom
RFEGFGTSFCWWANRLGYSDSLAEKAATLFYDKVNGLGLTVIRYNIGGGDDPTHHHITRTDSNMPGYAINPRYDGRSYTWDYNWNSDANQRNVLLKSVAKNRDEIIVEAFSNSPPYFMTNSGCSTGNFDANKDNLKSDAYPAFAKYLADVAEHFKTSWGVGFQSITPVNEPFTNYWGANSKKQEGCHFDQGNSESKIIVELKKAIDQRGLRDMQISGTDETSIDTQITSFQKLSNEAKNIITRIDTHTYGGSKRDELRLLAEN

SEQ ID NO: 11472 - protein, 344 aa, Anaeromyces robustus
  Glyco_hydro_catalytic_dom
PGFLSTKGRSIVDQNGRKIKLAGISWFGGETNNLSPHGLWAKPLDHFIKTIKDLGYNHIRYPWTNEMLTPGAKTNSIDSTSNPDLVNLTPLEVMDAVINACGKVGLKVYLDRHRPQSGGQSELWYIPEVDESKWIEDWQFLAKRYKGNPTVIGADIHNEPHGEACWGCGESKRDWKAAAERCGNAIHQVNPDWLIIVEGNDHYGEEGWQKGESYWWGGMLKGVKENPIKLNKPNKLVYSAHDYDKNVHMQDWFKESNFPDNMPTIWDDKWGFIAKQNIAPVLIGEFGSLLKDATDSKWLQNLVTYMTKNEIHWTFWCLNPNSGDTEGILGYDWETVDTKKDGLL

SEQ ID NO: 11473 - protein, 240 aa, Anaeromyces robustus
  Glyco_hydro_catalytic_dom
SKKIVGYFSEWRNSNYPISRVDLSKITHLNYAFGLIDPSTYAVTGYESWILTQVVEAAHKQGVKVLMSIGGWYGSRYFTKMTSSKSNMERFADSCKNLIDTYKIDGIDIDWEYPGREGACNTPDLANDTDNYLTLLEILRKKIGNDSLITAAVSAIPFEKNGQPVSNLSAYAKYFDFINLMAYDFAGSWSSVTSHHSGLYDPEAGDKLSVSTGVKNWLNAQFPASKIVVGVPAYGKSWIA

SEQ ID NO: 11474 - protein, 68 aa, Anaeromyces robustus
  Glyco_hydro_catalytic_dom
QIISYDDPKAIENKAKYVLSNNFAGMMVWELENDTEDFEILSAINKHLGCDGSFNGDSNKPTTTTTKK

SEQ ID NO: 11475 - protein, 245 aa, Anaeromyces robustus
  Glyco_hydro_catalytic_dom
ICKNSKLSKSIIVYYPEWKYYDFPPKDIPFSKLTHINYAFAEINPDDFSLEYDSNKFLELIDTAHKKNKSIKVLMSIGGWTGSRYFSKMASSSSNRTKFVKSVKRMIDASNADGIDIDWEYPGSSGAYDDNYDSENDTNNLLKLLKELRETIGTSKLITAAVPFNTFEVDHKPLSDMTEFAKLFDFINIMAYDFSGSWSSVTAHQSALYSTHEDDSGYSLSGAVKNWMNANFPAKKIVVGIPAYG

SEQ ID NO: 11476 - protein, 38 aa, Anaeromyces robustus
  Glyco_hydro_catalytic_dom
VGLKADYVIENNLGGMMMWEIEEDSKDSELISSMYQKF

SEQ ID NO: 11477 - protein, 63 aa, Anaeromyces robustus
  Glyco_hydro_catalytic_dom
FVGEIGAAINDKCKACVEETLNYLEENSDNIVGWAWWAAGPWWGNYMYSLEPKGKAFPEQMTW

SEQ ID NO: 11478 - protein, 211 aa, Piromyces finnis
  Glyco_hydro_catalytic_dom
WTQVSSYFKDFDEHLIFESLNEEGCWNDVWNRWSNAGDKNKAYGTLNNLNQQFVDIVRNSGGNNKNRHLLLAGYCTDIDLTVDSAFKIPSDSSNRLMVSVHYYTPSTFTILEKDEDWGKFAGSWGTDAEVKALIADFDKLKKRFVDNGIPVIIGEYGTVLTNKNKDSVHKYLFTCAQYATSLGMCPMLWDNGDHFDRKGLKFKDSEIGDFY

SEQ ID NO: 11479 - protein, 350 aa, Piromyces finnis
  Glyco_hydro_catalytic_dom
APFRFGVGLYGNDLAMSTITSEKMRKVIKYQFNSMTYTNLMNPSAILDQQASIDNIMNGNEDPILNFSNIVDGLDFAYKNGLNIRGHALVWHTQVPEWFFRDGYYSNTEFVSRDVMEYRLDSYIRKFLGFVQFNYPGTVDVWDVVNEAIEITDGQYDETTGWYTRTANNKTPNPWYEIFGPDYVAIAFRIARKYALPNVKLIYNDHNTFQIQPHDKTQAIIDLANILQQENLIDGIGMQSYIGVTWPNLDDYFNGLERLITSTGLEIQITELTITPPIGDNWLGAQAEQYYEYFNRLLSYIKNGYNISSVTVYGLQDGYRFYTKDSTKTRLLDHDLKKKPNFNAIINVLK

SEQ ID NO: 11480 - protein, 298 aa, Piromyces finnis
  Glyco_hydro_catalytic_dom
TTKNWQPITINGKRLLLKGVNRHDTDPFNGKAIPQETMREDITLMKKNNINAIRTSHYSNDSYLYWLCNKYGMYVMGETNMESHALMDNNDGKALFYELGLDRTETAYKRLKNNPSIVAWSIGNEMAYTGNPSDAGGLFRDMIWYYKKNDNTRPVHSEGQGGGMGVDMSSNMYPSSDGIRGNAGKGKMPYVMCEYDHAMGNSVGALKEYWDAIRSADNMLGGFIWDWVDQSRAVPIKSGGWDYYSESYAKTNLYSSEIKGKFYGYGGDWGDRPNDNSFCVNGLINPDRTPQPELAEVK

SEQ ID NO: 11481 - protein, 307 aa, Piromyces finnis
  Glyco_hydro_catalytic_dom
SLVNPKAIPAARKLYDFLKSNYGKRILSGQVGAAGKAGDEGQEFQRIKNASGKLPAVWNMDFIFESNDCTWRPENPDITEMAINWWKKYEGKGIMAAQWHWNIAGKTGNFAFYSKDTTFSLENAVTKGTWEYEKIIKDIDRVSGHIKKLQAVNMPLIWRPLHENNGDWFWWGNNPKACAKLWKILYERMVNYHGLNNLIWLWNGNNDEYTPVDYIDIIGVDIYANDHGPQTTAFNTHFDFYGGKKMVVLSENGRIPDIQQCVDQDAWWGYFQTWNSEFILQESYHTNAQLKEYFNHEIVMNMDELPS

SEQ ID NO: 11482 - protein, 195 aa, Piromyces finnis
  Glyco_hydro_catalytic_dom
GLNEPRKVGDPVEWTGDQEGYNFVNEMNEVFIKTIRSTGGNNALRHLMIPPYAAGVMDASLNTFRVPRDDDKIIVSLHSYSPYNFALNNGSGAISNFYDGSEIDYVMNTIHQRYISQNIPVIIGEFGAMNRDNEVDRARWAEYYIKKATSIGVPCVLWDNAYYEGKGERFGAINRTTLEVVFPDYINGLMKGLGN

SEQ ID NO: 11483 - protein, 192 aa, Piromyces finnis
  Glyco_hydro_catalytic_dom
FRFGVGFNGAAVSTSTTSSKVMRELVKYQFNSFSYSNLMKPLFVLDQAGCQKNFKNGSNEIALNFTPFVDGLDYAQKNGLHIRGHVLVWHKQFPDWFFREEFDDAKEYVSEEVIYERLENYIKQYLGFVNYNYPGVVDVWDVVNEAVEVLEGKFDNSTGWYTRTITYEGDRNIWYDFVGPDYVVKTFRIARK

SEQ ID NO: 11484 - protein, 353 aa, Piromyces finnis
  Glyco_hydro_catalytic_dom
GYVYTEGTNFYIDGYKIYFSGTNTYYLHSSQNERVDLALEVSAKHNIQVVRAWAFCDLKVCGDKQFVKFENGKAVFLEDNMEAIDYFIAAASQRNIRLVLGFTNNWTDYGGMDEWVKGYGGKYHDDFYTNTDIRKAFKSYIKLLITRINRHTNIRYSDDPTIFSWQLANEPRCGNGPSGLPQSGKCTPEVITEWANDISSYIKELDPNHLVSVGCEGFGLEAPEGSKGLYAYKYDEGTDFEALTALPNIDYNTYHYYPIPWGMKDLVSHTKDWIESHQAVGKKLNKPVVFEEWGLEIPTDCSKEERIQYYKTWTKQILDADVPMNMFWYTVGEDYYGTDKYIIKEDELVAAID

SEQ ID NO: 11485 - protein, 349 aa, Piromyces finnis
  Glyco_hydro_catalytic_dom
GFVQTDGTNFVVDGCKRYFSGSNTYYLMVSNHERVDLALETYARHNLNVVRAWAFCDECEDATRLVDFSGPEVTLNSENMEKVDYYLAAAAQRNIRVVLTLTNNWTDYGGMDVWVKQFGGKYHDEFYTNRDIVNGYKQYIKAMINRVNTYTGQYYKDDPTIFSWQLANEARCNNGPHGLPVKNCNTDTITKWMDEIASFIHEEDPNHLVSSGIEGIGLTPPAGVDPNTYVYSYIEGTDYEAISALDSIDYNTVHMYPVGWGLKDYTKDGMKWIQAHADVDKKFNKPTVVEEWGLSTSADNVPLEERDPIYTKWMETVLENDNIGMNMFWYVCGEDYYGTDGYLMEEDEI

SEQ ID NO: 11486 - protein, 343 aa, Piromyces finnis
  Glyco_hydro_catalytic_dom
PGYLSTKGKYIVDEKGRKVILGGLSWFGGETTNLSPHGLWANSLENFIKIVKDHGYNHLRYPWTNEMLFPGAETQSVDQVNNPDLANLSPLEVMDAVIDACGKAGLKVYLDRHRPLSGGQSELWYIPEVPEEQWIEDWQFLAKRYKGNPTVIGADLHNEPHSSACWGCGEIERDWRLAAERCGNAIHEVNPDWLIIVEGNDHYGEEGWQKGESYWWGGMLKGAKEFPVRLNVPNKLVYSAHDYDKNVHMQDWFKEPDFPDNMEPIWDDKWGYLVKENTAPVLISEFGSLLRDATDIKWLGNLVSYMKENDVHWTFWCLNPNSGDTEGILGYDWKTVNAQKDGL

SEQ ID NO: 11487 - protein, 349 aa, Piromyces finnis
  Glyco_hydro_catalytic_dom
LTLAAASSALALTSQQVIGEMGLGWNLGNTLEAFGDWINGSTVNQFETAWGNPAATEQLIGAIKDNGFNSIRIPVAWSNLMSSDYTINSNLLKRVKEVVSWVTNKNMYAIINIHYDGGWFEQFGTSQSTQANQKFNKIWTQVSSYFKDFDEHLIFESLNEEGCWNDVWNRWSNAGDKNKAYGTLNNLNQQFVDIVRNSGGNNKNRHLLLAGYCTDIDLTVDSAFKIPSDSSNRLMVSVHYYTPSTFTILEKDEDWGKFAGSWGTDAEVKALIADFDKLKKRFVDNGIPVIIGEYGTVLTNKNKDSVHKYLFTCAQYATSLGMCPMLWDNGDHFDRKGLKFKDSEIGDFY

SEQ ID NO: 11488 - protein, 342 aa, Piromyces finnis
  Glyco_hydro_catalytic_dom
PIRDISSLELIKEMRFGWNLGNTLEAFGDWINGSTVNQFETAWGNPAATEQLIGAIKDNGFNSIRIPVAWSNLMSSDYTINSNLLKRVKEVVSWVTNKNMYAIINIHYDGGWFEQFGTSQSTQANQKFNKIWTQVSSYFKDFDEHLIFESLNEEGCWNDVWNRWSNAGDKNKAYGTLNNLNQQFVDIVRNSGGNNKNRHLLLAGYCTDIDLTVDSAFKIPSDSSNRLMVSVHYYTPSTFTILEKDEDWGKFAGSWGTDAEVKALIADFDKLKKRFVDNGIPVIIGEYGTVLTNKNKDSVHKYLFTCAQYATSLGMCPMLWDNGDHFDRKGLKFKDSEIGDFY

SEQ ID NO: 11489 - protein, 347 aa, Piromyces finnis
  Glyco_hydro_catalytic_dom
PIRDISSLELIKEMRFGWNLGNTLDAECTSWMDYEKNPIGSETCWGNVKTNEDIFKTLMDNQFNVFRIPTTWTGHIGEAPEYKINEQWMKRVHEIVDYPYKNGAFVILNIHHETWNHAFAETVDEAKVELAQVWKQIAEEFKGYGERLIFEGQNEPRKNGTPVEWNGGDKEGWDVVNAMNAVFLETVRSSGGNNAKRHLMIPPYAAACNENSFKNFDFPEDDDKVIASVHAYSPYNFALNNGEGAVDKFDASGKNELDWNINLMKKRFVDQGIPMILGEYGAMNRDNEEERAAWAEYYMEKITALGVPQVWWDNGVFEGEGERFGLIDRKNLKIVYPSIVAALQKGR

SEQ ID NO: 11490 - protein, 347 aa, Piromyces finnis
  Glyco_hydro_catalytic_dom
PIRDISSIELIKEMRFGWNLGNTLDAECTSWMDYEKNPIGSETCWGNVKTNEDIFKTLMDNQFNVFRIPTTWTGHIGEAPEYKINEQWMKRVHEIVDYPYKNGAFVILNIHHETWNHAFAETVDEAKVELAQVWKQIAEEFKGYGERLIFEGQNEPRKNGTPVEWNGGDKEGWDVVNAMNAVFLETVRSSGGNNAKRHLMIPPYAAACNENSFKNFDFPEDDDKVIASVHAYSPYNFALNNGEGAVDKFDASGKNELDWNINLMKKRFVDQGIPMILGEYGAMNRDNEEERAAWAEYYMEKITALGVPQVWWDNGVFEGEGERFGLIDRKNLKIVYPSIVAALQKGR

SEQ ID NO: 11491 - protein, 342 aa, Piromyces finnis
  Glyco_hydro_catalytic_dom
PIRDISSIELIKEMRFGWNLGNTLEAFGDWINGSTVNQFETAWGNPAATEQLIGAIKDNGFNSIRIPVAWSNLMSSDYTINSNLLKRVKEVVSWVTNKNMYAIINIHYDGGWFEQFGTSQSTQANQKFNKIWTQVSSYFKDFDEHLIFESLNEEGCWNDVWNRWSNAGDKNKAYGTLNNLNQQFVDIVRNSGGNNKNRHLLLAGYCTDIDLTVDSAFKIPSDSSNRLMVSVHYYTPSTFTILEKDEDWGKFAGSWGTDAEVKALIADFDKLKKRFVDNGIPVIIGEYGTVLTNKNKDSVHKYLFTCAQYATSLGMCPMLWDNGDHFDRKGLKFKDSEIGDFY

SEQ ID NO: 11492 - protein, 221 aa, Piromyces finnis
  Glyco_hydro_catalytic_dom
LAQTPGALVSVDLADILPYWPYKWPGMQSWANEVKSFIADKKKSGLTNWYGLEIWNEPDGTWKDSNGLNFNEFWKQTYQVIRQNDPNEKIIGPCDSWYNESRMRSFLQFCKTNNVIPDIMCWHELSGIENVSNHIKAYRELEKSLGIKELPISINEYCDAEHELEGQPGSSARFIGKFERYKIDSAMISWWFVPKPGRLGSLLATDTQKGAGWYFYKWYGD

SEQ ID NO: 11493 - protein, 204 aa, Piromyces finnis
  Glyco_hydro_catalytic_dom
LPGWPYKFPGLQTWLNEVKSFVNDKKASGLKNWYGLEIWNEPDGTWKDSTNGLSFNDLWKETYKLLRQLDPNEKIIGPCNSFYHEDRIRSFLQFAKQNNCLPDIMCWHELSGIDYVSSHFRAYRNMEKSLGIKELPITINEYCDAEHELEGQPGSSARFIGKFERYKIDSGLITWWFTAHPGRLGSLLATDTQKGAGWYFYKWY

SEQ ID NO: 11494 - protein, 175 aa, Piromyces finnis
  Glyco_hydro_catalytic_dom
LPGWPYKFPGLQTWLNEVKSFVNDKKASGLKNWYGLEIWNEPDGTWKDSTNGLSFNDLWKETYKLLRQLDPNEKIIGPCNSFYHEDRIRSFLQFAKQNNCLPDIMCWHELSGIDYVSSHFRAYRNMEKSLGIKELPITINEYCDAEHELEGQPGSSARFIGKFERYKIDSGLITW

SEQ ID NO: 11495 - protein, 42 aa, Piromyces finnis
  Glyco_hydro_catalytic_dom
LVWGVGDPDSWLGQDKRGLLFDGSYKPKAQYNALLNVLKSTK

SEQ ID NO: 11496 - protein, 138 aa, Piromyces finnis
  Glyco_hydro_catalytic_dom
GYCTDIDLTIDEAYVVPKDDRVMVSVHYYTPSTFTILEEDADWGKAQPTWGSESEVEYLLNDFKKIKTRFVDNGIPVVIGEYGTVTKNKDINSVHKFLKTVAETSLNSGMCPFLWDNGEHFNRKTLVFRDEAIGEIYK

SEQ ID NO: 11497 - protein, 275 aa, Piromyces finnis
  Glyco_hydro_catalytic_dom
VAWSNLMLDNYIINPLLLSRVKEVVDYIVNNDMYAIVNIHWDMGWFTKFATNEKEAFKKYTSIWGQISQYFKDYDEHLVFESLNEEGCWDEIWNQWSNQGDKKKAFNLLNNINQEFVDIFRNSSENNAKRHLLLAGYCTSLDLTSDELYVIPKDDRVMISVHYYGPSTFTILEEDADWGKAAYSWGTEKEINYLVDELKKIKKNFIDKGIPIIVGEYGTAITNKEPASVIRWLKTVAKTTSSFGMVPCLWDAGQYFDREKLVFKNPAIGELFKQL

SEQ ID NO: 11498 - protein, 33 aa, Piromyces finnis
  Glyco_hydro_catalytic_dom
IGYKAKFVLENGFAGMMVWELENDTDDFEILTG

SEQ ID NO: 11499 - protein, 32 aa, Piromyces finnis
  Glyco_hydro_catalytic_dom
IGYKAKFVLENGFAGMMVWELENDTDDFEILT

SEQ ID NO: 11500 - protein, 45 aa, Piromyces finnis
  Glyco_hydro_catalytic_dom
IGYKAKFVLENGFAGMMVWELENDTDDFEILTAINNQLGCDGSSI

SEQ ID NO: 11501 - protein, 228 aa, Piromyces finnis
  Glyco_hydro_catalytic_dom
YFSEWRYSSYPVSRIDFSKFTHLNYAFAVIDPNTYALTGYEGWILNEVVTAAHNQDVKVLMSVGGWYGSRYFTKMTSSENNMKKFAESCKNLIDTYHIDGIDIDWEYPGREGACNNPDYANDTDNYLKLLKILREYIGNENIISAAVSITPFEKNGQPITNLAPYAEYFDFINIMGYDFAGSWSSVTSHHAALYDPEAGDILSISSGVNNWLNGQFPADKIVIGVPTY

SEQ ID NO: 11502 - protein, 310 aa, Piromyces finnis
  Glyco_hydro_catalytic_dom
KKLQYLGVNESSGEFGEGNLPGVYNKHYIYPDVKAIETTIEQGMNAFRICNRWERLQHELFGEFNEFDITEFKKVVDATTAKGAIAIIDPHNYARYNNKLIGSEDVPIEAFVDFWTRLAEIFKDNENVWFGLVNEPHDMETDDWFKAARAAVDGIRSTGAKNNILIPGNGWTGAWSWGKEAWYGEANADVALRYFSSEDENILFEVHQYFDKDYSGTGDQCVQRPCQNLFKEFVEWLKTNNLKGWIGEIGSYLTDECRECVQESIEYLQENNEYVLGTLWWAAGPWWGHNAMSIEPNAEKAFPGQMAWLK

SEQ ID NO: 11503 - protein, 310 aa, Piromyces finnis; identical to SEQ ID NO: 11502
  Glyco_hydro_catalytic_dom

SEQ ID NO: 11504 - protein, 318 aa, Piromyces finnis
  Glyco_hydro_catalytic_dom
IQQVRPDFYYGVATTKSFFSNPKYKDIISTYNLHTGGNECKFYTIQGTQTFNTKQCDDSIAFAKKFGAKFRGHNLFWPANSPDWFKNYSDDIEEVKAYYLDYVAKVLDHYKDEEDIIYWDVVNESVTDDSTIDKYKLRYGSDRSNEFKGWDTYTEDIFTLAREHTNPNVKLIYNDYNAENNNGNFNGKTGAVYKYIKEMKEKGIPIDGVGLQMHISCNYTPNYEQLTELIDMYKEIGVEVHVTEIDVSMKNCKTHDQQRKLYMDVFRACFDNENCKVFTVWGAYDTESWIGASNVPLPFDDDMYPKDIYFDMLEYVMK

SEQ ID NO: 11505 - protein, 314 aa, Piromyces finnis
  Glyco_hydro_catalytic_dom
DYAKDFRIGVAANTMRFNNQAYNEALKAFNYMVAENGCKLSGIQQRQGNYDFSDCDNHYKKAKELGMAFRGHALIWHAYMPSWFENANASTLKNAIVEHVTKVLQHYEGKIDTWDVVNEAIDDSSNGNGWKMRNSFLYQKVPNFVDLAFETARKVSPNTKLFYNDYNTEGIYGKTESVFQFVKDMKSRGIPIDGVGIQYHVSVDSQPQYNKIDDLISRYCGLGLEVHITELDVKCGSQCSSSNVESKQATVFTNALKACLNNSCCTGYLVWGVGDSDSWLGANEKGLLFNSNYQPKSQYTAVLNVLKETKPKAT

SEQ ID NO: 11506 - protein, 314 aa, Piromyces finnis; identical to SEQ ID NO: 11505
  Glyco_hydro_catalytic_dom

SEQ ID NO: 11507 - protein, 73 aa, Piromyces finnis
  Glyco_hydro_catalytic_dom
NVESKQATVFTNALKACLNNSCCTGYLVWGVGDSDSWLGANEKGLLFNSNYQPKSQYTAVLNVLKETKPKATT

SEQ ID NO: 11508 - protein, 73 aa, Piromyces finnis; identical to SEQ ID NO: 11507
  Glyco_hydro_catalytic_dom

SEQ ID NO: 11509 - protein, 72 aa, Piromyces finnis
  Glyco_hydro_catalytic_dom
NVESKQATVFTNALKACLNNSCCTGYLVWGVGDSDSWLGANEKGLLFNSNYQPKSQYTAVLNVLKETKPKAT

SEQ ID NO: 11510 - protein, 307 aa, Piromyces finnis; identical to SEQ ID NO: 11481
  Glyco_hydro_catalytic_dom

SEQ ID NO: 11511 - protein, 287 aa, Neocallimastix californiae; identical to SEQ ID NO: 9620
  Glyco_hydro-type_carb-bd_sub

SEQ ID NO: 11512 - protein, 260 aa, Neocallimastix californiae
  Glyco_hydro-type_carb-bd_sub
LTQNNNSYILKNNYATVVISKKDGYITSLKIAGDNQEFLNRAYIDANGSKAGFHAKKSTIIKNTNDHVEIAFTDNVLNMDWEVRYTMLNDTKGVYFSLKLDHKASYADTQFSEIRLVFRLKSNPFNWLQIEDNVGRYLPTAEEQKNCEVMGPKEACKVKTGEVLHKYDWSIDALKHDVHGFSTKNGLGCWFVLPSMEWKNGGAYNRDLACHNGENDSIQIMYMAGSHYGAGDEYPKKGENWSKVYGPYLIYVNKAGSPQA

SEQ ID NO: 11513 - protein, 289 aa, Neocallimastix californiae; identical to SEQ ID NO: 9622
  Glyco_hydro-type_carb-bd_sub

SEQ ID NO: 11514 - protein, 225 aa, Anaeromyces robustus
  Glyco_hydro-type_carb-bd_sub
LTENNTSYILSNGLATFTIAKSSGFITSMKYKNNSQEFLNRSYIDANGGKVYFSVTSSSVVIRTDDLVEIVFYDDYSKHVGTGFAIDWEVRYTMRSGVSGLYFSLTQAHKSNYEEAQCSELRLVMRLKSDVFNWLQVDDFTKRVMPTAAQQNKCTTLSPQEACQLETGEVIHKYDWSIDVLEHKVHGFASISKNLGSWFVMPSMEWKNGGAVNRDLACHQGGADS

SEQ ID NO: 11515 - protein, 288 aa, Piromyces finnis
  Glyco_hydro-type_carb-bd_sub
DSISVTENQNSYILSGKNFEFLINKSSGLLSTYKYRGETIITEGPTPNFWRGYVENDNNGAGWAKTFDSNWRNAMNGARCDKIEVNNGSDSSEKIIVSHLTLPKVGSTKVDITYTVHCDGSVDVEFNVDATRSDLGNFLRVGSMMKLPEGFEKLSWYGNGPVETFNDRKTNGRMGVWESTVTDMFYPYMKADDCGNLTDLKWISVQSKKRSASILVVAEGAVEGSALHFAPEDLMRADHPYKLRPLKTTILSVDYGSMGTGSATCGQATLDKYRLPSDRPYNWKFTII

SEQ ID NO: 11516 - protein, 228 aa, Piromyces finnis
  Glyco_hydro-type_carb-bd_sub
LTENNTSYILSNGLATFTIAKSSGFITSMKYKNNSQEFLNRSYIDANGGKVYFSVTSSYVATKNSDLVEIVFVDDYSKHVGTGFAIDWEVRYTMKSNVSGIYFSLTQSHKSNYEEAQCSELRLVMRLKSDVFNWLQVDDFNKRVMPTASEQSKCVTLSPSEACRLESGEVIHKYDWSVDALEHKVHGFGSISKNLGSWYVIPSMEWKNGGAVNRDLACHQGGSDSLQI

SEQ ID NO: 11517 - protein, 233 aa, Piromyces finnis
  Glyco_hydro-type_carb-bd_sub
SLTDNGSSYILRNDYAIVTIAKNSGYITSLKLNGNNQEFLNRSYIDANGGKVYFSPQSSKVIKNTSSHVEVAFYDNYNSNSKLGLDWEVRYTMLSDTRGVYYSLTNTHKTNYPETSYSEIRLVLRLKADIFNHLQVEDDVYRDMPSAADQNKCVEMGPKEACQLPNGEVIHKYDWSVDMLKHHIHGFSSKSTGLGCWFVIPSLEWKNGGAYNRDLSCHQGGSDSLQIMYMNGS

SEQ ID NO: 11518 - protein, 217 aa, Neocallimastix californiae
  Glycoside hydrolase/deacetylase
TWAGFRKGAASFTFDDGAPSHVSDGAPVFEKYGYRATFFLVYNWNPNWSGFQSLANKGHEIGSHSNSHGQNMSGEEASSKRNIGGKINQKYGIISVAYPNCNVPNEGAVLQNYILGRICNGSWQGMSDNMGKNGPSNWAKVPAIMTGSEGQIRSTNDFTSQMQKVIQSNGWVSFLTHGYQGKNNGSATYSPTDLSAIEGALQWAKQNDKNIWIAPMG

SEQ ID NO: 11519 - protein, 211 aa, Neocallimastix californiae
  Glycoside hydrolase/deacetylase
ASFTFDDGAPSQVSDCGPVFDKYGYKGTFNLVYNWNPNWSGFQSLADSGHEIASHSNSHGNNMSGEEASSKTNIGGKIKQKYGIITVAYPNCNVPNERAVLQNYIVGRICNGSWQGMSDIMGKNGPSNWAKTPAIMTGAEGQIKSTNDFTGQMQKAVQSNGWVAFLTHGFQGKNNGPATYSPTDLNAIDGALKWAKQNDKDIWVAPMGFVA

SEQ ID NO: 11520 - protein, 211 aa, Anaeromyces robustus; identical to SEQ ID NO: 11519
  Glycoside hydrolase/deacetylase

SEQ ID NO: 11521 - protein, 172 aa, Anaeromyces robustus
  Glycoside hydrolase/deacetylase
KFYTQCNNPKHWAMTYDDGPTEFADAILDLLKEKGIKATFFIVGHMYMDNNSSDWSRIIKRMDSEGHIVGNHTYDHQDLTGLSSDQIISQMKQVEDRIFKIIGKRPAFMRPPYGSGNGNQNVMNALQQAGYTAAINWNVDPQDYSNGGDANYARQVINQAKGQPIITLNHLK

SEQ ID NO: 11522 - protein, 296 aa, Neocallimastix californiae
  GLYCOSYL HYDROLASE 43 FAMILY MEMBER
NPIITQKYSADPGVMVYNGRVYVYATNDGDAGTRYNSENTYGQINTINVMSSADLVNWMDHGSIPAAGGGGAARWASNSWAPCAAWKKINGKDKFFLYFANNASGIGVLTADSPTGPFKDPIGRALISRQTPNSNVEWLFDPAVIVDTDGTGYLYYGGGVPQGQNANPRTIRVAKLGNDMTSIQGTPQMIDAPWVFEDSGINKIGNTYVYSYCTNWAGGPYGNARIAYMTSNNPMSGFKYQGTCFNNPGDFFQTTGNNHHTIIEFKNKYYIFYHAEWLNKQILGGQKGYRTTHVDE

SEQ ID NO: 11523 - protein, 550 aa, Neocallimastix californiae
  GLYCOSYL HYDROLASE 43 FAMILY MEMBER
VVATAATTVNNPIIWADVPDPDIIRVDDTYYMVSTTMYFTPGAPIMKSKDLVSWEIVTYTYDILANGDVQTLSRGQHDYSHGSWAASLRYNKGIFYVFFGSYGTNKSYIFKTKDIESGKWERFEINGMYHDASILFDDDGRNYLVYGGGGEIKIKEFNAEMTNFKWGGLDKTLFRTNLSGLAGEGSHVMKINGYYYVFIIAWPSGKGRIEICYRSKDLTGYYENKTVLDSGLGSYGSGVAQGGIVDTPDGKKWFGLLFQDHGAVGRIPVLVPVNWQNGWPMMGVNGKAPLTLQIDGGFKGSKLAKSDDFNYDSNHLDLVWQWNHNPDNSAWSVTERPGWLRLKNKHVASEILKARNTLTMRTEGPACSSVVKLDVTNLKVGDYAGLSAFQYNYGNVGVYVADNGEKRIYMASNGNTNGDVIKDSRNNIVQETKLNGNEVYLKLDFRFSNVERDGSASWNIDKVNFYYSYDGSKWTKIGKEIGMTYDLKLFTGYRSGLFSYPTKNTGGYADFDFFKYEREKWNQGTIASDDDTKTVYPGNQESNQGNNNDQ

SEQ ID NO: 11524 - protein, 595 aa, Neocallimastix californiae
  GLYCOSYL HYDROLASE 43 FAMILY MEMBER
NPINTIKYSADPGVMVYDGRVYVYGTNDGYAGELGRNPQDNTYGQINTINVMSSDDLVNWIDHGTIPAAGRNGAAKWAGNSWAPCATHKKINGKEKFFLYFANSGNGIGVLTSDSPTGPFVDPIGHALISRSTPNCSNIVWLFDPAVFVDDDGTGYLYFGGGVPDNQSSNPKTVRAVKLGNDMTSLAGNPVTIDAPWVFEDSGINKSGDTYFYSYCTNWNGGPYGNAKIAYMTSKNPLGPFTMQGTVLNNPGDFFGTTGNNHHTIIEFKDQWYIFYHAEWLNKQEFGSQKGYRTSHVDVLPFSNGKFGNAKGTLTGVTQLFKVNAYNTNYASMMAWQGGVSTNGLGHTTVTYNRGEWTGVSNVDFGEAATSVKITAASNNGAVIRITTGSPNGDVVGYVSIPATGGNSNFKTVTADINTVSGTKHVFFVASGDVVVDTWQFIGSGTGSDEPIEFGDGELDLNDKAKLEDGWYYIKNPSTGKYIQVEDGVGRNSANVVIGSERKDDAQKWKVTNTNGYVTFTSALGNYMIDIANGEDRNGANVQIYDAYGGDAQQFIIYKTGRENVYTIGTKASAGDKAIDIEGARNGENVNLLQW

SEQ ID NO: 11525 - protein, 296 aa, Neocallimastix californiae
  GLYCOSYL HYDROLASE 43 FAMILY MEMBER
NPTITHRYSADPGVMVYNGRVYVYATNDGDAATRYNSENTYAQINTINVMSSADLVNWMDHGSINATGGGGAAKWAKNSWAPAAAWKKINGKDKFFLYFADNASGIGVLTADSPTGPFRDPIGRALISRQTPNSNVEWLFDPAVFVDSDGTGYLYYGGGVPKGREANPNTIRVAKLGGDMTSISGTPANIDAPWVFEDSGINKIGNTYVYSYCTNWNGGPYGNARIAYMTSNNPMGKFTFQGTCFNNPGDFFQTTGNNHHTIIEFKNKYYIFYHAEWLNKQILGGQKGYRTTHVDE

SEQ ID NO: 11526 - protein, 370 aa, Neocallimastix californiae
  GLYCOSYL HYDROLASE 43 FAMILY MEMBER
VHDPSIVKSGNKYYIFGSHMDAAYTTDLWKFTKLYTGVDENNKMFTNLFSKSNYDAFKFVGKNSDGGYSVWAADVMYNKKMKKWVQYFCTSSTYIKSSLCYGIADKVEGPYTYKSCFLHSGMDSGSVGKTNLRAITGTEDKNRYYPNNRYNNKVYPNAIDPNAFYDFNGRLWLAYGSWSGGIYILELDESTGLPKHNISNGNNVDKYYGKKLAGGGHQSIEGPYILPYKAAGYYYLFVSYGTLTSNGGYQIRLFRSKNPDGPYTDVAGKEFMSGTNSNFGVKIMGNYGIPGREKAYMAPGHNSVLIDDDGKILLCYHTRFNDGQEYHEPRVHQMFLNKEGWLTAAPYAYTGETISKTGYSMNDMVGSYKF

SEQ ID NO: 11527 - protein, 290 aa, Neocallimastix californiae
  GLYCOSYL HYDROLASE 43 FAMILY MEMBER
NPIIKDMYTADPAPMVYGDTLYLYTTHDEDVLKNNFYTMENWYVFSTKDMVNWTNHGQILSLDDIEWADERAWAPQTVEKDGKFYFYFPAHKIDGGMAIGVAVADSPIGPFKEIGHPIVYEDDWNDFDPTVFIDDDGKAYLYFGNPELRYVVLNDDMISYDEEIGVVKVPMTEESFGKGGHDTGTSYAEGPYFYKRNGLYYMVYAAFREGSHTESLAYSTSEKPTGPWKYGGVLMTEGTAFTNHPGIADFNGKSYFFYHTDELPGGGDFHRSVCVTEFEYKEDGSIETIP

SEQ ID NO: 11528 - protein, 316 aa, Neocallimastix californiae
  GLYCOSYL HYDROLASE 43 FAMILY MEMBER
NPLFTHRYSADPGVMVYNNRVYVYATNDGDVATKFTDDNTYSHINSLNVMSSEDLVNWTDHGSILVAGNNGAAKWAGNSWAPCATYKKINGKDKFFLYFANNANGIGVLTSDSPTGPFKDPIGKALITRQTPNCGDVAWLFDPAVLVDTDGTGYLYFGGGVPDGKDAAPKTIRVVKLGADMVSLAGTPQLIDTPYVFEDSGINKIGNTYYYSYCTNWSAGEPYGQARIVYMTSSNPMGPFTYQGVCLNNPGEDFQTYGNNHHTIIEFKNKYYIFYHTEWLNKQVFGTQKGYRTSFVNEITFSNGKFEKAKGTYEGV

SEQ ID NO: 11529 - protein, 546 aa, Neocallimastix californiae
  GLYCOSYL HYDROLASE 43 FAMILY MEMBER
AQTTVRNPIIWADVPDDDIIRVDDTYYMVSTTMFFSPGAPIMKSKDLFSWEICNYVYDILADGDVQTLKNGKHDYSHGQWAASLRYHEGTFYVFFGSYGTNKSYIFKTKDIEKGTWTRNEIFGMYHDASILFDDDGRKYLVYGGSGEIKIKEFNNEMTDFKRGGADKVLFRTGLSGLAGEGSHIQKIGKYYYIFIIAWPNGKGRIEICYRSRDLLGNYENKIVLDSGLGSYGSGVAQGGIVDTPDGKWYGLLFQDHGSVGRIPVLVPVNWQNDWPIMGVNGKAPLTFQIEGNFKGTQLAKSDDFDYSSNRLSLEWQWNHNPDNTAWSVTDRPGWLRLKNKYIAPELLKARNTLTMRTEGPACSGVVKLDTSNMKVGDYAGLSAFQYNYGNVGVYVADNGERRIYMASNGGYNGNADVTNSRNNIVQEVKLNGKEIYLKTDFRFSTVKSDGSASNNIDKVNFYYSLDGNQWNKIGKEIGMTYDLKLFTGYRNALFSYPTKNTGGYADFDYFEYQREEWNSPNFAEEEKEDPNGYLFHNTFERGIDGW

SEQ ID NO: 11530 - protein, 296 aa, Neocallimastix californiae
  GLYCOSYL HYDROLASE 43 FAMILY MEMBER
NPLITHRYSADPGVMVYNGRVYVYATNDGDVANRNVGENKYDQINTINCMSSDDLINWMDHGPIPAAGGNGAAKWAKNSWAPTAAWKKINGKDKFFLYFANNASGIGVLTADSPTGPFKDPIGRALISRQTPNSNVEWLFDPAVFVDTDGTGYLYYGGGVPQGQNANPRTIRVAKLGNDMTSIQGTPQMIDAPWVFEDSGINKIGNTYVYSYCTNWAGGPYGNARIAYMTSNNPMSGFKYQGTCFNNPGDFFQTTGNNHHTIIEFKNKYYIFYHAEWLNKQVFGSQKGYRTTHVDE

SEQ ID NO: 11531 - protein, 306 aa, Neocallimastix californiae
  GLYCOSYL HYDROLASE 43 FAMILY MEMBER
NPINVLKYSADPGVMVYDGRVYVYATNDGIGENIGNNPRDNDYSHINTINVMSSSDMVNWVDHGTIPAAGNSGAAKWAGNSWAPCAAHKKINGKEKFFLYFANSGNGIGVLTSDSPTGPFVDPIGGPLVSRSTLNCNSIVWLFDPAVMVDDDGTGYLYFGGGVPENAKSNPKTVRAVKLGNDMISLAGTPQTIDAPWVFEDSGINKAGNTYFYSYCTNWDNGPYGNAKIAYMTSSSPLGPFQYQGTVLNNPGDFFGTVGNNHHTIINFKNKWYIFYHAEWLNKQVFGSQKGFRTSHVDELPFSNGK

SEQ ID NO: 11532 - protein, 370 aa, Neocallimastix californiae
  GLYCOSYL HYDROLASE 43 FAMILY MEMBER
VHDPSVVKYGNKYYIFGSHMDTAYTTDLWKFTKLYTGVNDNNKMFTNLFSKSNYGAFNFVGKNSDGGYSVWAPDIIYNNRMKKWVQYFCTSSTYIKSSICYALADNVEGPYTYKNCFIFSGMDSKTVGKTNLKAVIGYEDMNRYYPNNKYNNRVYPNAIDPNAFYDFKGKLWLVYGSWSGGIYILELDESTGLPKHNISNGNNTDRYYGKKLAGGNHQSIEGPFILPHKAVGYYYLFVSYGSLTSNGGYQIRMFRSKNPDGPYTDVAGKEFMSGNNSSFGVKVMGNYNIPGREQAYMAPGHNSALLDDDGKVLIFYHTRFNDGQEYHEPRIHQMFLNKEGWLCAAPYAYTGETISETGYSMNDMVGTYKF

SEQ ID NO: 11533 - protein, 278 aa, Neocallimastix californiae
  GLYCOSYL HYDROLASE 43 FAMILY MEMBER
PLVSNMYTADPAPMVYGDTLYLFTSHDENNIQNNFYTMLNWHLFSTKDMINWTSHGQVFSLDDISWADDRAWAPQAIARNDKFYLYVPVHKRNGGMAIAVGVSDKPTGPYKDIGHPLVDEGDWNDIDPTVFIDDDGQAYLYFGNPELRYVLLNEDMVSYNKSVGVKKIPMTADSFGRGEGSRTTYGEGPFFYKRKDMYYMAYAAFRPNKGSEHLAYSYSNSPTGPWKYGGVLMTEDGGTYTNHPGIARFKGRSYLFYHTGQLPGGGAYHRSVCFTEFK

SEQ ID NO: 11534 - protein, 208 aa, Neocallimastix californiae
  GLYCOSYL HYDROLASE 43 FAMILY MEMBER
LRLKNKYVVSELLRARNTLTMRTEGPACTSIVKMDTSKMKVGDYAGLSAFQFKYGNVGVYVADNGEKRVYMATNGGNEINNSRNYIEQETRMSGNEIYLKLEFRFNNVGNDGSASNNIDRVNFYYSYDGDKWTKIGKELGMTYDLTLFTGYRSALYSYPTKSTGGYVDFDYIKYTREKWNQGTLPDDADDDIKPQPIEPDENGYYFHN

SEQ ID NO: 11535 - protein, 306 aa, Anaeromyces robustus; identical to SEQ ID NO: 11531
  GLYCOSYL HYDROLASE 43 FAMILY MEMBER

SEQ ID NO: 11536 - protein, 289 aa, Anaeromyces robustus
  GLYCOSYL HYDROLASE 43 FAMILY MEMBER
PLVSNMYTADPAPMVYGDTLYLFTSHDENNIQNNFYTMLNWHLFSTKDMINWTSHGQVFSLDDISWADDRAWAPQAIARNDKFYLYVPVHKRNGGMAIAVGVSDKPTGPYKDIGHPLVDEGDWNDIDPTVFIDDDGQAYLYFGNPELRYVLLNEDMVSYNKSVGVKKIPMTADSFGRGEGSRTTYGEGPFFYKRKDMYYMAYAAFRPNKGSEHLAYSYSNSPTGPWKYGGVLMTEDGGTYTNHPGIARFKGRSYLFYHTGQLPGGGAYHRSVCFTEFKYNKDGSIDTIP

SEQ ID NO: 11537 - protein, 519 aa, Anaeromyces robustus
  GLYCOSYL HYDROLASE 43 FAMILY MEMBER
TTVYNPIIWADVPDPDIIRVDDTYYMVSTTMFFNPGAPIMKSKDLVSWKICNYVYDKLADGDVQNLARGQHDYSHGQWATSLRYHKGTFYVFFGSYGTNKSYIFKTKDIENGPWTRTELGGMYHDASMIFDDDGRNYLVYGAGGEIRIKEFNSEMTDFKRGGADKILFRTNLSGLAGEGSHVQKINNYYYIFIIAWPNGKGRIEICYRSKDILGNYESRTVLDSGVGSYGSGVAQGGIVDTPEGKWYGLLFQDHGSVGRIPVLVPVNWQSDWPMMGVNGRAPVTFQIDGDFKTTKLAKSDDFNYSSNDELDLVWQWNHNPDNSAWSVTEREGWLRLKNKYVVSELLRARNTLTMRTEGPACTSIVKMDTSKMKVGDYAGLSAFQFKYGNVGVYVADNGEKRVYMATNGGNEINNSRNYIEQETRMSGNEIYLKLEFRFNNVGNDGSASNNIDRVNFYYSYDGDKWTKIGKELGMTYDLTLFTGYRSALYSYPTKSTGGYVDFDYIKYTREKWNQGTLPD

SEQ ID NO: 11538 - protein, 297 aa, Anaeromyces robustus
  GLYCOSYL HYDROLASE 43 FAMILY MEMBER
NPVVSHRYSADPGAMVYDGRVYIYGSNDGNVAERQGKTNDYSQIKTINLLSSSDLVNWMDHGPIPATGQSGIAKFASNSWAPAACHKKINGKEKFFVYFANNASGICVLESDSPTGPFKDPLGKPLITRQTPNSNVEWLFDPACLVDDDGTGYLYFGGGVPNGQAANPRTVRVVKLGADMKSLAGTPQTIDAPWVFEDSGINKVGNTYYYNYCTNFNGGPYGNGRIAYMSSNSPMGPFSYKGTCFNNQGDFLQDGGGNNHHTIIEFKNKFYMVYHAQWLDMKVKGKSNGYRTTHIDE

SEQ ID NO: 11539 - protein, 421 aa, Anaeromyces robustus
  GLYCOSYL HYDROLASE 43 FAMILY MEMBER
VHDPSVIKNGNKYYIFGSHMDTAYTTDLWKFTKLYTGVNENNRMFTNLFSKSNYGAFNFVGKNSEGGYSVWAPDVMYNKKMRKWVQYFCTSSTYIKSSICYALADNVEGPYTYQSCFIFSGMDSGSVGKTNLRAVTGTEDGNRYYPGNKYNNRVYPNAIDPNVFYDFNGRLWLAYGSWSGGIYILELDESTGLPKHNISNGTNIDKYYGKKLAGGGHQSIEGPYILPYKAAGYYYLFVSYGTLTSNGGYQIRLFRSKNPDGPYTDPAGNEFMGGTNSNFGLKLMGNYNIPGRSQAYMAPGHNSAMIDDNGKVLMFYHTRFNDGQEYHEPRVHQLFLNKEGWFCVAPYAYTGETISTTGYGLNDIIGTYKMLFHFHTRINGDISNLYTIDLNEDFTVTGRYTGTWSYDKGTQYMTITIGKII

SEQ ID NO: 11540 - protein, 281 aa, Anaeromyces robustus
  GLYCOSYL HYDROLASE 43 FAMILY MEMBER
NPLITHRYSADPGVMIYNDRVYVYSTNDGDVDLNNKNVNGNTYDHIKSLNVMSSSDLVNWQDHGSINVAGGAAKWAQYSWAPCATYKKINGKDKFFLYFANNANGVGVLTSDSPTGPFTDPIGKALISRDTPNCGDVTWLFDPAVLVDDDGTGYLYFGGGVPNGMDANPKTIRVVKLGSDMISLAGQPQLIDAPYVFEDSGINKIGNTYFYSYCTNWTGGQYGGANIAFMTSNSPMGPFKAGSSCFKNPGEFLGNYGNNHHTIIQFKNKWYIFYHTEWLNK

SEQ ID NO: 11541 - protein, 297 aa, Anaeromyces robustus
  GLYCOSYL HYDROLASE 43 FAMILY MEMBER
NPLITHRYSADPGVMVYNDRVYVYATNDGDVANRNVGDNTYEQINTINCMSSDDLVNWTDHGPIAAAGQGGAAKWAKNSWAPTAAHKTINGKEKFFLYFANSGAGIGVLVSDSPTGPFTDPIGKALITPQTPNCASVTWLFDPAVLVDTDGTGYLYFGGGVPQGQDANPKTIRVVKLGPDMTSLAGNPETIDAPWVFEDSGINKIGNTYVYSYCTNWANGPHGNARIGYMTSNSPMGPFTFQGTCFNNPGDFFQTTGNNHHTIIEFKGKYYIFYHTEWLNKQVLGSQKGYRTTHVNE

SEQ ID NO: 11542 - protein, 297 aa, Anaeromyces robustus
  GLYCOSYL HYDROLASE 43 FAMILY MEMBER
NPIITHRYSADPGVMVYNGRVYVYATNDGDVANRNVGDNTYEQINTINCMSSDDLVNWTDHGPIKAAGQGGAAKWAKNSWAPHAAHKTINGKEKFFLYFANSGAGIGVLVSDSPTGPFTDPIGKALVTPQTPNCSSVTWLFDPAVLVDSDGTGYLYFGGGVPQGQNSNPKTIRVVKLGPDMTSLAGNPQTIDAPWVFEDSGINKVGNTYVYSYCTNWANGPYGNARIAYMTSNSPMGPFQYQGTCFNNPGDFFQTTGNNHHTIIEFKDKYYIFYHTEWLNKQVLGSQKGYRTTHVNE

SEQ ID NO: 11543 - protein, 287 aa, Anaeromyces robustus
  GLYCOSYL HYDROLASE 43 FAMILY MEMBER
IITSMYTADPAPLIVDDTLYIYTTHDEDVLINNFYTMRDWYVFSTKDMVNWTNHGPILSLDDITWADDRAWAPQTIERNGKYYFYYPAHKIDGGMAVGVAIGDSPVGPFKDIGEPLVYQDDWIDFDPTVFIDDDGQAYLYFGNPQLRYVLLNEDMVSYNEEVGIVDVELTVEGFGEGNNNPTSYDEGPFFYKRNGIYYMLFSGFRKGYESEYIGYATSTSPTGPWKYGGILMEEHEDKTFTNHSSIVEFNGHTYFFFHTGDLPDGGDFHRSVAYIEFEYNEDGSINP

SEQ ID NO: 11544 - protein, 287 aa, Anaeromyces robustus; identical to SEQ ID NO: 11543
  GLYCOSYL HYDROLASE 43 FAMILY MEMBER

SEQ ID NO: 11545 - protein, 334 aa, Piromyces finnis
  GLYCOSYL HYDROLASE 43 FAMILY MEMBER
DPAVFVDDDGTGYLYFGGGVPEGQASDPRTTRAAKLGDDMISIDGIPQTIEAPWVFEDSGINKVGDSYVYSYCVNWDNGPYGNAKIAYMTSENPLGPFTFQGTLLNNPGDFFGTTGNNHHTIIEFKGKWYIFYHAEWLNVQVYGSQKGYRTTHVDELPFFNGNFRNATGTLAGVEQLSNVDAYSTNYASMMAWQAGVSVYGLGHTTVTYRKGTWTGVSGVEFGDNATSVKISAASANGATIRITSGSENGEVIGYVTVPATGDEFVTVTADVSVSGVKDIFFVASDEVVVDTWQFVADEAISSADEEIEVDGDDEINVGEVDSADEEIDSADEE

SEQ ID NO: 11546 - protein, 286 aa, Piromyces finnis
  GLYCOSYL HYDROLASE 43 FAMILY MEMBER
PLITNMYTADPAPMVYGDTLYLYTTHDENNLKNNFYTMLDWYVFSTKDMVNWTNHGKIFSLDDISWADDRAWAPQAIERNGKFYLYCPVHKTNGGMAIAVGVSDKPTGPFKDIGHPLVDEGDWNDIDPTVFIDDDGQAYLYFGNPELRYVLLNEDMISINKSVGVKKIKMTEEAFGKGSHDTGTTYGEGPYFYKRNGIYYMAYAAFRQGKNIESLGYSTSTSPTGPWKYGGPLMTEEGGAFTVHPGIVDFKGHSYLFYHTGELPGGGDFHRSVGFAEFRYNKDGSI

SEQ ID NO: 11547 - protein, 421 aa, Piromyces finnis
  GLYCOSYL HYDROLASE 43 FAMILY MEMBER
VHDPSVVKNGNKYYIFGSHMDTAFTTDLWKFTKLYTGVNENNKMFSNLFSKSNYGAFNFVGKNSEGGFSVWAPDVMFNKRMNKWVQYFCTSSTYIKSSICYALADNIEGPYTYKDCFIFSGMDSGSVGKTNIRAITGSDNGNRYFPGNKYNNKVYPNAIDPNAFYDFNGKLWLAYGSWSGGIYILELDESTGLPKHNINNGNNIDKYYGKKLAGGNHQSIEGPYILPHKAAGYYYLFVSYGTLTSNGGYQIRLFRSKNPDGPYTDAAGREFMSGTNSNFGVKIMGNYNIPGRSQAYMAPGHNSALIDDNGKILLFYHTRFNDGQEYHEPRIHQMFLNKEGWLVAAPYAYTGETISPTGYSMNDMVGSYKLLFHFHTRINGEISNLYTINLNQDFTVTGKYTGTWSYDKGTHYMTITLNNYT

SEQ ID NO: 11548 - protein, 299 aa, Piromyces finnis
  GLYCOSYL HYDROLASE 43 FAMILY MEMBER
NPVNTLKFSADPGVMVYDGRVYVYATDDGHVDQLGNNPETNTYGQINTINVMSSDDLVNWIDHGSIPAAGRNGAAKWANNSWAPTAAHKKINGKEKFFLYFANSGNGVGVLSSDSPTGPFVDPIGGPLVSFDVPNCGDIVWLFDPAVFVDDDGKGYLYFGGGVPTGQDANPKTIRVVQLGDDMTSIVGTPQLIDAPYVFEDSGINKIGNTYIYSYCTNWANGPYGSANIAYMTSSSPMGPFKMQKSCFKNPGEYFGNYGNNHHTMIEFKGKNYIFYHTEWLNKEVFGTQKGYRTSHVDE

SEQ ID NO: 11549 - protein, 304 aa, Piromyces finnis
  GLYCOSYL HYDROLASE 43 FAMILY MEMBER
LTNHNPLMTYRYGADPGVFVYDGRVYVFTTNDGDVDLTNKNIAENTYSHIQTLNLISSADLVNWTDHGSISVAGNNGAAKWAQYSWAPCATYKKINGKDKFFLYFANNANGIGVLTSDSPTGPWKDPIGKALITRQTPNCNVEWLFDPAVFVDDDGTGYLYFGGGVPEGQASDPRTTRAAKLGDDMISIDGIPQTIEAPWVFEDSGINKVGDSYVYSYCVNWDNGPYGNAKIAYMTSENPLGPFTFQGTLLNNPGDFFGTTGNNHHTIIEFKGKWYIFYHAEWLNVQVYGSQKGYRTTHVDELP

SEQ ID NO: 11550 - protein, 299 aa, Piromyces finnis
  GLYCOSYL HYDROLASE 43 FAMILY MEMBER
NPLITHRYSADPGVMVYDGRVYVYGTNDGHADELGDNPEDNTYQQINTINVMSSDDLINWVDHGSIPAAGENGAAKWAVNSWAPAAAHKKINGKEKFFLYFANSGNGVGVLSSDSPTGPFVDPIGGPLVSFDVPNCGDIVWLFDPAVFVDDDGKGYLYFGGGVPTGQDANPKTIRVVQLGDDMTSIVGTPQLIDAPYVFEDSGINKIGNTYIYSYCTNWANGPYGSANIAYMTSSSPMGPFKMQKSCFKNPGEYFGNYGNNHHTMIEFKGKNYIFYHTEWLNKEVFGTQKGYRTSHVDE

SEQ ID NO: 11551 - protein, 591 aa, Piromyces finnis
  GLYCOSYL HYDROLASE 43 FAMILY MEMBER
NPVNTLKFSADPGVMVYDGRVYVYATDDGHVDQLGNNPETNTYGQINTINVMSSDDLVNWIDHGSIPAAGRNGAAKWANNSWAPTAAHKKINGKEKFFLYFANSGNGVGVLSSDSPTGPFVDPIGGPLVSFDVPNCGDIVWLFDPAVFVDDDGTGYLYFGGGVPEGQASDPRTTRAAKLGDDMISIDGIPQTIEAPWVFEDSGINKVGDSYVYSYCVNWDNGPYGNAKIAYMTSENPLGPFTFQGTLLNNPGDFFGTTGNNHHTIIEFKGKWYIFYHAEWLNVQVYGSQKGYRTTHVDELPFFNGNFRNATGTLAGVEQLSNVDAYSTNYASMMAWQAGVSVNGLGHTTVSYNRGDWTGVSNVDFGDSATSVKISAASSNGATIRITSGSENGDVIGYVTIPATGGDKNFKTVTANVKASGTKNIFFVASGDVTIDTWQFIGSGKGSNEPIEFGDGELPSSKPVAVKIEDGWYYIKNPASGKYLQVANNQAKATANIEIGSSSQDDGQKWLLTNVGEGYVTLKSALGDFMIDVSSGEDKNGANIQIYTAYGHDAQQFMILKSSVEGAYSITSRVSFQDKGIDIEGARTADG

SEQ ID NO: 11552 - protein, 299 aa, Piromyces finnis; identical to SEQ ID NO: 11548
  GLYCOSYL HYDROLASE 43 FAMILY MEMBER

SEQ ID NO: 11553 - protein, 304 aa, Piromyces finnis; identical to SEQ ID NO: 11549
  GLYCOSYL HYDROLASE 43 FAMILY MEMBER

SEQ ID NO: 11554 - protein, 591 aa, Piromyces finnis
  GLYCOSYL HYDROLASE 43 FAMILY MEMBER
NPLITHRYSADPGVMVYDGRVYVYGTNDGHADELGDNPEDNTYQQINTINVMSSDDLINWVDHGSIPAAGENGAAKWAVNSWAPAAAHKKINGKEKFFLYFANSGNGIGVLSSDSPTGPFTDPLGGPIISRSLPNCNNIVWLFDPAVFVDDDGTGYIYFGGGVPEGQSSNPKTVRAAKLSDDMIRISGTPQTIDAPWVFEDSGIHKYGDTYFYSYCTNWDNGPYGNAKIAYMTSKSPLGPFTYQGTLFNNPGEFFGTTGNNHHTIIEFKGKWYIFYHAEWLNVQVYGSQKGYRTTHVDELPFFNGNFRNATGTLAGVEQLSNVDAYSTNYASMMAWQAGVSVNGLGHTTVSYNRGDWTGVSNVDFGDSATSVKISAASSNGATIRITSGSENGDVIGYVTIPATGGDKNFKTVTANVKASGTKNIFFVASGDVTIDTWQFIGSGKGSNEPIEFGDGELPSSKPVAVKIEDGWYYIKNPASGKYLQVANNQAKATANIEIGSSSQDDGQKWLLTNVGEGYVTLKSALGDFMIDVSSGEDKNGANIQIYTAYGHDAQQFMILKSSVEGAYSITSRVSFQDKGIDIEGARTADG

SEQ ID NO: 11555 - protein, 302 aa, Piromyces finnis
  GLYCOSYL HYDROLASE 43 FAMILY MEMBER
LTNHNPLMTYRYGADPGVFVYDGRVYVFTTNDGDVDLTNKNIAENTYSHIQTLNLISSADLVNWTDHGSISVAGNNGAAKWAQYSWAPCATYKKINGKDKFFLYFANNANGIGVLTSDSPTGPWKDPIGKALITRQTPNCNVEWLFDPAVFVDDDGKGYLYFGGGVPTGQDANPKTIRVVQLGDDMTSIVGTPQLIDAPYVFEDSGINKIGNTYIYSYCTNWANGPYGSANIAYMTSSSPMGPFKMQKSCFKNPGEYFGNYGNNHHTMIEFKGKNYIFYHTEWLNKEVFGTQKGYRTSHVDE

SEQ ID NO: 11556 - protein, 299 aa, Piromyces finnis
  GLYCOSYL HYDROLASE 43 FAMILY MEMBER
NPVNTLKFSADPGVMVYDGRVYVYATDDGHVDQLGNNPETNTYGQINTINVMSSDDLVNWIDHGSIPAAGRNGAAKWANNSWAPTAAHKKINGKEKFFLYFANSGNGVGVLSSDSPTGPFVDPIGGPLVSFDVPNCGDIVWLFDPAVFVDDDGKGYLYFGGGVPTGQDANPKTIRVVQLGDDMTSIVGTPQLIDAPYVFEDSGINKIGNTYIYSYCTNWDNGPYGNARIAYMTSNSPMGPFSYKGTCFNNPGDFFQTTGNNHHTIIEFKNKYYIFYHTEWLNKQVFGSQKGYRTTHVNE

SEQ ID NO: 11557 - protein, 591 aa, Piromyces finnis; identical to SEQ ID NO: 11551
  GLYCOSYL HYDROLASE 43 FAMILY MEMBER

SEQ ID NO: 11558 - protein, 477 aa, Piromyces finnis
  GLYCOSYL HYDROLASE 43 FAMILY MEMBER
NPLSTLKYSADPGVMVYDGRVYVYGTNDGHADELGDNPEDNTYQQINTINVMSSDDLINWVDHGSIPAAGENGAAKWAVNSWAPAAAHKKINGKEKFFLYFANSGNGVGVLSSDSPTGPFVDPIGGPLVSFDVPNCGDIVWLFDPAVFVDDDGTGYLYFGGGVPEGQASDPRTTRAAKLGDDMISIDGIPQTIEAPWVFEDSGINKVGDSYVYSYCVNWDNGPYGNAKIAYMTSENPLGPFTFQGTLLNNPGDFFGTTGNNHHTIIEFKGKWYIFYHAEWLNVQVYGSQKGYRTTHVDELPFFNGNFRNATGTLAGVEQLSNVDAYSTNYASMMAWQAGVSVYGLGHTTVTYRKGTWTGVSGVEFGDNATSVKISAASANGATIRITSGSENGEVIGYVTVPATGDEFVTVTADVSVSGVKDIFFVASDEVVVDTWQFVADEAISSADEEIEVDGDDEINVGEVDSADEEIDSADEE

SEQ ID NO: 11559 - protein, 477 aa, Piromyces finnis
  GLYCOSYL HYDROLASE 43 FAMILY MEMBER
NPLITHRYSADPGVMVYDGRVYVYGTNDGHADELGDNPEDNTYQQINTINVMSSDDLINWVDHGSIPAAGENGAAKWAVNSWAPAAAHKKINGKEKFFLYFANSGNGIGVLSSDSPTGPFTDPLGGPIISRSLPNCNNIVWLFDPAVFVDDDGTGYIYFGGGVPEGQSSNPKTVRAAKLSDDMIRISGTPQTIDAPWVFEDSGIHKYGDTYFYSYCTNWDNGPYGNAKIAYMTSKSPLGPFTYQGTLFNNPGEFFGTTGNNHHTIIEFKGKWYIFYHAEWLNVQVYGSQKGYRTTHVDELPFFNGNFRNATGTLAGVEQLSNVDAYSTNYASMMAWQAGVSVYGLGHTTVTYRKGTWTGVSGVEFGDNATSVKISAASANGATIRITSGSENGEVIGYVTVPATGDEFVTVTADVSVSGVKDIFFVASDEVVVDTWQFVADEAISSADEEIEVDGDDEINVGEVDSADEEIDSADEE

SEQ ID NO: 11560 - protein, 299 aa, Piromyces finnis; identical to SEQ ID NO: 11556
  GLYCOSYL HYDROLASE 43 FAMILY MEMBER

SEQ ID NO: 11561 - protein, 96 aa, Neocallimastix californiae
  Glycosyl hydrolase domain
RYIRPGYTIIGCYNNSVAAYDSVGKKLVIVATNTANTTKTVDFNLSEFTSVGYNIRVIRTSGSVSNGEKWAELKPLIPYGKGFNADLKGNSITTFI

SEQ ID NO: 11562 - protein, 96 aa, Anaeromyces robustus
  Glycosyl hydrolase domain
RYIRPGYTIIGSYNNSVAAYDNEGKKLVIVATNTAGSNKIVDFDLSTFTSVGYNVRVIRTSGSMSNGEHWAELTPLIPYGKGFNAELKANSITTFI

SEQ ID NO: 11563 - protein, 247 aa, Neocallimastix californiae; identical to SEQ ID NO: 1061
  GLYCOSYL HYDROLASE-RELATED

SEQ ID NO: 11564 - protein, 553 aa, Anaeromyces robustus; identical to SEQ ID NO: 1062
  GLYCOSYL HYDROLASE-RELATED

SEQ ID NO: 11565 - protein, 366 aa, Neocallimastix californiae
  Glycosyl hydrolases family 6, cellulases
TISGNPFSGVEFYINPYYVEEVDGAIAQMSDSSLIAKAEKMKTYSNAIWLDTIKNMQSWLESNLQGAQSQHQSSGKDVLTVFVVYDLPGRDCHALASNGELLANDGDFTRYKSEYIDVIEGHLKTYKSQPVVLIVEPDSLANMVTNLDSTPACRDSEKYYMDGHAYLIKKFGVLPHVAMYLDIGHAFWLGWDDNREKAGKVYAKVISSGAPGKVRGFTDNVANYTPWEDPTLSRGPETEWNPCPDEKRYLQAIQKDFKSAGIQSVYFVCDTSRNGKKVDRKHPGEWCNQTGVGIGARPQASPVSGMEYLDAFYWIKPLGESDGTSDESAARFDGYCGHETAMKPAPEAGQWFQKHFEQGIKNANPP

SEQ ID NO: 11566 - protein, 351 aa, Neocallimastix californiae
  Glycosyl hydrolases family 6, cellulases
EEFYVFPDYQKQVKSSYDKLMAEGETEIAELVAKVARYPTPTWLANTAASKLVPKVLAQVTEQMKKTGKKVLTSFIIYNLPNRDCSAVASRGELGIEHLGVYKEWIDEIAGYFAAHEGPIVAIIEPDALGNMVSNSNSELCAEAFETQMEALVYAITKLNLPNVGVYQDVAQVGWLGWGGNMNLLIPILEQLLNKVGTGVLRGFSSNISNNQPLVRPDPPERTLSGNSSQSEYEYSLKVRENLKKVGMVDFGWVVDTSRNGVPNIKTKGENWCNIKGAGIGRRPEASPADLPGLDAVYWFKPPGESDGSDRVGQWGYDPSCASEDSLTDSPMAGQWFHKQFVELAVNANPS

SEQ ID NO: 11567 - protein, 107 aa, Neocallimastix californiae
  Glycosyl hydrolases family 6, cellulases
THNGNPFANKEFYINPYYVKEVEGAIAQMSDSSLIAKAEKMKTFSNAIWLDSIKNMQSWLESNLKGALAQQNASGKDVLTVFVVYDLPGRDCHALASNGELLANDGD

SEQ ID NO: 11568 - protein, 365 aa, Neocallimastix californiae
  Glycosyl hydrolases family 6, cellulases
THNGNPFSDVEFFINPYYTAEVDAAIAQMSDSSLIAKAEKMKTYSNAIWLDTIKNMNEWLEKNLKGALAQQSGSKKVLTVFVVYDLPGRDCHALASNGELLANDGDLARYKSEYIDVIEGHLKTYKSQPVVLIVEPDSLANLVTNLESTPACADSEKYYLDGHAYLIQKFGILPHVAMYLDIGHAFWLGWDDNREKAAKVYSKVISSGSPGKVRGFTDNVANYTPWEDPTLSRGPDTEWNPCPDEKRYLEAMHKDFKAAGISSVYFVCDTSRNGKKVDRKHPGEWCNQTGVGIGARPQASPVSGMEYLDAFYWIKPLGESDGTSDESAARFDGYCGHETAMKPAPEAGQWFQKHFEQGIKNANPP

SEQ ID NO: 11569 - protein, 327 aa, Neocallimastix californiae
  Glycosyl hydrolases family 6, cellulases
TISGNPFKGVEFYINPYYVEEVDGAIAQMSDSSLIAKAEKMKTYSNAIWLDTIKNMQSWLESNLQGAQSQHQSSGKDILTVFVVYDLPGRDCHALASNGELLANDGDLARYKSEYIDVIEGHLKTYKSQPVVLIVEPDSLANLVTNLESTPACADSEKYYLEGHAYLIKKLGVLPHVAMYLDIGHAFWLGWDDNREKAGKVYAKVISSGAPGNVRGFTDNVSNYTPWEDPTLSRGPETEWNPCPDEKRYLEAISKDFKSAGIKSVYFVSDSSRNGKKVDRKHPGEWCNQTGVGVGARPQASPISSMEYLDAFYWIKPLGESDGTSDD

SEQ ID NO: 11570 - protein, 328 aa, Neocallimastix californiae
  Glycosyl hydrolases family 6, cellulases
FFSTGNIYSNSQYQGEVQSSINKLSGELQQQANRVKYTPTAVWLAWDGAPGEVPKHLGAAGGNTAVFMMYWIPTRDCNSNASQGGASDLNSYKNYVDSVYNSFRSYGNSKIVVVVEPDTLGNMVTSQGNENCRRTAVIHKQALAYAINKFGSLNNVQVYLDAGHSQWLTGYEDETAEIIKEILDMAPQGKIRGFSTNVSNFQPVQREYEYHTRLYDALEKVGVKNMRFIVDTSRNGVDISEEFAKTKTWCNFVGTGFGERPKGNPDPVNMPLLDAYMWLKPPAESDGSSTGARADPVCARSDSLPGAPDAGQWFHEYFVQLLKNANPK

SEQ ID NO: 11571 - protein, 366 aa, Neocallimastix californiae
  Glycosyl hydrolases family 6, cellulases
TINGNPFANVEFYINPYYVEEVDNAISQMSDSSLIAKAEKMKTYSNAIWLDNIKNMQSWLQPNLEGALSQQNSGGTPVLTVFVVYDLPGRDCHALASNGELLANDSDMERYKSEYIDVIEGHLKTYKSQPVVLVIEPDSLANMVTNIESTPACADSQNYYFDGHAYLLKKLGVFPNVALYLDIGHAFWLGWDDNREKAAKVYAKVIQSGAPAKVRGFVDNVANYTPWEDPTLSRGPDTEWNPCPDEKRYLEAMHKDFTSAGIQSVYFFSDSSRNGKKTDRKHPGEWCNQTGCGIGARPKASPISGMEYLDAFYWVKPIGESDGTSDTSAKRYDGYCGHETAMKPAPEAGQWFQKFFEEGLKNANPP

SEQ ID NO: 11572 - protein, 206 aa, Neocallimastix californiae
  Glycosyl hydrolases family 6, cellulases
TISGNPFKGVEFYINPYYVDEVDGAIAQMSDSSLIAKAEKMKTYSNAIWLDTIKNMQSWLESNLKGALAEHNSTGKDILTVFVVYDLPGRDCHALASNGELLANSGDMERYKSEYIDVIEGHLKEYNSQPVVLIVEPDSLANLVTNLESTPACRDSEKYYLDGHAYLIQKLGVLPHVAMYLDIGHAFWLGWDDNREKAGKVYAKVI

SEQ ID NO: 11573 - protein, 294 aa, Neocallimastix californiae
  Glycosyl hydrolases family 6, cellulases
TINGNPFKGVEFYINPYYVDEVNGAIAQMSDSSLIAKAEKMKTYSNAIWLDTIKNMQSWLESNLEGALSQQESTGKKVLTVFVVYDLPGRDCHALASNGELLANSGDMERYKTEYIDVIEGHLKKYKSQPVVLIVEPDSLANMVTNIETTPACADSQNYYYDGHAYLLKKFGVLPHVAMYLDIGHAFWLGWDDNREKAGKVYAKVIQSGSPGKVRGFTDNVSNYTPWEDPTLSRGPETEWNPCPDEKRYLEAMHKDFKAAGIESVYFVSDTSRNGHKTDRKHPGEWCNQTGVGI

SEQ ID NO: 11574 - protein, 39 aa, Neocallimastix californiae
  Glycosyl hydrolases family 6, cellulases
TINGNPFKGVEFYINPYYVDEVNGAIAQMSDSSLIAKAE

SEQ ID NO: 11575 - protein, 147 aa, Neocallimastix californiae
  Glycosyl hydrolases family 6, cellulases
TISGNPFKGVEFYINPYYVEEVDGAIAQMSDSSLIAKAEKMKTYSNAIWLDTIKNMQSWLESNLQGAQSQHQSSGKDILTVFVVYDLPGRDCHALASNGELLANDGDLARYKSEYIDVIEGHLKTYKSQPVVLIVEPDSLANLVTNL

SEQ ID NO: 11576 - protein, 318 aa, Neocallimastix californiae
  Glycosyl hydrolases family 6, cellulases
TENFFDNELYISPNYVKEIESTIPDLSPELQAKAKNVEKVSSAVWLAYEGAPNDVAPHLKAAGSKTVTFILYMIPTRDCNSLASAGGVSDLDKYKGYVDKIANTIKKFPESKVVMVIEPDTLGNLITGETEACKNVHTLHKQALAYAANVFGNMSNVSAYLDAAHSKWLGWAADKVAAVVKEILDNAPNANIRGFSTNVSNYMPIEAEYEYHQKLHDALEEVGIKDKRFIVDTGRSGVDVREEFDVNQTWCNLIYAGLGEPSRGSPDPENMPLLDAFMWLKPPGEADGSDTGSRADPVCGREDSFPGSPDAGSWFGEY

SEQ ID NO: 11577 - protein, 98 aa, Neocallimastix californiae
  Glycosyl hydrolases family 6, cellulases
TISGNPFKGVEFYINPYYVEEVDGAIAQMSDSSLIAKAEKMKTYSNAIWLDTIKNMQSWLESNLQGAQSQHQSSGKDILTVFVVYDLPGRDCHALASN

SEQ ID NO: 11578 - protein, 41 aa, Neocallimastix californiae
  Glycosyl hydrolases family 6, cellulases
TINGNPFKGVEFYINPYYVDEVNGAIAQMSDSSLIAKAEKM

SEQ ID NO: 11579 - protein, 366 aa, Neocallimastix californiae
  Glycosyl hydrolases family 6, cellulases
TIEGNPFANVEFYINPYYVEEVDNAISQMSDSSLIAKAEKMKTYSNAIWLDNIKNMQSWLEPNLKGALSQQNSGGTPVLTVFVVYDLPGRDCHALASNGELLANDSDMERYKSEYIDVIEGHLKTYKSQPVVLVIEPDSLANMVTNIESTPACADSQTYYYDGHAYLLKKLGVFPNVALYLDIGHAFWLGWDDNREKAAKVYSKVIQSGSPAKVRGFVDNVANYTPWEDPTLSRGPDTEWNPCPDEKRYLEAMHKDFKAAGIQSVYFFSDSSRNGKKTDRKHPGEWCNQTGCGVGARPKASPISGMEYLDAFYWVKPIGESDGTSDTSAKRYDGYCGHETAMKPAPEAGQWFQKFFEEGIKNANPP

SEQ ID NO: 11580 - protein, 86 aa, Neocallimastix californiae
  Glycosyl hydrolases family 6, cellulases
THNGNPFANKDFYINPYYVEEIEGAIAQMSDSSLIAKAEKMKTYSNAIWLDSIKNMQSWLETNLKGALSQQNASGKDVLTVFVVYD

SEQ ID NO: 11581 - protein, 359 aa, Neocallimastix californiae
  Glycosyl hydrolases family 6, cellulases
SGNPFKDAEFYINPYYTTEVDAAITKISNASLIAKAEKMKEFSNAIWLDSIKNMNELLESSLNGALAQQESGYKKVLTVFVVYNLPGRDCHALASNGELLANDADFDRYKSEYIDVIEGHLKTYKSQPVVLIVEPNSLTNLVTNLESTPACSDSEKYYREGNAYLIKKFGVLPHVALYLDIGHAYLLGWDDTREKAARLYHDVIRSGAPGNIRGFADNIGGFVPWDDPNLSNGPETEWNPCPDEKRYLKAMYSDFVSAGIHSVKFVTDTSHNGKKFDYSDRELWCKSTSAGVGARPMAIPITTIDYLDAFYWIKPFGNVSELPNQSSFDNVCKDGLEIYSSDTWSQKVFEEGIRNANPP

SEQ ID NO: 11582 - protein, 350 aa, Neocallimastix californiae
  Glycosyl hydrolases family 6, cellulases
DFFVFPDYQKQVKSSYDKLIAEGETEVAEIVAKVARYPTPTWLANTAASKLVPKVLAQVTEQMKQTGKKILTSFIIYNLPNRDCSAVASRGELGTEHLGVYKEWIDEIAGYFAAHEGPIVAIIEPDALGNMVGNSNSELCAEAFETQMEALVYAITKLNLPNVSVYQDVAQVGWLGWGGNMRLLIPILEQLLNKVGTGVLRGFSSNISNNQPLTKPDPPEKTLSGCTSQSEYEYSLNVREALRKVGMVDFGWVVDTSRNGVPNIKTKGENWCNIKGAGIGRRPEATPEDLPGLDAVYWFKPPGESDGSDREGQFGYDPMCASEDSLTDSPRAGQWFHKQFVELAVNANPS

SEQ ID NO: 11583 - protein, 331 aa, Neocallimastix californiae
  Glycosyl hydrolases family 6, cellulases
PIGDNFFENELYSNFKFQGEVDSSIKKLSGNVKQKAEKVKYVPTAAWLAWEGAPNEVPQYLDEAGSKTVVFVLYMIPTRDCNANASAGGTANIDKYKSYVDKIYNTINKYPNSRIVMILEPDTIGNLVTANNANCRNVQNMHKQALSYAISKFGTQSNVRVYLDAAHGAWLNPHADKTAQVIKEILNNAGNGKLRGISTNVSNYQSVASEYKYHQNLNRALENLGVRGLKFIVDTSRNGANVEGAFNASGTWCNFKGAGLGERPKGNPNPGSMPLLDAYMWIKTPGEADGSSQGSRADPVCARGDSLQGAPDAGSWFHDYFVMLINNANPP

SEQ ID NO: 11584 - protein, 327 aa, Neocallimastix californiae
  Glycosyl hydrolases family 6, cellulases
FSSGNIYSNSQYQSEVQSSINKLSGELQQQASRVKYTPTAVWLAWYGAPNEVPKHLGAAGGNTAVFIMYWIPTRDCNSNASQGGASDLNSYKNYVDSVYNTFRSNGNSRIVIVIEPDTIGNIVTSQGNENCRRTAIIHKEALAYAVNKFGSLNNVQVYLDAGHSQWLTGYEDETAAIIKEILDMAPQGKIRGFSTNISNFQPVQREYEYHTRLYDALEKVGISNMRFIVDTSRNGVDISEAFAKTKTWCNFVGTGFGERPKGNPDPINMPLLDAYMWLKPPAESDGSSQGMRADPVCARPDSLPGAPEAGQWFHDYFVQLLRNANPK

SEQ ID NO: 11585 - protein, 366 aa, Neocallimastix californiae
  Glycosyl hydrolases family 6, cellulases
TLNGNPFANKIFYINPYYVEEVDGAIAQMIDASLISKAEKMKTFSNAIWLDTIKNMQSWLEPNLKGALAQQKSAGKEVLTVFVVYDLPGRDCHALASNGELLANKGDWARYKSEYIDVIEEKLRTYKSQPVVLIVEPDSLANMVTNLDSTPACRDSERYYMDGHAYLIQKFGVLPHVAMYLDIGHAFWLGWDDNRQKAGKVYSKVIQSGAPGKVRGFTDNVANYTPWEDPTLSRGPETEWNPCPDEKRYLEAIHKDFTAVGIPSVYFVCDTSRNGKKVDRKHPGEWCNQTGVGIGARPQASPISGMPYLDAFYWIKPLGESDGTSDTSAARFDGYCGHETAMKPAPEAGQWFQKHFEQGLKNANPP

SEQ ID NO: 11586 - protein, 365 aa, Neocallimastix californiae
  Glycosyl hydrolases family 6, cellulases
GNPFAGHKFYVNPYYVDKVDKAIAQMHDYDSSLKFKAEKMKEYSNAIWLDTINNMEAWLERNLKGALAQQNAEGSRVLTVFVVYDLPGRDCQALASNGELLANNGDMKRYKSEYIDIIDRRLSTYKSQPIVLVIEPNSLANLVTNLENIPACADSEKYYLDGHAYLIKKFGSHPHVAMYLDIGHAFWLGWDDKRASAAKIYSKVINPGAPGKVRGFASNVANYTPWEDPELSRGPDTEWNPCPDEKRYIKAMYKEFKAAGISSVYFIEDTSRNGHKTYRNHSGEWCNQMGSGIGARPKAYPVSGMEYLDAFYWVKPYGESDGTSDESDKSFDGYCGHATAMKPAPEAGQWFQKFFEEGLMNANPP

SEQ ID NO: 11587 - protein, 365 aa, Neocallimastix californiae
  Glycosyl hydrolases family 6, cellulases
KINGNPFKGVDFYLNPYYVEEVENALNNLIDSSLRSKVEKMKTFSNAIWLDTINNMQSWLEPNLKGALAQHQSTGKDVLTVFVVYDLPGRDCHALASNGELLANDADAQRYKTEYIDVIESHLKQYTAQPVVLIIEPDSLANMVTNLDDPHCSQSESYYMDGHAYLLKKFGVLDHVAMYLDIGHAFWLGWDDNREKAAKLYKKVIDSASPGKVRGFVDNVANYTPWEDPTLSRGPDTDWNPCPDEKRYLEAVKKDFTSAGIKSVYFVSDTSRNGHKTDRKHPGEWCNQTGVGVGARPQASPVSGMDYLDAFYWIKPLGESDGTSDESAVRFDGYCGHDTAMKPAPEAGQWFQAHFEQGVENANPP

SEQ ID NO: 11588 - protein, 366 aa, Neocallimastix californiae
  Glycosyl hydrolases family 6, cellulases
KISGNPFKGVDFYLNPYYVEEVENAIKQMTSSSLKAKAEKMKTYSNAIWLDNIKNMQSWLEPNLKGALAQHQSTGKDVLTVFVVYDLPGRDCHAMASNGELLANDSDAQRYKTEYIDVIESHLKKYTAQPVVLIIEPDSLANMVTNIENTPACAESETYYYDGHAYLLKKFGVLDHVAMYLDIGHAFWLGWDDNREKATKVYKKVIDSGSPGKVRGFVDNVANYTPWEDPTLSRGPDTEWNPCPDEKRYLEAMYKDFTSAGIKSVYFVSDSSRNGHKTDRKHPGEWCNQTGVGIGARPQASPISGMDYLDAFYWIKPLGESDGTSDESADRFDGYCGHDTAMKPAPEAGQWFQKHFEQGLENANPP

SEQ ID NO: 11589 - protein, 366 aa, Neocallimastix californiae
  Glycosyl hydrolases family 6, cellulases
KISGNPFSGVEFYLNPYYVEEVENAIKQMTSSSLKAKAEKMKTYSNAIWLDNIKNMQSWLEPNLKGALSQHQSTGKDVLTVFVVYDLPGRDCHALASNGELLANDSDAQRYKTEYIDVIEKQLKQYTAQPVVLIIEPDSLANMVTNIETTPACAESQDYYFDGHAYLLKKFGVLDHVAMYLDIGHAFWLGWDDNREKASKVYKKVIDSGSPGKVRGFVDNVANYTPWEDPTLSRGPETEWNPCPDEKRYLQAMYKDFTAAGIKSVYFVSDSSRNGHKTDRKHPGEWCNQTGVGIGARPQASPISGMSYLDAFYWIKPLGESDGTSDESAARFDGYCGHDTAMKPAPEAGQWFQKHFEQGLENANPP

SEQ ID NO: 11590 - protein, 361 aa, Neocallimastix californiae
  Glycosyl hydrolases family 6, cellulases
SHNGNPFKDVEFFINPYYTAEVDAAIAQMSDSSLISKAEKMKTFSNAIWLDTIKNMNEWLEKNLKGALAQQTGNKKVLTVFVVYDLPGRDCHALASNGELLANDSDWARYKTEYIDVIEEKLKTYKSQPVVLIIEPDSLANLVTNLDSTPACRDSEKYYLDGHAYLIQKFGVLKHVAMYLDIGHAFWLGWDDNREKAAKVYSKVISSGAPGEVRGFTDNVANYTPWEDPTLSRGPDTEWNPCPDEKRYLEAIHKDFVSAGIKSVYFVSDTSRNGKKVDRKHPGEWCNQTGVGVGARPQANPVSGMDYLDAFYWIKPLGESDGTSDESAARFDGYCGHETAMKPAPEAGQWFQKHFEQGIKN

SEQ ID NO: 11591 - protein, 365 aa, Neocallimastix californiae
  Glycosyl hydrolases family 6, cellulases
SHNGNPFKDVEFFINPYYTAEVDAAIAQMSDSSLISKAEKMKTFSNAIWLDTIKNMNEWLEKNLKGALAQQTGNKKVLTVFVVYDLPGRDCHALASNGELLANDSDWARYKTEYIDVIEEKLKTYKSQPVVLIIEPDSLANLVTNLDSTPACRDSEKYYLDGHAYLIQKFGVLKHVAMYLDIGHAFWLGWDDNREKAAKVYSKVISSGAPGEVRGFTDNVANYTPWEDPTLSRGPDTEWNPCPDEKRYLEAIHKDFVSAGIKSVYFVSDTSRNGKKVDRKHPGEWCNQTGVGVGARPQANPVSGMDYLDAFYWIKPLGESDGTSDESAARFDGYCGHETAMKPAPEAGQWFQKHFEQGIKNANPP

SEQ ID NO: 11592 - protein, 366 aa, Neocallimastix californiae
  Glycosyl hydrolases family 6, cellulases
THNGNPFANKIFYINPYYVEEVDGAIAQMSDSSLISKAEKMKTYSNAIWLDSIKNMQSWLESNLKGALSQQNASGQDVLTVFVVYDLPGRDCHALASNGELLANDSDWARYKTEYIDVIEGHLKTYKSQPVVLIIEPDSLANMVTNLDSTPACRDSEKYYMDGHAYLIQKFGVLPHVAMYLDIGHAFWLGWDDNRQKAGKVYSKVISSGAPGKVRGFTDNVANYTPWEDPTLSRGPETEWNPCPDEKRYLEAMYKDFKAAGIESVYFVCDSSRNGKKVDRKHPGEWCNQTGAGVGYRPQANPISGMSYLDAFYWIKPLGESDGTSDESAARFDGYCGHETAMKPAPEAGQWFQKFFEEGLKNANPA

SEQ ID NO: 11593 - protein, 327 aa, Neocallimastix californiae
  Glycosyl hydrolases family 6, cellulases
TSDNFFENELYSNFKFQGEVDTSIAKLSGQLQEKAKKVKYVPTAAWLAWEGATNEVPQYLNEAGDKTVVFVLYMIPTRDCNANASVGGSGSLDKYKGYVDNIYNTINRYPNSRIVMILEPDTIGNLVTANNDNCRNVQNMHKQALSYAISKFGTQSNVRVYLDAAHGAWLNSHADRTAQVIAEILRNAGNGKIRGISTNISNYQQVSDEYQYHQNLNRALESQGFRGMKFIVDTSRNGQNVTAAFSRNNTWCNFKGAGLGPRPQANPNPNMPLLDAYMWIKTPGEADGSATGSRADPVCARQDSLQGAPDAGSWFHDYFVMLLQNAN

SEQ ID NO: 11594 - protein, 306 aa, Neocallimastix californiae
  Glycosyl hydrolases family 6, cellulases
NFFENELYINQDYVKKIESTLKDMTPELQAKAKNVEKVATAVWLAWEGAPGEVEPHLKAAGNKTITFILYMIPTRDCNSLASAGGAADFEKYQGYVDSIAATIKKYPDAKVNMVIEPDTLGNLITGETEACKKVHDLHRKALSYAVNVFGNMSNVNAYLDAAHHKWLGWGTDKVAALIKDILDNAPDGDIRGISTNVSNYQSIDNEYQYHTDLHAALEAVGITGKKFIVDTGRSGVDVTEEFNVNQTWCNLIYAGLGEKSRGNPDPEKYPLLDAFMWLKPPAESDGSDVGSRADPVCAREDSFPGA

SEQ ID NO: 11595 - protein, 352 aa, Neocallimastix californiae
  Glycosyl hydrolases family 6, cellulases
ADDFYVFPDYQKQVKSSYDQLIAEGQNDVAEIVAKVARYPTPTWLANTQASKLVPKVLAQVTEQMKATGKKILTAFIIYNLPNRDCSAVASRGELGIEHLGVYKEWIDEIAGYFKAHEGPIVAIIEPDALGNMVSNSNSELCAEAFDTQMEAIVYAINKLSLPNVSVYQDVAQVGWLGWTGNMNILVPILEQILNKVGTGKLRGFSSNISNNQPLVKPDPPEATLSGNKSQSEYEYSLNVREALRKVGIADMGWVVDTSRNGRTNIKTRGENWCNIKGAGIGRRPEANPADLPELDAVYWFKPPGESDGSDRKGQWGYDPSCASEDSLTDSPMAGQWFHKQFVELAVNAVPS

SEQ ID NO: 11596 - protein, 156 aa, Neocallimastix californiae
  Glycosyl hydrolases family 6, cellulases
GNPFAGHKFYINPYYVDEVDKAIAQMNGSLRIKAEKLKEYSNAIWLDTIHKMEVRLERNLRGALAQQNAEGSRVLTVFVVYDLPGRDCQALASNGELLANDGDMKRYKTEYIDIIDSVLISYHSQPIVLVIEPNSLANLVTNLENIPACADSEKYY

SEQ ID NO: 11597 - protein, 114 aa, Anaeromyces robustus
  Glycosyl hydrolases family 6, cellulases
KISGNPFSGVEFYLNPYYVEEVENAIKQMTSSSLKAKAEKMKTYSNAIWLDNIKNMQSWLEPNLKGALSQHQSTGKDVLTVFVVYDLPGRDCHALASNGELLANDSDAQRYKTE

SEQ ID NO: 11598 - protein, 366 aa, Anaeromyces robustus
  Glycosyl hydrolases family 6, cellulases
RHNGNPFKGVEFFINPYYVDEVDKAIAQMTNSSLKAKAEKMKTFSNAIWLDTIKNMNEWLERNLKGALAQQNASNKNVLTVFVVYDLPGRDCHALASNGELLANDSDFARYKSEYIDVIETHLKKYTAQPVVLIIEPDSLANMVTNIENTPACAESETYYYDGHAYLLKKFGVLDHVAMYLDIGHAFWLGWDDNREKATKVYKKVIDSGSPGKVRGFVDNVANYTPWEDPTLSRGPDTEWNPCPDEKRYLEAMYKDFTSAGIKSVYFVSDSSRNGHKTDRKHPGEWCNQTGVGIGARPQASPISGMSYLDAFYWIKPLGESDGTSDESAARFDGYCGHDTAMKPAPEAGQWFQKHFEQGLENANPP

SEQ ID NO: 11599 - protein, 316 aa, Anaeromyces robustus
  Glycosyl hydrolases family 6, cellulases
TSDNFFENELYSNFKFQGEVDTSIAKLSGQLQEKAKKVKYVPTAAWLAWEGATNEVPQYLNEAGDKTVVFVLYMIPTRDCNANASVGGSGSLDKYKGYVDNIYNTINRYPNSRIVMILEPDTIGNLVTANNDNCRNVQNMHKQALSYAISKFGTQSNVRVYLDAAHGAWLNSHADRTAQVIAEILRNAGNGKIRGISTNISNYQQVSDEYQYHQNLNRALESQGFRGMKFIVDTSRNGQNVTAAFSRNNTWCNFKGAGLGPRPQANPNPNMPLLDAYMWIKTPGEADGSATGSRADPVCARQDSLQGAPDAGSWFH

SEQ ID NO: 11600 - protein, 99 aa, Anaeromyces robustus
  Glycosyl hydrolases family 6, cellulases
KINGNPFKGVDFYLNPYYVEEVENALNNLIDSSLRSKVEKMKTFSNAIWLDTINNMQSWLEPNLKGALAQHQSTGKDVLTVFVVYDLPGRDCHALASNG

SEQ ID NO: 11601 - protein, 352 aa, Anaeromyces robustus; identical to SEQ ID NO: 11595
  Glycosyl hydrolases family 6, cellulases

SEQ ID NO: 11602 - protein, 218 aa, Anaeromyces robustus
  Glycosyl hydrolases family 6, cellulases
SNSENFFDNELYINQDYVKKIESSLKSMSPELQAKAKNVEKVATAVWLAWEGAPGEVAPHLKAAGNKTITFILYMIPTRDCNSLASAGGAADFEKYQGYVDSIAATIKKYPNAKVNMVIEPDTLGNLITGETEACKKVHDLHRKALSYAVNVFGNMSNVNAYLDAAHHKWLGWGTDKVAALIKDILDNAPDGDIRGISTNVSNYQSIENEYQYHSDLH

SEQ ID NO: 11603 - protein, 323 aa, Anaeromyces robustus
  Glycosyl hydrolases family 6, cellulases
NFFENELYINQDYVKKIESTLKDMTPELQAKAKNVEKVATAVWLAWEGAPGEVEPHLKAAGNKTITFILYMIPTRDCNSLASAGGAADFEKYQGYVDSIAATIKKYPDAKVNMVIEPDTLGNLITGETEACKKVHDLHRKALSYAVNVFGNMSNVNAYLDAAHHKWLGWGTDKVAALIKDILDNAPDGDIRGISTNVSNYQSIDNEYQYHTDLHAALEAVGITGKKFIVDTGRSGVDVTEEFNVNQTWCNLIYAGLGEKSRGNPDPEKYPLLDAFMWLKPPAESDGSDVGSRADPVCAREDSFPGAPDAGSWFKEYFIAMLEK

SEQ ID NO: 11604 - protein, 250 aa, Anaeromyces robustus
  Glycosyl hydrolases family 6, cellulases
TISGNPFSGVEFYINPYYVEEVDNAIAQMTDSSLKAKAEKMKTYPNAIWLDNIKNMQSWLQPNLEKALAQQSGSKKVLTVFVVYDLPGRDCHAMASNGELLANDSDAQRYKTEYIDVIEEQLKKYKSQPIVLIIEPDSLANMVTNIETTPACAESQDYYFDGHAYLLKKFGVLQHVAMYLDIGHAFWLGWDDNREKAAKVYKKVIDSGSPGKVRGFVDNVANYTPWEDPTLSRGPDTEWNPCPDEKRYLE

SEQ ID NO: 11605 - protein, 331 aa, Anaeromyces robustus
  Glycosyl hydrolases family 6, cellulases
VNPSFFSGNIYSNYQYQSEVQSSINKLSGNLQQQANRVKYVPTAVWLAWDGAPKEVQRHLSSANGSTAVFIMYWIPTRDCNSNASQGGANDLNAYKSYVDDVANTFRSNQGSRIVIVVEPDTIGNMVTSQNNENCRRTAVIHKQALAYAVNRFGSLNNVQVYLDAGHSQWLTGYEDETAAVIKEILDMANQGKIRGFSTNVSNFQPIDKEYEYQTRLYDALENVGITDMRFVIDTSRNGQDISEAFAKTKTWCNLVGTGFGERPKGNPDPINMPLLDAYMWLKPPAESDGSSQGMRADPVCARSDSLPNAPEAGSWFHDYFVQLLRNANPP

SEQ ID NO: 11606 - protein, 351 aa, Anaeromyces robustus
  Glycosyl hydrolases family 6, cellulases
EEFYVFPNYQKQVKSSYDQLIAEGEPEIAEIVAKVAKYPTPTWLTNTDAAKLVPQVLSQVTKQMKKTGKKILTSFIIYNLPNRDCSAVASRGELGIEHLGVYKEWIDEIAGYFKNHEGPIVAVVEPDAFGNMINSNDNELCKEAFDTQMEALVYAITHLNAPNVGVYLDLAQVGWLGWSGNMRFLIPLLEEVLNKVGTGILRGFTSNISNYQPLVKPEVPEVTLSGNPSQSEYEYSLNVREALKKIGMVDFGWVVDTSRNGVSNIKTKGESWCNIKGAGIGRRPEANPPDLPGLDAVYWFKPPGESDGSDRKGQWGYDPSCESVDSLTDSPMAGQWYHKQFVELAVNANPS

SEQ ID NO: 11607 - protein, 344 aa, Anaeromyces robustus
  Glycosyl hydrolases family 6, cellulases
NPFAESELYVDPNYQQELDNLSSTIKDPTVIEKVEKMKQYSTGIWLDSIQSVNELLESNLDNAYAQQVESGKNVLTTFVLYNLPGRDCHAITTNGELLAKDSDLERYKHEYIDVIEEIIKKHNNQPIAFVVEPTSLPSIATFKKSTPACADTEKYYLEGHSYLIKKLGVLPNVFLYLDVGHAFWLGWDDLREETAKLYAKVIQSGAPGIVRGFADNISNYVPWDDANLTNGPNTEYNPYPDSKRYIESLRKDFVSVGIKNVNFISDTSLTTINNGSSPVEDWCYNAPLGIGARPQANPVSDMSYLDAFVWIKPFYGDKPYDSLCLEERLNTKRLFEKSVKNANP

SEQ ID NO: 11608 - protein, 329 aa, Anaeromyces robustus
  Glycosyl hydrolases family 6, cellulases
DNFFNNKIYCNQDRKDRVQSSINRLSGELKAKAQKIQDAPTAIWLSWDKAPETVSFHLDEAGNQTAVFILYWIPTRDCNSIASQGGAQSMDEYHTYVNRIVNGFKSHPNSKIVVVVEPDTLGNMITSQSNDNCKKVHNLHKQAIAYAIDTFGQIDNVRTYIDAAHGRWLGSHADEAAAIIKEIIDMAPNSNVRGLSTNVSNYQPTEDEYAYHQKLSAELEKLGVHNMKFIVDTARNGVDVAESLVKTGTWCNVKGTGFGERPRGSPDPVNKPLLDAYMWLKPGGDSDGSSTGDHADPVCEHEDSLPGAGDPGDWFHEYFVQLLTNANPP

SEQ ID NO: 11609 - protein, 36 aa, Piromyces finnis
  Glycosyl hydrolases family 6, cellulases
GYDPVCASEDSLTDSPRAGQWFHKQIVELAVNANPS

SEQ ID NO: 11610 - protein, 170 aa, Piromyces finnis
  Glycosyl hydrolases family 6, cellulases
EEFYVFPDYQKQIKSSYDKLIAEGENEVAEIVAKVARYPTPTWLASTDSVKLVPKVLAQVTEQMKKTGKKVLTSFIIYNLPNRDCSAQASRGELGIEHLGKYKEWIDEIAGYFAAHEGPIVAIVEPDAMGNMVSHNDNPVCEEAFDTQMEALVSAITKLNMKNVGVYMDL

SEQ ID NO: 11611 - protein, 351 aa, Piromyces finnis
  Glycosyl hydrolases family 6, cellulases
EEFYVFPDYQKQIKSSYDKLIAEGENEVAEIVAKVARYPTPTWLASTDSVKLVPKVLAQVTEQMKKTGKKVLTSFIIYNLPNRDCSAQASRGELGIEHLGKYKEWIDEIAGYFAAHEGPIVAIVEPDAMGNMVSHNDNPVCEEAFDTQMEALVYAITKLNMKNVGVYMDLAQVGWLGWSGNMRFLIPILEQLLNKVGTGVLRGFSSNISNTQPLVRPETLDVTLAGNPSQSEYEYSLNVREELKKIGMVDFGWVVDTSRNGVSNIKTKGEYWCNIKGSGIGRRPEANPADLPGLDAVYWFKPPGESDGSDNKNIIGYDPVCASEDSLTDSPRAGQWFHKQIVELAVNANPS

SEQ ID NO: 11612 - protein, 351 aa, Piromyces finnis; identical to SEQ ID NO: 11611
  Glycosyl hydrolases family 6, cellulases

SEQ ID NO: 11613 - protein, 219 aa, Piromyces finnis
  Glycosyl hydrolases family 6, cellulases
PTENFFDNELYISPRYVEEIESSMPDMSDELKAKAKNVMNVSSAVWLAWEGAPNEVEGHLKAAGSKTITFILYMIPTRDCNSLASAGGASDLKKYQGIVDKIANTISKYPDVKVAMVIEPDTLGNLITGSTEACKNVHTLHKNALSYAANVFGNMSNVSAYLDAAHGKWLGWAADKTAAVIKEILDNAPNANIRGFSTNVSNYQSIEKEYAYHEALNAA

SEQ ID NO: 11614 - protein, 325 aa, Piromyces finnis
  Glycosyl hydrolases family 6, cellulases
SQNFFLNEIYANPRFIEEIDSSIPKLSGDLAAKAEKVKQVPTAVWLAWDGAPGEVEGHLAAAGSKTVVFILYMIPTRDCNSLASAGGASDLKKYQGIVDKIANTISKYPDVKVAMVIEPDTLGNLITGSTEACKNVHTLHKNALSYAANVFGNMSNVSAYLDAAHGKWLGWAADKTAAVIKEILDNAPNANIRGFSTNVSNYQSIEKEYAYHEALNAALEKLGITGKKFIVDTGRSGVDVTEEFDVNQTWCNFVYAGLGEPSRGSPDLEKMPLLDAYMWLKPPGEADGSDVGSRADPVCGREDSFPGSPDAGSWFSEYFISMLEK

SEQ ID NO: 11615 - protein, 326 aa, Piromyces finnis
  Glycosyl hydrolases family 6, cellulases
PTENFFDNELYISPRYVEEIESSMPDMSDELKAKANNVMNVSSAVWLAWEGAPNEVEGHLKAAGSKTITFILYMIPTRDCNSLASAGGASDLKKYQGIVDKIANTISKYPDVKVAMVIEPDTLGNLITGSTEACKNVHTLHKNALSYAANVFGNMSNVSAYLDAAHGKWLGWAADKTAAVIKEILDNAPNANIRGFSTNVSNYQSIEKEYAYHEALNAALEKLGITGKKFIVDTGRSGVDVTEEFDVNQTWCNFVYAGLGEPSRGSPDLEKMPLLDAYMWLKPPGEADGSDVGSRADPVCGREDSFPGSPDAGSWFSEYFISMLEK

SEQ ID NO: 11616 - protein, 326 aa, Piromyces finnis; identical to SEQ ID NO: 11615
  Glycosyl hydrolases family 6, cellulases

SEQ ID NO: 11617 - protein, 206 aa, Piromyces finnis
  Glycosyl hydrolases family 6, cellulases
EPDTLGNLVTGSSEACKTVHTLHKNALSYAVNVFGAMSNVSVYLDAAHGKWLGGVTDKVATVVKEILDGAPNGKIRGLSTNVSNYQPVSAEYGYHQKLASSLSAVGVSDMHFIVDTGRNGVDVSSTFSINETWCNFVGTGFGERPQGNPSGMPLLDAYMWLKPPGEADGSDVGSRADPVCGREDSFPGSPDAGSWFSEYFISMLEK

SEQ ID NO: 11618 - protein, 366 aa, Piromyces finnis
  Glycosyl hydrolases family 6, cellulases
THSGNPFKGHKFFINPYYTAEVDAAIAQMSNSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQAFFEEGLKNANPP

SEQ ID NO: 11619 - protein, 366 aa, Piromyces finnis
  Glycosyl hydrolases family 6, cellulases
THSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQKHFEQGLENANPP

SEQ ID NO: 11620 - protein, 366 aa, Piromyces finnis; identical to SEQ ID NO: 11618
  Glycosyl hydrolases family 6, cellulases

SEQ ID NO: 11621 - protein, 366 aa, Piromyces finnis; identical to SEQ ID NO: 11618
  Glycosyl hydrolases family 6, cellulases

SEQ ID NO: 11622 - protein, 366 aa, Piromyces finnis
  Glycosyl hydrolases family 6, cellulases
THSGNPFKGHKFFINPYYTAEVDAAIAQMSNSSLIAKAEKMKEYSNAIWLDTIENMNNWLERNLKTALAEQNQTGKTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQAFFEEGLKNANPP

SEQ ID NO: 11623 - protein, 366 aa, Piromyces finnis
  Glycosyl hydrolases family 6, cellulases
THSGNPFKGHKFFINPYYTAEVDAAIAQMSNSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQKHFEQGLENANPP

SEQ ID NO: 11624 - protein, 366 aa, Piromyces finnis
  Glycosyl hydrolases family 6, cellulases
THSGNPFKGHKFFINPYYTAEVDAAIAQMSNSSLIAKAEKMKEYSNAIWLDTIENMNNWLERNLKTALAEQNQTGKTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQKHFEQGLENANPP

SEQ ID NO: 11625 - protein, 366 aa, Piromyces finnis
  Glycosyl hydrolases family 6, cellulases
THSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQASPIAGMDYLDAFYWVKPYGESDGTSDESAKRYDGYCGHRTAMKPAPEAGQWFQAFFEEGLKNANPP

SEQ ID NO: 11626 - protein, 366 aa, Piromyces finnis; identical to SEQ ID NO: 11625
  Glycosyl hydrolases family 6, cellulases

SEQ ID NO: 11627 - protein, 366 aa, Piromyces finnis; identical to SEQ ID NO: 11625
  Glycosyl hydrolases family 6, cellulases

SEQ ID NO: 11628 - protein, 366 aa, Piromyces finnis; identical to SEQ ID NO: 11618
  Glycosyl hydrolases family 6, cellulases

SEQ ID NO: 11629 - protein, 366 aa, Piromyces finnis; identical to SEQ ID NO: 11619
  Glycosyl hydrolases family 6, cellulases

SEQ ID NO: 11630 - protein, 366 aa, Piromyces finnis; identical to SEQ ID NO: 11623
  Glycosyl hydrolases family 6, cellulases

SEQ ID NO: 11631 - protein, 366 aa, Piromyces finnis; identical to SEQ ID NO: 11623
  Glycosyl hydrolases family 6, cellulases

SEQ ID NO: 11632 - protein, 366 aa, Piromyces finnis; identical to SEQ ID NO: 11618
  Glycosyl hydrolases family 6, cellulases

SEQ ID NO: 11633 - protein, 366 aa, Piromyces finnis; identical to SEQ ID NO: 11625
  Glycosyl hydrolases family 6, cellulases

SEQ ID NO: 11634 - protein, 366 aa, Piromyces finnis; identical to SEQ ID NO: 11618
  Glycosyl hydrolases family 6, cellulases

SEQ ID NO: 11635 - protein, 366 aa, Piromyces finnis; identical to SEQ ID NO: 11622
  Glycosyl hydrolases family 6, cellulases

SEQ ID NO: 11636 - protein, 329 aa, Piromyces finnis
  Glycosyl hydrolases family 6, cellulases
TSDNFFDNTLYSNFKFQAEVQSSINKLSGSLAEKAKKVKYVPTAAWLAWEGAPAEVPQYLDEAGSNTVVFVLYMIPTRDCNANASAGGSSNIEKYKGYVDKIYNTINQYPNSRIVMILEPDTIGNLVTANNDNCRNVQNMHKQALSYAISKFGTQSNVRVYLDAAHGAWLSSHADKTAQVIKEILNNAGNGKLRGISTNVSNYQTVNDEYNYHMRLNSALENLGVRGMKFIVDTSRNGANISGAFNASGTWCNFKGAGLGARPQGSPDPSKPLLDAYMWIKTPGEADGSSSGSRADPVCARYDSLQGAPDAGSWFHDYFVMLVQNANPA

SEQ ID NO: 11637 - protein, 366 aa, Piromyces finnis
  Glycosyl hydrolases family 6, cellulases
THSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRYDGYCGHRTAMKPAPEAGQWFQAFFEEGLKNANPP

SEQ ID NO: 11638 - protein, 366 aa, Piromyces finnis
  Glycosyl hydrolases family 6, cellulases
THSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNIESTPACAKSEKYYYDGHAYLIKKFGVLPHVSMYLDIGHAFWLGWDDNREKAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRYDGYCGHRTAMKPAPEAGQWFQAFFEEGLKNANPP

SEQ ID NO: 11639 - protein, 366 aa, Piromyces finnis; identical to SEQ ID NO: 11637
  Glycosyl hydrolases family 6, cellulases

SEQ ID NO: 11640 - protein, 366 aa, Piromyces finnis; identical to SEQ ID NO: 11638
  Glycosyl hydrolases family 6, cellulases

SEQ ID NO: 11641 - protein, 366 aa, Piromyces finnis; identical to SEQ ID NO: 11638
  Glycosyl hydrolases family 6, cellulases

SEQ ID NO: 11642 - protein, 365 aa, Piromyces finnis
  Glycosyl hydrolases family 6, cellulases
THSGNPFKGHKFFINPYYTAEVDAAIAQMSDSSLIAKAEKMKEYSNAIWLDNIENMQNWLERNLKSALAEQNATGQTVLTVFVVYDLPGRDCHALASNGELLANDADAARYKSEYIDVIEEKLKTYISQPVVLIIEPDSLANMVTNISTTPACAASEKYYYDGHAYLIKKLGILPHIAMYLDIGHAFWLGWDDNRLGAGKVYSKVISSGSPGQVRGFASNVANYTPWEDPELSRGPDTEWNSCPDEKRYIEAMYKDFKSAGIKSVYFIEDTSRNGVKNDRFHPGEWCNQMGSGIGARPQANPIAGMDYLDAFYWVKPYGESDGTSDESAKRYDGYCGHRTAMKPAPEAGQWFQAFFEEGLKNANP

SEQ ID NO: 11643 - protein, 365 aa, Piromyces finnis; identical to SEQ ID NO: 11642
  Glycosyl hydrolases family 6, cellulases

SEQ ID NO: 11644 - protein, 366 aa, Piromyces finnis; identical to SEQ ID NO: 11637
  Glycosyl hydrolases family 6, cellulases

SEQ ID NO: 11645 - protein, 365 aa, Piromyces finnis; identical to SEQ ID NO: 11642
  Glycosyl hydrolases family 6, cellulases

SEQ ID NO: 11646 - protein, 366 aa, Piromyces finnis; identical to SEQ ID NO: 11637
  Glycosyl hydrolases family 6, cellulases

SEQ ID NO: 11647 - protein, 366 aa, Piromyces finnis; identical to SEQ ID NO: 11638
  Glycosyl hydrolases family 6, cellulases

SEQ ID NO: 11648 - protein, 365 aa, Piromyces finnis; identical to SEQ ID NO: 11642
  Glycosyl hydrolases family 6, cellulases

SEQ ID NO: 11649 - protein, 158 aa, Neocallimastix californiae
  GLYCOSYL TRANSFERASE-RELATED
SYVGIYGWMDNPQIEYYVVDDWLHNRGAPGGSYMGSQKGTINVDGGTYKVWTGTRTGASKWGQSTFTQIFSVRTQQRTCGQINISEHFRQWEKLGIRVGQLMEAQILAESGGGSGYVDFTYATVEIGSGSSSGNGGNGGNGGNGNQNPWGGQQNQGQG

SEQ ID NO: 11650 - protein, 62 aa, Neocallimastix californiae
  GLYCOSYL TRANSFERASE-RELATED
GDFTIDGAKYTVYENTRYGPSIDGDTTFKQFFSIRQQARDCGTIDITAHFEQWEKLGMKLGK

SEQ ID NO: 11651 - protein, 103 aa, Neocallimastix californiae
  GLYCOSYL TRANSFERASE-RELATED
GYSYVGVYGWTLESGISGVFEFYIVDNWLSQYRPGDWVGNQKKGDFTIDGAVYTVYKNVNGNLTQYFSLRREPRTCGTIDVTAHFDQWEKLGLKMGKISEIKV

SEQ ID NO: 11652 - protein, 99 aa, Neocallimastix californiae
  GLYCOSYL TRANSFERASE-RELATED
SYIGIYGWTRNPLVEFYVVDNWLSQYRPGDWVGNKKHGDFTIDGARYTVYENTRYGPSIDGNTNFKQYFSIRQTARDCGTIDITAHFQQWEKLGMTMGK

SEQ ID NO: 11653 - protein, 105 aa, Neocallimastix californiae
  GLYCOSYL TRANSFERASE-RELATED
KDPLVEFYVVDNWLSQWRPGDWVGNKKHGDYVIDGATYTVYENERYGPSIVGDTNFKQFFSIRKEARDCGTIDITAHFLQWEKLGMKLGKMYEAKVLGEAGSNSS

SEQ ID NO: 11654 - protein, 114 aa, Neocallimastix californiae
  GLYCOSYL TRANSFERASE-RELATED
SYVGIYGWTRNPLVEFYVVDNWLSQWRPGDWVGNKKHGDFTIDGAKYTVYENTRYGPSIDGDTNFKQFFSIRQTARDCGTIDITAHFEQWEKLGMKLGKMHEAKVLGEAGSTGS

SEQ ID NO: 11655 - protein, 100 aa, Neocallimastix californiae
  GLYCOSYL TRANSFERASE-RELATED
SYIGIYGWTREPLVEYYVVDNWLSQYRPGDWVGNKKYGDFEIDGAEYTVYENTRTGPSIDGDNVTFKQYFSIRKEARDCGTIDITAHFEKWEELDLVLGK

SEQ ID NO: 11656 - protein, 163 aa, Neocallimastix californiae
  GLYCOSYL TRANSFERASE-RELATED
SYIGIYGWMDNPQIEYYVVDDWLHNRGAPGGSWMGQQKGTINVDGGTYKVWSGQRTGASKWGQSTFTQIFSVRTSQRQCGQINISEHFRQWEKLGLRIGQVMEAQILAEAGGGSGYVDFTYATVEIGSGSSQGGNQGGNQGGNNNQGGNQGGNQGGNNQWNPW

SEQ ID NO: 11657 - protein, 100 aa, Neocallimastix californiae
  GLYCOSYL TRANSFERASE-RELATED
SYIGIYGWTREPLVEYYVVDNWLSQYRPGDWVGNKKYGDFEIDGAEYTVYENTRTGPSIDGDNVTFKQYFSIRKEARDCGTIDITAHFEKWEELGLTLGK

SEQ ID NO: 11658 - protein, 99 aa, Neocallimastix californiae
  GLYCOSYL TRANSFERASE-RELATED
GYNYIGIYGWTVDPLVEYYIVDDWYNKPGSYLGQKKGEFTVDGDTYEIFQNTRVNQPSIKGTSTFPQFFSVRRSARSCGHIDISAHFKKWESLGMKLGK

SEQ ID NO: 11659 - protein, 160 aa, Neocallimastix californiae
  GLYCOSYL TRANSFERASE-RELATED
SYIGVYGWSRDPLVEYYVVDNWLSQYRPGDWVGNKKHGDFTIDGAKYTVYENTRYGPSIDGDTQFKQYFSIRQQARDCGTIDITAHFQQWEKLGMKLGKMHEAKVLGEAGSNGSGTSGTADFPYAKVYIGSGGNTGGNSGGNSGGNTGGNSGGNTGGNSG

SEQ ID NO: 11660 - protein, 99 aa, Anaeromyces robustus; identical to SEQ ID NO: 11658
  GLYCOSYL TRANSFERASE-RELATED

SEQ ID NO: 11661 - protein, 99 aa, Anaeromyces robustus
  GLYCOSYL TRANSFERASE-RELATED
SYVGIYGWTRNPLVEFYVVDNWLSQWRPGDWVGNKKHGDFTIDGAKYTVYENTRYGPSIDGDTNFKQYFSIRQQPRDCGTIDITAHFQQWEKLGMTMGK

SEQ ID NO: 11662 - protein, 99 aa, Anaeromyces robustus
  GLYCOSYL TRANSFERASE-RELATED
SYVGIYGWTRNPLVEFYVVDNWLSQYRPGDWVGNKKHGDFTIDGAKYTVYENTRYGPSIDGNTNFKQYFSIRQQARDCGTIDITAHFEQWEKLGMTMGK

SEQ ID NO: 11663 - protein, 99 aa, Anaeromyces robustus
  GLYCOSYL TRANSFERASE-RELATED
SYVGIYGWTRNPLVEFYVVDNWLSQYRPGDWVGNKKHGEFTIDGAKYTVYENTRYGPSIDGDTSFKQYFSIRQQARDCGTIDITAHFEQWEKLGMTMGK

SEQ ID NO: 11664 - protein, 105 aa, Anaeromyces robustus
  GLYCOSYL TRANSFERASE-RELATED
SYVGIYGWTRNPLVEFYIVDNWLSPSRPGDWVGNRKHGDFTIDGAKYTVYENTRNGPSIDGNTNFKQYFSIRQQARDCGTIDINAHFEQWEKLGMQMGKMHEAKI

SEQ ID NO: 11665 - protein, 167 aa, Anaeromyces robustus; identical to SEQ ID NO: 6271
  GLYCOSYL TRANSFERASE-RELATED

SEQ ID NO: 11666 - protein, 165 aa, Piromyces finnis
  GLYCOSYL TRANSFERASE-RELATED
SYVGIYGWTRSPLVEFYVVDNWLSQWRPGDWVGNKKHGDFVIDGATYTVYENTRYGPSIDGDTQFKQYFSIRQQARDCGTIDITAHFQQWAKLGMNLGKMHEAKVLGEAGSTGSGTSGTADFPYAKVYIGDGNSGNSNSNTGNSFGGNTGNTQTGNNQSSNNQSN

SEQ ID NO: 11667 - protein, 165 aa, Piromyces finnis
  GLYCOSYL TRANSFERASE-RELATED
SYVGIYGWTRSPLVEFYVVDNWLSQWRPGDWVGNKKHGDFVIDGATYTVYENTRYGPSIDGDTQFKQYFSIRQQARDCGTIDITAHFQQWEKLGMKLGKMHEAKVLGEAGSTGSGTSGTADFPYAKVYIGDGNSGNSNSNTGNSFGGNTGNTQTGNNQSSNNQSN

SEQ ID NO: 11668 - protein, 165 aa, Piromyces finnis; identical to SEQ ID NO: 11667
  GLYCOSYL TRANSFERASE-RELATED

SEQ ID NO: 11669 - protein, 165 aa, Piromyces finnis
  GLYCOSYL TRANSFERASE-RELATED
SYVGIYGWTRNPLVEFYVVDNWLSQWRPGDWVGNKKHGDFTIDGAQYTVYENTRYGPSIDGDTQFKQYFSIRQQARDCGTIDITAHFQQWEKLGMKLGKMHEAKVLGEAGSTGSGTSGTADFPYAKVYIGDGNSGNSNSNTGNSFGGNTGNTQTGNNQSSNNQSN

SEQ ID NO: 11670 - protein, 10 aa, Neocallimastix californiae
  GLYCOSYL_HYDROL_F10
GLEVHITELD

SEQ ID NO: 11671 - protein, 10 aa, Neocallimastix californiae
  GLYCOSYL_HYDROL_F10
GVEVHITEID

SEQ ID NO: 11672 - protein, 10 aa, Neocallimastix californiae
  GLYCOSYL_HYDROL_F10
GLEVHITEID

SEQ ID NO: 11673 - protein, 10 aa, Neocallimastix californiae
  GLYCOSYL_HYDROL_F10
GVEVHITELD

SEQ ID NO: 11674 - protein, 10 aa, Neocallimastix californiae
  GLYCOSYL_HYDROL_F10
GVEVHITELD

SEQ ID NO: 11675 - protein, 10 aa, Neocallimastix californiae
  GLYCOSYL_HYDROL_F10
GVEVHITELD

SEQ ID NO: 11676 - protein, 10 aa, Neocallimastix californiae
  GLYCOSYL_HYDROL_F10
GLEVHITELD

SEQ ID NO: 11677 - protein, 10 aa, Neocallimastix californiae
  GLYCOSYL_HYDROL_F10
GIEVHITELD

SEQ ID NO: 11678 - protein, 10 aa, Neocallimastix californiae
  GLYCOSYL_HYDROL_F10
GVEVHVTEID

SEQ ID NO: 11679 - protein, 10 aa, Neocallimastix californiae
  GLYCOSYL_HYDROL_F10
GVEVHVTEID

SEQ ID NO: 11680 - protein, 10 aa, Neocallimastix californiae
  GLYCOSYL_HYDROL_F10
GLEVHITELD

SEQ ID NO: 11681 - protein, 10 aa, Neocallimastix californiae
  GLYCOSYL_HYDROL_F10
GVEVHITELD

SEQ ID NO: 11682 - protein, 10 aa, Neocallimastix californiae
  GLYCOSYL_HYDROL_F10
GVEVHITEID

SEQ ID NO: 11683 - protein, 10 aa, Anaeromyces robustus
  GLYCOSYL_HYDROL_F10
GVEVHITEID

SEQ ID NO: 11684 - protein, 10 aa, Anaeromyces robustus
  GLYCOSYL_HYDROL_F10
GLEVHITELD

SEQ ID NO: 11685 - protein, 10 aa, Anaeromyces robustus
  GLYCOSYL_HYDROL_F10
GVEVHITELD

SEQ ID NO: 11686 - protein, 10 aa, Piromyces finnis
  GLYCOSYL_HYDROL_F10
GVEVHVTEID

SEQ ID NO: 11687 - protein, 10 aa, Piromyces finnis
  GLYCOSYL_HYDROL_F10
GLEVHITELD

SEQ ID NO: 11688 - protein, 10 aa, Piromyces finnis
  GLYCOSYL_HYDROL_F10
GLEVHITELD

SEQ ID NO: 11689 - protein, 10 aa, Neocallimastix californiae
  GLYCOSYL_HYDROL_F11_1
PQIEYYVVDD

SEQ ID NO: 11690 - protein, 10 aa, Neocallimastix californiae
  GLYCOSYL_HYDROL_F11_1
PQIEYYVVDD

SEQ ID NO: 11691 - protein, 10 aa, Neocallimastix californiae
  GLYCOSYL_HYDROL_F11_1
PLVEFYVVDN

SEQ ID NO: 11692 - protein, 10 aa, Neocallimastix californiae
  GLYCOSYL_HYDROL_F11_1
PLVEFYVVDN

SEQ ID NO: 11693 - protein, 10 aa, Neocallimastix californiae
  GLYCOSYL_HYDROL_F11_1
PLVEFYVVDN

SEQ ID NO: 11694 - protein, 10 aa, Neocallimastix californiae
  GLYCOSYL_HYDROL_F11_1
PLVEFYVVDN

SEQ ID NO: 11695 - protein, 10 aa, Neocallimastix californiae
  GLYCOSYL_HYDROL_F11_1
PLVEYYVVDN

SEQ ID NO: 11696 - protein, 10 aa, Neocallimastix californiae
  GLYCOSYL_HYDROL_F11_1
PLVEYYVVDN

SEQ ID NO: 11697 - protein, 10 aa, Neocallimastix californiae
  GLYCOSYL_HYDROL_F11_1
PLVEFYVVDN

SEQ ID NO: 11698 - protein, 10 aa, Neocallimastix californiae
  GLYCOSYL_HYDROL_F11_1
PQIEYYVVDD

SEQ ID NO: 11699 - protein, 10 aa, Neocallimastix californiae
  GLYCOSYL_HYDROL_F11_1
PQIEYYVVDD

SEQ ID NO: 11700 - protein, 10 aa, Neocallimastix californiae
  GLYCOSYL_HYDROL_F11_1
PLVEFYVVDN

SEQ ID NO: 11701 - protein, 10 aa, Neocallimastix californiae
  GLYCOSYL_HYDROL_F11_1
PLVEYYVVDN

SEQ ID NO: 11702 - protein, 10 aa, Neocallimastix californiae
  GLYCOSYL_HYDROL_F11_1
PLVEYYVVDN

SEQ ID NO: 11703 - protein, 10 aa, Neocallimastix californiae
  GLYCOSYL_HYDROL_F11_1
PLVEYYVVDN

SEQ ID NO: 11704 - protein, 10 aa, Neocallimastix californiae
  GLYCOSYL_HYDROL_F11_1
PLVEYYIVDD

SEQ ID NO: 11705 - protein, 10 aa, Neocallimastix californiae
  GLYCOSYL_HYDROL_F11_1
PLVEYYIVDN

SEQ ID NO: 11706 - protein, 10 aa, Neocallimastix californiae
  GLYCOSYL_HYDROL_F11_1
PLVEYYVVDN

SEQ ID NO: 11707 - protein, 10 aa, Anaeromyces robustus
  GLYCOSYL_HYDROL_F11_1
PLVEYYIVDD

SEQ ID NO: 11708 - protein, 10 aa, Anaeromyces robustus
  GLYCOSYL_HYDROL_F11_1
PLVEFYVVDN

SEQ ID NO: 11709 - protein, 10 aa, Anaeromyces robustus
  GLYCOSYL_HYDROL_F11_1
PLVEFYVVDN

SEQ ID NO: 11710 - protein, 10 aa, Anaeromyces robustus
  GLYCOSYL_HYDROL_F11_1
PLVEFYVVDN

SEQ ID NO: 11711 - protein, 10 aa, Anaeromyces robustus
  GLYCOSYL_HYDROL_F11_1
PLVEFYVVDN

SEQ ID NO: 11712 - protein, 10 aa, Anaeromyces robustus
  GLYCOSYL_HYDROL_F11_1
PLVEFYIVDN

SEQ ID NO: 11713 - protein, 10 aa, Anaeromyces robustus
  GLYCOSYL_HYDROL_F11_1
PLVEFYVVDN

SEQ ID NO: 11714 - protein, 10 aa, Anaeromyces robustus
  GLYCOSYL_HYDROL_F11_1
PLVEFYVVDN

SEQ ID NO: 11715 - protein, 10 aa, Anaeromyces robustus
  GLYCOSYL_HYDROL_F11_1
PLVEFYVVDN

SEQ ID NO: 11716 - protein, 10 aa, Piromyces finnis
  GLYCOSYL_HYDROL_F11_1
PLVEFYVVDN

SEQ ID NO: 11717 - protein, 10 aa, Piromyces finnis
  GLYCOSYL_HYDROL_F11_1
PLVEFYVVDN

SEQ ID NO: 11718 - protein, 10 aa, Piromyces finnis
  GLYCOSYL_HYDROL_F11_1
PLVEFYVVDN

SEQ ID NO: 11719 - protein, 10 aa, Piromyces finnis
  GLYCOSYL_HYDROL_F11_1
PLVEFYVVDN

SEQ ID NO: 11720 - protein, 11 aa, Neocallimastix californiae
  GLYCOSYL_HYDROL_F11_2
VLVEAGGGSGS

SEQ ID NO: 11721 - protein, 11 aa, Anaeromyces robustus
  GLYCOSYL_HYDROL_F11_2
VLVEAGGGSGS

SEQ ID NO: 11722 - protein, 17 aa, Neocallimastix californiae
  GLYCOSYL_HYDROL_F3
ILKEKMNFQGFVMSDWW

SEQ ID NO: 11723 - protein, 11 aa, Neocallimastix californiae
  GLYCOSYL_HYDROL_F45
TTRYWDCCLAS

SEQ ID NO: 11724 - protein, 11 aa, Neocallimastix californiae
  GLYCOSYL_HYDROL_F45
TTRYWDCCKPS

SEQ ID NO: 11725 - protein, 11 aa, Neocallimastix californiae
  GLYCOSYL_HYDROL_F45
TTRYWDCCKPS

SEQ ID NO: 11726 - protein, 11 aa, Neocallimastix californiae
  GLYCOSYL_HYDROL_F45
TTRYYDCCKPS

SEQ ID NO: 11727 - protein, 11 aa, Neocallimastix californiae
  GLYCOSYL_HYDROL_F45
TTRYYDCCKPS

SEQ ID NO: 11728 - protein, 11 aa, Neocallimastix californiae
  GLYCOSYL_HYDROL_F45
TTRYWDCCKPS

SEQ ID NO: 11729 - protein, 11 aa, Neocallimastix californiae
  GLYCOSYL_HYDROL_F45
TTRYYDCCKPS

SEQ ID NO: 11730 - protein, 11 aa, Neocallimastix californiae
  GLYCOSYL_HYDROL_F45
TTRYWDCCLAS

SEQ ID NO: 11731 - protein, 11 aa, Neocallimastix californiae
  GLYCOSYL_HYDROL_F45
TTRYWDCCKPS

SEQ ID NO: 11732 - protein, 11 aa, Neocallimastix californiae
  GLYCOSYL_HYDROL_F45
TTRYWDCCLAS

SEQ ID NO: 11733 - protein, 11 aa, Neocallimastix californiae
  GLYCOSYL_HYDROL_F45
TTRYWDCCKPS

SEQ ID NO: 11734 - protein, 11 aa, Neocallimastix californiae
  GLYCOSYL_HYDROL_F45
TTRYWDCCLAS

SEQ ID NO: 11735 - protein, 11 aa, Anaeromyces robustus
  GLYCOSYL_HYDROL_F45
TTRYWDCCLAS

SEQ ID NO: 11736 - protein, 11 aa, Anaeromyces robustus
  GLYCOSYL_HYDROL_F45
TTRYWDCCKPS

SEQ ID NO: 11737 - protein, 11 aa, Anaeromyces robustus
  GLYCOSYL_HYDROL_F45
TTRYWDCCKPS

SEQ ID NO: 11738 - protein, 11 aa, Anaeromyces robustus
  GLYCOSYL_HYDROL_F45
TTRYWDCCKPS

SEQ ID NO: 11739 - protein, 11 aa, Anaeromyces robustus
  GLYCOSYL_HYDROL_F45
TTRYYDCCKPS

SEQ ID NO: 11740 - protein, 11 aa, Anaeromyces robustus
  GLYCOSYL_HYDROL_F45
TTRYWDCCKPS

SEQ ID NO: 11741 - protein, 11 aa, Piromyces finnis
  GLYCOSYL_HYDROL_F45
TTRYYDCCKPS

SEQ ID NO: 11742 - protein, 11 aa, Piromyces finnis
  GLYCOSYL_HYDROL_F45
TTRYYDCCKPS

SEQ ID NO: 11743 - protein, 9 aa, Neocallimastix californiae
  GLYCOSYL_HYDROL_F5
LIFEGMNEP

SEQ ID NO: 11744 - protein, 9 aa, Neocallimastix californiae
  GLYCOSYL_HYDROL_F5
VWFGLVNEP

SEQ ID NO: 11745 - protein, 9 aa, Neocallimastix californiae
  GLYCOSYL_HYDROL_F5
IGADLHNEP

SEQ ID NO: 11746 - protein, 9 aa, Neocallimastix californiae
  GLYCOSYL_HYDROL_F5
IGADLHNEP

SEQ ID NO: 11747 - protein, 9 aa, Neocallimastix californiae
  GLYCOSYL_HYDROL_F5
LIFEGMNEP

SEQ ID NO: 11748 - protein, 9 aa, Neocallimastix californiae
  GLYCOSYL_HYDROL_F5
IGADLHNEP

SEQ ID NO: 11749 - protein, 9 aa, Neocallimastix californiae
  GLYCOSYL_HYDROL_F5
VWFDLVNEP

SEQ ID NO: 11750 - protein, 9 aa, Neocallimastix californiae
  GLYCOSYL_HYDROL_F5
VWFGLVNEP

SEQ ID NO: 11751 - protein, 9 aa, Neocallimastix californiae
  GLYCOSYL_HYDROL_F5
IGADLHNEP

SEQ ID NO: 11752 - protein, 9 aa, Neocallimastix californiae
  GLYCOSYL_HYDROL_F5
IGADLHNEP

SEQ ID NO: 11753 - protein, 9 aa, Neocallimastix californiae
  GLYCOSYL_HYDROL_F5
IGADLHNEP

SEQ ID NO: 11754 - protein, 9 aa, Neocallimastix californiae
  GLYCOSYL_HYDROL_F5
VWFGLVNEP

SEQ ID NO: 11755 - protein, 9 aa, Neocallimastix californiae
  GLYCOSYL_HYDROL_F5
IGADIHNEP

SEQ ID NO: 11756 - protein, 9 aa, Anaeromyces robustus
  GLYCOSYL_HYDROL_F5
IGADLHNEP

SEQ ID NO: 11757 - protein, 9 aa, Anaeromyces robustus
  GLYCOSYL_HYDROL_F5
IGADLHNEP

SEQ ID NO: 11758 - protein, 9 aa, Anaeromyces robustus
  GLYCOSYL_HYDROL_F5
VWFGLVNEP

SEQ ID NO: 11759 - protein, 9 aa, Anaeromyces robustus
  GLYCOSYL_HYDROL_F5
VWFGLVNEP

SEQ ID NO: 11760 - protein, 9 aa, Anaeromyces robustus
  GLYCOSYL_HYDROL_F5
IGADIHNEP

SEQ ID NO: 11761 - protein, 9 aa, Piromyces finnis
  GLYCOSYL_HYDROL_F5
IGADLHNEP

SEQ ID NO: 11762 - protein, 9 aa, Piromyces finnis
  GLYCOSYL_HYDROL_F5
LIFEGQNEP

SEQ ID NO: 11763 - protein, 9 aa, Piromyces finnis
  GLYCOSYL_HYDROL_F5
LIFEGQNEP

SEQ ID NO: 11764 - protein, 9 aa, Piromyces finnis
  GLYCOSYL_HYDROL_F5
VWFGLVNEP

SEQ ID NO: 11765 - protein, 9 aa, Piromyces finnis
  GLYCOSYL_HYDROL_F5
VWFGLVNEP

SEQ ID NO: 11766 - protein, 9 aa, Neocallimastix californiae
  GLYCOSYL_HYDROL_F6_2
VLIVEPDSL

SEQ ID NO: 11767 - protein, 9 aa, Neocallimastix californiae
  GLYCOSYL_HYDROL_F6_2
VAIIEPDAL

SEQ ID NO: 11768 - protein, 9 aa, Neocallimastix californiae
  GLYCOSYL_HYDROL_F6_2
VLIVEPDSL

SEQ ID NO: 11769 - protein, 9 aa, Neocallimastix californiae
  GLYCOSYL_HYDROL_F6_2
VLIVEPDSL

SEQ ID NO: 11770 - protein, 9 aa, Neocallimastix californiae
  GLYCOSYL_HYDROL_F6_2
VLVIEPDSL

SEQ ID NO: 11771 - protein, 9 aa, Neocallimastix californiae
  GLYCOSYL_HYDROL_F6_2
VLIVEPDSL

SEQ ID NO: 11772 - protein, 9 aa, Neocallimastix californiae
  GLYCOSYL_HYDROL_F6_2
VLIVEPDSL

SEQ ID NO: 11773 - protein, 9 aa, Neocallimastix californiae
  GLYCOSYL_HYDROL_F6_2
VLIVEPDSL

SEQ ID NO: 11774 - protein, 9 aa, Neocallimastix californiae
  GLYCOSYL_HYDROL_F6_2
VLVIEPDSL

SEQ ID NO: 11775 - protein, 9 aa, Neocallimastix californiae
  GLYCOSYL_HYDROL_F6_2
VAIIEPDAL

SEQ ID NO: 11776 - protein, 9 aa, Neocallimastix californiae
  GLYCOSYL_HYDROL_F6_2
VLIVEPDSL

SEQ ID NO: 11777 - protein, 9 aa, Neocallimastix californiae
  GLYCOSYL_HYDROL_F6_2
VLIIEPDSL

SEQ ID NO: 11778 - protein, 9 aa, Neocallimastix californiae
  GLYCOSYL_HYDROL_F6_2
VLIIEPDSL

SEQ ID NO: 11779 - protein, 9 aa, Neocallimastix californiae
  GLYCOSYL_HYDROL_F6_2
VLIIEPDSL

SEQ ID NO: 11780 - protein, 9 aa, Neocallimastix californiae
  GLYCOSYL_HYDROL_F6_2
VLIIEPDSL

SEQ ID NO: 11781 - protein, 9 aa, Neocallimastix californiae
  GLYCOSYL_HYDROL_F6_2
VLIIEPDSL

SEQ ID NO: 11782 - protein, 9 aa, Neocallimastix californiae
  GLYCOSYL_HYDROL_F6_2
VLIIEPDSL

SEQ ID NO: 11783 - protein, 9 aa, Neocallimastix californiae
  GLYCOSYL_HYDROL_F6_2
VAIIEPDAL

SEQ ID NO: 11784 - protein, 9 aa, Anaeromyces robustus
  GLYCOSYL_HYDROL_F6_2
VLIIEPDSL

SEQ ID NO: 11785 - protein, 9 aa, Anaeromyces robustus
  GLYCOSYL_HYDROL_F6_2
VAIIEPDAL

SEQ ID NO: 11786 - protein, 9 aa, Anaeromyces robustus
  GLYCOSYL_HYDROL_F6_2
VLIIEPDSL

SEQ ID NO: 11787 - protein, 9 aa, Piromyces finnis
  GLYCOSYL_HYDROL_F6_2
VLIIEPDSL

SEQ ID NO: 11788 - protein, 9 aa, Piromyces finnis
  GLYCOSYL_HYDROL_F6_2
VLIIEPDSL

SEQ ID NO: 11789 - protein, 9 aa, Piromyces finnis
  GLYCOSYL_HYDROL_F6_2
VLIIEPDSL

SEQ ID NO: 11790 - protein, 9 aa, Piromyces finnis
  GLYCOSYL_HYDROL_F6_2
VLIIEPDSL

SEQ ID NO: 11791 - protein, 9 aa, Piromyces finnis
  GLYCOSYL_HYDROL_F6_2
VLIIEPDSL

SEQ ID NO: 11792 - protein, 9 aa, Piromyces finnis
  GLYCOSYL_HYDROL_F6_2
VLIIEPDSL

SEQ ID NO: 11793 - protein, 9 aa, Piromyces finnis
  GLYCOSYL_HYDROL_F6_2
VLIIEPDSL

SEQ ID NO: 11794 - protein, 9 aa, Piromyces finnis
  GLYCOSYL_HYDROL_F6_2
VLIIEPDSL

SEQ ID NO: 11795 - protein, 9 aa, Piromyces finnis
  GLYCOSYL_HYDROL_F6_2
VLIIEPDSL

SEQ ID NO: 11796 - protein, 9 aa, Piromyces finnis
  GLYCOSYL_HYDROL_F6_2
VLIIEPDSL

SEQ ID NO: 11797 - protein, 9 aa, Piromyces finnis
  GLYCOSYL_HYDROL_F6_2
VLIIEPDSL

SEQ ID NO: 11798 - protein, 9 aa, Piromyces finnis
  GLYCOSYL_HYDROL_F6_2
VLIIEPDSL

SEQ ID NO: 11799 - protein, 9 aa, Piromyces finnis
  GLYCOSYL_HYDROL_F6_2
VLIIEPDSL

SEQ ID NO: 11800 - protein, 9 aa, Piromyces finnis
  GLYCOSYL_HYDROL_F6_2
VLIIEPDSL

SEQ ID NO: 11801 - protein, 9 aa, Piromyces finnis
  GLYCOSYL_HYDROL_F6_2
VLIIEPDSL

SEQ ID NO: 11802 - protein, 9 aa, Piromyces finnis
  GLYCOSYL_HYDROL_F6_2
VLIIEPDSL

SEQ ID NO: 11803 - protein, 9 aa, Piromyces finnis
  GLYCOSYL_HYDROL_F6_2
VLIIEPDSL

SEQ ID NO: 11804 - protein, 9 aa, Piromyces finnis
  GLYCOSYL_HYDROL_F6_2
VLIIEPDSL

SEQ ID NO: 11805 - protein, 9 aa, Piromyces finnis
  GLYCOSYL_HYDROL_F6_2
VLIIEPDSL

SEQ ID NO: 11806 - protein, 9 aa, Piromyces finnis
  GLYCOSYL_HYDROL_F6_2
VLIIEPDSL

SEQ ID NO: 11807 - protein, 9 aa, Piromyces finnis
  GLYCOSYL_HYDROL_F6_2
VLIIEPDSL

SEQ ID NO: 11808 - protein, 9 aa, Piromyces finnis
  GLYCOSYL_HYDROL_F6_2
VLIIEPDSL

SEQ ID NO: 11809 - protein, 9 aa, Piromyces finnis
  GLYCOSYL_HYDROL_F6_2
VLIIEPDSL

SEQ ID NO: 11810 - protein, 9 aa, Piromyces finnis
  GLYCOSYL_HYDROL_F6_2
VLIIEPDSL

SEQ ID NO: 11811 - protein, 9 aa, Piromyces finnis
  GLYCOSYL_HYDROL_F6_2
VLIIEPDSL

SEQ ID NO: 11812 - protein, 9 aa, Piromyces finnis
  GLYCOSYL_HYDROL_F6_2
VLIIEPDSL

SEQ ID NO: 11813 - protein, 9 aa, Piromyces finnis
  GLYCOSYL_HYDROL_F6_2
VLIIEPDSL

SEQ ID NO: 11814 - protein, 9 aa, Piromyces finnis
  GLYCOSYL_HYDROL_F6_2
VLIIEPDSL

SEQ ID NO: 11815 - protein, 9 aa, Piromyces finnis
  GLYCOSYL_HYDROL_F6_2
VLIIEPDSL

SEQ ID NO: 11816 - protein, 9 aa, Piromyces finnis
  GLYCOSYL_HYDROL_F6_2
VLIIEPDSL

SEQ ID NO: 11817 - protein, 18 aa, Neocallimastix californiae
  GLYCOSYL_HYDROL_F9_2
FVDSRKDYQMSEVALDYN

SEQ ID NO: 11818 - protein, 18 aa, Neocallimastix californiae
  GLYCOSYL_HYDROL_F9_2
YTDTRKNYEMNEVALDYN

SEQ ID NO: 11819 - protein, 18 aa, Neocallimastix californiae
  GLYCOSYL_HYDROL_F9_2
YSDTRKDYEMNEVALDYN

SEQ ID NO: 11820 - protein, 18 aa, Neocallimastix californiae
  GLYCOSYL_HYDROL_F9_2
YTDDRTNYNSNEVALDYN

SEQ ID NO: 11821 - protein, 18 aa, Neocallimastix californiae
  GLYCOSYL_HYDROL_F9_2
WDDDRNNYITNEVSCDYN

SEQ ID NO: 11822 - protein, 18 aa, Neocallimastix californiae
  GLYCOSYL_HYDROL_F9_2
FVDSRKDYQMSEVALDYN

SEQ ID NO: 11823 - protein, 18 aa, Neocallimastix californiae
  GLYCOSYL_HYDROL_F9_2
WDDDRNNYVTNEVACDYN

SEQ ID NO: 11824 - protein, 18 aa, Neocallimastix californiae
  GLYCOSYL_HYDROL_F9_2
YKDIREDYQKNEVALDYN

SEQ ID NO: 11825 - protein, 18 aa, Neocallimastix californiae
  GLYCOSYL_HYDROL_F9_2
FKDARDNYEMNEVALDYN

SEQ ID NO: 11826 - protein, 18 aa, Neocallimastix californiae
  GLYCOSYL_HYDROL_F9_2
FKDARDNYEMNEVALDYN

SEQ ID NO: 11827 - protein, 18 aa, Neocallimastix californiae
  GLYCOSYL_HYDROL_F9_2
YTDSRKNYQMNEVALDYN

SEQ ID NO: 11828 - protein, 18 aa, Anaeromyces robustus
  GLYCOSYL_HYDROL_F9_2
YTDSRKNYQMNEVALDYN

SEQ ID NO: 11829 - protein, 18 aa, Anaeromyces robustus
  GLYCOSYL_HYDROL_F9_2
YKDDRTNYNSNEVALDYN

SEQ ID NO: 11830 - protein, 18 aa, Anaeromyces robustus
  GLYCOSYL_HYDROL_F9_2
YKDTRNNYEMNEVALDYN

SEQ ID NO: 11831 - protein, 18 aa, Anaeromyces robustus
  GLYCOSYL_HYDROL_F9_2
YSDTRKNYEMNEVALDYN

SEQ ID NO: 11832 - protein, 18 aa, Anaeromyces robustus
  GLYCOSYL_HYDROL_F9_2
YTDTRKNYEMNEVALDYN

SEQ ID NO: 11833 - protein, 18 aa, Anaeromyces robustus
  GLYCOSYL_HYDROL_F9_2
YKDDRTNYNSNEVALDYN

SEQ ID NO: 11834 - protein, 18 aa, Anaeromyces robustus
  GLYCOSYL_HYDROL_F9_2
WDDDRNNYITNEVSCDYN

SEQ ID NO: 11835 - protein, 18 aa, Piromyces finnis
  GLYCOSYL_HYDROL_F9_2
YTDSRKNYEMNEVALDYN

SEQ ID NO: 11836 - protein, 18 aa, Piromyces finnis
  GLYCOSYL_HYDROL_F9_2
YIDTRSNFRTNEVALDYN

SEQ ID NO: 11837 - protein, 18 aa, Piromyces finnis
  GLYCOSYL_HYDROL_F9_2
YTDSRKNYEMNEVALDYN

SEQ ID NO: 11838 - protein, 18 aa, Piromyces finnis
  GLYCOSYL_HYDROL_F9_2
YTDSRKNYEMNEVALDYN

SEQ ID NO: 11839 - protein, 18 aa, Piromyces finnis
  GLYCOSYL_HYDROL_F9_2
YIDTRSNFRTNEVALDYN

SEQ ID NO: 11840 - protein, 18 aa, Piromyces finnis
  GLYCOSYL_HYDROL_F9_2
YTDSRKNYEMNEVALDYN

SEQ ID NO: 11841 - protein, 18 aa, Piromyces finnis
  GLYCOSYL_HYDROL_F9_2
YKDARNNYEMNEVALDYN

SEQ ID NO: 11842 - protein, 18 aa, Piromyces finnis
  GLYCOSYL_HYDROL_F9_2
YEDTRKNYEMNEVALDYN

SEQ ID NO: 11843 - protein, 18 aa, Piromyces finnis
  GLYCOSYL_HYDROL_F9_2
YTDDRTNYNSNEVALDYN

SEQ ID NO: 11844 - protein, 18 aa, Piromyces finnis
  GLYCOSYL_HYDROL_F9_2
YTDDRTNYNSNEVALDYN

SEQ ID NO: 11845 - protein, 176 aa, Neocallimastix californiae
  GroES-like
TTFKAWAALNAKEKLQPYEYTPEPLADDQIEVKVTHNGLCHSDIHMKDNDWGNSSYPFIPGHEVIGNVVALGANAEKLSGLKVGDRVGYGWIRDSCGFCECCIEGQENLCEKGYEGTIVGHHGGFQDRIRMPAKFAFKIPEKLPSEYAAPLMCAGATVYNPLRLFIEKPNVKVGVI

SEQ ID NO: 11846 - protein, 159 aa, Neocallimastix californiae
  GroES-like
KAWAALNAKEKLQPYEYTPEPLADDQIEVKVTHNGLCHSDIHMKDNDWGNSSYPFIPGHEVIGNVVALGANAEKLSGLKVGDRVGYGWIRDSCGFCECCIEGQENLCEKGYEGTIVGHHGGFQDRIRMPAKFAFKIPEKLPSEYAAPLMCAGATVYNPL

SEQ ID NO: 11847 - protein, 210 aa, Neocallimastix californiae
  GroES-like
MKGYAMVKIGEPGWVEKEKPKCGPMDAICKPLAIAVCTSDVHTVWEGAIGDRHDMILGHECCAEVVEVGSEVKDFKPGDRVIVPAITPDWNSLEAQAGYSMHSHGMLAGWKFSNIKDGVFSEYFHVNDADGNLAHLPSSINTVDACMLSDMVPTGFHAVELADIQFGDVVLQIGIGPVGLMSVAGASLRGASRIICVGTRKVCQDVARKY

SEQ ID NO: 11848 - protein, 181 aa, Neocallimastix californiae
  GroES-like
MKGYAMVKIGEPGWVEKEKPKCGPMDAICKPLAIAVCTSDVHTVWEGAIGDRHDMILGHECCAEVVEVGSEVKDFKPGDRVIVPAITPDWNSLEAQAGYSMHSHGMLAGWKFSNIKDGVFSEYFHVNDADGNLAHLPSSINTVDACMLSDMVPTGFHAVELADIQFGDVVLQIGIGPVGLM

SEQ ID NO: 11849 - protein, 154 aa, Neocallimastix californiae
  GroES-like
SLENVSCVLNHFPGEGMVKLDDMKIVKSVVPELGENDVLLKNLCCSVDPFMRGRMRKGVKSYVASFEEGKPMPVFSVTQVAKIGSAVTDINVGDKYMCFNGIEKYTVLPQQVIKGEGEKNLGSFNKIDPNNPLKDSFYLGLFGMPGMTAWAFFN

SEQ ID NO: 11850 - protein, 147 aa, Neocallimastix californiae
  GroES-like
VLNHFPGEGMVKLDDMKIVKSVVPELGENDVLLKNLCCSVDPFMRGRMRKGVKSYVASFEEGKPMPVFSVTQVAKIGSAVTDINVGDKYMCFNGIEKYTVLPQQVIKGEGEKNLGSFNKIDPNNPLKDSFYLGLFGMPGMTAWAFFN

SEQ ID NO: 11851 - protein, 92 aa, Neocallimastix californiae
  GroES-like
ISKAMVCSKYGQPKDVLSLKELKIPKIRDNEVLVKFLAAPINPSDINQIEGVYPIKPRFREYGAVGGNEGVAEVVAAGSKVKNLTIGDWVIP

SEQ ID NO: 11852 - protein, 163 aa, Neocallimastix californiae
  GroES-like
SKAMVCSKYGQPKDVLSLKELKIPKIRDNEVLVKFLAAPINPSDINQIEGVYPIKPRFREYGAVGGNEGVAEVVAAGSKVKNLTIGDWVIPDSKAFGTWQTFAASSENELQKISKNGISKISAATISVNPPTAYRMLKDFVNLKKGDVVIQNGANSAVGQSVI

SEQ ID NO: 11853 - protein, 161 aa, Neocallimastix californiae
  GroES-like
FGVSLVERRALRDDDVEIDIKYCGICHSDIMIVQINQPGKGVVPGHEITGVVKSVGKAVTNFKVGDHVGVGCFVNSCSNCEYCKRGDEQFCDKGVVVVFNSKDYDGAITYGGYTQTIIVKDKFVLHIPDSLDLAVASPLLCAGITTYSPLKRYNIGKGSRV

SEQ ID NO: 11854 - protein, 148 aa, Neocallimastix californiae
  GroES-like
VERRALRDDDVEIDIKYCGICHSDIMIVQINQPGKGVVPGHEITGVVKSVGKAVTNFKVGDHVGVGCFVNSCSNCEYCKRGDEQFCDKGVVVVFNSKDYDGAITYGGYTQTIIVKDKFVLHIPDSLDLAVASPLLCAGITTYSPLKRY

SEQ ID NO: 11855 - protein, 134 aa, Neocallimastix californiae
  GroES-like
SECIGLPAYTDDEVVIKVKGVSMQFKDIMTAMDALIGFDSYEPGMECIGRVVAIGKNVASNPRNQLQIGDPVIAFSHKYGHLLRTYGVVDPLSLQKIPESMYKVEYAGIFIVFITAYYSLHVRAGGIKPGQTIL

SEQ ID NO: 11856 - protein, 141 aa, Neocallimastix californiae
  GroES-like
MKYSECIGLPAYTDDEVVIKVKGVSMQFKDIMTAMDALIGFDSYEPGMECIGRVVAIGKNVASNPRNQLQIGDPVIAFSHKYGHLLRTYGVVDPLSLQKIPESMYKVEYAGIFIVFITAYYSLHVRAGGIKPGQTILIHAA

SEQ ID NO: 11857 - protein, 134 aa, Neocallimastix californiae
  GroES-like
REVFGLPECGPDEVIIKIHSVALQFKDIMSVMNNLPGYNVYEPGMESNGYVVKIGENAKKHIQLQIGQPVFAFTHKYGHMVSTYGKAHYKLVKPMNTNDMNPESYSSVIVLGTVLYALRDRAGGVKRGQSILIH

SEQ ID NO: 11858 - protein, 145 aa, Neocallimastix californiae
  GroES-like
NTGQIGKLKFREVFGLPECGPDEVIIKIHSVALQFKDIMSVMNNLPGYNVYEPGMESNGYVVKIGENAKKHIQLQIGQPVFAFTHKYGHMVSTYGKAHYKLVKPMNTNDMNPESYSSVIVLGTVLYALRDRAGGVKRGQSILIHS

SEQ ID NO: 11859 - protein, 109 aa, Neocallimastix californiae
  GroES-like
CVIVKVKTISLQNNDVLQNSYPELAEIMKGSSVIECVGTIVNVGSKVKKFKRGDFVFGISFYGDYVPSTYVKIPQDLVFAVDRKDTLKQQQLISSVYAYTVALYLLNEI

SEQ ID NO: 11860 - protein, 111 aa, Neocallimastix californiae
  GroES-like
ECVIVKVKTISLQNNDVLQNSYPELAEIMKGSSVIECVGTIVNVGSKVKKFKRGDFVFGISFYGDYVPSTYVKIPQDLVFAVDRKDTLKQQQLISSVYAYTVALYLLNEIQ

SEQ ID NO: 11861 - protein, 161 aa, Neocallimastix californiae
  GroES-like
FGVSLVERRALRDDDVEIDIKYCGICHSDIMIVQNNQPGNGIVPGHEIAGVVKSVGKAVTNFKVGDHVGIGCFVNSCSNCEYCKRGDEQFCDKGVVIVFNSKDYDGAITYGGYTQTIIVRDKFVLHIPESLDLAMASPLLCAGVTTYSPLKRYNIGKGSRV

SEQ ID NO: 11862 - protein, 149 aa, Neocallimastix californiae
  GroES-like
VERRALRDDDVEIDIKYCGICHSDIMIVQNNQPGNGIVPGHEIAGVVKSVGKAVTNFKVGDHVGIGCFVNSCSNCEYCKRGDEQFCDKGVVIVFNSKDYDGAITYGGYTQTIIVRDKFVLHIPESLDLAMASPLLCAGVTTYSPLKRYN

SEQ ID NO: 11863 - protein, 110 aa, Neocallimastix californiae
  GroES-like
NESVVVKVRMISLQNNDVLHNSYPELADIMKCSNVVECVGTIVNVGSRVKNFKRGDFVFGISFYADYVPSSYVKIPQDLVVVINEKDSQKQQRLISSVYAYTVALYLLND

SEQ ID NO: 11864 - protein, 113 aa, Neocallimastix californiae
  GroES-like
KDNESVVVKVRMISLQNNDVLHNSYPELADIMKCSNVVECVGTIVNVGSRVKNFKRGDFVFGISFYADYVPSSYVKIPQDLVVVINEKDSQKQQRLISSVYAYTVALYLLNDI

SEQ ID NO: 11865 - protein, 125 aa, Anaeromyces robustus
  GroES-like
KDVLRLKEIKISKIKDDEVLVKFLASPINPSDINQIEGVYPIKPRFKEYGAVGGNEGVAEVIAAGSKVKNLTVGDWVIPDTKAFGTWQTYATSPENELQKISKNGISSISAATISVNPPTAYRML

SEQ ID NO: 11866 - protein, 163 aa, Anaeromyces robustus
  GroES-like
SKAMVCEKHGQPKDVLRLKEIKISKIKDDEVLVKFLASPINPSDINQIEGVYPIKPRFKEYGAVGGNEGVAEVIAAGSKVKNLTVGDWVIPDTKAFGTWQTYATSPENELQKISKNGISSISAATISVNPPTAYRMLKDFVNLKKGDVVIQNGANSAVGQSVI

SEQ ID NO: 11867 - protein, 90 aa, Anaeromyces robustus
  GroES-like
KAMVCEKHGQPKDVLSLKELKISKIKDNEVLVKFLASPINPSDINQIEGVYPIKPRFKEFGAVGGNEGVAEVIAAGPKVKNLVVGDWVIP

SEQ ID NO: 11868 - protein, 163 aa, Anaeromyces robustus
  GroES-like
SKAMVCEKHGQPKDVLSLKELKISKIKDNEVLVKFLASPINPSDINQIEGVYPIKPRFKEFGAVGGNEGVAEVIAAGPKVKNLVVGDWVIPDTKAFGTWQTFAASPENEFQKINKNGISKISAATISVNPPTAYRMLKDFVNLKKGDVVIQNGANSAVGQSVI

SEQ ID NO: 11869 - protein, 154 aa, Anaeromyces robustus
  GroES-like
MTLENVSCILNNYPDGMVTVDNMKVVKSPVPELGENDVLLKNLCCSIDPFMRGRMRENVKSYVPSFEKGKVMQVFSVTQVEKIGSAVTDINVGDKYMCFNGIEKYTVLPQQVIKGDGKQSLGSFTKIDQRNPIKDSFYLGLFGMPGMTAWAFFN

SEQ ID NO: 11870 - protein, 152 aa, Anaeromyces robustus
  GroES-like
VSCILNNYPDGMVTVDNMKVVKSPVPELGENDVLLKNLCCSIDPFMRGRMRENVKSYVPSFEKGKVMQVFSVTQVEKIGSAVTDINVGDKYMCFNGIEKYTVLPQQVIKGDGKQSLGSFTKIDQRNPIKDSFYLGLFGMPGMTAWAFFNKVG

SEQ ID NO: 11871 - protein, 134 aa, Anaeromyces robustus
  GroES-like
REVFGLPECSPDEVVIKIHSVALQFKDVMSVMNNLPGYNVYEPGMESNGYVVKIGENAKKHINLKIGQPVFAFTHKYGHMVSTYGKAHYKLVKPMMNNDMNPENYSSVIVLGTVLYALRDRAGGVKPGQSILIQ

SEQ ID NO: 11872 - protein, 142 aa, Anaeromyces robustus
  GroES-like
TGQIGKLKFREVFGLPECSPDEVVIKIHSVALQFKDVMSVMNNLPGYNVYEPGMESNGYVVKIGENAKKHINLKIGQPVFAFTHKYGHMVSTYGKAHYKLVKPMMNNDMNPENYSSVIVLGTVLYALRDRAGGVKPGQSILI

SEQ ID NO: 11873 - protein, 155 aa, Piromyces finnis
  GroES-like
MTIENVSCTLNRYPEGMVKLDDFKIVQGPIPEISDNDVLLKVLCCSVDPFMRGRMKKDNPSSYVPPCQPGKVIQVFSITQVEKIGANVTDINVGDKYMCFNGIEKYTVVPQQAIKGDGQKNLGNYNKIDPNNPIKDSFYLGLFGMPGMTAWAFFN

SEQ ID NO: 11874 - protein, 152 aa, Piromyces finnis
  GroES-like
SCTLNRYPEGMVKLDDFKIVQGPIPEISDNDVLLKVLCCSVDPFMRGRMKKDNPSSYVPPCQPGKVIQVFSITQVEKIGANVTDINVGDKYMCFNGIEKYTVVPQQAIKGDGQKNLGNYNKIDPNNPIKDSFYLGLFGMPGMTAWAFFNKVG

SEQ ID NO: 11875 - protein, 124 aa, Piromyces finnis
  GroES-like
KDVLRLKELTIPKIKDDEVLVKFLAAPINPSDINQIEGVYPIKPRFKKYGAVGGNEGVAEVVAAGNKVKNLTVGDWVIPDTKAFGTWQTFAASPENELQKISKNISKISASTISVNPPTAYRML

SEQ ID NO: 11876 - protein, 162 aa, Piromyces finnis
  GroES-like
SKAMVCEKHGKPKDVLRLKELTIPKIKDDEVLVKFLAAPINPSDINQIEGVYPIKPRFKKYGAVGGNEGVAEVVAAGNKVKNLTVGDWVIPDTKAFGTWQTFAASPENELQKISKNISKISASTISVNPPTAYRMLKDFVNLKKGDVIIQNGANSAVGQAVI

SEQ ID NO: 11877 - protein, 134 aa, Piromyces finnis
  GroES-like
REVFGLPECGPDEIIIKIQSVALQFKDIMSVMNNLPGYNVYEPGMESNGYVVKIGENAKKHVNFKIGQPVFAFTHKYGHMVSTYGKAHYKLVKPMINNDMNPENYSSVVVMGTVLYAIRDRAGGIKPGQSILIQ

SEQ ID NO: 11878 - protein, 142 aa, Piromyces finnis
  GroES-like
TGQIGKLKFREVFGLPECGPDEIIIKIQSVALQFKDIMSVMNNLPGYNVYEPGMESNGYVVKIGENAKKHVNFKIGQPVFAFTHKYGHMVSTYGKAHYKLVKPMINNDMNPENYSSVVVMGTVLYAIRDRAGGIKPGQSILI

SEQ ID NO: 11879 - protein, 115 aa, Piromyces finnis
  GroES-like
LSKHEMDKESVVVKVSTISLQNNDILQNSLPDLSSLMKDSSVAECIGTIVHTGSNVKNFKKGDVVFGLNLQANDIPSTYVKIHQDLVFPVNTMDMDKQNNLLSSVYAYTVAIYLL

SEQ ID NO: 11880 - protein, 118 aa, Piromyces finnis
  GroES-like
PDLSKHEMDKESVVVKVSTISLQNNDILQNSLPDLSSLMKDSSVAECIGTIVHTGSNVKNFKKGDVVFGLNLQANDIPSTYVKIHQDLVFPVNTMDMDKQNNLLSSVYAYTVAIYLLN

SEQ ID NO: 11881 - protein, 132 aa, Piromyces finnis
  GroES-like
CIGLPKYNDDQIVIKTKGVSMQFKDIMTAMDTLVGFDDYEPGMECIGRVVAIGKNVASDPKNVLQIGDPVVAFAHKYGHLLRTYGVADPLSVQKIPESMYKVEYAGIFIVFITAYYSLHVRAGGIKPGQTIL

SEQ ID NO: 11882 - protein, 144 aa, Piromyces finnis
  GroES-like
IGQMKFTECIGLPKYNDDQIVIKTKGVSMQFKDIMTAMDTLVGFDDYEPGMECIGRVVAIGKNVASDPKNVLQIGDPVVAFAHKYGHLLRTYGVADPLSVQKIPESMYKVEYAGIFIVFITAYYSLHVRAGGIKPGQTILIHAA

SEQ ID NO: 11883 - protein, 134 aa, Neocallimastix californiae
  HMG_CoA_synt_C
ISKIYKERVEASTLMTANMGCMYNASVLNGIISLNESLTPDDIGKRALVYSFGSGSVGALWTLRIDGLAEKDDLVNRLSNRKEVSVDTYFEIRKLWLEEIKKFGRSYKKDQFELPIRDGDYYLASVSSNGVRKY

SEQ ID NO: 11884 - protein, 78 aa, Neocallimastix californiae
  HMG_CoA_synt_C
NRGIFSNSTFDFYKPYGYKNHYPVVDGKYSIKCYLDSLKSCYEDLKKKTKSETEFLDHQFGVFHNSSVSLTRKGFNTL

SEQ ID NO: 11885 - protein, 78 aa, Anaeromyces robustus
  HMG_CoA_synt_C
NRGIFSNSTFDFYKPYGYKNHYPVVDGKYSIDCYLNSLVSCYEDLKKKSKSETEFLDHQFGVFHNSSVSLTRKGFNTL

SEQ ID NO: 11886 - protein, 133 aa, Anaeromyces robustus
  HMG_CoA_synt_C
SKIYKERVEASTLMTANMGCMYNASVLNGIISLNESLKPEDIGKRILVYSFGSGSVGALWSLRIDGLAEKDDLNNRLNNRKEISVDSYFKVRQLWLEDIKKFGRSYKKDQFELPIRDGDYYLSSVSVNGVRKY

SEQ ID NO: 11887 - protein, 77 aa, Piromyces finnis
  HMG_CoA_synt_C
RGIFSNSTFDFYKPYGYKNHYPVVDGKYSIDCYLSSLKSCYEQLKKKTGSETEFLDHQFSVFHNSSVSLTRKGFNTL

SEQ ID NO: 11888 - protein, 134 aa, Piromyces finnis
  HMG_CoA_synt_C
ISNVYKERVEASTLMTANMGCMYNASVLNGIISLNESLTPEDIGKRVLVYSFGSGSVGALWTLRIDGLAEKDDLVNRLNSRNEVSVDTYFEIRKLWLEEIKKFGRSYKKDQFELQIREGDYYLSSVSLDGVRKY

SEQ ID NO: 11889 - protein, 168 aa, Neocallimastix californiae
  HMG_CoA_synt_N
ENVGIIGLASYIPSTTVNMSKLEVHDNCQGKYTISLGQKYMSLTAPNEDVVSMALNAVKRLMKKMNLKPSDIGRIQIGTETPVDLSKSVKTFIVEQFFDQGITDIEGVDNVNACFGSTAALFDTVAWMQSEFWNGRYAIVVGTDISQGEDIYHFLTGSSAVAVLIGPN

SEQ ID NO: 11890 - protein, 168 aa, Anaeromyces robustus
  HMG_CoA_synt_N
ENIGIIGLATYIPATTVSMTKLEAHDKCQGKYTISLGQKYMSLTAPNEDVVSMALNAVKRLMKKMNLKPSDIGRIQIGTETPVDLSKSVKTFIVEQFFEQGITDIEGVDNVNACFGSTAALFDTVAWMQSDFWNGRYAIVVGTDISQGEDIYHFLTGSSAVAVLIGPN

SEQ ID NO: 11891 - protein, 168 aa, Piromyces finnis
  HMG_CoA_synt_N
ENVGIIGLATYIPSSTVNMTKLEAHDNCQGKYTISLGQKYMSLTAPNEDVVSMALNAVKRLMKKMNLKPSDIGRIQIGTETPVDLSKSVKTFIVEQFFEQGITDIEGVDNVNACFGSTAALFDTVAWMQSDFWNGRYAIVVGTDISQGEDIYHFLTGSSAVALLIGPN

SEQ ID NO: 11892 - protein, 124 aa, Neocallimastix californiae
  HotDog_dom
FAKEHFNYNERDVILYSIGVGITKKELSYVYENSPDFKVLPTFSTVPAMDYFSKMNLANVLPIFSPEALIQTKHYMELNKTFEPKDNVVSKGKIVDIIKTKMGAVLITAISTYDKDGNEICYNE

SEQ ID NO: 11893 - protein, 147 aa, Neocallimastix californiae
  HotDog_dom
QHLLRHVDKYDHCPEKSLGSKANTVITIPKRKPDAIVKERTSEDQAILYRLSGDKNPLHVDPAMASIAGYHSPVLQSLCVLAISTLHIIQTFCYGDVASIKSIQADFVSHVFPGETLQTNMWQDGTKILFNVKALERDVIVISNAAV

SEQ ID NO: 11894 - protein, 125 aa, Neocallimastix californiae
  HotDog_dom
FAKERFNYNEKDVILYSLGVGITKKELSYVYENSPDFKVLPTFSTVPALDYFSKMNLSNILPIFSPEALIQTKHYMELNKTFEPKDNVVSKGRIIDIIKSKMGAILVTAISTYDEEGNEICYNEF

SEQ ID NO: 11895 - protein, 146 aa, Neocallimastix californiae
  HotDog_dom
HLLRHVDNYDHCPEKAIESKANTVITIPKRKPDAIVKERTSEDQAILYRLSGEKNPLHVDPAMASIAGYHSPVLQSLCVLAIGTLHIIQTFCYGDVASVKSIQADFVSHVFPGETLQTNMWQDGTKILFNVKALERDVIVISNAAV

SEQ ID NO: 11896 - protein, 113 aa, Neocallimastix californiae
  HotDog_dom
PNTNEDYSLASGDVNPIHTNYYFANLADLDVPITHGMWTSAATRRYVETYAADNDAERVVSYKVNFIGMVSPKDELRTSLTHVGMHNGRKIIKVSVKDLRTNETVMEGEAEVK

SEQ ID NO: 11897 - protein, 101 aa, Neocallimastix californiae
  HotDog_dom
THPSNKVVPSMDFIIVTSWVSVFKTIFAKEFDADITRLVHMNNGYEVIDPRPLRIGEVVDTRSIISAVTNLDSGKLIEVTGHVFREGKEYVKVTSSFLCRG

SEQ ID NO: 11898 - protein, 108 aa, Neocallimastix californiae
  HotDog_dom
NRAESYTDRGQKVLFAPMDFAIVVGWQSIIRAIFPKFINADLLKLVHLTNGFRMIDNESGLKEGDIVKTESRIISVINDETGKIVEVKGVLKRDEKPFMEVISKFFYR

SEQ ID NO: 11899 - protein, 114 aa, Neocallimastix californiae
  HotDog_dom
THSSNIGYSRVSGDVNPIHTNPYFAQLADLPGNITHGMWTSASTRKFVETFAAENHPHRVTSYEVKFLDMVFPGDRLETKLFHTGMANGKKIIQCKTINQDGKVVLEGTAEVEQ

SEQ ID NO: 11900 - protein, 114 aa, Neocallimastix californiae; identical to SEQ ID NO: 11899
  HotDog_dom

SEQ ID NO: 11901 - protein, 108 aa, Neocallimastix californiae; identical to SEQ ID NO: 11898
  HotDog_dom

SEQ ID NO: 11902 - protein, 114 aa, Neocallimastix californiae
  HotDog_dom
THSSNLGYSRVSGDVNPIHTNPYFAQLADLPGNITHGMWTSASTRKFVETFAAENHPHRVTSYEVKFLDMVFPGDRLETKLFHTGMANGKKIIQCKTINQDGKVILEGTAEVEQ

SEQ ID NO: 11903 - protein, 108 aa, Neocallimastix californiae
  HotDog_dom
NRAESYTDRGQKVLFAPMDFAIVVGWQSIIRAIFPKFINADLLKLVHLSNGFRMIDNELGLKEGDVVKTESRIISVVNDETGKIVEVKGVLKRDEKPFMEVISKFFYR

SEQ ID NO: 11904 - protein, 113 aa, Neocallimastix californiae
  HotDog_dom
PNTNEDYSLASGDVNPIHTNYYFANLADLDVPITHGMWTSAATRRYIETYAADNDAERVVSYKVNFIGMVSPKDELRTSLTHVGMHNGRKIIKVSVKDLRTNETVMEGEAEVK

SEQ ID NO: 11905 - protein, 101 aa, Neocallimastix californiae
  HotDog_dom
THPSNKVVPSMDFIIVTSWVSVFKTIFAKEFDADITRLVHMNNGYEVIDPRPLKIGELVDTRSIISAVTNLDSGKLIEVTGHVFREGKEFVKVTSSFLCRG

SEQ ID NO: 11906 - protein, 126 aa, Anaeromyces robustus
  HotDog_dom
FPKERFQYSERDVILYSLGVGITKKELSYVYENSPDFKVLPTFSTVPAMDYFSKMNLANVLPVFSPESLIQTKHYMELNKIFEPKDCVVSTGKIVDIIKTKMGAVLITAITTYDQDGNEICYNEFQ

SEQ ID NO: 11907 - protein, 145 aa, Anaeromyces robustus
  HotDog_dom
LLRHVDNYDHCPDKAPESKANTLITIPKRKPDAIVKERTSEDQAILYRLSGDKNPLHVDPAMASIAGYHSPVLQSLCVLAISTLHIIQTFCYSDVASIKSVQADFVSHVFPGETLQTNMWQDGTKILFTVKALERDVIVISNAAV

SEQ ID NO: 11908 - protein, 100 aa, Anaeromyces robustus
  HotDog_dom
HPSNKIVPSMDFIIVTSWVSVFKTIFAKEFDADITRLVHMNNGYEVIDPRPLQIGEIVDTRSIISAVTNLDSGKLIEVTGHVFREGKEFIKVTSSFLCRG

SEQ ID NO: 11909 - protein, 113 aa, Anaeromyces robustus
  HotDog_dom
PNTNEDYSLASGDVNPIHTNYYFANLADLDVPITHGMWTSAATRRYVETYAADNDAERVVSYRVNFIGMVSPKDELRTSLTHVGMHNGRKIIKVSVKDLRTNETVMEGEAEVK

SEQ ID NO: 11910 - protein, 107 aa, Anaeromyces robustus
  HotDog_dom
QAESYTDRGQKVLFAPMDFAIVVGWQSIIRAIFPKFIDADLLKLVHLSNGFRMIENETGLKEGDVVKTESRIISVVNDETGKIVEVKGVLKRDEKPFMEVISTFFYR

SEQ ID NO: 11911 - protein, 114 aa, Anaeromyces robustus
  HotDog_dom
THSSNLGYSRVSGDVNPIHTNPYFAQLADLPGNITHGMWTSASTRKFVETFAAENHPHRVTSYEVKFLDMVLPGDRLETKLFHTGMANGKKIIQCKTINQNGQVILEGTAEVEQ

SEQ ID NO: 11912 - protein, 107 aa, Piromyces finnis
  HotDog_dom
QAESYTDRGQKVLYAPMDFAIVVGWQSIIRAIFPKFINADLLKLVHLSNGFRMIDNATGLKEGDIVKTESRIISVINDENGKIVEVKGVLKRDEKPFMEVISKFFYR

SEQ ID NO: 11913 - protein, 114 aa, Piromyces finnis
  HotDog_dom
THSSNLGYSRVSGDVNPIHTNPYFAQLADLPGNITHGMWTSASTRKFVETFAAENHPQRVTSYEVNFLDMVFPGDRLETKLYHTGMANGKKIIKCKTINQNGQVILEGTAEVEQ

SEQ ID NO: 11914 - protein, 107 aa, Piromyces finnis; identical to SEQ ID NO: 11912
  HotDog_dom

SEQ ID NO: 11915 - protein, 114 aa, Piromyces finnis; identical to SEQ ID NO: 11913
  HotDog_dom

SEQ ID NO: 11916 - protein, 114 aa, Piromyces finnis; identical to SEQ ID NO: 11913
  HotDog_dom

SEQ ID NO: 11917 - protein, 107 aa, Piromyces finnis; identical to SEQ ID NO: 11912
  HotDog_dom

SEQ ID NO: 11918 - protein, 107 aa, Piromyces finnis; identical to SEQ ID NO: 11912
  HotDog_dom

SEQ ID NO: 11919 - protein, 114 aa, Piromyces finnis; identical to SEQ ID NO: 11913
  HotDog_dom

SEQ ID NO: 11920 - protein, 147 aa, Piromyces finnis
  HotDog_dom
HHLLRHVDHYDNCPEKALESKMNNTVVIPKRKPDAIVKERTSEDQAILYRLSGEKNPLHVDPAMASIAGYNSPVLQNLCVLAISTLHVIQTFCYSDVASVKSIQADFVSHVFPGETLQTNMWQEGTKILFTVKALERDIVVISNAAI

SEQ ID NO: 11921 - protein, 123 aa, Piromyces finnis
  HotDog_dom
NKEKFSYSERDVILYSLGVGITKKELSYVYENSPDFKVLPTFSTVPALDYFSKMNLSNILPIFTPETFIQTKHFMELKKIFEPKDVVVSKGKIVDIIKTKLGAVLVTAISTYDQDDNVICYNE

SEQ ID NO: 11922 - protein, 96 aa, Anaeromyces robustus
  HxxPF_rpt
NQDISFSELLKLLKLKKINNSFVFQPKVMFNNNNSENSIFSDDNNENMFTLYESSNELLNKENSKFDITFNVVENEENYLISIIYNDHLYESKIIN

SEQ ID NO: 11923 - protein, 100 aa, Anaeromyces robustus
  ICP-like
IEDQYDNTIYVESNHILKITVGDNSSTGYQWIILNEDDIRRSDYIDFIGSNYESHCQPNKYGEFPTGCGGSLTFHYRIWEVTEEDVLPNIKMAYVRPWEV

SEQ ID NO: 11924 - protein, 101 aa, Anaeromyces robustus
  Inhibitor_I42
IYVESNHILKITVGDNSSTGYQWIILNEDDIRRSDYIDFIGSNYESHCQPNKYGEFPTGCGGSLTFHYRIWEVTEEDVLPNIKMAYVRPWEVINPLPSLDF

SEQ ID NO: 11925 - protein, 207 aa, Neocallimastix californiae
  Inosine monophosphate dehydrogenase (IMPDH)
GELLMDTRYTRLTGRPPLLVGGMTPTTANPQFVSAVINAGYNVEVGCGALYAPHVLDKCIKDIVERIPDGEGILCNIVFLNQRLWAFQFPGVLDMRKNRGIRIEGITIAAGVPSLEYCNKMIPQLIDAGIPYIGFKPGNRDAILKVIQIARTFPQMPIVVEWTGGRSGGHHSCEDFYAPILETYAALRKQSNIVVVVGSGFGDDVGT

SEQ ID NO: 11926 - protein, 265 aa, Neocallimastix californiae
  Inosine monophosphate dehydrogenase (IMPDH)
KLFAPKLVKSANNGKIYVETRFSRLLGKPPLMVGGMTPTTANENLVSACINAGYHIELAGGGQHSTQMIRDRIKKIMSKVPSGEGITMNIMFLNAFQWGFQYPLVQEMRKEGVPLDGLCIAAGVPSLDVANEILGNLKACGIKHVAFKPGSVSAIQQVIAIAKQNPDMPIIMQWTGGRAGGHHSFEDFHQPIIDTYASIRRQPNIIIVVGSGFGDAEGTLPYLTGEWARKFGYPPMPFDGILFGSRILVAAEAGTSEEVKKLLVK

SEQ ID NO: 11927 - protein, 264 aa, Neocallimastix californiae
  Inosine monophosphate dehydrogenase (IMPDH)
KLFAPKLVKSANNGKIYVETRFSRLLGKPPLMVGGMTPTTANENLVSACINAGYHIELAGGGQHSTQMIRDRIKKIMSKVPSGEGITMNIMFLNAFQWGFQYPLVQEMRKEGIPLDGLCIAAGVPSLDVANEILGNLKACGIKHVAFKPGSVSAIQQVIAIAKQNPDMPIIMQWTGGRAGGHHSFEDFHQPIIDTYASIRRQPNIIIVVGSGFGDAEGTLPYLTGEWASKFGYPPMPFDGILFGSRILVAAEAGTSEEVKKLLV

SEQ ID NO: 11928 - protein, 253 aa, Neocallimastix californiae
  Inosine monophosphate dehydrogenase (IMPDH)
GELLMDTRYTRLTGRPPLLVGGMTPTTANSQFVSAVINAGYNVEVGCGALYAPHVLDKCIKEIVEKIPDGEGILCNIVFLNQRLWAFQFPGVLDMRKNRGIRIEGITIAAGVPSLEYCKKMIPQLIDAGIPYIGFKPGNRDAILKVIQIARTFPQMPIVVEWTGGRSGGHHSCEDFYAPILETYAALRKQSNIVVVVGSGFGDDVETLPFITGDWSIELGYPPMPFDGLLVGSRVCVAKEALTSDGIKEVIVN

SEQ ID NO: 11929 - protein, 264 aa, Anaeromyces robustus
  Inosine monophosphate dehydrogenase (IMPDH)
KLFAPKLVKSANNGKIYVETRFSRLLGKPPLMVGGMTPTTANENLVSACINAGYHIELAGGGQHSTQMIRNRIKKIMSNVPCGEGITMNIMFLNAFQWGFQYPLVQEMRKEGIPLEGLCIAAGVPSLDVANEILSNLKACGIKHVAFKPGSVSAIKQVIAIARQNPDMPIIMQWTGGRAGGHHSFEDFHQPIIDTYAIIRRQPNIIIVVGSGFGNAEGTLPYLTGEWARKFGYPPMPFDGILFGSRILVAAEAGTSEEVKKLLV

SEQ ID NO: 11930 - protein, 251 aa, Piromyces finnis
  Inosine monophosphate dehydrogenase (IMPDH)
GKIYVETRFSRLIGKPPLMVGGMTPTTANENLVGACINAGYHIELAGGGQHSTQMIRDRIKKIMSKVPSGEGITMNIMFLNAFQWGFQYPLVQEMRKEGIPLEGLCIAAGVPSLDVANEILANLKACGIKHVAFKPGSVSAIQQVIAIAKQNPDMPIIMQWTGGRAGGHHSFEDFHQPIIDTYAAIRRQPNIIIVVGSGFGDAEGTLPYLTGDWARKFGYPPMPFDGILFGSRILVAAEAGTSEEVKKLLV

SEQ ID NO: 11931 - protein, 251 aa, Piromyces finnis; identical to SEQ ID NO: 11930
  Inosine monophosphate dehydrogenase (IMPDH)

SEQ ID NO: 11932 - protein, 251 aa, Piromyces finnis; identical to SEQ ID NO: 11930
  Inosine monophosphate dehydrogenase (IMPDH)

SEQ ID NO: 11933 - protein, 251 aa, Piromyces finnis; identical to SEQ ID NO: 11930
  Inosine monophosphate dehydrogenase (IMPDH)

SEQ ID NO: 11934 - protein, 63 aa, Neocallimastix californiae
  Integrin alpha N-terminal domain
LRNKRAITAYALKFQNRKFTVQWTFRILDYKNKIPAGHGMVEFHSIRGVDLDGDGFDEIHLGG

SEQ ID NO: 11935 - protein, 117 aa, Neocallimastix californiae
  Integrin alpha N-terminal domain
KDSKGASYRVEHVYAGDLDGDGTYDFVVKRMSDNRDPILLEAYKLDGTFLWRMNLGPNIETYTSSLTSPVLVYDFDGDGKAEVMVKTSEGTVFGDGTKIGDVNHDGRTDYCERNRTQ

SEQ ID NO: 11936 - protein, 60 aa, Neocallimastix californiae
  Integrin alpha N-terminal domain
ALKFQNKKFTVQWTFRILDYKNKIPAGHGMVEFHSIRALDLDGDGFDEIHLGGFAIDHNG

SEQ ID NO: 11937 - protein, 116 aa, Neocallimastix californiae
  Integrin alpha N-terminal domain
GASYRVEHVYAGDLDGDGTYDFVVKRMSDNRDPILLEAYKLDGTFLWRINLGPNIETYTSSLTSPVLVYDFDGDGKAEVMVKTGEGTVFGDGTKIGDVNRDGKTDYRERNRTQYQV

SEQ ID NO: 11938 - protein, 23 aa, Anaeromyces robustus
  KAZAL_1
CGSYVEPYCNQEAILYGYPCCSE

SEQ ID NO: 11939 - protein, 259 aa, Neocallimastix californiae
  ketoacyl-synt
QVAVVGIALRLPGGINTVDKYWKSLENGRFCVSPTGTNRHLHHNMTHNEELKPGEHYIFNYCRYDSTPDAAPITDFDPMFFNMNPNEATVLDPKFRWVLETTYEVLQDAGINPDSLSGTHTNIYTAPGQVDEMNAYATNASPTGYSVLNGMSMHSCASASLPGRISFMYNLFGAAHTVDTACSSGLVAIHDAFKDLNIGETDLAIVNAAHCPFQSSSFSLLSIAKMVSRNCRCASYDEAADGYVPGEGCVSVILKRKDD

SEQ ID NO: 11940 - protein, 261 aa, Neocallimastix californiae
  ketoacyl-synt
VPIAVVGMGLRLPGGINTPSKYWNALVNGKDCISPTPANRHLHQYLRPFCPPNELGPFDHYIHRAGYYDVTPDAAPISDFDPTFFNISPLEAKFTEPKFRWIYETVYEAFQDACINVSELNGTRTSVFTTVGSTADYIALTKAFTKVESMTSQTMHGSAASSCAGRISFNYGFIGPSDTIDTACSSGLNDCHNACKSLSMGDSDVAVVSAVHQQFVSTQFHVISVAHMASQIGRCATFDAEADGYAPGEGCISIILKRLDD

SEQ ID NO: 11941 - protein, 245 aa, Neocallimastix californiae
  ketoacyl-synt
AIIGIGCHFPEGIESKEAFWKMLEDARCITKDIPKDRWDKNEWYSKEPIQGTIQTKRGAFLKNPYLFDNKYFYISMPEAKEMSPEQRWLLELTVETLEDANIKPEAVRGSRTGVFIGSSGCDYLATQISHANDINSHSPTGFELSILANRLSYVFDLQGPSISCNTACSSAFSALNIGLNAMITDDCEMALVAGSNFMNCPGGFVAFSQLRVVSPDGSCKPFDEKANGYARLEGAGMVLIKPYEK

SEQ ID NO: 11942 - protein, 257 aa, Neocallimastix californiae
  ketoacyl-synt
KKIAIIGMAFRLPGAISNSKSLWMALAKSRDCILPPVKTRDLHHGYVNKPANQLGPKEHYLARVGCYDVRPNVAKPSEFDADFFNCSPEEATALDPRHRWILETSWEALENAGIVPSSLKNTITGVFVGMNNDHEHEDLLKKCGKVPPLAAHATAQSSIAGRLSYFYELFGPSYTIDTACSTGSSALHSACQSMQCGDCDLSIVSGVKYMYSSDEFHKTCAARMTSPNSRCATFDASADGFAQSEGCVTFVLKRLED

SEQ ID NO: 11943 - protein, 245 aa, Neocallimastix californiae
  ketoacyl-synt
AVIGVGCRFPGNIKSKEDFWEMLTSGRCLTSEIPNDRWNTAEWYNKEPKRGTMQTTRGAFMEDAFYFDNKYFSISQNEAKEMSPEQRWLMELAVETFEDANINPKKLKGSRTGVFVGSSGMDFVSAQISHANDLTQHSATGLELSILANRISYFFDLNGPSICTNTACSASMTALNLAINSMITDDCDAALVAGTNLLFTPGSYVAYSQLRVVSTDGSCKPFDKNADGYSRIEGAGMILIKPYEK

SEQ ID NO: 11944 - protein, 206 aa, Neocallimastix californiae
  ketoacyl-synt
VSGQLPTGWDPARYGIPKDIIEQVDIITCYCIVSAVEALVSAGITDPYEFYEYVHVSEVGNACGSGVGAELANRAIFKDRFLDKPLQSDILQETFVNTMSAWINLLLLSSSGPIRTPVGACASAVESVDIGIDTILSGKAKVVFVGGYDDFQEEGSYEFAQMKATSNSREEMAQGREPNEMSRPTASSRGGFMEAQGVGTQVLMPA

SEQ ID NO: 11945 - protein, 257 aa, Neocallimastix californiae
  ketoacyl-synt
DKIAIIGMALRLPGTINNSKSLWMSLAKGRDCVLPPVKTRDLHHGYVNKSFNELGPDEHYLPRIGCYDTRSNAAKPSEFDASFFNCTAEEAISLDPRHRWILETSWEALENAGIAPNSLENTLTGVYVGINNEHEHEDLLKECGIVPPVASHTLNQSSIAGRLSYFYKLFGPSFTIDTACSTGSSALHTACRAMQYGECDLSIVTGVKYMYSSKEFHKTCSAHMTSPNGRCATFDESADGFAQSEGCVTFILKRLDD

SEQ ID NO: 11946 - protein, 245 aa, Neocallimastix californiae
  ketoacyl-synt
KIAIIGVGCRLPGDILTKDDFWNMLVTKRVVTTEIPADRWDRDEWYSDEPIPGTIQTKHGGFLTNAYDFDNKYFSISQAEALEITPEQRWLCELAVETMEDANIRPEELKGSQTGVFVGSAGIDFGGNQLVNTLQMSAHTMTGLEPSIFSNRISYIFDLHGPSITSNTACSASMSSLSMACNAIAVGDCDKAFVAGSNFLPSPGGYVAFSQLRVVSKTGSCKPFDEKADGYARLEGACMLLIKDY

SEQ ID NO: 11947 - protein, 222 aa, Neocallimastix californiae
  ketoacyl-synt
KKGSTIYIPKALQFDRTVAGQIPTGWKPETYGIPKSIIDQVDPITLYVIVATVEALVSSGITDPYEFYEYVHVSEVGNCSGGGVGGMVSNRKQYFERLFEKPVQNDILQECFINTMPAWINLLLLSSSGPIKTPVGACATAVESVEIGLETILSGKAKIVIVGGYDDFQEEGSYEFANMKATSNSLEELAHGRDPSEMSRPATTTRGGFMESQGAGHEILMT

SEQ ID NO: 11948 - protein, 256 aa, Neocallimastix californiae
  ketoacyl-synt
KRVAVIGMALRLPGAINNSKSFWMSLAKGRDCVLAPVKDRKLHLGYVDKPSNLLGENEHNIPKCGCYDSRSNAAKPSEFDAEFFNCLPEEVNSMDPRQRWVLETSWEAFENAGIAPNTLENTTTGVFVGVNDDHDYQDLLKENGIAQPISAHSTPSGIAGRLSYFYKLFGPSFTIDTACSTGASALHSACRSLQFGDCDLSVVSGVKYLYSASEFHRTSVARMTSPHGRCATFDKDADGFAPGEGCVTFILKRLED

SEQ ID NO: 11949 - protein, 245 aa, Neocallimastix californiae
  ketoacyl-synt
AIIGTGIRLPGEINNKDDFWKVMTDKKVITGLIPEDRWDREEWYSKVEKPGTIQTLHGGFIENAFDFDNKYFGISQNEALDATPEQRWLCELTVETVEDANMDMDDFKGSHTGVFVGTSGMDYGSYVFSVPEKITKYTYSGIEPSIHANRVSYLFNLHGPSLSTNTACSSSMTALSIACNSMAAGDCEMALVAGTNFFQAPANGVAYSQLRVVSKKGACRPFDIGADGYARLEGAAMVLLKPYEK

SEQ ID NO: 11950 - protein, 257 aa, Neocallimastix californiae
  ketoacyl-synt
NAIAIIGMGLRLPGAINNEKTLWSALVKGRDCVSNIPKDRKLHESYVNKPSNELNPGEHNVKKCGYYDSRTSGEKVSQFDAEFFNCLPEEAIGLDPKHRWILETSWEALENAGISPDSLEDSNTGVFVGIGDQQDHAQFMKECHRKKVVSYHNSNPSAIAGRLSYFYKLYGPSVTVDTACSTGATALHTACRSMIYGDCRLAMVTASKYLFYPEEFEMTSKARMTSPNGRCATFDKDADGYAPAEGCVTFILKCLED

SEQ ID NO: 11951 - protein, 256 aa, Neocallimastix californiae
  ketoacyl-synt
KIAIIGMGLRLPGAINSAKSLWLALAKGKDCVLPPIKTRDLHRNYVNKPSDQLDPTEHNIPRLGLYDTRNSVAKPSQFDAKFFNCLPDEALALDPRHRWILETSWEALENAGIPPNSLENSSTGVFVGINDDHEYSDLLTECGVKSPIAAHGQSPSGIAGRLSYFYRLYGPSFTMDTACSTGASALHTACRSLQCGDCDLSIVSGVKFMYSSKDFYMTCSARMTSPHGRCATFDKDADGFVPGEGCVTFILKRLED

SEQ ID NO: 11952 - protein, 227 aa, Neocallimastix californiae
  ketoacyl-synt
WNVKFKKGSTIYIPKALQFDRTVAGQIPTGWKPETYGIPKSIIDQVDPVTLYVIVATVEALINSGITDPYEFYEYVHVSEVGNCSGGGVGGMLSSRKEYFERAFEKPIQSDILQECFINTMPAWINLLLLSSSGPIKTPVGACATAVESVEIGLETILSGKAKIVIVGGYDDFQEEGSYEFANMKATSNALDELAHGRDPSEMSRPGTTTRGGFMESQGAGHEILMT

SEQ ID NO: 11953 - protein, 259 aa, Neocallimastix californiae
  ketoacyl-synt
QVAVVGIALRLPGGINTVDKYWKSLESGRFCISPTGTNRLLHHNLTHNEHLNPGEHYIFNYCRYDSTSDVSPITDFDPLFFNMNPSEATVLDPKFRWVLETTYEAFQDAGINPDTLSGTRTNVYTAPGQVDEMNTYTIDASPTGYSILNGMSMHSCAAASLPGRISFMYNLYGAAHTVDTACSSGLVATHDAFKDLNIGETDLAIVNAAHCPFQSSGFSLLSVAKMVSRNCRCAAYDEAADGYVPGEGCVSIILKRKDD

SEQ ID NO: 11954 - protein, 269 aa, Neocallimastix californiae
  ketoacyl-synt
NRIAIVGIGLRLPGGINSTKKFWFSLIKGKNCLSATPTDRELHLGMVDMSKKPPEYRLNKNEHYVCRYGIYDSHYASSGVKYTDFDANFFDCSTEEAISMDVKQRWMLETSWEALEDAGIDPSSIENSDTGVFIGMNNCYHQTKLLSSKKATNISSSFNPTTLHCTDLSSVAGRISYFYKIYGPAISMDTACSTGATALHTAYRSMQYGECDLAIVSGARFLYYNDEFINTSHAKMASPNGRCATFDEDADGFAPAEGCVTLILKRLDR

SEQ ID NO: 11955 - protein, 269 aa, Neocallimastix californiae; identical to SEQ ID NO: 11954
  ketoacyl-synt

SEQ ID NO: 11956 - protein, 269 aa, Neocallimastix californiae
  ketoacyl-synt
NRIAIVGIGLRLPGGINSTKKFWHSLLQGKNCLSTTPVDRQLHLGMIDMAKQQPGYKLNKNEHYIHKYGYYDSIHTASIAKPTKFDANFFECTNEEAIGMDVKQRWMLETSWEALEDAGIDPSTLENSNTGVFIGMNNSNHHIKLLSSEKATNVGPNFSSVTLHGTDLSSAAGRISYFYKLYGPAISIDTACSTGATALHTAYRSMQYGDCDLAIVSGARFLYYNDEFINISHAKMTSPKGRCATFDESADGFAPAEGCVTLILKRLDD

SEQ ID NO: 11957 - protein, 152 aa, Neocallimastix californiae
  ketoacyl-synt
WEALENAGIAPNSLENTLTGVYVGINNEHEHEDLLKKCGIVPPLGSHTLNQSSIAGRLSYFYKLFGPSFTIDTACSTGSSALHIACNAMKRGECDLSIVTGVKYMYSSKEFHKTCSAHMTSPKGRCATFDASADGFAQSEGCVTFVLKRLDD

SEQ ID NO: 11958 - protein, 206 aa, Anaeromyces robustus
  ketoacyl-synt
VSGQLPTGWDPARYGIPKDIIEQVDPITCYCIVSAVEALVSAGITDPYEFYEYVHVSEVGNACGSGVGAEIANRAIFKDRFLDKPLQSDILQETFVNTMSAWINLLLLSSSGPIRTPVGACASAVESVDIGIDTILSGKAKVVFVGGYDDFQEEGSYEFAQMKATSNSREEMAQGREPDEMSRPTASSRGGFMESQGVGTQVLMPA

SEQ ID NO: 11959 - protein, 256 aa, Anaeromyces robustus
  ketoacyl-synt
NKIAIIGMALRLPGAINNAKSFWMALAKGKDCISTPVKDRKLHLGYVNKPSHLLNENEHNIPRCGCYDSRSNVAKPSEFDAEFFNCLPEEAMALDPRHRWILETSWEALENSGIAPNSLENTITGVFLGINDSHDYHDLMKENGITPPIAAHSTPSGIVGRLSYFYKLFGPSFTIDTACSTGASALHSACRSLQFGDCDLSIVSGVKYLYTSNDFHRTSIARMTSPKGRCATFDKDADGFVPSEGCVTFILKRYED

SEQ ID NO: 11960 - protein, 256 aa, Anaeromyces robustus
  ketoacyl-synt
NKIAIIGMALRLPGAINNAKSFWMALAKGKDCVTTPVKDRKLHLGYVDKPSHLLGENEHNIPRCGCYDTRSNVAKPSEFDAEFFNCLPEEAMALDPRHRWILETSWEALENSGIAPNSLENTITGVFLGINDSHDYHDLMKENGITPPIAAHSTPSGIVGRLSYFYKLFGPSFTIDTACSTGASALHSACRSLQFGDCDLSIVSGVKYLYTSNDFHRTSIARMTSPKGRCATFDKDADGFAPGEGCVTFILKRYED

SEQ ID NO: 11961 - protein, 245 aa, Anaeromyces robustus
  ketoacyl-synt
AIIGIGCHFPEGIESKEDFWQMLEDARCITKDIPKERWDKDEWYSEEPIQGTIQTKRGAFLKNPYLFDNKYFYISMPEAKEMSPEQRWLLELTVETLEDANIKPETLKGTRTGVFIGSSGCDYLATQISHANDINSHSPTGFELSILANRLSYVFDLQGPSISCNTACSSAFSALNIGLNAMITDDCEMALVAGSNFMNCPGGFVAFSQLRVVSPDGSCKPFDEKANGYARLEGAGMVLIKPYEK

SEQ ID NO: 11962 - protein, 257 aa, Anaeromyces robustus
  ketoacyl-synt
EKIAIIGMSLRLPGSINSAKSFWMALAKGKNCVLPPVKNRDLHHGYVNKPSDQLNPGEHNIPYIGCYDTRSNVAKPSQFDAEFFNCLPDEALALDPRHRWVLETSWEALENAGIPPNSLEDSLTGVFVGMSQDHEYADLLAERNIIAPIAAHSNTQSGIAGRLSYFYRLYGPSLTMDTACSTGGSAIHTAVRSLQNRDCNLSIVSCVRYMYTSKTFYKTCAARMTSPHGRCATFDKDADGFASGEGCVCFVLKRLDD

SEQ ID NO: 11963 - protein, 260 aa, Anaeromyces robustus
  ketoacyl-synt
PIAVIGMGIRLPGGINTPGKYWSALVSGRDCTSPTPTNRHLHHYLKPGCPANELGPMEHYIHRGGFYDTTPDAAPLSDFDPTFFNISPLEAKATDPKFRWVYETVYEAFQDACINISELNGSRTSVYCTVGQILDYVSVARAFNKSENMTSQTMHGSNPSSCAGRIAFNYGFTGPSDTIDTACSSGLNDVNNACKALSCGDTDLAVVSAVHQQIIGTQFHVISVAQMASHLGRCATFDAEADGYAPGEGCISLILKRLDE

SEQ ID NO: 11964 - protein, 259 aa, Anaeromyces robustus
  ketoacyl-synt
QVAVVGIALRLPGGINTVDKYWDVLVNGKFCATPTGTNRHLHHYMTTAEHLKPGEHYVTKYCRYDSTPDAAPITDFDPMFFNMNPSEAAALDPKFRWVLETTYEALQDACINPDSLSGTRTNIYTAPGQVHEMNNYTTSASPTGFSVLNGQSMHGVACASLPGRISFMYNLYGAAHTVDTACSSGLVAAHDAFKDLNIGETDLAIVNAAHCPFIGSGFSLLSIAQMVSRNCRCAAYDEAADGYVPGEGCVTVILKRKDD

SEQ ID NO: 11965 - protein, 216 aa, Anaeromyces robustus
  ketoacyl-synt
IPKALQFDRTVAAQIPTGWKPETYGVPKNIIDQVDPITLYVIVATVEALVSSGITDPYEFYEYVHVSEVGNCSGGGVGGMVSTHKEYFDRAFEKPVQSDILQESFINTMPAWINLLLLSSSGPIKTPVGACATAVESVDIGVETILSGKAKIVIVGGYDDFQEEGSYEFAQMKATSNSLDELAHGRDPSEMSRPATTTRSGFMEAQGAGHEILMKA

SEQ ID NO: 11966 - protein, 245 aa, Anaeromyces robustus
  ketoacyl-synt
KIAIIGVGCRLPGDITTKEDFWNMLVTKRVVTSEIPADRWDREEWYSKEPIPGTIQTKHGGFLSNAYDFDNKYFSISQAEALEITPEQRWLCELAVETMEDANIRPEELKGSQTGVFVGSAGIDFGGNQLVNTLQMSAHTMTGLEPSIFSNRISYIFDLHGPSITSNTACSASMSSLSMACNAIAVGDCDKAFVAGSNFLPTPGGYVAFSQLRVVSKTGSCKPFDEKADGYARLEGACMLLIKDY

SEQ ID NO: 11967 - protein, 257 aa, Anaeromyces robustus
  ketoacyl-synt
EKIAIIGMALRLPGAINNAKSLWMTLLKGKNCVVAPVKNRDLHTNYVNKPSNQLLPNEHNIPYFGCYDTKSNVAKPSQFDAEFFNCLPDEALSLDPRHRWILETTWEALENAGIPINSLKNTTTGVFVGINDDHEYSDLLEENGISIPISSHSNHPSDIAGRLSYFYNLYGPSYTMDTACSTGASAIHVACRSLQNRDCNLCMVTGVKYMYSSKSLSKACSARMISPHGRCATFDIDADGFVPGEGCVTYILKRLND

SEQ ID NO: 11968 - protein, 264 aa, Anaeromyces robustus
  ketoacyl-synt
IAIVGIGLRLPGGINSTQKFWLSLIKGRNCLSNTPTDRQLHQGFVDMQKNPNKNLDINEHYIGKYGYYESVRGTAKPTDFDADFFECSKDEAIGMDVKQRWILETSWEALEDAGIDPSIIENSNTGIFVGMNNCNHHVKLMASKEATNINSNYNSITTHGTELCSVAGRLSYFYKLYGPAISIDTACSTGATAVHVACRSIQMGECDLAIVSGARYLYYNDEFINTSHAKMTSPNNRCATFDESADGFASSEGCVTLILKRLDE

SEQ ID NO: 11969 - protein, 259 aa, Piromyces finnis
  ketoacyl-synt
QIAVVGIALRLPGGINTVDKYWNSLVDGRFCISPIGTNRHLHHYMSKEENLKPGEHYIYNYGRYDSTPDAAPISDFDPMFFNMNPNEASALDPKFRWVLETTYEAFQDAGIDPDVLSGTNTSVYTAPGQVDEMNRYAILASDTGFSVLNGMSMHSCAAASLPGRISFMYNLLGAAHTVDTACSSGLVATHDAVKDLNLGETDLAIVNAAHCPFMSSGFSLLSVAKMVSRNCRCAAYDEAADGYVPGEGCVTIILKRKDD

SEQ ID NO: 11970 - protein, 257 aa, Piromyces finnis
  ketoacyl-synt
NKIAIIGMALRLPGAINNSKSLWMALAKGKDCVLPPVKTRDLHTRYANKSADQLELDEHYLPRIGCYDTRNSVAKPSEFDASFFNCLPDEAVALDPRHRWILETSWEALENAGIAPNSLKKTTTGVFIGINNEHEHEDLLHDCGIIPPLASHATAQSSIAGRLSYFYQLFGPSYTIDTACSTGSSALHSACQSLQCNDCNLSIVTGVKYMYSSKEFHKTCSARMTSPNGRCATFDASADGFAQSEGCVTFILKRFDD

SEQ ID NO: 11971 - protein, 156 aa, Piromyces finnis
  ketoacyl-synt
LETSWEALENANIAPNSLENSSTGVFVGINDDHEYSDLMTECGIETSIASHGSSPSGIAGRLSYFYRLYGPSFTIDTACSTGATALHTACRSLQHHDCNLSIVSGVKYMYSSKNFYKTCAARMTSPHGRCATFDKDADGFVPSEGCVTFILKRLDD

SEQ ID NO: 11972 - protein, 105 aa, Piromyces finnis
  ketoacyl-synt
EKIAIIGMGLRLPGAINNAKSLWMSLAKGKDCVLPPLKNRDLHRNYVNKPSELLDPSEHNIPRLGLYDTRSNVAKPSQFDAAFFNCLPDEALSLDPRHRWILETS

SEQ ID NO: 11973 - protein, 245 aa, Piromyces finnis
  ketoacyl-synt
KIAIIGVGCRLPGDISTKEDFWNMLVTKRVVTSEIPSDRWDREEWFSEDPVPGTIQTKCGGFITNAYDFDNKYFSISQAEAFEITPEQRWLCELAVETMEDANIRPEELKGSQTGVFVGSAGIDFGGTQLANTLQMSAHTMTGLEPSIFSNRISYIFDLHGPSITSNTACSASMSSLSMACNAIAVGDCDKAFVAGSNFLPTPGGFVAFSQLRVVSKTGSCKPFDEKADGYARLEGACMLLIKDY

SEQ ID NO: 11974 - protein, 238 aa, Piromyces finnis
  ketoacyl-synt
VPIAVIGMGIRLPGGINTPTKYWNALVNGKDCISPTPNNRHLHHFLRPNCPHNELGPYDHYVHRAGYYDVVPDAAPITDFDPTFFNISPLEAKFTEPKFRWVYETVYEAFQDACIDISELNGSRTGIYCTVGGTFDYIGLTKAFVSGQTMTSQTMHGSAASSCAGRIAFNYGFIGPSDTVDTACSSGLNDVNNACKSLSCGDTDIAVASAVHHQYVSTQFHVISVAHMASQTGRCATF

SEQ ID NO: 11975 - protein, 29 aa, Piromyces finnis
  ketoacyl-synt
GRCATFDASADGYAPGEGCISLVLKRLDD

SEQ ID NO: 11976 - protein, 245 aa, Piromyces finnis
  ketoacyl-synt
AIIGTGIRLPGDINNKDDFWKVMIEKKVITGLTPEDRWDRDEWYCKTEKPGTIQTLYGGFIENAFDFDNKFFSISQKEALDATPEQRWLCELTVETIEDANINIDKFKGSNTGVFVGTSGIDYGSYVFSVPEKITKYTYSGIEPSIHANRVSYLFDLHGPSLSTNTACSSSLTALSIACNSMAAGDCEMAIVAGTNFFQAPANGVAYSQLRVVSKKGACRPFDSGADGYARLEGAGMVLLKPYEK

SEQ ID NO: 11977 - protein, 219 aa, Piromyces finnis
  ketoacyl-synt
SSIYIPKALQFDRTVAAQIPTGWKPETYGVPKSIIDQVDPITLYVIVATVEALISSGITDPYEFYEYVHVSEVGNCSGGGVGGMTSNHKQYFDRVFEKPVQSDILQECFINTMPAWINLLLLSSSGPIKTPVGACATAVESVEIGLETILSGKAKIVIVGGYDDFQEEGSYEFAQMKATSNSLEELAHGRDPSEMSRPATTTRAGFMEAQGAGHEILMT

SEQ ID NO: 11978 - protein, 219 aa, Piromyces finnis; identical to SEQ ID NO: 11977
  ketoacyl-synt

SEQ ID NO: 11979 - protein, 219 aa, Piromyces finnis; identical to SEQ ID NO: 11977
  ketoacyl-synt

SEQ ID NO: 11980 - protein, 219 aa, Piromyces finnis; identical to SEQ ID NO: 11977
  ketoacyl-synt

SEQ ID NO: 11981 - protein, 245 aa, Piromyces finnis
  ketoacyl-synt
AVIGIGCHFPEGIESKESFWKMLEDGKCITKDIPKERWDKDEWYSKEPVQGTIQTKRGAFLENPYLFDNKYFYISMPEAKEMSPEQRWLLELTVETLEDANIKPETLKGSRTGVFIGSSGIDYLVTQISHANDINSHSPTGFELSILANRLSYVFDFQGPSISCNTACSSAFSALNIGLNAMITDDCEMAIVAGSNFMSCPGSFVAYSQLRVVSKDGSCKPFDEKADGYAKLEGAGMILVKPYEK

SEQ ID NO: 11982 - protein, 245 aa, Piromyces finnis
  ketoacyl-synt
AVIGVGCRFPGNIKSKEDFWEMLTTGRCLTSETPKDRWDSAEWYNKEPKRGTVQTTRGAFMEDAFYFDNKYFSISQNEAKEMSPEQRWLLELAVETFEDANINPKKLKGSRTGVFVGSSGMDFVAAQISHANDLTQHSATGLELSILANRISYYFDLNGPSICTNTACSASMTALNLAINSMITDDCDAALIAGTNLLFTPGSCVAYSQLRVVSVDGSCKPFDKRADGYSRVEGAGMLLIKPYEK

SEQ ID NO: 11983 - protein, 257 aa, Piromyces finnis
  ketoacyl-synt
NSIAIIGMGLRLPGAINSDKSLWSTLVKGRDCITAIPKDRKLHENYVDKQSSELNMGEHNVKRCGYYDSRSSGKKISQFDAEFFNCLPDEAIGLDPKHRWILETSWEALENAGISPESLENTDTGVFVGIGDQQEHVKFMQECQKEKVVAHHNSNPSAIAGRLSYFYKLYGPSVTVDTACSTGATALHTACRSMIFGDCNLSIVTASKFLFYSEEFEMTSKARMTSPSGRCATFDKNADGYVPAEGCVTFILKRLED

SEQ ID NO: 11984 - protein, 117 aa, Neocallimastix californiae
  Ketoacyl-synt_C
YGLINATAVGQSGSRASMSTPTVLGQKYIHKKVLEKANLTPGDIDYMEGHGTGTKLGDRIEAEAINEVFKGTHSESRPLTLASVKTNIGHTEEVSGLASLVKVLLAMKHKTVPPHLH

SEQ ID NO: 11985 - protein, 118 aa, Neocallimastix californiae
  Ketoacyl-synt_C
YGVITGITTSQSGIRPSISSPAVGPQVENIQKALQIANVSPADVDYVEAHGTGTQVGDAIETETLNIAFGGTHNAKKPLIVGSVKTNIGHTEEVSGLAGLCKVLLSMSHRTIPPHLHL

SEQ ID NO: 11986 - protein, 121 aa, Neocallimastix californiae
  Ketoacyl-synt_C
YCAIVGCGSNEDGRSPSLTMPSYEAQYKLLSHVCEKSGILPSEIDYVEAHGTGTKVGDPIESHAIGDAYGRSKGVRGPNDPPVLVSSVKGNTGHGENSSGIVSIIKTSLMLHKRKLVPTVA

SEQ ID NO: 11987 - protein, 116 aa, Neocallimastix californiae
  Ketoacyl-synt_C
SVILGSSSGQSGLRQSISAPSSEGQRITIQRAMKVAGITPDQVSYVEAHGTGTPLGDAIEVHALNQVYAGSHTEENPLVVGSIKSNIGHTCEAAGLAGIAKVIVAMKHNTIPKNIH

SEQ ID NO: 11988 - protein, 135 aa, Neocallimastix californiae
  Ketoacyl-synt_C
YCAILGSGTNEDGHTPSLTMPSYSSQCKLLTHVCEKFDIDPASIDYVEAHGTGTAVGDPIEARSIGYAYGRRVREGKQIKTTRPGETEEILDQPTFPLLIGSSKGNTGHGEYSSGIIGMIKAILMLYHRTMVPTI

SEQ ID NO: 11989 - protein, 115 aa, Neocallimastix californiae
  Ketoacyl-synt_C
VILSSVSGQSGFRQSISAPSYEGQAINIERAMKIAGIKPEQVSYVEAHGTGTPLGDAIEIHALNKVYGGSHTEENPLIVGSIKSNIGHTCEAAGLAGIAKVIVSMKHNLIPKNIH

SEQ ID NO: 11990 - protein, 119 aa, Neocallimastix californiae
  Ketoacyl-synt_C
YACIIGSGTNEDGRTLSITMPSSDAQCTLMKWVCEKSNIKADTIDYVEAHGTGTPTGDPIEARSIGNAFGKAVRAPGSKPLPVGTVKGNVGHGEFLSGAIGLLKTSLMLFNKQLVPTAA

SEQ ID NO: 11991 - protein, 89 aa, Neocallimastix californiae
  Ketoacyl-synt_C
LRGALAVFGLTIDDIEALSFHGTGTKANDTNESEVINKQFKHLGRSKGNVCPAIMQKYLTGHPKGAAASWMLNGMLQVIETGIIPGNRN

SEQ ID NO: 11992 - protein, 116 aa, Neocallimastix californiae
  Ketoacyl-synt_C
SVILGTSSGQSGLRQSISAPSSDGQVLNLKRALKFAGVDPSEVSFVEAHGTGTPLGDAIEVDALNQVYGGSHTEENPLVIGSVKTNIGHTNEAAGLAGMAKVILAMQHKYIPKNLH

SEQ ID NO: 11993 - protein, 119 aa, Neocallimastix californiae
  Ketoacyl-synt_C
YATILSTACNEDGKTSSLTTPSSEAQCQLMKRVYSKGHIDPCTIDFVEAHGTGTSVGDPIEARSIGEAYGKVNKANGHPLLPVGSVKGNVGHGEYLSGIVGLIKGALILHKNTIVPQTA

SEQ ID NO: 11994 - protein, 118 aa, Neocallimastix californiae
  Ketoacyl-synt_C
LGVILGTSSGQSGFRQSISVPSFEGQARNIKRVMEIAGVNPSDISYVETHGTGTPYGDAIEIQGINQVYAGSHTPEHPLVIGSIKTNIGHTAETSGLAGIAKVLVAMKNKTIPRHLHF

SEQ ID NO: 11995 - protein, 116 aa, Neocallimastix californiae
  Ketoacyl-synt_C
SVVLSTSSGQSGLRQSISAPSSEGQAINMRKAMKFAGIKPEDVSYVEAHGTGTPLGDALEVHALNEIYGGSHTEENPLVVGSIKTNIGHTCETAGLAGIAKVIVSMQHKHIPRNLH

SEQ ID NO: 11996 - protein, 89 aa, Neocallimastix californiae
  Ketoacyl-synt_C
LRGALAVFGLTMDDIDALSFHGTGTKANDTNESEVINKQFKHLGRSKGNVCPAIMQKYLTGHPKGAAASWMLNGMLQVIETGIIPGNRN

SEQ ID NO: 11997 - protein, 118 aa, Neocallimastix californiae
  Ketoacyl-synt_C
YGLINATAVGQSGSRASMSTPSAIGQKIIHEEVLKNANLTPKDIDYMEGHGTGTKLGDRIEGEAINEVFKGSHSESRPLTLASVKTNIGHTEEVSGLASLVKVLLAMKYKTIPPHLHF

SEQ ID NO: 11998 - protein, 118 aa, Neocallimastix californiae
  Ketoacyl-synt_C
YGILLGSSNGQSGGRQSISVPSSEAQVRNIKNALKDAHVSPKDISFVEAHGTGTPYGDAIEIHALNQIFKDSHSKKSPLYIGSVKTNIGHTCEAAGLAGIVKVLLSMKHNVIPKHINF

SEQ ID NO: 11999 - protein, 118 aa, Neocallimastix californiae; identical to SEQ ID NO: 11998
  Ketoacyl-synt_C

SEQ ID NO: 12000 - protein, 118 aa, Neocallimastix californiae
  Ketoacyl-synt_C
YGILLGSSNGQSGGRQSISVPSSEAQVRNIRNALMDAQISPKDISYIEAHGTGTPYGDALEIHALNQVFGESHTKNSPLYIGSVKTNIGHTCEAAGLAGIVKVLLSMKHQIIPKHINF

SEQ ID NO: 12001 - protein, 70 aa, Neocallimastix californiae
  Ketoacyl-synt_C
TVILGSVSGQSGLRQSISAPSYEGQALNIERAMKIAGISPDQVSYVEAHGTGTPLGDAIEIHALNEVYAG

SEQ ID NO: 12002 - protein, 89 aa, Anaeromyces robustus
  Ketoacyl-synt_C
LRGALAAFGLTVDDIGVASFHGTGTKANDKNESDVFNKQFEHLGRTKGNACPVVCQKYLTGHGKGAAAAWMLNGVIQIIQTGIIPGNRN

SEQ ID NO: 12003 - protein, 116 aa, Anaeromyces robustus
  Ketoacyl-synt_C
SVILGTSSGQSGIRQSISAPSSDGQVINLKRALHFAGVDPSDISFVETHGTGTPLGDAIEVNALNQVYKGTHTSENPLIIGSVKTNIGHTTEVAGLAGVAKVILSMQHKYIPKNLH

SEQ ID NO: 12004 - protein, 116 aa, Anaeromyces robustus
  Ketoacyl-synt_C
SVILGTSSGQSGIRQSISAPSSDGQVINLKRALHFAGVNPSDISFVETHGTGTPLGDAIEVNALNQVYKGTHTSENPLVIGSVKTNIGHTTEVAGLAGVAKVILSMQHKYIPKNLH

SEQ ID NO: 12005 - protein, 121 aa, Anaeromyces robustus
  Ketoacyl-synt_C
YCAIVGCGSNEDGRSPSLTMPSYEAQYKLLTHVCEKSGIHPTQIDYVEAHGTGTKVGDPIESRAIGDAYGKSKGIRGPNDPPILISSVKGNTGHGENSSGIVSIIKTSMMLHKRRLVPTVA

SEQ ID NO: 12006 - protein, 116 aa, Anaeromyces robustus
  Ketoacyl-synt_C
SVIIGTSSGQSGLRQSISAPSSEGQAINIKRAMEIADIKPEDVSYVEAHGTGTPLGDALEIHSLNQVYAGSHNEENPLVVGSVKTNIGHTGEVAGLASIAKVILAMQHKHIPKNLH

SEQ ID NO: 12007 - protein, 118 aa, Anaeromyces robustus
  Ketoacyl-synt_C
YGVITGISTAQSGTRRSISTPAVGPQAENMRRVLSMANINASDVDYLEAHGTGTPVGDAIETETLNLVFGKTHTEKKPLIVGSVKTNLGHTEEVSGLAGLCKVLLSMSHRIIPPHLHL

SEQ ID NO: 12008 - protein, 118 aa, Anaeromyces robustus
  Ketoacyl-synt_C
YGLINAAAVGQSGSRSSMSTPTVEGQSRIHKEVLKLAHLEPKDIDYMEGHGTGTSLGDRIEGEAINLIFKGTHSETRPLTLASVKTNIGHTEEVSGLASLVKVLLAMKNKTVPPHLHF

SEQ ID NO: 12009 - protein, 89 aa, Anaeromyces robustus
  Ketoacyl-synt_C
LRGALAVFGLTIDDIDALSFHGTGTKANDTNESEVINKQFKHLGRSKGNVCPAIMQKYLTGHPKGAAASWMLNGMLQVIETGIIPGNRN

SEQ ID NO: 12010 - protein, 119 aa, Anaeromyces robustus
  Ketoacyl-synt_C
YATIIGSGTNEDGRTLSITLPSSDAQCALMKWVCEKSNIKADTIDYVEAHGTGTPTGDPIEARSIGNAFGKVVRTPGSKPLPVGTVKGNVGHGEFLSGAIGLLKTSLMLFNKQLVPTAA

SEQ ID NO: 12011 - protein, 116 aa, Anaeromyces robustus
  Ketoacyl-synt_C
SVIIGSSSGQSGLRQSISAPSSEGQALNIRKAMEFAQVKPEDISYVEAHGTGTPLGDAMEIHALNEVYAGTHSKENPLIVGSIKTNIGHTCEVAGLAGLAKVIVSLQHKHIPRNLH

SEQ ID NO: 12012 - protein, 117 aa, Anaeromyces robustus
  Ketoacyl-synt_C
YGVILGSSNGQSGGRQSISVPSSEAQERNIRNAMKNANVSPKDISYIEAHGTGTPYGDALEIHAINQIFGHTHTQDSPLYIGSVKTNIGHTCEASGLAGLVKVLLSMKHQLIPKHIN

SEQ ID NO: 12013 - protein, 118 aa, Piromyces finnis
  Ketoacyl-synt_C
YGLINAAAVGQSGSRASMSSPTVIGQTNIHKQVLKKAGVNPSDIDYMEGHGTGTKLGDRIEAEAINNVFKGSHSKERPLVLASVKTNIGHTEEVSGLASLVKVLLAMKNKTVAPHLHF

SEQ ID NO: 12014 - protein, 117 aa, Piromyces finnis
  Ketoacyl-synt_C
LAVVLGSASGQSGLRQSISAPSSEGQTVSIKRAMEKAGITPEQVSFVEAHGTGTPLGDALEVHALNQVYGGSHTEENPLIVGSIKSNIGHTCEAAGLASIAKVIVAMKYNLIPRNIH

SEQ ID NO: 12015 - protein, 116 aa, Piromyces finnis
  Ketoacyl-synt_C
SVILSTSSGQSGLRQSISAPSSEGQAINMRKAMEFAGIKPEDVSYIEAHGTGTPLGDALEVHALNEIYAGSHTEENPLVVGSIKTNIGHTCETAGLAGIAKVIVSMQHKYIPKNLH

SEQ ID NO: 12016 - protein, 119 aa, Piromyces finnis
  Ketoacyl-synt_C
YATIISSGTNEDGRTLSITLPSSDAQCALMQWVCEKSNIKADTIDYVEAHGTGTPTGDPIEARSIGNAFGKKVRSPNSKPLPVGTVKGNVGHGEFLSGAIGLLKVSLMLFNRQLVPTAA

SEQ ID NO: 12017 - protein, 66 aa, Piromyces finnis
  Ketoacyl-synt_C
TGTPLGDAIETETLNKAFGGSHTEKKPLVVGSVKTNIGHTEEVSGLAGLTKVILSMSHRIIPPHLH

SEQ ID NO: 12018 - protein, 66 aa, Piromyces finnis; identical to SEQ ID NO: 12017
  Ketoacyl-synt_C

SEQ ID NO: 12019 - protein, 56 aa, Piromyces finnis
  Ketoacyl-synt_C
YGVITGISTSQSGSRPSISSPAIIPQVMNIKNALQIANVTPEEVDYVEAHGTGTPL

SEQ ID NO: 12020 - protein, 91 aa, Piromyces finnis
  Ketoacyl-synt_C
YATILSTACNEDGKTASLTTPSSKAQYKLMKRVYEKGHIDPCTIDFIEAHGTGTAVGDPIEASSIGEAYGKINKANGNPAIPVGSVKGNVG

SEQ ID NO: 12021 - protein, 89 aa, Piromyces finnis
  Ketoacyl-synt_C
LRGALAVFGLTIDDIQALSFHGTSTKANDSNESEVFNKQFKHLGRTKGNACPVITQKYLTGHPKGAAASWMLNGMLQVIETGIIPGNRN

SEQ ID NO: 12022 - protein, 89 aa, Piromyces finnis
  Ketoacyl-synt_C
LRGALAAFGLTVDDIGVASFHGTGTKANDKNESDVFNKQFEHLGRTKGNACPVVCQKYLTGHGKGAAAAWMLNGVIQILQTGIVPGNRN

SEQ ID NO: 12023 - protein, 89 aa, Piromyces finnis; identical to SEQ ID NO: 12021
  Ketoacyl-synt_C

SEQ ID NO: 12024 - protein, 89 aa, Piromyces finnis; identical to SEQ ID NO: 12022
  Ketoacyl-synt_C

SEQ ID NO: 12025 - protein, 121 aa, Piromyces finnis
  Ketoacyl-synt_C
YCAIVGCGSNEDGRSPSLTMPSYEAQYKLLTHVCEKSGINPTQIDYVEAHGTGTKVGDPIESHAIGDAYGRGKGIRGPNDPPVLVSSVKGNTGHGENSSGIVSIIKTSMMLYKRKLVPTAA

SEQ ID NO: 12026 - protein, 135 aa, Piromyces finnis
  Ketoacyl-synt_C
YCAILGSSTNEDGHTPSLTMPSYDSQCKLLTHVCEKFDIDPASIDYVEAHGTGTAVGDPIEARSIGYAYGRRVREGKQIKTTRPGETEEILDQPTYPLIIGSSKGNTGHGEYSSGIIGMIKAVLMLHHRTMVPTI

SEQ ID NO: 12027 - protein, 118 aa, Piromyces finnis
  Ketoacyl-synt_C
LGVILGTSSGQSGFRQSISVPSSEGQARNIERAMAVAGVQPSDISYIEAHGTGTPYGDAIEIQGINQVYAGSHTSEHPLVIGSIKTNIGHTAETAGLASIAKVLLAMKNKTIPRNLHF

SEQ ID NO: 12028 - protein, 183 aa, Neocallimastix californiae
  KR
GTILITGGLGGVGFDISRYLMRQPNLKALVLTGRRPETDEKVAGKLAELRALNPKIKITYVTANVGSETEMKKVIDDINAGSPEEALVGVFHTAGTNDDGLIFNQSYERFAKLINSKIEGTLCIAKLTNDLNLKFTILFSSMTAFFGNRGQINYCTANMFINKVCDYYRNHGRKDILSLELAG

SEQ ID NO: 12029 - protein, 192 aa, Neocallimastix californiae
  KR
GNILITGGLGDVSMDVVNSLLADKDSKLEHIFLLGRSSKTNSRVIEKLARIEKVRKDHDKNIQIEYYSCDISDESSLAEVFNDIRKRQGLQITGIFHTAGVNSDANFLSQSYEKLVEIAPSKIIGTHNIMKLSEEFKDELKFVVFVSSLSAVSGNGGQTNYTAANMFIDALARYYNDHGRTNVIAIELGGWK

SEQ ID NO: 12030 - protein, 177 aa, Neocallimastix californiae
  KR
TYLITGAFGGVGLRVVLWLVSRGAKNILLTTSSSVEKQYEQPIIRSLLEKGINVMIKTCDITDLTSVQQLFQQTTPRIAGVFHLANRFAPGLISTSDLALLRKGFSAKAEGAWNLHLVTLQKAHQVQLFVVFSSILDVLGNRGQTAYGAANAFLSSIVDHRREKGLSGNCIALPAMR

SEQ ID NO: 12031 - protein, 173 aa, Neocallimastix californiae
  KR
YLITGAFGGVGLRVAEWLQLRGAKNIVLTTSGNIEKRNRNPIVETLRSKGVHVTVTQCDISNIHAVRKLFQETTPQIAGIFHLANKFAPGLIQRTSLEQFHVAYNPKARGALNLHLVSKDYPIDMFVMFSSVLDLLGNKGQAAYGAANSFLGSLVELRRSQGLCGSCLSLPAM

SEQ ID NO: 12032 - protein, 175 aa, Neocallimastix californiae
  KR
SYLVTGAFGGVGLRVCLWMQLRGAHHLVLTTSSNPESKKDHPIVKALRQRGAQVSIVKCDISKYDEVEKLFKETSPSLDGVFHFANKFGPKLIRDSGLESFIATYEPKARGALNLHKISQKGYPLSTFVLFSSVLDLLGNTGQIAYGGANAFLGNLVYYRRRQGLSGQCFSLPAM

SEQ ID NO: 12033 - protein, 185 aa, Neocallimastix californiae
  KR
GTVLITGGTGGVGFDICRYLVKQANLKGLVLTGRRPETDEKVAGRLAEIRALNPKIKITYVTANVGSEQEMKKVFDDINSGSPEEALVGVIHTAGTNDDGLIFNQSYERFAKLINSKIEGALCIAKLTEGLNLKFTILFSSMTAFFGNRGQINYCTANMFLNKVCQFYRSHNGRKDIMSLELAAW

SEQ ID NO: 12034 - protein, 175 aa, Neocallimastix californiae
  KR
SYLVTGAFGGVGLRVCLWMQLRGAHHLVLTTSSNPEMKYHHPIVNALRQRGAEVTIVKCDISKYNEVEKLFKETTPVIDGVFHFANKFGPKLIRDSNLSGFISTYEPKARGALNLHKVSQQGYPLSNFVLFSSVLDLLGNTGQIAYGGANSFLGNLVYYRRSKGLSGQCFSLPAM

SEQ ID NO: 12035 - protein, 192 aa, Anaeromyces robustus
  KR
GNLLITGGLGDISIDIMKYFFSLDHCKLDHIFLIGRSSKSSAKVNDKLARLDKSMKDNGKNIDIQYYPCDISNEAALAEVFNDIRKRQGLQINGILHTAGTNSDASFINQTYDKLVEIAPAKIHGTHNIIKLTEEFNDEIKYIVLFSSITALSGFSGQTNYTAVNLFIDNIAKYCKNHGRDNVMSIELTIWE

SEQ ID NO: 12036 - protein, 183 aa, Anaeromyces robustus
  KR
GTILITGGLGGVGYDVSKYLITKPNLKALVLTGRRPETDEKVAAKLNDLRSASKNVKIIYAVANVNSEEEMKKLFDDIAASENPLTGIIHTAGTNDDGLIFNQSYERFMKLVPGKVEGPLIITKLTKDIPNLKFTILLSSMSSFFGNRGQINYTTSNVFINKLCRYYRAHGRKDMVALQLAAW

SEQ ID NO: 12037 - protein, 174 aa, Anaeromyces robustus
  KR
SYLITGAFGGVGLRVALWLQLRGAKNIILTTSGNAEKRNKNPIVEGLRNKGVNVLVRQCDISDINAVRKLFQEANPPIAGIFHLANKFAPGLIERTSLEQFHVAYNPKARGALNLHLVSKNYPVDMFVMFSSVLDLLGNKGQAAYGAANSFLGSLVELRRSQGLCGSCLSLPAM

SEQ ID NO: 12038 - protein, 181 aa, Piromyces finnis
  KR
GTILITGGLGGVGYDISRFLMKQPNLKGLVLTGRRPETDEKVAAKLSSIREVNKAIKVTYITVNVGSQTEMKEVISGIKASGSKLTGIIHTAGVNDDGLIFNQSYERFAKLINSKIEGSHCIAKITEGMNLEFILLFSSMTSFFGNRGQINYCVANMFVNKIAHYYRSHGRKDIITLQLAV

SEQ ID NO: 12039 - protein, 175 aa, Piromyces finnis
  KR
SYIITGAFGGVGLRVALWLQLRGAKNIVLTTSGNAAKRNKNPIVEGLRSKGVNVTVCQCDISNINAVRKLFQETTPQVGGIFHLANKFLPGLIPRTSLEQFHIAYDPKAKGALNLHLVSKDYPIDMFVLFSSVLDLLGNKGQAAYGAANSFLGSLVEFRRSKGLCGSCISLPAMK

SEQ ID NO: 12040 - protein, 192 aa, Piromyces finnis
  KR
GNLLITGGLGDVSMDVIENLLSDKETKLDHIFLLGRSSKTSTKVEDKLDRIEKIKKANNKKTEVEYYCCDISNGDSLNDVFNDIRKRQGLQINGIFHTAGTNDDTLFLTQTYEKFEKLAPAKVIGTHNIIKYTEDFKDELKFIILTSSLTALSGLTGQTNYTAANMFIDAIARYCRNHGRNNVMSLELCGWS

SEQ ID NO: 12041 - protein, 175 aa, Piromyces finnis
  KR
SYLITGAFGGIGLKVGLWMQLRGARHIVLTTSSDPESKYKHPIVNALRQKGVHVTITKCDISKYDEVEKLFMETTPAIDGVFHFANKFGPKLIRDSSLDSFNTAFEPKARGALNLHKISQKGFSLSSFVLFSSVLDILGNSGQMAYGAANSYLNNLIYYRRRKGLSGQCFSLPAM

SEQ ID NO: 12042 - protein, 177 aa, Piromyces finnis
  KR
TYLVTGAFGGVGLRVVLWLVSRGAKNLLLTTSGSVEKQYEQPIIRSLIEKGVNVMIKTCDITDYNNVQQLFQQTQPRVAGVFHLANRFAPGLISTSDLALLRKGFNAKAEGAWNLHKVTAQKQHQVQLFVVFSSILDVLGNRGQTAYGAANAFLSSIIDHRRENGLSGNCIALPAMR

SEQ ID NO: 12043 - protein, 84 aa, Piromyces finnis
  KR
SYLITGAFGGIGLKVGLWMRLRGARHIVLTTSSDPESKYKHPIVNALRQKGVHVTITKCDISKYDEVEKLFMETTPAIDGVFHF

SEQ ID NO: 12044 - protein, 254 aa, Neocallimastix californiae
  L domain-like
QDSKIVKVHMADLYLDDKPISEQFCHLNSLISLELINNGLAGNLPACLTSLNTLEYLNLTGNKLTGSILSDIDKLRNLKELTLSKNNLSGKLPEAIGNIASLEYLYLDNNQITGILPNSLDNLASIKAIDLSFNQFYGSLPEEIYNLESLEQLYLNDNGFSGSISEDLGSFSVITELDITNNMFVGKIPETIGYLQNLEWLSVAGNQFSDEFPVNLGKLRYLTHLDISDNNFLSLPESLKRLKYLNYIDLSDNK

SEQ ID NO: 12045 - protein, 252 aa, Anaeromyces robustus
  L domain-like
NQEMLNDCCDNLTFKCQDNSITEIALQNANLSGSLSKTLGEISSLEILNLSTNQLTGSLPYSIGELNLLKTLYLYDNNISGSIPSSIGNLSDLKKLFLHNNEITGKIPESIGDMKNLIDLNLGNNKISGNIPKSIGSLKSIEAISISYNSLTGKIPDSIGKLETLRTLNLENNQLSSTIPESLGDLKKLSTLYLNDNKLSGSIPSSFGNLSNIEDLYLNNNKLSGILPESLNKLTELHLLYVNDNENLYGYV

SEQ ID NO: 12046 - protein, 331 aa, Piromyces finnis
  L domain-like
CNENDKVTELNINFTNKKGEIKEFPESLQLLTNLEKFTFEGNSQRIDALPDLSSLENLKSIKVFNKYITEFPKGLDKLKKLEEIDFSYTNISEIPKQIYKIENLRTLSLFYNNISSPISKDIKNLKKLKVLNLSDNKVSGTLPPELFELEELEYLNLLNNEFKSSIPENIGNLKNVKEIVFENSGITGFLPESLGELENLEYLKMRRNDVYGSIPKSFGNLKKMIYLQLYGNNLNGTIPEELGNMENLEQMLISRNKLTGSIPESFGNLKNLKQLHLYYNNLSGTVPQSLEKLEKLEIFDISFNNFNGVLPEFLNELPNLKEVVASFNKDL

SEQ ID NO: 12047 - protein, 248 aa, Piromyces finnis
  L domain-like
HITNLYLENKRINEKFCKFNELISLELMNNGLMGEIPSCITSLTSLEYLNLSDNALTGSIPMDIENLSSLKELTLSKNNLTGEFPESLGNIGSLTGLFIDSNQLSGELPHSLDNLFSIKSFDVSDNQFSGDLPEEFYNMYTLEHGYFNNNKFTGRLDRDIGVFSVLSELDLTNNKFEGKIPSSIGFLQNLEWLSLAGNKFTGDFPSNIAKSKYLVYLDLSNNKFSSVPTALKRLAYLGYIDVSNNPNL

SEQ ID NO: 12048 - protein, 135 aa, Neocallimastix californiae
  LamGL
NSFTIEVNVVPTGVQQFNMLAGKGDRSIGFRTSTNSIDFFIYAGNEWRTVNYNMGVDSASGWVGRKHQVAGIYDAENNMLRVYADGRILGERSVGTNSGVAHSNYNLMLGACPDTGRNSQGNFYEMRVYSKALTA

SEQ ID NO: 12049 - protein, 135 aa, Neocallimastix californiae
  LamGL
NSFTIEVNVVPTGVQSFNMLAGKGDYSLGFRTTTGALDFFVYAGNEWRMVSYTMGVDANSGWIGKKHQVAGIFDAGSNMLRLYVDGKMVAEKSVGTTAGVSSSNYNLMLGACPDTGRNSQGNFYEMRVYSKALSA

SEQ ID NO: 12050 - protein, 135 aa, Piromyces finnis
  LamGL
NSFTIEINVVPSGVQQFNMFAGKGDHSFGFRTTTSSLDFFIFAGGEWRSLYHDMGVDSSSGWVGKKHQVAGIYDAENNMLRLYADGKMVRETKINTNSGVEHSSYNLMLGACPETGRNSQAKFYEMRVYNKALTA

SEQ ID NO: 12051 - protein, 159 aa, Neocallimastix californiae
  Laminin_G_3
NYISGALTIPHNSKIDSALEGRNSFTIEVNVVPTGVQQFNMLAGKGDRSIGFRTSTNSIDFFIYAGNEWRTVNYNMGVDSASGWVGRKHQVAGIYDAENNMLRVYADGRILGERSVGTNSGVAHSNYNLMLGACPDTGRNSQGNFYEMRVYSKALTASE

SEQ ID NO: 12052 - protein, 160 aa, Neocallimastix californiae
  Laminin_G_3
GNYISGALTIPHNSKLDSALQGRNSFTIEVNVVPTGVQSFNMLAGKGDYSLGFRTTTGALDFFVYAGNEWRMVSYTMGVDANSGWIGKKHQVAGIFDAGSNMLRLYVDGKMVAEKSVGTTAGVSSSNYNLMLGACPDTGRNSQGNFYEMRVYSKALSASE

SEQ ID NO: 12053 - protein, 160 aa, Piromyces finnis
  Laminin_G_3
GNYISGALTIPHNSRIDSALEGKNSFTIEINVVPSGVQQFNMFAGKGDHSFGFRTTTSSLDFFIFAGGEWRSLYHDMGVDSSSGWVGKKHQVAGIYDAENNMLRLYADGKMVRETKINTNSGVEHSSYNLMLGACPETGRNSQAKFYEMRVYNKALTASE

SEQ ID NO: 12054 - protein, 242 aa, Neocallimastix californiae
  LEUCINE-RICH REPEAT RECEPTOR-LIKE PROTEIN KINASE
PISEQFCHLNSLISLELINNGLAGNLPACLTSLNTLEYLNLTGNKLTGSILSDIDKLRNLKELTLSKNNLSGKLPEAIGNIASLEYLYLDNNQITGILPNSLDNLASIKAIDLSFNQFYGSLPEEIYNLESLEQLYLNDNGFSGSISEDLGSFSVITELDITNNMFVGKIPETIGYLQNLEWLSVAGNQFSDEFPVNLGKLRYLTHLDISDNNFLSLPESLKRLKYLNYIDLSDNKNFIGEI

SEQ ID NO: 12055 - protein, 239 aa, Anaeromyces robustus
  LEUCINE-RICH REPEAT RECEPTOR-LIKE PROTEIN KINASE
NDCCDNLTFKCQDNSITEIALQNANLSGSLSKTLGEISSLEILNLSTNQLTGSLPYSIGELNLLKTLYLYDNNISGSIPSSIGNLSDLKKLFLHNNEITGKIPESIGDMKNLIDLNLGNNKISGNIPKSIGSLKSIEAISISYNSLTGKIPDSIGKLETLRTLNLENNQLSSTIPESLGDLKKLSTLYLNDNKLSGSIPSSFGNLSNIEDLYLNNNKLSGILPESLNKLTELHLLYVND

SEQ ID NO: 12056 - protein, 321 aa, Piromyces finnis
  LEUCINE-RICH REPEAT RECEPTOR-LIKE PROTEIN KINASE
IICNENDKVTELNINFTNKKGEIKEFPESLQLLTNLEKFTFEGNSQRIDALPDLSSLENLKSIKVFNKYITEFPKGLDKLKKLEEIDFSYTNISEIPKQIYKIENLRTLSLFYNNISSPISKDIKNLKKLKVLNLSDNKVSGTLPPELFELEELEYLNLLNNEFKSSIPENIGNLKNVKEIVFENSGITGFLPESLGELENLEYLKMRRNDVYGSIPKSFGNLKKMIYLQLYGNNLNGTIPEELGNMENLEQMLISRNKLTGSIPESFGNLKNLKQLHLYYNNLSGTVPQSLEKLEKLEIFDISFNNFNGVLPEFLNELPN

SEQ ID NO: 12057 - protein, 278 aa, Piromyces finnis
  LEUCINE-RICH REPEAT RECEPTOR-LIKE PROTEIN KINASE
WNLGTNDCCTAYKDFEYPVIINCNQNNEIIKIHITNLYLENKRINEKFCKFNELISLELMNNGLMGEIPSCITSLTSLEYLNLSDNALTGSIPMDIENLSSLKELTLSKNNLTGEFPESLGNIGSLTGLFIDSNQLSGELPHSLDNLFSIKSFDVSDNQFSGDLPEEFYNMYTLEHGYFNNNKFTGRLDRDIGVFSVLSELDLTNNKFEGKIPSSIGFLQNLEWLSLAGNKFTGDFPSNIAKSKYLVYLDLSNNKFSSVPTALKRLAYLGYIDVSNNP

SEQ ID NO: 12058 - protein, 206 aa, Neocallimastix californiae
  Lipase_GDSL
IMPVGDSITFGEGERGGYRKYLYSALTQKGYKIDMVGPEGSNSASANGIQYDDNNAGYSGFQIKEIPGWGQQQGGEGSLYNKLKSKNAVKQSQPDIILLIIGTNDMTANRSMDACANDLRALLDYMLADMPANSIIFMGSIPEFTAYGGNAQRIANYNGTVKKVADEYANKGKNVRFADVHGCLNGMSDIGSDRLHPSGNGYKKIG

SEQ ID NO: 12059 - protein, 249 aa, Neocallimastix californiae
  Lipase_GDSL
IVFGDSYTTATIDYSTLQFNGQSSNNEEESKNWPLFLVKKRIMNMWNFACSGAVVDNDIIHSNNALPMTEQYKAFILHMGKGGKHSNWRSDQSLIGIWFGINDIMNRADNDIDYDDDQSIIKSMFKIINKIYDLGARNFLILDVPSLEKLPHFIYSPVKGLDEEVLKFNKMIADSAMNFQKSKPETNVFVYNAYNELNYIMKNENKFGFTITVDDWYHNNERKLEDITKEYFWRDGYHLSKYVQEALSQ

SEQ ID NO: 12060 - protein, 256 aa, Neocallimastix californiae
  Lipase_GDSL
IIIFGDSYTTVGINFNTMKYTGDNLSGGKNWPQFLIDMHPMNMWNFAISGAVVDAKVVDGNPQYTPMTEQYNWFLKNMAPGKQFSNWKGESSLFAIWFGINDIGSKRRNEGLTSSQIDEKIATSMFNMIDGMYKQGARNFMFIFVPTIEKCPAYSNGNNPNIKSDIPNYNSNLNKYAKNFQASHPDTNVFVYDSYNEFDYIMENKSQYGITNIDSTCGGGFGFGWGWGNQNNCDSNTYFWKDVIHPTPTVHKPLAQ

SEQ ID NO: 12061 - protein, 206 aa, Neocallimastix californiae
  Lipase_GDSL
IMPVGDSITFGMGENGGYRKYLYSALTQKGYNIDMVGPEGSSRATANGISYDDNHAGYSGFQIKEIPDWGRQQGGDGSLYNKLKSKNAVKQAQPDIILLIIGTNDMTANRSMDACASDLRALLDYMLGDMPSGGIIFMGSIPEFTAYGGNAQRVANYNGTVKKVAEEYASKGKNVRFADVHGSLNGTGDLGGDGLHPNGNGYKKMG

SEQ ID NO: 12062 - protein, 206 aa, Anaeromyces robustus; identical to SEQ ID NO: 12061
  Lipase_GDSL

SEQ ID NO: 12063 - protein, 253 aa, Anaeromyces robustus
  Lipase_GDSL
IVIFGDSYTTVSVDFETMTYTGLNLSGGKNWPQFLIDMHLMKMWNYAVGGACVDLSLINGDPENTPMTDQYAWFLKNMSKGKKFANWDGDTSLFVIWFGINDINGMSGIDDVLNSGINEKIATSIFNMVEGMYKEGAKNFLFIYVPSLVKFPAYANEDGTGVYNENLSYVIDEVPEYNNNLNQYAKNFQEIHPDTNVFVYNAYDEFDYIMENKSEYGIVNIRDKCSYTCNMKTYFWNDNYHPTAHVHKILAKD

SEQ ID NO: 12064 - protein, 264 aa, Anaeromyces robustus
  Lipase_GDSL
IIFGDSYTTVGIDFNTMKYTGSNMSGGKNWPQFLVDMHPMNMWNFAISGASVDAKIVGNAQFTPMTEQYSYFQRNMAAGKQFSGWKGETSLFCIWFGINDLGAVNHNGGVTTAQVSERIATSMFNMIEGMYKEGGRNFMFIYVPPIEKCPAYNSGQNYMKTDVPIYNDIINKYAQNFQKSHPDTNIFVYDSYNEFDYIMENRSKYGITNIDGTCGGFGFGGGFGGGFGGFGGFGGGNGQQQCDSNTYFWKDVIHPTPTVHKPLA

SEQ ID NO: 12065 - protein, 248 aa, Piromyces finnis
  Lipase_GDSL
IVIYGDSYTTVSTNYNTMEYTGENLSKGKNWPQHLIDPIHPMKMWNFAANGAVVDARIVGQYTPMTEQYSYFLKHMGKGQKFNTWKGETTLFTIWFGINDLLSKRGTGTSVDEQIATSMFEMIEGMYNEGGRNFMIFFVPDVSKSPLYYGNETQKTYIPAYNQILNKYAMMYQASHPDTNFFVYNTFSEFEYIMENKSEYGLTNITDVCQTGFGFGGFQWGGQSNCDEKTYFWADNLHPSPKVHEALA

SEQ ID NO: 12066 - protein, 248 aa, Piromyces finnis; identical to SEQ ID NO: 12065
  Lipase_GDSL

SEQ ID NO: 12067 - protein, 248 aa, Piromyces finnis; identical to SEQ ID NO: 12065
  Lipase_GDSL

SEQ ID NO: 12068 - protein, 179 aa, Neocallimastix californiae
  Lipase_GDSL_2
VGDSLTAGQYLPNEQADSWSFLFGKYMNAETDIIAKPGICLSDIPLYGMDHGMEVSYFLNSNPLARSWGYISDEAHDFSERKAPDLMIIFLGTNDAGNDAKVVAEDYYETLKKFLTRVREIYPETPLAITSLLYDPGNWNEIQSNIVNEFDNIYYIYINDPVINSSPNIYLTNYHLTQK

SEQ ID NO: 12069 - protein, 194 aa, Neocallimastix californiae
  Lipase_GDSL_2
VCFGDSITDGRGVTNDKNNRWTDILATRLQQNPATKNIGVLNQGIGATTVAGTYYNPTSPAGQARFEKDVLKQTNVKYLIILYGVNDILYNNSNAQTIINVYKDLIKKAHNNGIKVFGGTILPFGKNSGFNSNKESQRTTVNNWIMNTPASQGGFDGYIDFASAVADKSNKQWLNTNWNFENDGLHPNAVGYEA

SEQ ID NO: 12070 - protein, 140 aa, Neocallimastix californiae
  Lipase_GDSL_2
VIGDSLSAGQYCPNEALDAWAFLLGKAMNVEVDVIAKPGACLTDVPIYDNAHGLEYSYFMTNGPNAEQFGYDDDAEYDFSKRKAPELIIIYMGNNDSGKEDPIAPEDYFETLKKFITRIRGIYPNSKIIVTSAFDSRPHW

SEQ ID NO: 12071 - protein, 23 aa, Neocallimastix californiae
  LRR
TLEYLNLTGNKLTGSILSDIDKL

SEQ ID NO: 12072 - protein, 21 aa, Neocallimastix californiae
  LRR
SLEYLYLDNNQITGILPNSLD

SEQ ID NO: 12073 - protein, 23 aa, Neocallimastix californiae
  LRR
NLEWLSVAGNQFSDEFPVNLGKL

SEQ ID NO: 12074 - protein, 22 aa, Neocallimastix californiae
  LRR
NLKELTLSKNNLSGKLPEAIGN

SEQ ID NO: 12075 - protein, 22 aa, Neocallimastix californiae
  LRR
SLEQLYLNDNGFSGSISEDLGS

SEQ ID NO: 12076 - protein, 21 aa, Neocallimastix californiae
  LRR
YLTHLDISDNNFLSLPESLKR

SEQ ID NO: 12077 - protein, 22 aa, Piromyces finnis
  LRR
NLEWLSLAGNKFTGDFPSNIAK

SEQ ID NO: 12078 - protein, 22 aa, Piromyces finnis
  LRR
VLSELDLTNNKFEGKIPSSIGF

SEQ ID NO: 12079 - protein, 22 aa, Piromyces finnis
  LRR
YLVYLDLSNNKFSSVPTALKRL

SEQ ID NO: 12080 - protein, 23 aa, Piromyces finnis
  LRR
SLEYLNLSDNALTGSIPMDIENL

SEQ ID NO: 12081 - protein, 22 aa, Piromyces finnis
  LRR
SLKELTLSKNNLTGEFPESLGN

SEQ ID NO: 12082 - protein, 23 aa, Piromyces finnis
  LRR
SLTGLFIDSNQLSGELPHSLDNL

SEQ ID NO: 12083 - protein, 20 aa, Neocallimastix californiae
  LRR_1
LEYLNLTGNKLTGSILSDID

SEQ ID NO: 12084 - protein, 20 aa, Neocallimastix californiae
  LRR_1
LTHLDISDNNFLSLPESLKR

SEQ ID NO: 12085 - protein, 21 aa, Anaeromyces robustus
  LRR_1
SLEILNLSTNQLTGSLPYSIG

SEQ ID NO: 12086 - protein, 21 aa, Anaeromyces robustus
  LRR_1
LKTLYLYDNNISGSIPSSIGN

SEQ ID NO: 12087 - protein, 21 aa, Anaeromyces robustus
  LRR_1
LRTLNLENNQLSSTIPESLGD

SEQ ID NO: 12088 - protein, 22 aa, Piromyces finnis
  LRR_1
NLEYLKMRRNDVYGSIPKSFGN

SEQ ID NO: 12089 - protein, 21 aa, Piromyces finnis
  LRR_1
LEYLNLLNNEFKSSIPENIGN

SEQ ID NO: 12090 - protein, 20 aa, Piromyces finnis
  LRR_1
LVYLDLSNNKFSSVPTALKR

SEQ ID NO: 12091 - protein, 37 aa, Piromyces finnis
  LRR_4
ENLRTLSLFYNNISSPISKDIKNLKKLKVLNLSDNKV

SEQ ID NO: 12092 - protein, 48 aa, Piromyces finnis
  LRR_4
ENLEQMLISRNKLTGSIPESFGNLKNLKQLHLYYNNLSGTVPQSLEKL

SEQ ID NO: 12093 - protein, 37 aa, Piromyces finnis
  LRR_4
SELDLTNNKFEGKIPSSIGFLQNLEWLSLAGNKFTGD

SEQ ID NO: 12094 - protein, 23 aa, Neocallimastix californiae
  LRR_6
LQNLEWLSVAGNQFSDEFPVNLG

SEQ ID NO: 12095 - protein, 59 aa, Neocallimastix californiae
  LRR_8
RNLKELTLSKNNLSGKLPEAIGNIASLEYLYLDNNQITGILPNSLDNLASIKAIDLSFN

SEQ ID NO: 12096 - protein, 58 aa, Anaeromyces robustus
  LRR_8
LKKLFLHNNEITGKIPESIGDMKNLIDLNLGNNKISGNIPKSIGSLKSIEAISISYNS

SEQ ID NO: 12097 - protein, 58 aa, Anaeromyces robustus
  LRR_8
KLSTLYLNDNKLSGSIPSSFGNLSNIEDLYLNNNKLSGILPESLNKLTELHLLYVNDN

SEQ ID NO: 12098 - protein, 58 aa, Piromyces finnis
  LRR_8
LISLELMNNGLMGEIPSCITSLTSLEYLNLSDNALTGSIPMDIENLSSLKELTLSKNN

SEQ ID NO: 12099 - protein, 26 aa, Anaeromyces robustus
  LRR_SD22
LNLLKTLYLYDNNISGSIPSSIGNLS

SEQ ID NO: 12100 - protein, 26 aa, Anaeromyces robustus
  LRR_SD22
LKKLSTLYLNDNKLSGSIPSSFGNLS

SEQ ID NO: 12101 - protein, 26 aa, Anaeromyces robustus
  LRR_SD22
MKNLIDLNLGNNKISGNIPKSIGSLK

SEQ ID NO: 12102 - protein, 23 aa, Neocallimastix californiae
  LRR_TYP
LRNLKELTLSKNNLSGKLPEAIG

SEQ ID NO: 12103 - protein, 23 aa, Neocallimastix californiae
  LRR_TYP
LRYLTHLDISDNNFLSLPESLKR

SEQ ID NO: 12104 - protein, 24 aa, Neocallimastix californiae
  LRR_TYP
LESLEQLYLNDNGFSGSISEDLGS

SEQ ID NO: 12105 - protein, 23 aa, Neocallimastix californiae
  LRR_TYP
IASLEYLYLDNNQITGILPNSLD

SEQ ID NO: 12106 - protein, 24 aa, Anaeromyces robustus
  LRR_TYP
LNLLKTLYLYDNNISGSIPSSIGN

SEQ ID NO: 12107 - protein, 23 aa, Anaeromyces robustus
  LRR_TYP
LSNIEDLYLNNNKLSGILPESLN

SEQ ID NO: 12108 - protein, 23 aa, Anaeromyces robustus
  LRR_TYP
ISSLEILNLSTNQLTGSLPYSIG

SEQ ID NO: 12109 - protein, 23 aa, Anaeromyces robustus
  LRR_TYP
LETLRTLNLENNQLSSTIPESLG

SEQ ID NO: 12110 - protein, 23 aa, Anaeromyces robustus
  LRR_TYP
LKKLSTLYLNDNKLSGSIPSSFG

SEQ ID NO: 12111 - protein, 24 aa, Anaeromyces robustus
  LRR_TYP
MKNLIDLNLGNNKISGNIPKSIGS

SEQ ID NO: 12112 - protein, 23 aa, Piromyces finnis
  LRR_TYP
LKKLEEIDFSYTNISEIPKQIYK

SEQ ID NO: 12113 - protein, 23 aa, Piromyces finnis
  LRR_TYP
LKNLKQLHLYYNNLSGTVPQSLE

SEQ ID NO: 12114 - protein, 24 aa, Piromyces finnis
  LRR_TYP
LKKLKVLNLSDNKVSGTLPPELFE

SEQ ID NO: 12115 - protein, 22 aa, Piromyces finnis
  LRR_TYP
LEKLEIFDISFNNFNGVLPEFL

SEQ ID NO: 12116 - protein, 23 aa, Piromyces finnis
  LRR_TYP
MENLEQMLISRNKLTGSIPESFG

SEQ ID NO: 12117 - protein, 132 aa, Anaeromyces robustus
  LYSOPHOSPHOLIPASE-RELATED
KSPLLLSLHGMDQDPNYQQSNTHWETLADTEGFVVVYPRGGTGMSTWDIQGDKDTKWVLQIIDQMAKDYDIDRNRVYLSGFSMGGMFTYHAMSKIGDKIAAFAPCSGPNVFGASKAMRPVPIFHVHGTNDDV

SEQ ID NO: 12118 - protein, 3606 aa, Neocallimastix californiae; identical to SEQ ID NO: 9469
  MALONYL COA-ACYL CARRIER PROTEIN TRANSACYLASE

SEQ ID NO: 12119 - protein, 3316 aa, Neocallimastix californiae; identical to SEQ ID NO: 9470
  MALONYL COA-ACYL CARRIER PROTEIN TRANSACYLASE

SEQ ID NO: 12120 - protein, 2410 aa, Neocallimastix californiae; identical to SEQ ID NO: 9471
  MALONYL COA-ACYL CARRIER PROTEIN TRANSACYLASE

SEQ ID NO: 12121 - protein, 3956 aa, Neocallimastix californiae; identical to SEQ ID NO: 9472
  MALONYL COA-ACYL CARRIER PROTEIN TRANSACYLASE

SEQ ID NO: 12122 - protein, 2891 aa, Neocallimastix californiae; identical to SEQ ID NO: 9473
  MALONYL COA-ACYL CARRIER PROTEIN TRANSACYLASE

SEQ ID NO: 12123 - protein, 3962 aa, Anaeromyces robustus; identical to SEQ ID NO: 9474
  MALONYL COA-ACYL CARRIER PROTEIN TRANSACYLASE

SEQ ID NO: 12124 - protein, 3766 aa, Anaeromyces robustus; identical to SEQ ID NO: 9475
  MALONYL COA-ACYL CARRIER PROTEIN TRANSACYLASE

SEQ ID NO: 12125 - protein, 3755 aa, Piromyces finnis; identical to SEQ ID NO: 9476
  MALONYL COA-ACYL CARRIER PROTEIN TRANSACYLASE

SEQ ID NO: 12126 - protein, 3754 aa, Piromyces finnis; identical to SEQ ID NO: 9477
  MALONYL COA-ACYL CARRIER PROTEIN TRANSACYLASE

SEQ ID NO: 12127 - protein, 3755 aa, Piromyces finnis; identical to SEQ ID NO: 9478
  MALONYL COA-ACYL CARRIER PROTEIN TRANSACYLASE

SEQ ID NO: 12128 - protein, 3754 aa, Piromyces finnis; identical to SEQ ID NO: 9479
  MALONYL COA-ACYL CARRIER PROTEIN TRANSACYLASE

SEQ ID NO: 12129 - protein, 114 aa, Neocallimastix californiae
  MaoC_dehydrat_N
SVSEPITRQQITDFVNIIGNRAESYTDRGQKVLFAPMDFAIVVGWQSIIRAIFPKFINADLLKLVHLTNGFRMIDNESGLKEGDIVKTESRIISVINDETGKIVEVKGVLKRDE

SEQ ID NO: 12130 - protein, 114 aa, Neocallimastix californiae; identical to SEQ ID NO: 12129
  MaoC_dehydrat_N

SEQ ID NO: 12131 - protein, 115 aa, Neocallimastix californiae
  MaoC_dehydrat_N
VSVSEPITRQQITDFVNIIGNRAESYTDRGQKVLFAPMDFAIVVGWQSIIRAIFPKFINADLLKLVHLSNGFRMIDNELGLKEGDVVKTESRIISVVNDETGKIVEVKGVLKRDE

SEQ ID NO: 12132 - protein, 123 aa, Anaeromyces robustus
  MaoC_dehydrat_N
KTEFPKERFQYSERDVILYSLGVGITKKELSYVYENSPDFKVLPTFSTVPAMDYFSKMNLANVLPVFSPESLIQTKHYMELNKIFEPKDCVVSTGKIVDIIKTKMGAVLITAITTYDQDGNEI

SEQ ID NO: 12133 - protein, 113 aa, Anaeromyces robustus
  MaoC_dehydrat_N
VSEPITRQQITDFVNIIGNQAESYTDRGQKVLFAPMDFAIVVGWQSIIRAIFPKFIDADLLKLVHLSNGFRMIENETGLKEGDVVKTESRIISVVNDETGKIVEVKGVLKRDE

SEQ ID NO: 12134 - protein, 111 aa, Piromyces finnis
  MaoC_dehydrat_N
ISVSEPITRQQITDFVNIIGNQAESYTDRGQKVLYAPMDFAIVVGWQSIIRAIFPKFINADLLKLVHLSNGFRMIDNATGLKEGDIVKTESRIISVINDENGKIVEVKGVL

SEQ ID NO: 12135 - protein, 111 aa, Piromyces finnis; identical to SEQ ID NO: 12134
  MaoC_dehydrat_N

SEQ ID NO: 12136 - protein, 111 aa, Piromyces finnis; identical to SEQ ID NO: 12134
  MaoC_dehydrat_N

SEQ ID NO: 12137 - protein, 111 aa, Piromyces finnis; identical to SEQ ID NO: 12134
  MaoC_dehydrat_N

SEQ ID NO: 12138 - protein, 117 aa, Neocallimastix californiae
  MaoC_dehydratas
TIPKRKPDAIVKERTSEDQAILYRLSGDKNPLHVDPAMASIAGYHSPVLQSLCVLAISTLHIIQTFCYGDVASIKSIQADFVSHVFPGETLQTNMWQDGTKILFNVKALERDVIVIS

SEQ ID NO: 12139 - protein, 117 aa, Neocallimastix californiae
  MaoC_dehydratas
TIPKRKPDAIVKERTSEDQAILYRLSGEKNPLHVDPAMASIAGYHSPVLQSLCVLAIGTLHIIQTFCYGDVASVKSIQADFVSHVFPGETLQTNMWQDGTKILFNVKALERDVIVIS

SEQ ID NO: 12140 - protein, 104 aa, Neocallimastix californiae
  MaoC_dehydratas
QRAPNTNEDYSLASGDVNPIHTNYYFANLADLDVPITHGMWTSAATRRYVETYAADNDAERVVSYKVNFIGMVSPKDELRTSLTHVGMHNGRKIIKVSVKDLRT

SEQ ID NO: 12141 - protein, 96 aa, Neocallimastix californiae
  MaoC_dehydratas
THSSNIGYSRVSGDVNPIHTNPYFAQLADLPGNITHGMWTSASTRKFVETFAAENHPHRVTSYEVKFLDMVFPGDRLETKLFHTGMANGKKIIQCK

SEQ ID NO: 12142 - protein, 96 aa, Neocallimastix californiae; identical to SEQ ID NO: 12141
  MaoC_dehydratas

SEQ ID NO: 12143 - protein, 96 aa, Neocallimastix californiae
  MaoC_dehydratas
THSSNLGYSRVSGDVNPIHTNPYFAQLADLPGNITHGMWTSASTRKFVETFAAENHPHRVTSYEVKFLDMVFPGDRLETKLFHTGMANGKKIIQCK

SEQ ID NO: 12144 - protein, 104 aa, Neocallimastix californiae
  MaoC_dehydratas
QRAPNTNEDYSLASGDVNPIHTNYYFANLADLDVPITHGMWTSAATRRYIETYAADNDAERVVSYKVNFIGMVSPKDELRTSLTHVGMHNGRKIIKVSVKDLRT

SEQ ID NO: 12145 - protein, 116 aa, Anaeromyces robustus
  MaoC_dehydratas
IPKRKPDAIVKERTSEDQAILYRLSGDKNPLHVDPAMASIAGYHSPVLQSLCVLAISTLHIIQTFCYSDVASIKSVQADFVSHVFPGETLQTNMWQDGTKILFTVKALERDVIVIS

SEQ ID NO: 12146 - protein, 104 aa, Anaeromyces robustus
  MaoC_dehydratas
QRAPNTNEDYSLASGDVNPIHTNYYFANLADLDVPITHGMWTSAATRRYVETYAADNDAERVVSYRVNFIGMVSPKDELRTSLTHVGMHNGRKIIKVSVKDLRT

SEQ ID NO: 12147 - protein, 96 aa, Anaeromyces robustus
  MaoC_dehydratas
THSSNLGYSRVSGDVNPIHTNPYFAQLADLPGNITHGMWTSASTRKFVETFAAENHPHRVTSYEVKFLDMVLPGDRLETKLFHTGMANGKKIIQCK

SEQ ID NO: 12148 - protein, 96 aa, Piromyces finnis
  MaoC_dehydratas
THSSNLGYSRVSGDVNPIHTNPYFAQLADLPGNITHGMWTSASTRKFVETFAAENHPQRVTSYEVNFLDMVFPGDRLETKLYHTGMANGKKIIKCK

SEQ ID NO: 12149 - protein, 96 aa, Piromyces finnis; identical to SEQ ID NO: 12148
  MaoC_dehydratas

SEQ ID NO: 12150 - protein, 96 aa, Piromyces finnis; identical to SEQ ID NO: 12148
  MaoC_dehydratas

SEQ ID NO: 12151 - protein, 96 aa, Piromyces finnis; identical to SEQ ID NO: 12148
  MaoC_dehydratas

SEQ ID NO: 12152 - protein, 115 aa, Piromyces finnis
  MaoC_dehydratas
IPKRKPDAIVKERTSEDQAILYRLSGEKNPLHVDPAMASIAGYNSPVLQNLCVLAISTLHVIQTFCYSDVASVKSIQADFVSHVFPGETLQTNMWQEGTKILFTVKALERDIVVI

SEQ ID NO: 12153 - protein, 312 aa, Neocallimastix californiae
  Metallo-dependent phosphatases
FRFVFLGDPQIGASKNNFSVLTEQRLTEEEGLRNDAFNWNMTIYNSYAKANEASIILSAGDNADSGQSPGDSSGKTEEYIRNDLLRQEREYSTLLLPKLMQQVPFAPAVGNHESFTPSFRYHFNTPNPYLIGKTETSPGYSYFFKHNNVLVIVLETNYGTEEEFREVVGKANSTFPDVDWRVALFHHDIYSNGYTHSQDPLITEYIRKEVTQLFDIYDIDLVINGHDHMYAASHFITYDESRKEGYKVDEVEKNKVYSSHKGTMYLTANCSTGSKLYGIINDRAFDYIYYSNQTFTSTFGILDFTNNNGKTQ

SEQ ID NO: 12154 - protein, 45 aa, Neocallimastix californiae
  Metallo-dependent phosphatases
GTLFITANCSSGSKFLDFEDSSFDYVYQFNQTFTSTFGVLDFKNE

SEQ ID NO: 12155 - protein, 223 aa, Neocallimastix californiae
  Metallo-dependent phosphatases
FKFVFVGDPQIGGSVSRVGYHTSKTFDYSEAVRNDAFNWNVTVNSFFKKTGNPSLLLSAGDQADTMGEDESQEQQYSGLLLPELIKTIPIAPALGNHEVYSESFRHHFNVPNPYKPKKLDTLSRISAYNYYFKYNNVLVVVLESNHNTCHDCEMVISNAIDEYPDTDWRIALFHHDLYGNGKTHSQGSSDGKRLRACLTGLFDIYNFDLVINGHDHVYTSTHF

SEQ ID NO: 12156 - protein, 37 aa, Neocallimastix californiae
  Metallo-dependent phosphatases
GTLYITANCSTGSKLYNTKGNKDYLYYYNQTFTSTFG

SEQ ID NO: 12157 - protein, 234 aa, Neocallimastix californiae
  Metallo-dependent phosphatases
FRFIFLGDPQIGASAGAISELHLNKVLSDDEGLRNDAFNWNMTIYNSYEKANGPSLILSAGDNADSGQSPSNENSKIEDIKKDLIRQEKQYSALLLPSLMQKVPFATALGNHESYSPSFKYHFNNPNPYKVERSEFSPGYNYFFKYNNALVVMLESNYGIKDDYSDVISNATSTYPDTDWRIAVFHHDIYSNGVMHSSEYRVTELRKWLTPLFDEYDFDLVINGHDHMYSASQF

SEQ ID NO: 12158 - protein, 40 aa, Neocallimastix californiae
  Metallo-dependent phosphatases
GTFFITANCSTGSKFFSFDKGTFDYVYNYNQTYTSTFGVM

SEQ ID NO: 12159 - protein, 226 aa, Neocallimastix californiae
  Metallo-dependent phosphatases
FNFIFVGDPQIGGSNDRIIYDSRESQGYSLAIKNDAFNWNMTIYSSFEMTKNPSLLLSAGDNADTENYYSSIDYYNQESEYSAFLLPELIKTIPIAPALGNHETKTEGYKYHFNPPNTYSTKRFEQMSLVPAYSYFFKYNNVLVVVLESNKSSCIDCEIIFSKAVKKYPDTDWRIALFHHDVYGNGKTHSQGDALRLRPCLTGLFSIYKFDVVINGHDHVYTTTKF

SEQ ID NO: 12160 - protein, 303 aa, Neocallimastix californiae
  Metallo-dependent phosphatases
FRFVFLGDPQIGSSRGSYSIGNRKQFSDDEGLRNDAFNWNMTIFNSYSKANEASLILSAGDNADSGETPSNGDILDNISNISKMSTDLLRQEKEYSSLLLPELMQKVPFVPAVGNHESYTATYRYHFNTPNSYKVESENQIPGYNYTSITPGYNYYFKHNNVLIVVLESNYGNEEIYTTVMNMANDAYPDVDWRIALFHHDIFSDGYIHSEEGRVQELRQWLTPLFDKFNFDLVINGHDHMYSASHFITYGNNNNIYKFEKIEKNKIYKDPNGTMFITANCSTGSKLYDVGDPKDFIYFSNQT

SEQ ID NO: 12161 - protein, 270 aa, Neocallimastix californiae
  Metallo-dependent phosphatases
FKFVFVGDPQIGGSNDRLAYQSNSRMNSDSIRNDAFNWNMTVNSFYELTGKPSLLLSAGDQADQMGNDKTQERQYSAYLLPELIKKIPIAPALGNHEVYSESFRRHFNVPNPILKKRFYSNKPVSAYNYYFKYNNVLVVVIETNYNTCHECEKVISEAVKQYPSADWRVALFHHDLYGNGKTHSQGDAQKLRPCLTGLFDIYHFDLVINGHDHVYTSTHFVKFQDSKKKTYDIAKISKGSVNENPNGTFYVTANCSTGSKFLPFYEGKLD

SEQ ID NO: 12162 - protein, 221 aa, Neocallimastix californiae
  Metallo-dependent phosphatases
FKFIFLGDPQIGGSIGRHQYHSSDYFDYAEAIRNDAFNWNITIFNSIKFTKTPSLILSAGDQADTMGDDITQEQQYSGLLLPELIKTIPFAPTLGNHEVFSESFRRHFNVPHPYIPKKYDDLDYVPAYNYYFKYNNVLVVVLESNHNSCHDCEIVMAKAVDKYPNTDWRIALFHHDIYGNGATHSQGDAKKLRPCLTGLFDIYKFDLVINGHDHVYTTTKF

SEQ ID NO: 12163 - protein, 304 aa, Neocallimastix californiae
  Metallo-dependent phosphatases
FRFVFLGDPQIGASRNLISGKKSLTDDEGLRNDAFNWNMTIYNSYEFANEPSLILSAGDNADSGQSPGDDKKSEENIKIDLLRQEREYSTLLLPQIMQKVPFASAIGNHESFTPTFRYHFNTPHSYKVESDNFIKGFQSSITPGYNYFFKYNNVLIVVLESNYSTEEQYREVIENAITTYPETDWRIGLFHHDIYSNGYGHSTEPRVMDLRKWLTPMLDKYDFDLVINGHDHVYVATHFVTSDKNSKNGYSFNKIERNKVYNDPKGTLYLTANCSTGNKLYRLIDPFDFVYYSNQTYTSTFGVL

SEQ ID NO: 12164 - protein, 276 aa, Neocallimastix californiae
  Metallo-dependent phosphatases
FNFIFLGDPQIGGSNSRHSALDPTRPLTVEEGTRNDAFNWNRTITNSFQFTREPSVIMTAGDQADSMCIDSNLDEIYNQETQYSAFLLPELMQKIPTATTVGNHDSFTTNYRNHFNPPNTYTTPEYVMANGFSGVIPGYSYFFKYNNVLVVVLETNYNNCNDFENVINKAIEKYPYTDWRIAMFHHDIYGDGYIHSTEDYITKYLRPCLTGIFTDKKFDLVINGHDHVYTASHFISYTGAYNNGGYSFSHIEKNKVYRDPKGTLYITANCSSGSKL

SEQ ID NO: 12165 - protein, 45 aa, Neocallimastix californiae
  Metallo-dependent phosphatases
GTMYITANSSTGSKLYKTKDYDMGYLYFYNQTYSSTFGILDFKNE

SEQ ID NO: 12166 - protein, 242 aa, Neocallimastix californiae
  Metallo-dependent phosphatases
FRFIFLGDPQIGASHNVLSIDKYIDDDESLRNDAFNWNMTIYNSYSKANEASLILSAGDNTDSGQSPSDRDILRYPDELEYDLIKQEKEYSSLLLPELMQKVPFASAVGNHESFTASFRYHFNTPNSLEVESNNQIPGYDYASVTPGYSYFFKYNNVLIIVLESNYGTEEQYETLLEKACSTYPGVDWRIALFHHDIYSNGFNHSEEERVLLLRQWLTKLLYKNKIDLVINGHDHIYSASHF

SEQ ID NO: 12167 - protein, 276 aa, Neocallimastix californiae
  Metallo-dependent phosphatases
FNFIFVGDPQIGGSHGKPNFLDMSKELTNDEATRNDAFNWERTMNKAFELKSNNPPSLLLSAGDQADDEKLQDYLDETQFSALLQPAVLKGIPHAMTVGNHEQYNENFRHHFNTPNSFTEIERSDREVIPGFNYFFRFNNVLVVVLDTNEPSTYDYSHTMKNAVTKYPDTTWRIVMFHHDLFGIGRTHSQGTYIVNKLRPILNPLLAKYKVDLVINGHDHYYSTSHFVSFDGVNYDISEISENKTFNNPKGILYITANCATGSKLNPRNDAKVDYI

SEQ ID NO: 12168 - protein, 274 aa, Neocallimastix californiae
  Metallo-dependent phosphatases
FKFAFVGDPQIGGSNERLAYKSNLLMGGSDGMRNDAFNWNVTVNSFFKQTELMPSLLLSAGDQVDFVGDDLDLEQQYSAYLLPELMKSLPVAPTLGNHEKYSNSFRRHFNVPNPYIPNKLKDMSNDNIYPISSYNYFFKYNNVLVVVLESNRNSCLDCEMVISNAVNKYPEADWRIALFHHDLYGNGKTHSQGIEDSLRLRSCLTGLFDIYKFDLVINGHDHVHTTTKFISYNNKNNNDYNISNIQKNVKNENPKGTFFITANCSTGSKFLDFE

SEQ ID NO: 12169 - protein, 266 aa, Neocallimastix californiae
  Metallo-dependent phosphatases
FKFVFVGDPQIGGSNDRLAYKSKSKMNESSIGNDAFNWNMTVNSFYELTGKPSLLLSAGDQADYMGGDKTQERQYSAYLLPDLIKKIPIAPALGNHEVYSESFRRHFNVPNPMFNALHYKTSYSAYNYYFKYNNVLVVVIESNYNTCHQCEKIISKAVKEYPDADWRIALFHHDLYGNGNTHSQGDAQRLRPCLTGLFDIHKFDLVINGHDHVYTSTHFVKFHDSQNKIYDIAKISKGSVNENPNGTFYVTANCSTGSKFLPFYEG

SEQ ID NO: 12170 - protein, 203 aa, Neocallimastix californiae
  Metallo-dependent phosphatases
YSAFLLPELLKTIPSATAVGNHDSFTENFRHHFNTPNSYLNPEYTDIIPGYNYFFKFNNVLVVVLETNYGTCDDFTNVISKAIKKYPSTDWRIAMFHHDIYGNGEYHSQDPQITEVLRPCLTKLLYRNEFDLAISGHDHVYSASHFVTYDKESEKGYAVNEIKKGNVYKNPKGTFYLTANCSTGSKLYTFIDKKPSYIYHYKQ

SEQ ID NO: 12171 - protein, 38 aa, Anaeromyces robustus
  Metallo-dependent phosphatases
GTFFITANCSTGSKLYGYNDEIDDYLSYFNQTYTSSFG

SEQ ID NO: 12172 - protein, 229 aa, Anaeromyces robustus
  Metallo-dependent phosphatases
FTVAFLGDPQIGGSAGHIPYEKNFKDTLSIEEATRNDAFNWNMTIYKIFEKTVKPSLILSAGDQIDYDGNRKSEYDIDIQEEQYAAFFLPEKLKQVPIAEAIGNHESRLDTFNLHYNVPNPYDTPIEPQIAPGYSYFFKHNNILVVVLETNFGFCEDYQEVMRRAYNKYPDTDWRIALFHHDIYSSGWCHSQEESVTDFLRPCLTELFTKYKFDLAINGHDHIYSTSHF

SEQ ID NO: 12173 - protein, 301 aa, Anaeromyces robustus
  Metallo-dependent phosphatases
FNFIFVGDPQIGGSYNRISVADLTRTLTREEGTRNDAFNWNMTVNSSFEVTKTPSVFLSAGDQIDTECFTVDDYSYYLQETQYSAFLLPELLKSIPSATTVGNHESLTKNFKHHFNTPNSYLTPLEKDLAPGYNYFFKYNNVLVVVLETNYGFCDDFKEVMRQAYLKYPDTDWRIAMFHHDIYGNGKYHSQDDYITMKLRPCLTELISKYKFDLVINGHDHVYSASYFISYEDSAKGYDPKEIVKEKVNENPNGTFYITGNCSSGSKLYGYVEKDFDYVYNYNQTYTSSFGTLDFEKEEDK

SEQ ID NO: 12174 - protein, 305 aa, Anaeromyces robustus
  Metallo-dependent phosphatases
IAYFGDPQIGGSKGRLSIANPTEPLNVFEATRNDAFNWNNTVYKAYEFQGFQQPDFYFTAGDNADEQAFPDVYESQESQYSAFLLPKIMQQIRLVPALGNHEINSKNFKNHFNVPNPYADEEVRGQNYLPSYHYYFKHYNILVIVLESTTGFDYEFEEIMSRATKSCPDCDWRIVMFHHDIYGAGETHINEDRVQYLRPVLLELLSKYNIDVVINGHDHVYSQSYFLKYDKNSSTKYTKLEIPKDKTYYNPEGTLFITANCATGSKLYRTAENVDYINTASQTFSINSGYLIFDRNEKRVSLTLF

SEQ ID NO: 12175 - protein, 227 aa, Anaeromyces robustus
  Metallo-dependent phosphatases
KVIIGGDPQIGANTKRVAYIPEKGWTLQTGLDAATNDAFNWRLTLKNAYSKHPDTSFIITAGDQIHNSDNNQQEIEYAGFLSNPYLRVLPLASTVGNHDHAGNSINFKHHFNNPIKVTKEAGAVSSGPDYFYSRGKSLFIHLNGNNLNIKDHKNTIDEAIGAYPNNIWRIVVIHFDLYGPASHLNDDTVKVLRTGLTPVFFETKIDVVLQGHNHIHARTHLITRVEV

SEQ ID NO: 12176 - protein, 333 aa, Anaeromyces robustus
  Metallo-dependent phosphatases
FNFIFVGDPQIGGSHGHISTVKKNGIVTIAEAIPNDAFNWNVTIQSSFSFAKQPSLFISAGDQADTDLKRVRENETNKYNSNCIEYNEHRIFQEQEYSAFLYPNLLKTIPVVAAVGNHDAYTTSFRDHFNTPNSYLTPEKPISVITPDNGKTSSIIPGYNYFFKYNNVLVVVLETNFGTENDFKTVIENAINKYPNTDWRIAVFHHDIYGSGYTHSQDWTIADPDYGIRSVLTKLLNENNFDLAINGHDHVYTASKFISYDENSKKKYHMEEIESGKVYKERKGTLFITANCSTGSKLYDIVHPDPEYAHVSKQDYKVTFGILNFSKKNGTTT

SEQ ID NO: 12177 - protein, 220 aa, Anaeromyces robustus
  Metallo-dependent phosphatases
FKFIFVGDPQIGGSHSHVAHGMRRVLGLDDGIRNDAFNWKRTISKAFDLTKEPSLVLSAGDQADSPYDLLYREIEYSALFLPDQLKTVPMAAAVGNHDAESFSHDLHFNVPHPYLTPEFQSKIPGYNYFFKFNNVLVVVLETNFITENDAEVVINNAVETYPETEWRIALFHHDMFGNGYAHSQFDDTTRLRKFLTELFTNNNFDVVINGHDHLYTASKF

SEQ ID NO: 12178 - protein, 40 aa, Anaeromyces robustus
  Metallo-dependent phosphatases
GTLYITANCSSGSKLYTETGDNDKLDYVNYFTQTYTATFG

SEQ ID NO: 12179 - protein, 247 aa, Anaeromyces robustus
  Metallo-dependent phosphatases
FKFIFVGDPQIGGSNNHRTFNENSSHLLTVPEGTRNDAFNWNMTIYNSFKLTREPSLLMSAGDQADSECFNQTLENLYNQETQFSALLLPEILQTIPSAFTVGNHESHTESFKFHFNTPNTYRTTECESDSGLEICNNGIYDYDGPFFSPGYSYFFKFNNVLVVVLETNFNTCNDLTTVISNAVEKYKDIDWRIAMFHHDIYGNGQYHSQEPYITDVLRPCLTELFDKNKFDLVINGHDHVYTTSHF

SEQ ID NO: 12180 - protein, 45 aa, Anaeromyces robustus
  Metallo-dependent phosphatases
GTLYITANCSTGSKLYNYIPETPDYVYYYNQTYTSTFGVLDFKKE

SEQ ID NO: 12181 - protein, 294 aa, Anaeromyces robustus
  Metallo-dependent phosphatases
FKFIFFGDPQIGGSHSHVSLGQRRILGVDDGIRNDAFSWNRTISKSFEFTKEPSLILSAGDQADDDVDELYQEIEYSALFLPELLKTVPLATAVGNHDSYTINYRQHFHVPNPYLTPEYQYTIPGYSYFFKYNNVLVVVLETNYITENDAYEIIPNAVKKYPDTDWRIALFHQDLYSNGYTHSQQYDVLRLRPFLTKLFSEYNFDLVINGHDHIYSASQFVSYDNINDYYKVSFIQRGKPQENPEGTLYITANCSTGSKLYGFEDFPLDYIYYFNQTFSSTFGVLDFQKENGKH

SEQ ID NO: 12182 - protein, 303 aa, Anaeromyces robustus
  Metallo-dependent phosphatases
FTFVFVGDPQIGGSHGRISVADITKALSVEQGTRNDVFNWNMTVSSFFNLVDEPSLLLSAGDQVDVQCSTKNIVYDDYNQETQYSGFLLPELLKTIPMAAALGNHDATSKNYRYHFNLPNPYLTPETIGYEITGYNFFFKYNNVLVVVLESNNSSCNDFKTSLKNAIKKYPNTDWRIALFHHDIFGNGATHSQGGSLELRPCLSKLLSSYKFDLVINGHDHLYTASHFISYNEKAENKYTVSKIEKGNVNENPKGTLYITANCSTGSKLYINDLFPYDYVNEFDQPFKSTFGLLKFEKSEEKV

SEQ ID NO: 12183 - protein, 40 aa, Anaeromyces robustus
  Metallo-dependent phosphatases
GTLYISSNSSTGSKLYGYDERDFDYISYYHQTYTSTFGVL

SEQ ID NO: 12184 - protein, 229 aa, Anaeromyces robustus
  Metallo-dependent phosphatases
FKFIFVGDPQIGASHDRISFAKNLQDVLTIPESTRNDAFNWNMTIYKSFEFIKEPSLLLSAGDQIDIACSPKTEEDLYLQETQYSGFLLPDLLKTIPSVIAVGNHEALTHSFKHHFNPPNPYTTPIEPELAPGYSYFFKYNNILFVILETNYGFCDDFKEVMRRAYLKYPNTDWRIAMFHHDIYSNGSNHSQEEYIVRFLRPCLTELLSKYKFDLVINGHDHAYSSSHL

SEQ ID NO: 12185 - protein, 307 aa, Anaeromyces robustus
  Metallo-dependent phosphatases
FKFIFVGDPQIGGSEGHVTYDNPTEPLSEVDGTKNDAFNWNMTIHKSLELTKEPSLLLSAGDQVNAFCMEGYDKQYELQEYEYSALLLPDPLKSLPMATTVGNHEIYTKAFKNHYHTPNSYETPLEPDLAPGYNYFFKYNNVLVIVLETNYGYCDDFKEVMRRAHLKYPNTDWRIVMFHHDIYSNGKFHSQESYITDTLRPCLSQLMTYYKIDLVINGHDHIYSASRLITYDKNEDLGFKSVQLTPGKTNKNVKGTYYVTANCSTGSKLFSFIEESKDYTNNFNQTYTSTFGVIDFEKDKKSHTVQM

SEQ ID NO: 12186 - protein, 300 aa, Anaeromyces robustus
  Metallo-dependent phosphatases
FQFIFVGDPQIGGSHDRLSVADPYHVLTREEGTRNDAFNWNMTIYKSFEKTGKPSVLLSAGDQVDTECFSGTTEEDYSQEIQYSAFLLPDLLKTIPSATTVGNHEALNKNYRNHYNTPNSHIPLEPEIAPGYSYFFKYNNVLVVVLETNYSFCDDFKAVFKKAFLKYPNTDWRVAMFHHDIYGNGSFHSQDEYIINKLRPCLTELLSYYKFDLVINGHDHIFSASKFVSYKKGNKYSLSNIQKGKVNKNAKGTFYITANCSTGSKLFGFINQDFDYNYNFSQTYTSAFGVLDFQKSNGKV

SEQ ID NO: 12187 - protein, 220 aa, Anaeromyces robustus
  Metallo-dependent phosphatases
FKFIFLGDPQIGGSHSHVAHGMRRVLGLDDAIRNDAFNWKRTISKAFEFTKEPSLILSAGDQADTEQDLLYREIEYSALFLPDQLKTVPMAAAVGNHDAWSFSHKLHFNVPNPYLTPDYSYFIPGYSYFFKYNNALVVVLETNYLTENDANAVITNAVKTYPNTDWRIALFHHDMYGNGEVHSQNNDATSLRPYLTKLFTEYQFDVTINGHDHVYTASKI

SEQ ID NO: 12188 - protein, 52 aa, Anaeromyces robustus
  Metallo-dependent phosphatases
NPKGTLYVTANCSSGSKLFKNLKKNIDYVNYSTQTYSATFGVLDFEKVNGKL

SEQ ID NO: 12189 - protein, 307 aa, Piromyces finnis
  Metallo-dependent phosphatases
FKILFVGDPQIGGAHDRITASNNYSRVLTREEGNRNDAFNWNVTVYNSFNFAGQPSLLLSAGDQADEEYAVKGNEYDYNEESQYSAFLLPKLMQTIPTVPTIGNHDSYTENFKYHFNTPNNYASKNYTKYYNGNEPGYNYFFKYNNILFVVLNTNAPICEEFTEIINKAITKYPDTDWRIAMFHQDLYGDGSTHSQNDGITKVLRPCLTKLIYDNKFDLVLNGHDHVYTVSKFITYTGADNYGGYGFNSIERNKVYHKPDGTLYITANCSTGNKLYKYVKPQLDYVYYHDQTYTPTFGVMDFKKSDG

SEQ ID NO: 12190 - protein, 154 aa, Piromyces finnis
  Metallo-dependent phosphatases
YNNVLVVVLETNYGYCDDFKEVLRQAHAKYPNTDWRIAMFHHNIYGNGKYHSQDYHITDVLRPCLTELLSNYKFDLVINGHDHIYTASYFISYSNNDKGYTPEKISQNRIYENPKGTFYITANCSTGSKLYESIDRTMDYVYNYGQNYLSSFGV

SEQ ID NO: 12191 - protein, 39 aa, Piromyces finnis
  Metallo-dependent phosphatases
GTLYITSNCSTGSKLYGFSSNPNRDYVYRYNQTYSSTFG

SEQ ID NO: 12192 - protein, 52 aa, Piromyces finnis
  Metallo-dependent phosphatases
MFHHDIYGNGSTHSSDTDITSKLRPCLTRLMDHYHFDLVLNGHDHVYTVSNF

SEQ ID NO: 12193 - protein, 193 aa, Piromyces finnis
  Metallo-dependent phosphatases
KFKFIFVGDPQIGGSKNRFAFRPGGKSKKFVMEEAIRNDAFNWNMTIVNSFKIAGNEPSLLLSAGDQAETMADDWSEANYLEQETQYSAFLLPELLKQFPSATAIGNHDSLTVNYRNHFNTPNSFTNPSYKDSWKGSRWEGFIPGYSYYFKYNNVVVVVLETNYSDCTDFETVIKEALTKYPEANWRIAMFHH

SEQ ID NO: 12194 - protein, 192 aa, Piromyces finnis
  Metallo-dependent phosphatases
FKFIFVGDPQIGGSKNRFAFRPGGKSKKFVMEEAIRNDAFNWNMTIVNSFKIAGNEPSLLLSAGDQAETMADDWSEANYLEQETQYSAFLLPELLKQFPSATAIGNHDSLTVNYRNHFNTPNSFTNPSYKDSWKGSRWEGFIPGYSYYFKYNNVVVVVLETNYSDCTDFETVIKEALTKYPEANWRIAMFHH

SEQ ID NO: 12195 - protein, 26 aa, Piromyces finnis
  Metallo-dependent phosphatases
GTFFITANCSSGSKLYSFVEDTPDFV

SEQ ID NO: 12196 - protein, 233 aa, Piromyces finnis
  Metallo-dependent phosphatases
FKFIFVGDPQIGGSHDRYSISNLYERVLTVDEGTANDAFNWNRTITHSFDFVKEPSLLLSAGDQADEENNSFYSDQEHYNEETQYSALLLPKQIQTIPMAAAIGNHDRNTENFRHHFNVPNPYKNPSYLMDDGWIEGYNYYFKYNNVLIVVLNTNHEECVDFESVITNAVEKYPDTLWRIALFHHDIYGNGVTHSLEDGMKNVLRPCLTKLLSNFKFDLAISGHDHVYTASKF

SEQ ID NO: 12197 - protein, 286 aa, Piromyces finnis
  Metallo-dependent phosphatases
FKFVFVGDPQIGGSHDRFSITNNYERVLTLNEGNRNDAFNWNRTISRSFEFANKPSLLLSAGDQADEECKHLEDNEKGPMELLNEEMQYSAFLLPDLLKSVPVAAAVGNHDASNNNFRKHFNSPNSYTDPKYQDLIPGYNYFFRHHNVLVVVLETNYGYCEDFSNVIEKAIKKYPDVDWRIAMFHHDIYGNGVTHSKEPYIVNELRPCLTQLFYENKFDLVINGHDHVYTASKFISYDNNNYSVSDIKKNKVYKQPKGTFYITANCSTGSKLYDYYKEDLDYVYQN

SEQ ID NO: 12198 - protein, 286 aa, Piromyces finnis; identical to SEQ ID NO: 12197
  Metallo-dependent phosphatases

SEQ ID NO: 12199 - protein, 283 aa, Piromyces finnis
  Metallo-dependent phosphatases
FNFIFLGDPQIGGSKNRYSKLLKDRGVTIEEGIRNDAFNWNRTLTEAVNYVKTPSLILSAGDQAESMAYDSDEELILQEKEYAAFLTPNLIQSIPTAATVGNHDQYTDNFIHHFNPPNLYNQDTVLQTTGTRVLPGYNYYFKYNNVLVVVLDTNNHNCTDFSTVIEEAIEKHPKTDWRIAMFHHDIYGNGSTHSSEDDIKLYLRPCLTPLIDKAHFDLVINGHDHVYSSSKFISYNDDGSLYSLNDIETNKIYENQNGTLYLTANCSTGSKLYGFSSIKNYTS

SEQ ID NO: 12200 - protein, 283 aa, Piromyces finnis; identical to SEQ ID NO: 12199
  Metallo-dependent phosphatases

SEQ ID NO: 12201 - protein, 283 aa, Piromyces finnis; identical to SEQ ID NO: 12199
  Metallo-dependent phosphatases

SEQ ID NO: 12202 - protein, 283 aa, Piromyces finnis; identical to SEQ ID NO: 12199
  Metallo-dependent phosphatases

SEQ ID NO: 12203 - protein, 330 aa, Neocallimastix californiae
  Metallo-depent_PP-like
NPNNFRFVFLGDPQIGASKNNFSVLTEQRLTEEEGLRNDAFNWNMTIYNSYAKANEASIILSAGDNADSGQSPGDSSGKTEEYIRNDLLRQEREYSTLLLPKLMQQVPFAPAVGNHESFTPSFRYHFNTPNPYLIGKTETSPGYSYFFKHNNVLVIVLETNYGTEEEFREVVGKANSTFPDVDWRVALFHHDIYSNGYTHSQDPLITEYIRKEVTQLFDIYDIDLVINGHDHMYAASHFITYDESRKEGYKVDEVEKNKVYSSHKGTMYLTANCSTGSKLYGIINDRAFDYIYYSNQTFTSTFGILDFTNNNGKTQMVITSYEVDTFNVI

SEQ ID NO: 12204 - protein, 314 aa, Neocallimastix californiae
  Metallo-depent_PP-like
DPDNFKFVFVGDPQIGGSVSRVGYHTSKTFDYSEAVRNDAFNWNVTVNSFFKKTGNPSLLLSAGDQADTMGEDESQEQQYSGLLLPELIKTIPIAPALGNHEVYSESFRHHFNVPNPYKPKKLDTLSRISAYNYYFKYNNVLVVVLESNHNTCHDCEMVISNAIDEYPDTDWRIALFHHDLYGNGKTHSQGSSDGKRLRACLTGLFDIYNFDLVINGHDHVYTSTHFITYSSKNNKGENYKLSEIEEGKTIKNPNGTLFITANCSSGSKFLDFEDSSFDYVYQFNQTFTSTFGVLDFKNESGKVRMTINVYEVD

SEQ ID NO: 12205 - protein, 327 aa, Neocallimastix californiae
  Metallo-depent_PP-like
PDNFRFIFLGDPQIGASAGAISELHLNKVLSDDEGLRNDAFNWNMTIYNSYEKANGPSLILSAGDNADSGQSPSNENSKIEDIKKDLIRQEKQYSALLLPSLMQKVPFATALGNHESYSPSFKYHFNNPNPYKVERSEFSPGYNYFFKYNNALVVMLESNYGIKDDYSDVISNATSTYPDTDWRIAVFHHDIYSNGVMHSSEYRVTELRKWLTPLFDEYDFDLVINGHDHMYSASQFVHHDKSSTDKFKYKVSEIERGKVYDNPKGTLYITANCSTGSKLYNTKGNKDYLYYYNQTFTSTFGILDFKKENGKSQLSITSYEVDTLDI

SEQ ID NO: 12206 - protein, 328 aa, Neocallimastix californiae
  Metallo-depent_PP-like
DPDNFNFIFVGDPQIGGSNDRIIYDSRESQGYSLAIKNDAFNWNMTIYSSFEMTKNPSLLLSAGDNADTENYYSSIDYYNQESEYSAFLLPELIKTIPIAPALGNHETKTEGYKYHFNPPNTYSTKRFEQMSLVPAYSYFFKYNNVLVVVLESNKSSCIDCEIIFSKAVKKYPDTDWRIALFHHDVYGNGKTHSQGDALRLRPCLTGLFSIYKFDVVINGHDHVYTTTKFVAFNNGNEKKNYIVKDIKKGEVNKNPKGTFFITANCSTGSKFFSFDKGTFDYVYNYNQTYTSTFGVMDFKKANGKVRLTIDIYEVDTKKKIDESYIFE

SEQ ID NO: 12207 - protein, 346 aa, Neocallimastix californiae
  Metallo-depent_PP-like
PENFRFVFLGDPQIGSSRGSYSIGNRKQFSDDEGLRNDAFNWNMTIFNSYSKANEASLILSAGDNADSGETPSNGDILDNISNISKMSTDLLRQEKEYSSLLLPELMQKVPFVPAVGNHESYTATYRYHFNTPNSYKVESENQIPGYNYTSITPGYNYYFKHNNVLIVVLESNYGNEEIYTTVMNMANDAYPDVDWRIALFHHDIFSDGYIHSEEGRVQELRQWLTPLFDKFNFDLVINGHDHMYSASHFITYGNNNNIYKFEKIEKNKIYKDPNGTMFITANCSTGSKLYDVGDPKDFIYFSNQTFTSTFGLLDFKNENGKLQLSITSYEVDTYKVTDGPYIFEK

SEQ ID NO: 12208 - protein, 321 aa, Neocallimastix californiae
  Metallo-depent_PP-like
SNDFKFVFVGDPQIGGSNDRLAYQSNSRMNSDSIRNDAFNWNMTVNSFYELTGKPSLLLSAGDQADQMGNDKTQERQYSAYLLPELIKKIPIAPALGNHEVYSESFRRHFNVPNPILKKRFYSNKPVSAYNYYFKYNNVLVVVIETNYNTCHECEKVISEAVKQYPSADWRVALFHHDLYGNGKTHSQGDAQKLRPCLTGLFDIYHFDLVINGHDHVYTSTHFVKFQDSKKKTYDIAKISKGSVNENPNGTFYVTANCSTGSKFLPFYEGKLDYVFNYNQTFTSTFGVLDFQRSNGKVKLTINVYEVETHDVVDGPYIFEK

SEQ ID NO: 12209 - protein, 304 aa, Neocallimastix californiae
  Metallo-depent_PP-like
DPDNFKFIFLGDPQIGGSIGRHQYHSSDYFDYAEAIRNDAFNWNITIFNSIKFTKTPSLILSAGDQADTMGDDITQEQQYSGLLLPELIKTIPFAPTLGNHEVFSESFRRHFNVPHPYIPKKYDDLDYVPAYNYYFKYNNVLVVVLESNHNSCHDCEIVMAKAVDKYPNTDWRIALFHHDIYGNGATHSQGDAKKLRPCLTGLFDIYKFDLVINGHDHVYTTTKFINYNNSNKKSYTLSEIKEGVTNKNPKGTFFITANCSSGSKFLDFTDKTLDYVFNSTQTFTSTFGVLDFKKESGKVKMII

SEQ ID NO: 12210 - protein, 338 aa, Neocallimastix californiae
  Metallo-depent_PP-like
DPDNFRFVFLGDPQIGASRNLISGKKSLTDDEGLRNDAFNWNMTIYNSYEFANEPSLILSAGDNADSGQSPGDDKKSEENIKIDLLRQEREYSTLLLPQIMQKVPFASAIGNHESFTPTFRYHFNTPHSYKVESDNFIKGFQSSITPGYNYFFKYNNVLIVVLESNYSTEEQYREVIENAITTYPETDWRIGLFHHDIYSNGYGHSTEPRVMDLRKWLTPMLDKYDFDLVINGHDHVYVATHFVTSDKNSKNGYSFNKIERNKVYNDPKGTLYLTANCSTGNKLYRLIDPFDFVYYSNQTYTSTFGVLDFKKENGKTQMRITTYEVDTFNVTDGTYIF

SEQ ID NO: 12211 - protein, 315 aa, Neocallimastix californiae
  Metallo-depent_PP-like
PENFNFIFLGDPQIGGSNSRHSALDPTRPLTVEEGTRNDAFNWNRTITNSFQFTREPSVIMTAGDQADSMCIDSNLDEIYNQETQYSAFLLPELMQKIPTATTVGNHDSFTTNYRNHFNPPNTYTTPEYVMANGFSGVIPGYSYFFKYNNVLVVVLETNYNNCNDFENVINKAIEKYPYTDWRIAMFHHDIYGDGYIHSTEDYITKYLRPCLTGIFTDKKFDLVINGHDHVYTASHFISYTGAYNNGGYSFSHIEKNKVYRDPKGTLYITANCSSGSKLYTFVDDNLEPDYVNFSNQTFTATFGVLDFKKENGIS

SEQ ID NO: 12212 - protein, 339 aa, Neocallimastix californiae
  Metallo-depent_PP-like
DPYNFRFIFLGDPQIGASHNVLSIDKYIDDDESLRNDAFNWNMTIYNSYSKANEASLILSAGDNTDSGQSPSDRDILRYPDELEYDLIKQEKEYSSLLLPELMQKVPFASAVGNHESFTASFRYHFNTPNSLEVESNNQIPGYDYASVTPGYSYFFKYNNVLIIVLESNYGTEEQYETLLEKACSTYPGVDWRIALFHHDIYSNGFNHSEEERVLLLRQWLTKLLYKNKIDLVINGHDHIYSASHFISYDINNSNQYKYNITEIERNKIYKDHKGTMYITANSSTGSKLYKTKDYDMGYLYFYNQTYSSTFGILDFKNENGKVQMKITSYEVDTYNITD

SEQ ID NO: 12213 - protein, 320 aa, Neocallimastix californiae
  Metallo-depent_PP-like
DPDNFNFIFVGDPQIGGSHGKPNFLDMSKELTNDEATRNDAFNWERTMNKAFELKSNNPPSLLLSAGDQADDEKLQDYLDETQFSALLQPAVLKGIPHAMTVGNHEQYNENFRHHFNTPNSFTEIERSDREVIPGFNYFFRFNNVLVVVLDTNEPSTYDYSHTMKNAVTKYPDTTWRIVMFHHDLFGIGRTHSQGTYIVNKLRPILNPLLAKYKVDLVINGHDHYYSTSHFVSFDGVNYDISEISENKTFNNPKGILYITANCATGSKLNPRNDAKVDYIYHSNQTYTATFGIIDFEKDIEKQVNRITINYYDVESLDVT

SEQ ID NO: 12214 - protein, 331 aa, Neocallimastix californiae
  Metallo-depent_PP-like
TNNFKFAFVGDPQIGGSNERLAYKSNLLMGGSDGMRNDAFNWNVTVNSFFKQTELMPSLLLSAGDQVDFVGDDLDLEQQYSAYLLPELMKSLPVAPTLGNHEKYSNSFRRHFNVPNPYIPNKLKDMSNDNIYPISSYNYFFKYNNVLVVVLESNRNSCLDCEMVISNAVNKYPEADWRIALFHHDLYGNGKTHSQGIEDSLRLRSCLTGLFDIYKFDLVINGHDHVHTTTKFISYNNKNNNDYNISNIQKNVKNENPKGTFFITANCSTGSKFLDFEEKSINYVFNYTQTFTSSFGTLEFENNDDKVKLTINFLEVDTHNLIDGPYIFEKD

SEQ ID NO: 12215 - protein, 322 aa, Neocallimastix californiae
  Metallo-depent_PP-like
SNDFKFVFVGDPQIGGSNDRLAYKSKSKMNESSIGNDAFNWNMTVNSFYELTGKPSLLLSAGDQADYMGGDKTQERQYSAYLLPDLIKKIPIAPALGNHEVYSESFRRHFNVPNPMFNALHYKTSYSAYNYYFKYNNVLVVVIESNYNTCHQCEKIISKAVKEYPDADWRIALFHHDLYGNGNTHSQGDAQRLRPCLTGLFDIHKFDLVINGHDHVYTSTHFVKFHDSQNKIYDIAKISKGSVNENPNGTFYVTANCSTGSKFLPFYEGELDYVFNYNQTFTSTFGVLDFQKSDGKVTLTINTYEVDTHDVVDGPYIFKKDE

SEQ ID NO: 12216 - protein, 234 aa, Neocallimastix californiae
  Metallo-depent_PP-like
ELLKTIPSATAVGNHDSFTENFRHHFNTPNSYLNPEYTDIIPGYNYFFKFNNVLVVVLETNYGTCDDFTNVISKAIKKYPSTDWRIAMFHHDIYGNGEYHSQDPQITEVLRPCLTKLLYRNEFDLAISGHDHVYSASHFVTYDKESEKGYAVNEIKKGNVYKNPKGTFYLTANCSTGSKLYTFIDKKPSYIYHYKQTFSSTFGILEFKKESGKVRLTINSYEVGTNKVTDGPYI

SEQ ID NO: 12217 - protein, 317 aa, Anaeromyces robustus
  Metallo-depent_PP-like
DPDNFTVAFLGDPQIGGSAGHIPYEKNFKDTLSIEEATRNDAFNWNMTIYKIFEKTVKPSLILSAGDQIDYDGNRKSEYDIDIQEEQYAAFFLPEKLKQVPIAEAIGNHESRLDTFNLHYNVPNPYDTPIEPQIAPGYSYFFKHNNILVVVLETNFGFCEDYQEVMRRAYNKYPDTDWRIALFHHDIYSSGWCHSQEESVTDFLRPCLTELFTKYKFDLAINGHDHIYSTSHFVTFNEQKSSKLKKKYDLQKLEKNVTNEGNKGTFFITANCSTGSKLYGYNDEIDDYLSYFNQTYTSSFGTIDFKKEDGKAKMIIN

SEQ ID NO: 12218 - protein, 329 aa, Anaeromyces robustus
  Metallo-depent_PP-like
ENNFNFIFVGDPQIGGSYNRISVADLTRTLTREEGTRNDAFNWNMTVNSSFEVTKTPSVFLSAGDQIDTECFTVDDYSYYLQETQYSAFLLPELLKSIPSATTVGNHESLTKNFKHHFNTPNSYLTPLEKDLAPGYNYFFKYNNVLVVVLETNYGFCDDFKEVMRQAYLKYPDTDWRIAMFHHDIYGNGKYHSQDDYITMKLRPCLTELISKYKFDLVINGHDHVYSASYFISYEDSAKGYDPKEIVKEKVNENPNGTFYITGNCSSGSKLYGYVEKDFDYVYNYNQTYTSSFGTLDFEKEEDKVRLTINYYEVDTHRKIDGPYIIEKS

SEQ ID NO: 12219 - protein, 327 aa, Anaeromyces robustus
  Metallo-depent_PP-like
IIIAYFGDPQIGGSKGRLSIANPTEPLNVFEATRNDAFNWNNTVYKAYEFQGFQQPDFYFTAGDNADEQAFPDVYESQESQYSAFLLPKIMQQIRLVPALGNHEINSKNFKNHFNVPNPYADEEVRGQNYLPSYHYYFKHYNILVIVLESTTGFDYEFEEIMSRATKSCPDCDWRIVMFHHDIYGAGETHINEDRVQYLRPVLLELLSKYNIDVVINGHDHVYSQSYFLKYDKNSSTKYTKLEIPKDKTYYNPEGTLFITANCATGSKLYRTAENVDYINTASQTFSINSGYLIFDRNEKRVSLTLFSYDFDNVKLIDEIVQINKKA

SEQ ID NO: 12220 - protein, 87 aa, Anaeromyces robustus
  Metallo-depent_PP-like
NVVQSDSRTKYTNPDGIIFFEASTSSGSSYHSLMNDYFKYIARRGQPLDPLYSVMEITIDKESLKTSLTLDTYKVSDNSKYDNGYII

SEQ ID NO: 12221 - protein, 229 aa, Anaeromyces robustus
  Metallo-depent_PP-like
EDRLKVIIGGDPQIGANTKRVAYIPEKGWTLQTGLDAATNDAFNWRLTLKNAYSKHPDTSFIITAGDQIHNSDNNQQEIEYAGFLSNPYLRVLPLASTVGNHDHAGNSINFKHHFNNPIKVTKEAGAVSSGPDYFYSRGKSLFIHLNGNNLNIKDHKNTIDEAIGAYPNNIWRIVVIHFDLYGPASHLNDDTVKVLRTGLTPVFFETKIDVVLQGHNHIHARTHLITRV

SEQ ID NO: 12222 - protein, 345 aa, Anaeromyces robustus
  Metallo-depent_PP-like
DPNNFNFIFVGDPQIGGSHGHISTVKKNGIVTIAEAIPNDAFNWNVTIQSSFSFAKQPSLFISAGDQADTDLKRVRENETNKYNSNCIEYNEHRIFQEQEYSAFLYPNLLKTIPVVAAVGNHDAYTTSFRDHFNTPNSYLTPEKPISVITPDNGKTSSIIPGYNYFFKYNNVLVVVLETNFGTENDFKTVIENAINKYPNTDWRIAVFHHDIYGSGYTHSQDWTIADPDYGIRSVLTKLLNENNFDLAINGHDHVYTASKFISYDENSKKKYHMEEIESGKVYKERKGTLFITANCSTGSKLYDIVHPDPEYAHVSKQDYKVTFGILNFSKKNGTTTLEISTHDV

SEQ ID NO: 12223 - protein, 322 aa, Anaeromyces robustus
  Metallo-depent_PP-like
DPDNFKFIFVGDPQIGGSHSHVAHGMRRVLGLDDGIRNDAFNWKRTISKAFDLTKEPSLVLSAGDQADSPYDLLYREIEYSALFLPDQLKTVPMAAAVGNHDAESFSHDLHFNVPHPYLTPEFQSKIPGYNYFFKFNNVLVVVLETNFITENDAEVVINNAVETYPETEWRIALFHHDMFGNGYAHSQFDDTTRLRKFLTELFTNNNFDVVINGHDHLYTASKFITYDPSRIDESSEKFTGYNVTVVEKDKIYEDPKGTLYITANCSSGSKLYTETGDNDKLDYVNYFTQTYTATFGVLDFEKIDGKLQLKITSYEVENYNE

SEQ ID NO: 12224 - protein, 350 aa, Anaeromyces robustus
  Metallo-depent_PP-like
PKNFKFIFVGDPQIGGSNNHRTFNENSSHLLTVPEGTRNDAFNWNMTIYNSFKLTREPSLLMSAGDQADSECFNQTLENLYNQETQFSALLLPEILQTIPSAFTVGNHESHTESFKFHFNTPNTYRTTECESDSGLEICNNGIYDYDGPFFSPGYSYFFKFNNVLVVVLETNFNTCNDLTTVISNAVEKYKDIDWRIAMFHHDIYGNGQYHSQEPYITDVLRPCLTELFDKNKFDLVINGHDHVYTTSHFVAFSDDSYGKYAYDINEIKKDKVYKNPKGTLYITANCSTGSKLYNYIPETPDYVYYYNQTYTSTFGVLDFKKEGKTPKLSITTYDVETLEVTDGPYIIEK

SEQ ID NO: 12225 - protein, 306 aa, Anaeromyces robustus
  Metallo-depent_PP-like
DPDNFKFIFFGDPQIGGSHSHVSLGQRRILGVDDGIRNDAFSWNRTISKSFEFTKEPSLILSAGDQADDDVDELYQEIEYSALFLPELLKTVPLATAVGNHDSYTINYRQHFHVPNPYLTPEYQYTIPGYSYFFKYNNVLVVVLETNYITENDAYEIIPNAVKKYPDTDWRIALFHQDLYSNGYTHSQQYDVLRLRPFLTKLFSEYNFDLVINGHDHIYSASQFVSYDNINDYYKVSFIQRGKPQENPEGTLYITANCSTGSKLYGFEDFPLDYIYYFNQTFSSTFGVLDFQKENGKHRLNITSYD

SEQ ID NO: 12226 - protein, 330 aa, Anaeromyces robustus
  Metallo-depent_PP-like
DPDNFTFVFVGDPQIGGSHGRISVADITKALSVEQGTRNDVFNWNMTVSSFFNLVDEPSLLLSAGDQVDVQCSTKNIVYDDYNQETQYSGFLLPELLKTIPMAAALGNHDATSKNYRYHFNLPNPYLTPETIGYEITGYNFFFKYNNVLVVVLESNNSSCNDFKTSLKNAIKKYPNTDWRIALFHHDIFGNGATHSQGGSLELRPCLSKLLSSYKFDLVINGHDHLYTASHFISYNEKAENKYTVSKIEKGNVNENPKGTLYITANCSTGSKLYINDLFPYDYVNEFDQPFKSTFGLLKFEKSEEKVRLIINTYDVDHHNVTDGPYIIEK

SEQ ID NO: 12227 - protein, 349 aa, Anaeromyces robustus
  Metallo-depent_PP-like
DPNNFKFIFVGDPQIGASHDRISFAKNLQDVLTIPESTRNDAFNWNMTIYKSFEFIKEPSLLLSAGDQIDIACSPKTEEDLYLQETQYSGFLLPDLLKTIPSVIAVGNHEALTHSFKHHFNPPNPYTTPIEPELAPGYSYFFKYNNILFVILETNYGFCDDFKEVMRRAYLKYPNTDWRIAMFHHDIYSNGSNHSQEEYIVRFLRPCLTELLSKYKFDLVINGHDHAYSSSHLISFHQYLNNNNDNNNNNTNDNDNNSYNLYDIHEIKKGEINKNVNGTLYISSNSSTGSKLYGYDERDFDYISYYHQTYTSTFGVLDFKKEKDNDNVRMTITHYEVDTLRQIDEPYIF

SEQ ID NO: 12228 - protein, 324 aa, Anaeromyces robustus
  Metallo-depent_PP-like
DPDNFKFIFVGDPQIGGSEGHVTYDNPTEPLSEVDGTKNDAFNWNMTIHKSLELTKEPSLLLSAGDQVNAFCMEGYDKQYELQEYEYSALLLPDPLKSLPMATTVGNHEIYTKAFKNHYHTPNSYETPLEPDLAPGYNYFFKYNNVLVIVLETNYGYCDDFKEVMRRAHLKYPNTDWRIVMFHHDIYSNGKFHSQESYITDTLRPCLSQLMTYYKIDLVINGHDHIYSASRLITYDKNEDLGFKSVQLTPGKTNKNVKGTYYVTANCSTGSKLFSFIEESKDYTNNFNQTYTSTFGVIDFEKDKKSHTVQMTVNYYEVDTLRQI

SEQ ID NO: 12229 - protein, 323 aa, Anaeromyces robustus
  Metallo-depent_PP-like
DPNNFQFIFVGDPQIGGSHDRLSVADPYHVLTREEGTRNDAFNWNMTIYKSFEKTGKPSVLLSAGDQVDTECFSGTTEEDYSQEIQYSAFLLPDLLKTIPSATTVGNHEALNKNYRNHYNTPNSHIPLEPEIAPGYSYFFKYNNVLVVVLETNYSFCDDFKAVFKKAFLKYPNTDWRVAMFHHDIYGNGSFHSQDEYIINKLRPCLTELLSYYKFDLVINGHDHIFSASKFVSYKKGNKYSLSNIQKGKVNKNAKGTFYITANCSTGSKLFGFINQDFDYNYNFSQTYTSAFGVLDFQKSNGKVKLTVNYYEVDTLRQIDGPY

SEQ ID NO: 12230 - protein, 318 aa, Anaeromyces robustus
  Metallo-depent_PP-like
NFKFIFLGDPQIGGSHSHVAHGMRRVLGLDDAIRNDAFNWKRTISKAFEFTKEPSLILSAGDQADTEQDLLYREIEYSALFLPDQLKTVPMAAAVGNHDAWSFSHKLHFNVPNPYLTPDYSYFIPGYSYFFKYNNALVVVLETNYLTENDANAVITNAVKTYPNTDWRIALFHHDMYGNGEVHSQNNDATSLRPYLTKLFTEYQFDVTINGHDHVYTASKIVAYDPSKIDESSEIFTGYNTTTIEKGKVYQNPKGTLYVTANCSSGSKLFKNLKKNIDYVNYSTQTYSATFGVLDFEKVNGKLRLNITSYEVEDYNIV

SEQ ID NO: 12231 - protein, 327 aa, Piromyces finnis
  Metallo-depent_PP-like
QDNFKILFVGDPQIGGAHDRITASNNYSRVLTREEGNRNDAFNWNVTVYNSFNFAGQPSLLLSAGDQADEEYAVKGNEYDYNEESQYSAFLLPKLMQTIPTVPTIGNHDSYTENFKYHFNTPNNYASKNYTKYYNGNEPGYNYFFKYNNILFVVLNTNAPICEEFTEIINKAITKYPDTDWRIAMFHQDLYGDGSTHSQNDGITKVLRPCLTKLIYDNKFDLVLNGHDHVYTVSKFITYTGADNYGGYGFNSIERNKVYHKPDGTLYITANCSTGNKLYKYVKPQLDYVYYHDQTYTPTFGVMDFKKSDGKVTMTINTYDVESHKLV

SEQ ID NO: 12232 - protein, 186 aa, Piromyces finnis
  Metallo-depent_PP-like
YNNVLVVVLETNYGYCDDFKEVLRQAHAKYPNTDWRIAMFHHNIYGNGKYHSQDYHITDVLRPCLTELLSNYKFDLVINGHDHIYTASYFISYSNNDKGYTPEKISQNRIYENPKGTFYITANCSTGSKLYESIDRTMDYVYNYGQNYLSSFGVLDFSKEDGKVKLTISNYDVDTGNKVDGDYIIQ

SEQ ID NO: 12233 - protein, 99 aa, Piromyces finnis
  Metallo-depent_PP-like
NGHDHVYTASKFISYTGADNLGGYTPSEIVTNKAIRDPKGTLYITANCSTGSKLYDYYQGEIDIDYVHFYNQTFTATFGVLDFEKEDDIVRMSITTYDV

SEQ ID NO: 12234 - protein, 117 aa, Piromyces finnis
  Metallo-depent_PP-like
LVINGHDHVYTTTKFVSYVKKSNDYNSPDNYQVDPIERNVVNKNPKGTFYVTANCSSGAKYLDFLKDPNVDYVYSFNQTYTQTFGILDFTQANGKVRLEITTYDAETYDVIDGSYII

SEQ ID NO: 12235 - protein, 136 aa, Piromyces finnis
  Metallo-depent_PP-like
DDKNFKFIFMGDAQIGGSHGRYRSYPQFQYRTTDDEGNRNDVFNWNRVVNSAFKFSKTPSVLLSAGDQADDSRSFNDDRKYLYKKMTNIESQYSGFLYPELLKHIVTATSVGNHETTSNGFGRRFNTPNSLKNCTL

SEQ ID NO: 12236 - protein, 146 aa, Piromyces finnis
  Metallo-depent_PP-like
AMFHHDIYGNGSTHSSDTDITSKLRPCLTRLMDHYHFDLVLNGHDHVYTVSNFIHYKGTDNDQMEGYYGVSSIKKEEVNKNVNGTLYITSNCSTGSKLYGFSSNPNRDYVYRYNQTYSSTFGVLDFNTTDTTTMLSITIYEVDSME

SEQ ID NO: 12237 - protein, 195 aa, Piromyces finnis
  Metallo-depent_PP-like
SKKFKFIFVGDPQIGGSKNRFAFRPGGKSKKFVMEEAIRNDAFNWNMTIVNSFKIAGNEPSLLLSAGDQAETMADDWSEANYLEQETQYSAFLLPELLKQFPSATAIGNHDSLTVNYRNHFNTPNSFTNPSYKDSWKGSRWEGFIPGYSYYFKYNNVVVVVLETNYSDCTDFETVIKEALTKYPEANWRIAMFHH

SEQ ID NO: 12238 - protein, 196 aa, Piromyces finnis
  Metallo-depent_PP-like
NPDNFKFIFVGDPQIGGSKNRFAFRPGGKSKKFVMEEAIRNDAFNWNMTIVNSFKIAGNEPSLLLSAGDQAETMADDWSEANYLEQETQYSAFLLPELLKQFPSATAIGNHDSLTVNYRNHFNTPNSFTNPSYKDSWKGSRWEGFIPGYSYYFKYNNVVVVVLETNYSDCTDFETVIKEALTKYPEANWRIAMFHH

SEQ ID NO: 12239 - protein, 330 aa, Piromyces finnis
  Metallo-depent_PP-like
NPDNFKFIFVGDPQIGGSHDRYSISNLYERVLTVDEGTANDAFNWNRTITHSFDFVKEPSLLLSAGDQADEENNSFYSDQEHYNEETQYSALLLPKQIQTIPMAAAIGNHDRNTENFRHHFNVPNPYKNPSYLMDDGWIEGYNYYFKYNNVLIVVLNTNHEECVDFESVITNAVEKYPDTLWRIALFHHDIYGNGVTHSLEDGMKNVLRPCLTKLLSNFKFDLAISGHDHVYTASKFITYDANANNSGKYVTSDIQTNETFKDPKGTFFITANCSSGSKLYSFVEDTPDFVHEDIQSFTSTFGTLDFTKEYGKATLKIVTYDVESPDTII

SEQ ID NO: 12240 - protein, 325 aa, Piromyces finnis
  Metallo-depent_PP-like
DPYNFKFVFVGDPQIGGSHDRFSITNNYERVLTLNEGNRNDAFNWNRTISRSFEFANKPSLLLSAGDQADEECKHLEDNEKGPMELLNEEMQYSAFLLPDLLKSVPVAAAVGNHDASNNNFRKHFNSPNSYTDPKYQDLIPGYNYFFRHHNVLVVVLETNYGYCEDFSNVIEKAIKKYPDVDWRIAMFHHDIYGNGVTHSKEPYIVNELRPCLTQLFYENKFDLVINGHDHVYTASKFISYDNNNYSVSDIKKNKVYKQPKGTFYITANCSTGSKLYDYYKEDLDYVYQNSQTFSATFGILDFKVEDGITKLSIASYDVETYEII

SEQ ID NO: 12241 - protein, 325 aa, Piromyces finnis; identical to SEQ ID NO: 12240
  Metallo-depent_PP-like

SEQ ID NO: 12242 - protein, 323 aa, Piromyces finnis
  Metallo-depent_PP-like
SDHFNFIFLGDPQIGGSKNRYSKLLKDRGVTIEEGIRNDAFNWNRTLTEAVNYVKTPSLILSAGDQAESMAYDSDEELILQEKEYAAFLTPNLIQSIPTAATVGNHDQYTDNFIHHFNPPNLYNQDTVLQTTGTRVLPGYNYYFKYNNVLVVVLDTNNHNCTDFSTVIEEAIEKHPKTDWRIAMFHHDIYGNGSTHSSEDDIKLYLRPCLTPLIDKAHFDLVINGHDHVYSSSKFISYNDDGSLYSLNDIETNKIYENQNGTLYLTANCSTGSKLYGFSSIKNYTSYYKQTFTSNFGVLDFENVDGKTRLSITTLEVESKNIV

SEQ ID NO: 12243 - protein, 323 aa, Piromyces finnis; identical to SEQ ID NO: 12242
  Metallo-depent_PP-like

SEQ ID NO: 12244 - protein, 323 aa, Piromyces finnis; identical to SEQ ID NO: 12242
  Metallo-depent_PP-like

SEQ ID NO: 12245 - protein, 323 aa, Piromyces finnis; identical to SEQ ID NO: 12242
  Metallo-depent_PP-like

SEQ ID NO: 12246 - protein, 229 aa, Neocallimastix californiae
  Metallophos
FRFVFLGDPQIGASKNNFSVLTEQRLTEEEGLRNDAFNWNMTIYNSYAKANEASIILSAGDNADSGQSPGDSSGKTEEYIRNDLLRQEREYSTLLLPKLMQQVPFAPAVGNHESFTPSFRYHFNTPNPYLIGKTETSPGYSYFFKHNNVLVIVLETNYGTEEEFREVVGKANSTFPDVDWRVALFHHDIYSNGYTHSQDPLITEYIRKEVTQLFDIYDIDLVINGHDHM

SEQ ID NO: 12247 - protein, 217 aa, Neocallimastix californiae
  Metallophos
FKFVFVGDPQIGGSVSRVGYHTSKTFDYSEAVRNDAFNWNVTVNSFFKKTGNPSLLLSAGDQADTMGEDESQEQQYSGLLLPELIKTIPIAPALGNHEVYSESFRHHFNVPNPYKPKKLDTLSRISAYNYYFKYNNVLVVVLESNHNTCHDCEMVISNAIDEYPDTDWRIALFHHDLYGNGKTHSQGSSDGKRLRACLTGLFDIYNFDLVINGHDHV

SEQ ID NO: 12248 - protein, 228 aa, Neocallimastix californiae
  Metallophos
FRFIFLGDPQIGASAGAISELHLNKVLSDDEGLRNDAFNWNMTIYNSYEKANGPSLILSAGDNADSGQSPSNENSKIEDIKKDLIRQEKQYSALLLPSLMQKVPFATALGNHESYSPSFKYHFNNPNPYKVERSEFSPGYNYFFKYNNALVVMLESNYGIKDDYSDVISNATSTYPDTDWRIAVFHHDIYSNGVMHSSEYRVTELRKWLTPLFDEYDFDLVINGHDHM

SEQ ID NO: 12249 - protein, 219 aa, Neocallimastix californiae
  Metallophos
NFIFVGDPQIGGSNDRIIYDSRESQGYSLAIKNDAFNWNMTIYSSFEMTKNPSLLLSAGDNADTENYYSSIDYYNQESEYSAFLLPELIKTIPIAPALGNHETKTEGYKYHFNPPNTYSTKRFEQMSLVPAYSYFFKYNNVLVVVLESNKSSCIDCEIIFSKAVKKYPDTDWRIALFHHDVYGNGKTHSQGDALRLRPCLTGLFSIYKFDVVINGHDHV

SEQ ID NO: 12250 - protein, 241 aa, Neocallimastix californiae
  Metallophos
FRFVFLGDPQIGSSRGSYSIGNRKQFSDDEGLRNDAFNWNMTIFNSYSKANEASLILSAGDNADSGETPSNGDILDNISNISKMSTDLLRQEKEYSSLLLPELMQKVPFVPAVGNHESYTATYRYHFNTPNSYKVESENQIPGYNYTSITPGYNYYFKHNNVLIVVLESNYGNEEIYTTVMNMANDAYPDVDWRIALFHHDIFSDGYIHSEEGRVQELRQWLTPLFDKFNFDLVINGHDHM

SEQ ID NO: 12251 - protein, 213 aa, Neocallimastix californiae
  Metallophos
KFVFVGDPQIGGSNDRLAYQSNSRMNSDSIRNDAFNWNMTVNSFYELTGKPSLLLSAGDQADQMGNDKTQERQYSAYLLPELIKKIPIAPALGNHEVYSESFRRHFNVPNPILKKRFYSNKPVSAYNYYFKYNNVLVVVIETNYNTCHECEKVISEAVKQYPSADWRVALFHHDLYGNGKTHSQGDAQKLRPCLTGLFDIYHFDLVINGHDHV

SEQ ID NO: 12252 - protein, 214 aa, Neocallimastix californiae
  Metallophos
KFIFLGDPQIGGSIGRHQYHSSDYFDYAEAIRNDAFNWNITIFNSIKFTKTPSLILSAGDQADTMGDDITQEQQYSGLLLPELIKTIPFAPTLGNHEVFSESFRRHFNVPHPYIPKKYDDLDYVPAYNYYFKYNNVLVVVLESNHNSCHDCEIVMAKAVDKYPNTDWRIALFHHDIYGNGATHSQGDAKKLRPCLTGLFDIYKFDLVINGHDHV

SEQ ID NO: 12253 - protein, 233 aa, Neocallimastix californiae
  Metallophos
FRFVFLGDPQIGASRNLISGKKSLTDDEGLRNDAFNWNMTIYNSYEFANEPSLILSAGDNADSGQSPGDDKKSEENIKIDLLRQEREYSTLLLPQIMQKVPFASAIGNHESFTPTFRYHFNTPHSYKVESDNFIKGFQSSITPGYNYFFKYNNVLIVVLESNYSTEEQYREVIENAITTYPETDWRIGLFHHDIYSNGYGHSTEPRVMDLRKWLTPMLDKYDFDLVINGHDHV

SEQ ID NO: 12254 - protein, 227 aa, Neocallimastix californiae
  Metallophos
NFIFLGDPQIGGSNSRHSALDPTRPLTVEEGTRNDAFNWNRTITNSFQFTREPSVIMTAGDQADSMCIDSNLDEIYNQETQYSAFLLPELMQKIPTATTVGNHDSFTTNYRNHFNPPNTYTTPEYVMANGFSGVIPGYSYFFKYNNVLVVVLETNYNNCNDFENVINKAIEKYPYTDWRIAMFHHDIYGDGYIHSTEDYITKYLRPCLTGIFTDKKFDLVINGHDHV

SEQ ID NO: 12255 - protein, 236 aa, Neocallimastix californiae
  Metallophos
FRFIFLGDPQIGASHNVLSIDKYIDDDESLRNDAFNWNMTIYNSYSKANEASLILSAGDNTDSGQSPSDRDILRYPDELEYDLIKQEKEYSSLLLPELMQKVPFASAVGNHESFTASFRYHFNTPNSLEVESNNQIPGYDYASVTPGYSYFFKYNNVLIIVLESNYGTEEQYETLLEKACSTYPGVDWRIALFHHDIYSNGFNHSEEERVLLLRQWLTKLLYKNKIDLVINGHDHI

SEQ ID NO: 12256 - protein, 220 aa, Neocallimastix californiae
  Metallophos
NFIFVGDPQIGGSHGKPNFLDMSKELTNDEATRNDAFNWERTMNKAFELKSNNPPSLLLSAGDQADDEKLQDYLDETQFSALLQPAVLKGIPHAMTVGNHEQYNENFRHHFNTPNSFTEIERSDREVIPGFNYFFRFNNVLVVVLDTNEPSTYDYSHTMKNAVTKYPDTTWRIVMFHHDLFGIGRTHSQGTYIVNKLRPILNPLLAKYKVDLVINGHDHY

SEQ ID NO: 12257 - protein, 222 aa, Neocallimastix californiae
  Metallophos
FKFAFVGDPQIGGSNERLAYKSNLLMGGSDGMRNDAFNWNVTVNSFFKQTELMPSLLLSAGDQVDFVGDDLDLEQQYSAYLLPELMKSLPVAPTLGNHEKYSNSFRRHFNVPNPYIPNKLKDMSNDNIYPISSYNYFFKYNNVLVVVLESNRNSCLDCEMVISNAVNKYPEADWRIALFHHDLYGNGKTHSQGIEDSLRLRSCLTGLFDIYKFDLVINGHDH

SEQ ID NO: 12258 - protein, 212 aa, Neocallimastix californiae
  Metallophos
KFVFVGDPQIGGSNDRLAYKSKSKMNESSIGNDAFNWNMTVNSFYELTGKPSLLLSAGDQADYMGGDKTQERQYSAYLLPDLIKKIPIAPALGNHEVYSESFRRHFNVPNPMFNALHYKTSYSAYNYYFKYNNVLVVVIESNYNTCHQCEKIISKAVKEYPDADWRIALFHHDLYGNGNTHSQGDAQRLRPCLTGLFDIHKFDLVINGHDHV

SEQ ID NO: 12259 - protein, 134 aa, Neocallimastix californiae
  Metallophos
PELLKTIPSATAVGNHDSFTENFRHHFNTPNSYLNPEYTDIIPGYNYFFKFNNVLVVVLETNYGTCDDFTNVISKAIKKYPSTDWRIAMFHHDIYGNGEYHSQDPQITEVLRPCLTKLLYRNEFDLAISGHDHV

SEQ ID NO: 12260 - protein, 223 aa, Anaeromyces robustus
  Metallophos
FTVAFLGDPQIGGSAGHIPYEKNFKDTLSIEEATRNDAFNWNMTIYKIFEKTVKPSLILSAGDQIDYDGNRKSEYDIDIQEEQYAAFFLPEKLKQVPIAEAIGNHESRLDTFNLHYNVPNPYDTPIEPQIAPGYSYFFKHNNILVVVLETNFGFCEDYQEVMRRAYNKYPDTDWRIALFHHDIYSSGWCHSQEESVTDFLRPCLTELFTKYKFDLAINGHDHI

SEQ ID NO: 12261 - protein, 145 aa, Anaeromyces robustus
  Metallophos
LQETQYSAFLLPELLKSIPSATTVGNHESLTKNFKHHFNTPNSYLTPLEKDLAPGYNYFFKYNNVLVVVLETNYGFCDDFKEVMRQAYLKYPDTDWRIAMFHHDIYGNGKYHSQDDYITMKLRPCLTELISKYKFDLVINGHDHV

SEQ ID NO: 12262 - protein, 217 aa, Anaeromyces robustus
  Metallophos
FGDPQIGGSKGRLSIANPTEPLNVFEATRNDAFNWNNTVYKAYEFQGFQQPDFYFTAGDNADEQAFPDVYESQESQYSAFLLPKIMQQIRLVPALGNHEINSKNFKNHFNVPNPYADEEVRGQNYLPSYHYYFKHYNILVIVLESTTGFDYEFEEIMSRATKSCPDCDWRIVMFHHDIYGAGETHINEDRVQYLRPVLLELLSKYNIDVVINGHDHV

SEQ ID NO: 12263 - protein, 172 aa, Anaeromyces robustus
  Metallophos
LTLKNAYSKHPDTSFIITAGDQIHNSDNNQQEIEYAGFLSNPYLRVLPLASTVGNHDHAGNSINFKHHFNNPIKVTKEAGAVSSGPDYFYSRGKSLFIHLNGNNLNIKDHKNTIDEAIGAYPNNIWRIVVIHFDLYGPASHLNDDTVKVLRTGLTPVFFETKIDVVLQGHNH

SEQ ID NO: 12264 - protein, 250 aa, Anaeromyces robustus
  Metallophos
NFIFVGDPQIGGSHGHISTVKKNGIVTIAEAIPNDAFNWNVTIQSSFSFAKQPSLFISAGDQADTDLKRVRENETNKYNSNCIEYNEHRIFQEQEYSAFLYPNLLKTIPVVAAVGNHDAYTTSFRDHFNTPNSYLTPEKPISVITPDNGKTSSIIPGYNYFFKYNNVLVVVLETNFGTENDFKTVIENAINKYPNTDWRIAVFHHDIYGSGYTHSQDWTIADPDYGIRSVLTKLLNENNFDLAINGHDHV

SEQ ID NO: 12265 - protein, 214 aa, Anaeromyces robustus
  Metallophos
FKFIFVGDPQIGGSHSHVAHGMRRVLGLDDGIRNDAFNWKRTISKAFDLTKEPSLVLSAGDQADSPYDLLYREIEYSALFLPDQLKTVPMAAAVGNHDAESFSHDLHFNVPHPYLTPEFQSKIPGYNYFFKFNNVLVVVLETNFITENDAEVVINNAVETYPETEWRIALFHHDMFGNGYAHSQFDDTTRLRKFLTELFTNNNFDVVINGHDHL

SEQ ID NO: 12266 - protein, 241 aa, Anaeromyces robustus
  Metallophos
FKFIFVGDPQIGGSNNHRTFNENSSHLLTVPEGTRNDAFNWNMTIYNSFKLTREPSLLMSAGDQADSECFNQTLENLYNQETQFSALLLPEILQTIPSAFTVGNHESHTESFKFHFNTPNTYRTTECESDSGLEICNNGIYDYDGPFFSPGYSYFFKFNNVLVVVLETNFNTCNDLTTVISNAVEKYKDIDWRIAMFHHDIYGNGQYHSQEPYITDVLRPCLTELFDKNKFDLVINGHDHV

SEQ ID NO: 12267 - protein, 214 aa, Anaeromyces robustus
  Metallophos
FKFIFFGDPQIGGSHSHVSLGQRRILGVDDGIRNDAFSWNRTISKSFEFTKEPSLILSAGDQADDDVDELYQEIEYSALFLPELLKTVPLATAVGNHDSYTINYRQHFHVPNPYLTPEYQYTIPGYSYFFKYNNVLVVVLETNYITENDAYEIIPNAVKKYPDTDWRIALFHQDLYSNGYTHSQQYDVLRLRPFLTKLFSEYNFDLVINGHDHI

SEQ ID NO: 12268 - protein, 221 aa, Anaeromyces robustus
  Metallophos
TFVFVGDPQIGGSHGRISVADITKALSVEQGTRNDVFNWNMTVSSFFNLVDEPSLLLSAGDQVDVQCSTKNIVYDDYNQETQYSGFLLPELLKTIPMAAALGNHDATSKNYRYHFNLPNPYLTPETIGYEITGYNFFFKYNNVLVVVLESNNSSCNDFKTSLKNAIKKYPNTDWRIALFHHDIFGNGATHSQGGSLELRPCLSKLLSSYKFDLVINGHDHL

SEQ ID NO: 12269 - protein, 223 aa, Anaeromyces robustus
  Metallophos
FKFIFVGDPQIGASHDRISFAKNLQDVLTIPESTRNDAFNWNMTIYKSFEFIKEPSLLLSAGDQIDIACSPKTEEDLYLQETQYSGFLLPDLLKTIPSVIAVGNHEALTHSFKHHFNPPNPYTTPIEPELAPGYSYFFKYNNILFVILETNYGFCDDFKEVMRRAYLKYPNTDWRIAMFHHDIYSNGSNHSQEEYIVRFLRPCLTELLSKYKFDLVINGHDHA

SEQ ID NO: 12270 - protein, 222 aa, Anaeromyces robustus
  Metallophos
FKFIFVGDPQIGGSEGHVTYDNPTEPLSEVDGTKNDAFNWNMTIHKSLELTKEPSLLLSAGDQVNAFCMEGYDKQYELQEYEYSALLLPDPLKSLPMATTVGNHEIYTKAFKNHYHTPNSYETPLEPDLAPGYNYFFKYNNVLVIVLETNYGYCDDFKEVMRRAHLKYPNTDWRIVMFHHDIYSNGKFHSQESYITDTLRPCLSQLMTYYKIDLVINGHDHI

SEQ ID NO: 12271 - protein, 219 aa, Anaeromyces robustus
  Metallophos
QFIFVGDPQIGGSHDRLSVADPYHVLTREEGTRNDAFNWNMTIYKSFEKTGKPSVLLSAGDQVDTECFSGTTEEDYSQEIQYSAFLLPDLLKTIPSATTVGNHEALNKNYRNHYNTPNSHIPLEPEIAPGYSYFFKYNNVLVVVLETNYSFCDDFKAVFKKAFLKYPNTDWRVAMFHHDIYGNGSFHSQDEYIINKLRPCLTELLSYYKFDLVINGHDH

SEQ ID NO: 12272 - protein, 214 aa, Anaeromyces robustus
  Metallophos
FKFIFLGDPQIGGSHSHVAHGMRRVLGLDDAIRNDAFNWKRTISKAFEFTKEPSLILSAGDQADTEQDLLYREIEYSALFLPDQLKTVPMAAAVGNHDAWSFSHKLHFNVPNPYLTPDYSYFIPGYSYFFKYNNALVVVLETNYLTENDANAVITNAVKTYPNTDWRIALFHHDMYGNGEVHSQNNDATSLRPYLTKLFTEYQFDVTINGHDHV

SEQ ID NO: 12273 - protein, 227 aa, Piromyces finnis
  Metallophos
FKILFVGDPQIGGAHDRITASNNYSRVLTREEGNRNDAFNWNVTVYNSFNFAGQPSLLLSAGDQADEEYAVKGNEYDYNEESQYSAFLLPKLMQTIPTVPTIGNHDSYTENFKYHFNTPNNYASKNYTKYYNGNEPGYNYFFKYNNILFVVLNTNAPICEEFTEIINKAITKYPDTDWRIAMFHQDLYGDGSTHSQNDGITKVLRPCLTKLIYDNKFDLVLNGHDHV

SEQ ID NO: 12274 - protein, 66 aa, Piromyces finnis
  Metallophos
FKEVLRQAHAKYPNTDWRIAMFHHNIYGNGKYHSQDYHITDVLRPCLTELLSNYKFDLVINGHDHI

SEQ ID NO: 12275 - protein, 227 aa, Piromyces finnis
  Metallophos
FKFIFVGDPQIGGSHDRYSISNLYERVLTVDEGTANDAFNWNRTITHSFDFVKEPSLLLSAGDQADEENNSFYSDQEHYNEETQYSALLLPKQIQTIPMAAAIGNHDRNTENFRHHFNVPNPYKNPSYLMDDGWIEGYNYYFKYNNVLIVVLNTNHEECVDFESVITNAVEKYPDTLWRIALFHHDIYGNGVTHSLEDGMKNVLRPCLTKLLSNFKFDLAISGHDHV

SEQ ID NO: 12276 - protein, 228 aa, Piromyces finnis
  Metallophos
FKFVFVGDPQIGGSHDRFSITNNYERVLTLNEGNRNDAFNWNRTISRSFEFANKPSLLLSAGDQADEECKHLEDNEKGPMELLNEEMQYSAFLLPDLLKSVPVAAAVGNHDASNNNFRKHFNSPNSYTDPKYQDLIPGYNYFFRHHNVLVVVLETNYGYCEDFSNVIEKAIKKYPDVDWRIAMFHHDIYGNGVTHSKEPYIVNELRPCLTQLFYENKFDLVINGHDHV

SEQ ID NO: 12277 - protein, 228 aa, Piromyces finnis; identical to SEQ ID NO: 12276
  Metallophos

SEQ ID NO: 12278 - protein, 225 aa, Piromyces finnis
  Metallophos
NFIFLGDPQIGGSKNRYSKLLKDRGVTIEEGIRNDAFNWNRTLTEAVNYVKTPSLILSAGDQAESMAYDSDEELILQEKEYAAFLTPNLIQSIPTAATVGNHDQYTDNFIHHFNPPNLYNQDTVLQTTGTRVLPGYNYYFKYNNVLVVVLDTNNHNCTDFSTVIEEAIEKHPKTDWRIAMFHHDIYGNGSTHSSEDDIKLYLRPCLTPLIDKAHFDLVINGHDHV

SEQ ID NO: 12279 - protein, 225 aa, Piromyces finnis; identical to SEQ ID NO: 12278
  Metallophos

SEQ ID NO: 12280 - protein, 225 aa, Piromyces finnis; identical to SEQ ID NO: 12278
  Metallophos

SEQ ID NO: 12281 - protein, 225 aa, Piromyces finnis; identical to SEQ ID NO: 12278
  Metallophos

SEQ ID NO: 12282 - protein, 62 aa, Neocallimastix californiae
  Mucin
CSKTQNSAEPEVTSKAKTTTTTTTTTTAPKTTTTTTTTTTTTTTKPVTTTTTTTTTSKATKT

SEQ ID NO: 12283 - protein, 56 aa, Neocallimastix californiae
  Mucin
KQKTTTTTTTTTIKKTTTTTTTTTTKTTTTTTKTTTTTTTTTTTTTRSPQPTVQCA

SEQ ID NO: 12284 - protein, 106 aa, Neocallimastix californiae
  NAD(P)-bd_dom
IGGLGHLAVQFASKMGYEVTALSTSYNKKEEATGFGCHNFVLLKEAAEKVPNYFDLIINTSPYDMDWKMLLGLLRPNGKLCLIGIPAVDMKVPVMPIIFSQKTICG

SEQ ID NO: 12285 - protein, 172 aa, Neocallimastix californiae
  NAD(P)-bd_dom
GTILITGGLGGVGFDISRYLMRQPNLKALVLTGRRPETDEKVAGKLAELRALNPKIKITYVTANVGSETEMKKVIDDINAGSPEEALVGVFHTAGTNDDGLIFNQSYERFAKLINSKIEGTLCIAKLTNDLNLKFTILFSSMTAFFGNRGQINYCTANMFINKVCDYYRNHG

SEQ ID NO: 12286 - protein, 162 aa, Neocallimastix californiae
  NAD(P)-bd_dom
AGKPKEGETIFVTAAAGAVGQVVCQLAKLKGLRVVACASSPEKIGFLKQAIKVDEAFSYRDFPDKESFTAQLRKVCPNGIDIYYDNVGGYILDSALELMNIHGRVIMCGMISQYNLTEKYKYTLRDITSRRLTLQGCLFNDYFPQCMGEFMQDMIPKLQQGK

SEQ ID NO: 12287 - protein, 237 aa, Neocallimastix californiae
  NAD(P)-bd_dom
LRFDERVVVITGAGGGFGRAHAFLFASRGATLVLNDNAIISNNNGQPKYLVDDVVREITKAGFHAIANYEPIGNGDKIIEAAMNAFGRVDILINNAGVTCNKPFKEMSDKDWEYVHNVNLHGAYKVTKAVWPIMQKQKYGRIINIVSAAGLYGSYGQTNYSSAKMALHGFTLSLAREGYRYNIYCNCVSPYVALNYDASIKDKSVQVVKPEFLSPLLVFLTHEKTRENGSHFEAGAG

SEQ ID NO: 12288 - protein, 264 aa, Neocallimastix californiae
  NAD(P)-bd_dom
PSNNESVGDLSFKGKVVIITGAGGGLGRAYAKHFAKLGASVVVNDLGVLLRGRGANTQVADSVVEEIKQMGGIAVPSYDSVEEGEKIVETAIKNFGRVDIIINNAGILRDRSFGRMTDTDWMMTYRVHLKGTYKVTRAAWPYMMKQKYGRIINITSAAGLFGNFGQSNYAAAKSGVIGLTNALALEGKEYNITVNSVAPNAGTRMTATIMPQEMVELLKPEYTAPLISFLTHESCNATGGIYEVGSCWVARLRWQRSGGASFAI

SEQ ID NO: 12289 - protein, 237 aa, Neocallimastix californiae
  NAD(P)-bd_dom
LRFDERVVVITGAGGGFGRAHAFLFASRGATLVLNDNAIISNSNGQKKYLVDDVVHEITKAGFHAIANYEPIGNGDKIIEAAMNAFGRVDILINNAGVTCNKPFKEMSDKDWEYVHNVNLHGAYKVTKAVWPIMQKQKYGRIINIVSAAGLYGSYGQSNYSSAKMALHGFTLSLAREGYRYNIYCNCVSPYVALNYDASIKDKSVQVVKPEFLSPLLVFLTHEKTRENGSHFEAGAG

SEQ ID NO: 12290 - protein, 260 aa, Neocallimastix californiae
  NAD(P)-bd_dom
SIGDLSFKGRVVIVTGAGGGLGRAYAKHFAKLGASVVVNDLGVLLRGRGANTQVADGVVEEIKKMGGIAVPSYDSVEEGEKIVETAIKNFGRVDIIINNAGILRDRSFARMTDTDWMMTYRVHLKGTYKVTRAAWPYMMKQKYGRIINITSAAGLFGNFGQSNYAAAKSGVIGLTNALALEGKEHNITINSVAPNAGTRMTATIMPQEMVELLKPEYTAPLISFLTHESCNVTGGIYEVGSCWVARLRWQRSGGASFAIN

SEQ ID NO: 12291 - protein, 174 aa, Neocallimastix californiae
  NAD(P)-bd_dom
VNPPTAYRMLKDFVNLKKGDVVIQNGANSAVGQSVIQIAKAWGIKTINVIRDRPNFEEVAGELHKLGATLVIKEEDLRSNSTRELVKNLGSPVRLALNCVGGKSASGITRLLGQNATIVTYGGMSKQPLTFGTGPFIFKNLRASGFWISRWNKEASKKDKQYMFDDICELVRGG

SEQ ID NO: 12292 - protein, 213 aa, Neocallimastix californiae
  NAD(P)-bd_dom
NILITGGLGDVSMDVVNSLLADKDSKLEHIFLLGRSSKTNSRVIEKLARIEKVRKDHDKNIQIEYYSCDISDESSLAEVFNDIRKRQGLQITGIFHTAGVNSDANFLSQSYEKLVEIAPSKIIGTHNIMKLSEEFKDELKFVVFVSSLSAVSGNGGQTNYTAANMFIDALARYYNDHGRTNVIAIELGGWKGAGSSDQLVNDFMVITSEAGFN

SEQ ID NO: 12293 - protein, 108 aa, Neocallimastix californiae
  NAD(P)-bd_dom
IMGLGGLGHLGVQFAHAMGAEVTVLGHSESKKEEAKKLGADCYEILKTDEDFKKYYRTFDFILNCATANLNLDNHFKLLKPNGVLCFVSIVPEEQRFSELNLFGNQAS

SEQ ID NO: 12294 - protein, 195 aa, Neocallimastix californiae
  NAD(P)-bd_dom
TYLITGAFGGVGLRVVLWLVSRGAKNILLTTSSSVEKQYEQPIIRSLLEKGINVMIKTCDITDLTSVQQLFQQTTPRIAGVFHLANRFAPGLISTSDLALLRKGFSAKAEGAWNLHLVTLQKAHQVQLFVVFSSILDVLGNRGQTAYGAANAFLSSIVDHRREKGLSGNCIALPAMRGSGYLAKWNQTKQSKDFE

SEQ ID NO: 12295 - protein, 96 aa, Neocallimastix californiae
  NAD(P)-bd_dom
HAAAGGVGQAAVKLCQLWGANIIASASASKQQFLRDTYGLEHVTNSRDPEEFYRDVMKWTDGKGVDFVLNSLSGKSLKMGIKCLKNGGKFVEIGKT

SEQ ID NO: 12296 - protein, 240 aa, Neocallimastix californiae
  NAD(P)-bd_dom
SFTGKHVLITGCGRNSIGECVLKYLLAGGAKVVATTSSYRRATMEHFRSVYEQVGTKGSTLVVVPFNQGSKKDVNDLIEFIYSKDSRVNGLGWDLDLVIPFAAISENGRDISDLDGKSELAHRIMMTNVIRILGAVRTQKMKVGSLVSAQVILPLSPNHGTFGGDGLYGESKIGLENLLNRWRSETWSKYLSITGACIGWTRGTGLMNSNNLISEGIESQGTCRTFTTTEMAFNLIGLVS

SEQ ID NO: 12297 - protein, 94 aa, Neocallimastix californiae
  NAD(P)-bd_dom
GAGGVGQAAIKLCQYWGAKIFVSTSAKKVQYLKDMYGLEYITNSRDSKTFYNDIMKWTNNEGVDFVLNALAGDGITYGLKCLKKGGHFVEIGKK

SEQ ID NO: 12298 - protein, 181 aa, Neocallimastix californiae
  NAD(P)-bd_dom
ENKAYLITGAFGGVGLRVAEWLQLRGAKNIVLTTSGNIEKRNRNPIVETLRSKGVHVTVTQCDISNIHAVRKLFQETTPQIAGIFHLANKFAPGLIQRTSLEQFHVAYNPKARGALNLHLVSKDYPIDMFVMFSSVLDLLGNKGQAAYGAANSFLGSLVELRRSQGLCGSCLSLPAMKGSG

SEQ ID NO: 12299 - protein, 208 aa, Neocallimastix californiae
  NAD(P)-bd_dom
SFKNKYVLITGCGRNSIGSQIIKGLLNGGAKIIATTSRFSKATMQYYRQLYEDHGSKGSCLIVVPFNAASVEDVNRLIDYIYSKDPKNGLGWDLDYVIPFAAISENGRTLENIDSRSELAHRIMLTNLLRMLGKIVSQKEAHKYDTRPAQCILPMSPNHGTFGGDGLYSESKIALETLFNRWHSEGWGGYLTVAGAVIGWTRGTGLMN

SEQ ID NO: 12300 - protein, 165 aa, Neocallimastix californiae
  NAD(P)-bd_dom
EDKSYLVTGAFGGVGLRVCLWMQLRGAHHLVLTTSSNPESKKDHPIVKALRQRGAQVSIVKCDISKYDEVEKLFKETSPSLDGVFHFANKFGPKLIRDSGLESFIATYEPKARGALNLHKISQKGYPLSTFVLFSSVLDLLGNTGQIAYGGANAFLGNLVYYRRR

SEQ ID NO: 12301 - protein, 96 aa, Neocallimastix californiae
  NAD(P)-bd_dom
DGDRNQCVQQVKAFTNNQGVHYVIDANVKFDHEEVLEACLREGGEYIKVGNLDHHVKKRTTHKVVQMSALSVKQMAPLVREAIEKINKCTVEAIEL

SEQ ID NO: 12302 - protein, 109 aa, Neocallimastix californiae
  NAD(P)-bd_dom
IMGLGGLGHLGVQFAHAMGAEVTVLGHSESKKEEAKKLGADCYEILKTDEDFKKYYRTFDFILNCATANLSLDNHIKLLKPNGVLCFVSIVPEEQKFTEMNLFGNQATI

SEQ ID NO: 12303 - protein, 207 aa, Neocallimastix californiae
  NAD(P)-bd_dom
FKNKYVLITGCGRNSIGSQVIKGLLNGGAKIIATTSRFSKATMQYYRQLYEDHGSKGSCLIVVPFNAASVEDVNRLIEYIYSKDPKNGLGWDLDYVIPFAAISENGRTLENIDSRSELAHRIMLTNLLRMLGKIVTEKESHKYDTRPAQCILPMSPNHGTFGGDGLYSESKIALETLFNRWHSEGWGGYLTVAGAVIGWTRGTGLMN

SEQ ID NO: 12304 - protein, 175 aa, Neocallimastix californiae
  NAD(P)-bd_dom
SGTVLITGGTGGVGFDICRYLVKQANLKGLVLTGRRPETDEKVAGRLAEIRALNPKIKITYVTANVGSEQEMKKVFDDINSGSPEEALVGVIHTAGTNDDGLIFNQSYERFAKLINSKIEGALCIAKLTEGLNLKFTILFSSMTAFFGNRGQINYCTANMFLNKVCQFYRSHNGR

SEQ ID NO: 12305 - protein, 161 aa, Neocallimastix californiae
  NAD(P)-bd_dom
KEDKSYLVTGAFGGVGLRVCLWMQLRGAHHLVLTTSSNPEMKYHHPIVNALRQRGAEVTIVKCDISKYNEVEKLFKETTPVIDGVFHFANKFGPKLIRDSNLSGFISTYEPKARGALNLHKVSQQGYPLSNFVLFSSVLDLLGNTGQIAYGGANSFLGNLV

SEQ ID NO: 12306 - protein, 103 aa, Neocallimastix californiae
  NAD(P)-bd_dom
QRIVNSGDHDQCLHHVKQLTNGHGVHYVIDANVKSDRENVLKECLSHKGEYIRVGHFSQNVIKKSISNRVIQMNALSTKEISPIVRKAIEMINDYSVEAIELK

SEQ ID NO: 12307 - protein, 163 aa, Anaeromyces robustus
  NAD(P)-bd_dom
DFVNLKKGDVVIQNGANSAVGQSVIQIAKAWGIKTINVVRDRPNFDELASELHKLGATLVIKEEDLRANSTRELVKSLGSPVRLALNCVGGKSASGITRLLGHNATIVTYGGMSKQPLTFGTGPFIFKNLRACGYWNSRWNKEASKKDKQYMFDDICELIRGG

SEQ ID NO: 12308 - protein, 237 aa, Anaeromyces robustus
  NAD(P)-bd_dom
LRFDERVVVITGAGGGFGRAHAFLFASRGATLVLNDNAVVSHKKGQTKYVVDDVVNEITKAGFHAIANYEPIGNGDKIIEAAMNAFGRVDILINNAGVTCNKPFKDMTDKDWEYVHNVNLHGAYKVTKAVWPIMQKQKYGRIINIVSAAGLYGSYGQVNYSSAKMALHGFTLSLAREGYRYNIYCNCVSPYVALNYDATIKDKSVQVVKPEFLSPLLVFLTHEKTRENGSHFEAGAG

SEQ ID NO: 12309 - protein, 259 aa, Anaeromyces robustus
  NAD(P)-bd_dom
SVGDLNFKGRVVIVTGAGGGLGRAYAKHFAKLGASVVVNDLGVLLRGRGANTQVADSVVEEIKKMGGIAVPSYDSVEEGEKIVETAIKNFGRVDVIINNAGILRDRSFARITDTDWMMTYKVHLKGTYKVTKAAWPYMIKQKYGRIINITSAAGLFGNFGQSNYAAAKSGVIGFTNALALEGKEHNITINSVAPNAGTRMTATIMPQEMVELLKPEYTAPLISFLTHESCTATGGIYEVGSCWVARLRWQRSGGASFAI

SEQ ID NO: 12310 - protein, 174 aa, Anaeromyces robustus
  NAD(P)-bd_dom
VNPPTAYRMLKDFVNLKKGDVVIQNGANSAVGQSVIQIAKAWGIKTINVVRDRPNFDEFAAELHKLGATLVIKEEDLRANSTRELVKNLGNPVRLALNCVGGKSASGITRLLGNNATIVTYGGMSKQPLTFGTGPFIFKNLRACGFWVSRWNKEASKKDKQYMFDDICELIRGG

SEQ ID NO: 12311 - protein, 209 aa, Anaeromyces robustus
  NAD(P)-bd_dom
SFAGKHVLITGCGRNSIGENVLKYLIAGGAKVVATTSSYRRQTLEHFRSVYEQVGTKGSTLVVVPFNQGSKKDVNDLIEFIYSKDSRVNGLGWDLDLVIPFAAISENGRDISDLDGKSELAHRIMMTNVIRILGAIRNQKMKVRSLVSCQVVLPLSPNHGTFGGDGLYGESKIGLENLLNRWRSETWSNYLSITGACIGWTRGTGLMNS

SEQ ID NO: 12312 - protein, 162 aa, Anaeromyces robustus
  NAD(P)-bd_dom
VGKPKEGETIFITAATGAVGQVVCQLAKLKGLRVVACASSPEKIGFLKQALKVDEAFSYRDFPDKKSFTEQLRKVCPNGIDIYYDNVGGYILDSALEVMNIHGRVIMCGMISQYNLKDKYQYTLRDITSRRLTLQGCLFNDFFPQCMGEFMQDMIPKLEKGQ

SEQ ID NO: 12313 - protein, 189 aa, Anaeromyces robustus
  NAD(P)-bd_dom
LLITGGLGDISIDIMKYFFSLDHCKLDHIFLIGRSSKSSAKVNDKLARLDKSMKDNGKNIDIQYYPCDISNEAALAEVFNDIRKRQGLQINGILHTAGTNSDASFINQTYDKLVEIAPAKIHGTHNIIKLTEEFNDEIKYIVLFSSITALSGFSGQTNYTAVNLFIDNIAKYCKNHGRDNVMSIELTIW

SEQ ID NO: 12314 - protein, 179 aa, Anaeromyces robustus
  NAD(P)-bd_dom
GTILITGGLGGVGYDVSKYLITKPNLKALVLTGRRPETDEKVAAKLNDLRSASKNVKIIYAVANVNSEEEMKKLFDDIAASENPLTGIIHTAGTNDDGLIFNQSYERFMKLVPGKVEGPLIITKLTKDIPNLKFTILLSSMSSFFGNRGQINYTTSNVFINKLCRYYRAHGRKDMVALQ

SEQ ID NO: 12315 - protein, 207 aa, Anaeromyces robustus
  NAD(P)-bd_dom
FKNKYVLITGCGRNSIGSQVIKGLLNGGAKIIATTSRFSKATMQYYRQLYEDHGSKGSCLIVVPFNAASVEDVNHLIEYIYSKDPKNGLGWDLDYVIPFAAISENGRTLENIDSRSELAHRIMLTNLLRMLGKIVSEKEAHKYDTRPAQCILPMSPNHGTFGGDGLYSESKIALETLFNRWHSEGWGGYLTIAGAVIGWTRGTGLMN

SEQ ID NO: 12316 - protein, 161 aa, Anaeromyces robustus
  NAD(P)-bd_dom
SKSYLITGAFGGVGLRVALWLQLRGAKNIILTTSGNAEKRNKNPIVEGLRNKGVNVLVRQCDISDINAVRKLFQEANPPIAGIFHLANKFAPGLIERTSLEQFHVAYNPKARGALNLHLVSKNYPVDMFVMFSSVLDLLGNKGQAAYGAANSFLGSLVELR

SEQ ID NO: 12317 - protein, 94 aa, Anaeromyces robustus
  NAD(P)-bd_dom
AAGGVGQAAIKLCKYWGAKIYVSTSTKKREYLKNLYGLEYITDSRNPKIFYEDIMKWTNNEGVDFVLNALAGDGITYGLKCLKKGGCFVEIGKK

SEQ ID NO: 12318 - protein, 162 aa, Piromyces finnis
  NAD(P)-bd_dom
VGKPKEGETIFVSAASGAVGQVVCQLAKLKGLKVVACASSPEKIGFLKGAIKVDEAFSYRDFPDKESFVAQLRKVCPNGIDIYFDNVGGYILDSALQLMNVHGRVVMCGMISQYNLKDKYQYTLQDISNRRLTLQGCLFNDYFPRCMGEFMQDMIPMVQSGK

SEQ ID NO: 12319 - protein, 190 aa, Piromyces finnis
  NAD(P)-bd_dom
GTILITGGLGGVGYDISRFLMKQPNLKGLVLTGRRPETDEKVAAKLSSIREVNKAIKVTYITVNVGSQTEMKEVISGIKASGSKLTGIIHTAGVNDDGLIFNQSYERFAKLINSKIEGSHCIAKITEGMNLEFILLFSSMTSFFGNRGQINYCVANMFVNKIAHYYRSHGRKDIITLQLAVWPSGLTSKI

SEQ ID NO: 12320 - protein, 162 aa, Piromyces finnis
  NAD(P)-bd_dom
DFVNLKKGDVIIQNGANSAVGQAVIQIAKAWGIKTINVVRDRPNFDELADQLHKLGATLVIKEEDLRANSTRELVKNLGSPVRLGLNCVGGKSANGITRLLGHNASLVTYGGMSKQPLTFGTGPFIFKNLKACGFWNSRWNKEASKKDKQYMFDDLCELIRG

SEQ ID NO: 12321 - protein, 94 aa, Piromyces finnis
  NAD(P)-bd_dom
AAGGVGQAAIKLCQYWGAKVYVSTSARKRKYLEDLYGLEHITDSRNPKTFYEDIMKWTNNEGVDFVLNALAGDGITYGLKCLKKGGRFIEIGKK

SEQ ID NO: 12322 - protein, 160 aa, Piromyces finnis
  NAD(P)-bd_dom
EDKSYIITGAFGGVGLRVALWLQLRGAKNIVLTTSGNAAKRNKNPIVEGLRSKGVNVTVCQCDISNINAVRKLFQETTPQVGGIFHLANKFLPGLIPRTSLEQFHIAYDPKAKGALNLHLVSKDYPIDMFVLFSSVLDLLGNKGQAAYGAANSFLGSLVE

SEQ ID NO: 12323 - protein, 177 aa, Piromyces finnis
  NAD(P)-bd_dom
LLITGGLGDVSMDVIENLLSDKETKLDHIFLLGRSSKTSTKVEDKLDRIEKIKKANNKKTEVEYYCCDISNGDSLNDVFNDIRKRQGLQINGIFHTAGTNDDTLFLTQTYEKFEKLAPAKVIGTHNIIKYTEDFKDELKFIILTSSLTALSGLTGQTNYTAANMFIDAIARYCRNHG

SEQ ID NO: 12324 - protein, 165 aa, Piromyces finnis
  NAD(P)-bd_dom
KENKSYLITGAFGGIGLKVGLWMQLRGARHIVLTTSSDPESKYKHPIVNALRQKGVHVTITKCDISKYDEVEKLFMETTPAIDGVFHFANKFGPKLIRDSSLDSFNTAFEPKARGALNLHKISQKGFSLSSFVLFSSVLDILGNSGQMAYGAANSYLNNLIYYRR

SEQ ID NO: 12325 - protein, 155 aa, Piromyces finnis
  NAD(P)-bd_dom
EIPTGESVLISTDASDLMQALATIAQQKGINLFIDDTSSKYSKANSNAFKNIKAQMINTRQASEYVRLVKQHTNGEGVGVIIDINVKFDKENTLEKCLRIDGEYIKVGNIDQSTKKRTTHKIVQMSHFKDNVITPVVRQAVEMIIHGKVEAIDLK

SEQ ID NO: 12326 - protein, 207 aa, Piromyces finnis
  NAD(P)-bd_dom
FKNKYVLVTGCGRNSIGSQIIKGLLNGGAKIIATTSRFSKVTMQYYRQLYEDHGSKGSCLIVVPFNAASTEDVNRLIEYIYSKDPKNGLGWDLDYVIPFAAISENGRTLENIDSRSELAHRIMLTNLLRMLGKIVSEKEAHKYDTRPAQCILPMSPNHGTFGGDGLYSESKIALETLFNRWHSEGWGGYLTIVGAVIGWTRGTGLMN

SEQ ID NO: 12327 - protein, 207 aa, Piromyces finnis; identical to SEQ ID NO: 12326
  NAD(P)-bd_dom

SEQ ID NO: 12328 - protein, 207 aa, Piromyces finnis; identical to SEQ ID NO: 12326
  NAD(P)-bd_dom

SEQ ID NO: 12329 - protein, 207 aa, Piromyces finnis; identical to SEQ ID NO: 12326
  NAD(P)-bd_dom

SEQ ID NO: 12330 - protein, 96 aa, Piromyces finnis
  NAD(P)-bd_dom
HAAAGGVGQAAVKLCQLWGANIIASASASKQQFLRDTYGIEHVTNSRDPEQFYSDVMKWTNGKGVDFVLNSLSGKSLRMGIKCLKNGGKFVEIGKT

SEQ ID NO: 12331 - protein, 198 aa, Piromyces finnis
  NAD(P)-bd_dom
TYLVTGAFGGVGLRVVLWLVSRGAKNLLLTTSGSVEKQYEQPIIRSLIEKGVNVMIKTCDITDYNNVQQLFQQTQPRVAGVFHLANRFAPGLISTSDLALLRKGFNAKAEGAWNLHKVTAQKQHQVQLFVVFSSILDVLGNRGQTAYGAANAFLSSIIDHRRENGLSGNCIALPAMRGSGYLAKWNQTKQSKEFEQLI

SEQ ID NO: 12332 - protein, 237 aa, Piromyces finnis
  NAD(P)-bd_dom
LRFDERVVVITGAGGGFGRAHAFLFASRGATLVLNDNAIISNNNGQPKYLVDDVVNEITKAGFHAIANYEPIENGDKIIEAAMNAFGRIDILINNAGVTCNKPFNEMSDKDWEYVQSVNLHGAYKVTKAVWPIMQRQRYGRIINIVSAAGLYGSYGQANYSSAKMALHGFTLSLAREGYRYNIYCNCVSPYVALNYDASIKDKSVQVVKPEFLSPLLVFLTHENTRENGSHFEAGAG

SEQ ID NO: 12333 - protein, 263 aa, Piromyces finnis
  NAD(P)-bd_dom
SNNESIGELSFKGRVVIVTGAGGGLGRAYAKHFAKLGASVVVNDLGVLLRGRGANTQVADSVVEEIKSMGGIAVPSYDSVEEGEKIVETAIKNFGRVDVIINNAGILRDRSFARMTDTDWMMTYKVHLKGCYKVTKAAWPYMVKQKYGRIINITSAAGLFGNFGQSNYAAAKAGVIGLTNTLALEGKEHNITVNSIAPNAGTRMTATIMPQEMVELLKPEYTAPLISFLTHESCTATGGIYEVGSCWIARIRWQRSGGASFAI

SEQ ID NO: 12334 - protein, 87 aa, Piromyces finnis
  NAD(P)-bd_dom
ENKSYLITGAFGGIGLKVGLWMRLRGARHIVLTTSSDPESKYKHPIVNALRQKGVHVTITKCDISKYDEVEKLFMETTPAIDGVFHF

SEQ ID NO: 12335 - protein, 161 aa, Neocallimastix californiae
  NAD(P)-binding Rossmann-fold domains
LPSEYAAPLMCAGATVYNPLRLFIEKPNVKVGVIGIGGLGHLAVQFASKMGYEVTALSTSYNKKEEATGFGCHNFVLLKEAAEKVPNYFDLIINTSPYDMDWKMLLGLLRPNGKLCLIGIPAVDMKVPVMPIIFSQKTICGSIVAGRKFTNEMLEFAALNG

SEQ ID NO: 12336 - protein, 171 aa, Neocallimastix californiae
  NAD(P)-binding Rossmann-fold domains
NTVDACMLSDMVPTGFHAVELADIQFGDVVLQIGIGPVGLMSVAGASLRGASRIICVGTRKVCQDVARKYGATDFISYKNGTIEEQVMKLTDGKGVDRVCIAGGTVKTFESAIKCLKPGGKIGNVNYLGSGEFVTIPRVEWGVGMGHKDIRGGLMPGGRLRMEKLASLVVA

SEQ ID NO: 12337 - protein, 170 aa, Neocallimastix californiae
  NAD(P)-binding Rossmann-fold domains
GTILITGGLGGVGFDISRYLMRQPNLKALVLTGRRPETDEKVAGKLAELRALNPKIKITYVTANVGSETEMKKVIDDINAGSPEEALVGVFHTAGTNDDGLIFNQSYERFAKLINSKIEGTLCIAKLTNDLNLKFTILFSSMTAFFGNRGQINYCTANMFINKVCDYYRN

SEQ ID NO: 12338 - protein, 165 aa, Neocallimastix californiae
  NAD(P)-binding Rossmann-fold domains
LGLFGMPGMTAWAFFNKAGKPKEGETIFVTAAAGAVGQVVCQLAKLKGLRVVACASSPEKIGFLKQAIKVDEAFSYRDFPDKESFTAQLRKVCPNGIDIYYDNVGGYILDSALELMNIHGRVIMCGMISQYNLTEKYKYTLRDITSRRLTLQGCLFNDYFPQCMG

SEQ ID NO: 12339 - protein, 244 aa, Neocallimastix californiae
  NAD(P)-binding Rossmann-fold domains
LSFKGKVVIITGAGGGLGRAYAKHFAKLGASVVVNDLGVLLRGRGANTQVADSVVEEIKQMGGIAVPSYDSVEEGEKIVETAIKNFGRVDIIINNAGILRDRSFGRMTDTDWMMTYRVHLKGTYKVTRAAWPYMMKQKYGRIINITSAAGLFGNFGQSNYAAAKSGVIGLTNALALEGKEYNITVNSVAPNAGTRMTATIMPQEMVELLKPEYTAPLISFLTHESCNATGGIYEVGSCWVARLR

SEQ ID NO: 12340 - protein, 239 aa, Neocallimastix californiae
  NAD(P)-binding Rossmann-fold domains
LRFDERVVVITGAGGGFGRAHAFLFASRGATLVLNDNAIISNNNGQPKYLVDDVVREITKAGFHAIANYEPIGNGDKIIEAAMNAFGRVDILINNAGVTCNKPFKEMSDKDWEYVHNVNLHGAYKVTKAVWPIMQKQKYGRIINIVSAAGLYGSYGQTNYSSAKMALHGFTLSLAREGYRYNIYCNCVSPYVALNYDASIKDKSVQVVKPEFLSPLLVFLTHEKTRENGSHFEAGAGYI

SEQ ID NO: 12341 - protein, 239 aa, Neocallimastix californiae
  NAD(P)-binding Rossmann-fold domains
LRFDERVVVITGAGGGFGRAHAFLFASRGATLVLNDNAIISNSNGQKKYLVDDVVHEITKAGFHAIANYEPIGNGDKIIEAAMNAFGRVDILINNAGVTCNKPFKEMSDKDWEYVHNVNLHGAYKVTKAVWPIMQKQKYGRIINIVSAAGLYGSYGQSNYSSAKMALHGFTLSLAREGYRYNIYCNCVSPYVALNYDASIKDKSVQVVKPEFLSPLLVFLTHEKTRENGSHFEAGAGYI

SEQ ID NO: 12342 - protein, 244 aa, Neocallimastix californiae
  NAD(P)-binding Rossmann-fold domains
LSFKGRVVIVTGAGGGLGRAYAKHFAKLGASVVVNDLGVLLRGRGANTQVADGVVEEIKKMGGIAVPSYDSVEEGEKIVETAIKNFGRVDIIINNAGILRDRSFARMTDTDWMMTYRVHLKGTYKVTRAAWPYMMKQKYGRIINITSAAGLFGNFGQSNYAAAKSGVIGLTNALALEGKEHNITINSVAPNAGTRMTATIMPQEMVELLKPEYTAPLISFLTHESCNVTGGIYEVGSCWVARLR

SEQ ID NO: 12343 - protein, 182 aa, Neocallimastix californiae
  NAD(P)-binding Rossmann-fold domains
SKISAATISVNPPTAYRMLKDFVNLKKGDVVIQNGANSAVGQSVIQIAKAWGIKTINVIRDRPNFEEVAGELHKLGATLVIKEEDLRSNSTRELVKNLGSPVRLALNCVGGKSASGITRLLGQNATIVTYGGMSKQPLTFGTGPFIFKNLRASGFWISRWNKEASKKDKQYMFDDICELVRG

SEQ ID NO: 12344 - protein, 205 aa, Neocallimastix californiae
  NAD(P)-binding Rossmann-fold domains
NILITGGLGDVSMDVVNSLLADKDSKLEHIFLLGRSSKTNSRVIEKLARIEKVRKDHDKNIQIEYYSCDISDESSLAEVFNDIRKRQGLQITGIFHTAGVNSDANFLSQSYEKLVEIAPSKIIGTHNIMKLSEEFKDELKFVVFVSSLSAVSGNGGQTNYTAANMFIDALARYYNDHGRTNVIAIELGGWKGAGSSDQLVNDFMV

SEQ ID NO: 12345 - protein, 164 aa, Neocallimastix californiae
  NAD(P)-binding Rossmann-fold domains
LDLAVASPLLCAGITTYSPLKRYNIGKGSRVAIMGLGGLGHLGVQFAHAMGAEVTVLGHSESKKEEAKKLGADCYEILKTDEDFKKYYRTFDFILNCATANLNLDNHFKLLKPNGVLCFVSIVPEEQRFSELNLFGNQASITVSNVGGIGITQEMLNFSAEKGI

SEQ ID NO: 12346 - protein, 149 aa, Neocallimastix californiae
  NAD(P)-binding Rossmann-fold domains
VEYAGIFIVFITAYYSLHVRAGGIKPGQTILIHAAAGGVGQAAVKLCQLWGANIIASASASKQQFLRDTYGLEHVTNSRDPEEFYRDVMKWTDGKGVDFVLNSLSGKSLKMGIKCLKNGGKFVEIGKTDILNDSKLGLHCLLNNISFVS

SEQ ID NO: 12347 - protein, 192 aa, Neocallimastix californiae
  NAD(P)-binding Rossmann-fold domains
NLTYLITGAFGGVGLRVVLWLVSRGAKNILLTTSSSVEKQYEQPIIRSLLEKGINVMIKTCDITDLTSVQQLFQQTTPRIAGVFHLANRFAPGLISTSDLALLRKGFSAKAEGAWNLHLVTLQKAHQVQLFVVFSSILDVLGNRGQTAYGAANAFLSSIVDHRREKGLSGNCIALPAMRGSGYLAKWNQTKQ

SEQ ID NO: 12348 - protein, 233 aa, Neocallimastix californiae
  NAD(P)-binding Rossmann-fold domains
SFTGKHVLITGCGRNSIGECVLKYLLAGGAKVVATTSSYRRATMEHFRSVYEQVGTKGSTLVVVPFNQGSKKDVNDLIEFIYSKDSRVNGLGWDLDLVIPFAAISENGRDISDLDGKSELAHRIMMTNVIRILGAVRTQKMKVGSLVSAQVILPLSPNHGTFGGDGLYGESKIGLENLLNRWRSETWSKYLSITGACIGWTRGTGLMNSNNLISEGIESQGTCRTFTTTEMAF

SEQ ID NO: 12349 - protein, 198 aa, Neocallimastix californiae
  NAD(P)-binding Rossmann-fold domains
ENKAYLITGAFGGVGLRVAEWLQLRGAKNIVLTTSGNIEKRNRNPIVETLRSKGVHVTVTQCDISNIHAVRKLFQETTPQIAGIFHLANKFAPGLIQRTSLEQFHVAYNPKARGALNLHLVSKDYPIDMFVMFSSVLDLLGNKGQAAYGAANSFLGSLVELRRSQGLCGSCLSLPAMKGSGYLAQFKQERQANQFKGL

SEQ ID NO: 12350 - protein, 138 aa, Neocallimastix californiae
  NAD(P)-binding Rossmann-fold domains
LGTVLYALRDRAGGVKRGQSILIHSGAGGVGQAAIKLCQYWGAKIFVSTSAKKVQYLKDMYGLEYITNSRDSKTFYNDIMKWTNNEGVDFVLNALAGDGITYGLKCLKKGGHFVEIGKKNIIFNTPLGLKSLMNNINF

SEQ ID NO: 12351 - protein, 245 aa, Neocallimastix californiae
  NAD(P)-binding Rossmann-fold domains
FKNKYVLITGCGRNSIGSQIIKGLLNGGAKIIATTSRFSKATMQYYRQLYEDHGSKGSCLIVVPFNAASVEDVNRLIDYIYSKDPKNGLGWDLDYVIPFAAISENGRTLENIDSRSELAHRIMLTNLLRMLGKIVSQKEAHKYDTRPAQCILPMSPNHGTFGGDGLYSESKIALETLFNRWHSEGWGGYLTVAGAVIGWTRGTGLMNSNNLVAEGIEMFGVHTFSTHEMAFNLIGLMHSDICKLC

SEQ ID NO: 12352 - protein, 190 aa, Neocallimastix californiae
  NAD(P)-binding Rossmann-fold domains
EDKSYLVTGAFGGVGLRVCLWMQLRGAHHLVLTTSSNPESKKDHPIVKALRQRGAQVSIVKCDISKYDEVEKLFKETSPSLDGVFHFANKFGPKLIRDSGLESFIATYEPKARGALNLHKISQKGYPLSTFVLFSSVLDLLGNTGQIAYGGANAFLGNLVYYRRRQGLSGQCFSLPAMKGSGYLSQWKQE

SEQ ID NO: 12353 - protein, 164 aa, Neocallimastix californiae
  NAD(P)-binding Rossmann-fold domains
LDLAMASPLLCAGVTTYSPLKRYNIGKGSRVAIMGLGGLGHLGVQFAHAMGAEVTVLGHSESKKEEAKKLGADCYEILKTDEDFKKYYRTFDFILNCATANLSLDNHIKLLKPNGVLCFVSIVPEEQKFTEMNLFGNQATITVSNVGGIDITQEMLNFSAEKGI

SEQ ID NO: 12354 - protein, 254 aa, Neocallimastix californiae
  NAD(P)-binding Rossmann-fold domains
FKNKYVLITGCGRNSIGSQVIKGLLNGGAKIIATTSRFSKATMQYYRQLYEDHGSKGSCLIVVPFNAASVEDVNRLIEYIYSKDPKNGLGWDLDYVIPFAAISENGRTLENIDSRSELAHRIMLTNLLRMLGKIVTEKESHKYDTRPAQCILPMSPNHGTFGGDGLYSESKIALETLFNRWHSEGWGGYLTVAGAVIGWTRGTGLMNSNNLVAEGIEMFGVHTFSTHEMAFNLIGLMHSDICKLCLKNPVFADL

SEQ ID NO: 12355 - protein, 48 aa, Neocallimastix californiae
  NAD(P)-binding Rossmann-fold domains
NELKKIAEDGISFAGKHVLITGCGRNSIGECVLKYLLAGGAKVVATTS

SEQ ID NO: 12356 - protein, 180 aa, Neocallimastix californiae
  NAD(P)-binding Rossmann-fold domains
SSGTVLITGGTGGVGFDICRYLVKQANLKGLVLTGRRPETDEKVAGRLAEIRALNPKIKITYVTANVGSEQEMKKVFDDINSGSPEEALVGVIHTAGTNDDGLIFNQSYERFAKLINSKIEGALCIAKLTEGLNLKFTILFSSMTAFFGNRGQINYCTANMFLNKVCQFYRSHNGRKDIM

SEQ ID NO: 12357 - protein, 217 aa, Neocallimastix californiae
  NAD(P)-binding Rossmann-fold domains
EDKSYLVTGAFGGVGLRVCLWMQLRGAHHLVLTTSSNPEMKYHHPIVNALRQRGAEVTIVKCDISKYNEVEKLFKETTPVIDGVFHFANKFGPKLIRDSNLSGFISTYEPKARGALNLHKVSQQGYPLSNFVLFSSVLDLLGNTGQIAYGGANSFLGNLVYYRRSKGLSGQCFSLPAMKGSGYLSQWKQDEQSREFSEVIEFLDAEDLPDILDFFLR

SEQ ID NO: 12358 - protein, 182 aa, Anaeromyces robustus
  NAD(P)-binding Rossmann-fold domains
SSISAATISVNPPTAYRMLKDFVNLKKGDVVIQNGANSAVGQSVIQIAKAWGIKTINVVRDRPNFDELASELHKLGATLVIKEEDLRANSTRELVKSLGSPVRLALNCVGGKSASGITRLLGHNATIVTYGGMSKQPLTFGTGPFIFKNLRACGYWNSRWNKEASKKDKQYMFDDICELIRG

SEQ ID NO: 12359 - protein, 244 aa, Anaeromyces robustus
  NAD(P)-binding Rossmann-fold domains
LNFKGRVVIVTGAGGGLGRAYAKHFAKLGASVVVNDLGVLLRGRGANTQVADSVVEEIKKMGGIAVPSYDSVEEGEKIVETAIKNFGRVDVIINNAGILRDRSFARITDTDWMMTYKVHLKGTYKVTKAAWPYMIKQKYGRIINITSAAGLFGNFGQSNYAAAKSGVIGFTNALALEGKEHNITINSVAPNAGTRMTATIMPQEMVELLKPEYTAPLISFLTHESCTATGGIYEVGSCWVARLR

SEQ ID NO: 12360 - protein, 239 aa, Anaeromyces robustus
  NAD(P)-binding Rossmann-fold domains
LRFDERVVVITGAGGGFGRAHAFLFASRGATLVLNDNAVVSHKKGQTKYVVDDVVNEITKAGFHAIANYEPIGNGDKIIEAAMNAFGRVDILINNAGVTCNKPFKDMTDKDWEYVHNVNLHGAYKVTKAVWPIMQKQKYGRIINIVSAAGLYGSYGQVNYSSAKMALHGFTLSLAREGYRYNIYCNCVSPYVALNYDATIKDKSVQVVKPEFLSPLLVFLTHEKTRENGSHFEAGAGYI

SEQ ID NO: 12361 - protein, 182 aa, Anaeromyces robustus
  NAD(P)-binding Rossmann-fold domains
SKISAATISVNPPTAYRMLKDFVNLKKGDVVIQNGANSAVGQSVIQIAKAWGIKTINVVRDRPNFDEFAAELHKLGATLVIKEEDLRANSTRELVKNLGNPVRLALNCVGGKSASGITRLLGNNATIVTYGGMSKQPLTFGTGPFIFKNLRACGFWVSRWNKEASKKDKQYMFDDICELIRG

SEQ ID NO: 12362 - protein, 231 aa, Anaeromyces robustus
  NAD(P)-binding Rossmann-fold domains
SFAGKHVLITGCGRNSIGENVLKYLIAGGAKVVATTSSYRRQTLEHFRSVYEQVGTKGSTLVVVPFNQGSKKDVNDLIEFIYSKDSRVNGLGWDLDLVIPFAAISENGRDISDLDGKSELAHRIMMTNVIRILGAIRNQKMKVRSLVSCQVVLPLSPNHGTFGGDGLYGESKIGLENLLNRWRSETWSNYLSITGACIGWTRGTGLMNSNNLISEGIESEGHCRTFTTTEM

SEQ ID NO: 12363 - protein, 155 aa, Anaeromyces robustus
  NAD(P)-binding Rossmann-fold domains
LGLFGMPGMTAWAFFNKVGKPKEGETIFITAATGAVGQVVCQLAKLKGLRVVACASSPEKIGFLKQALKVDEAFSYRDFPDKKSFTEQLRKVCPNGIDIYYDNVGGYILDSALEVMNIHGRVIMCGMISQYNLKDKYQYTLRDITSRRLTLQGCL

SEQ ID NO: 12364 - protein, 203 aa, Anaeromyces robustus
  NAD(P)-binding Rossmann-fold domains
LLITGGLGDISIDIMKYFFSLDHCKLDHIFLIGRSSKSSAKVNDKLARLDKSMKDNGKNIDIQYYPCDISNEAALAEVFNDIRKRQGLQINGILHTAGTNSDASFINQTYDKLVEIAPAKIHGTHNIIKLTEEFNDEIKYIVLFSSITALSGFSGQTNYTAVNLFIDNIAKYCKNHGRDNVMSIELTIWENAGNFDQLYATAM

SEQ ID NO: 12365 - protein, 181 aa, Anaeromyces robustus
  NAD(P)-binding Rossmann-fold domains
GTILITGGLGGVGYDVSKYLITKPNLKALVLTGRRPETDEKVAAKLNDLRSASKNVKIIYAVANVNSEEEMKKLFDDIAASENPLTGIIHTAGTNDDGLIFNQSYERFMKLVPGKVEGPLIITKLTKDIPNLKFTILLSSMSSFFGNRGQINYTTSNVFINKLCRYYRAHGRKDMVALQLA

SEQ ID NO: 12366 - protein, 245 aa, Anaeromyces robustus
  NAD(P)-binding Rossmann-fold domains
FKNKYVLITGCGRNSIGSQVIKGLLNGGAKIIATTSRFSKATMQYYRQLYEDHGSKGSCLIVVPFNAASVEDVNHLIEYIYSKDPKNGLGWDLDYVIPFAAISENGRTLENIDSRSELAHRIMLTNLLRMLGKIVSEKEAHKYDTRPAQCILPMSPNHGTFGGDGLYSESKIALETLFNRWHSEGWGGYLTIAGAVIGWTRGTGLMNSNNLVAEGIEMFGVHTFSTHEMAFNLIGLMHSEICKMC

SEQ ID NO: 12367 - protein, 197 aa, Anaeromyces robustus
  NAD(P)-binding Rossmann-fold domains
SKSYLITGAFGGVGLRVALWLQLRGAKNIILTTSGNAEKRNKNPIVEGLRNKGVNVLVRQCDISDINAVRKLFQEANPPIAGIFHLANKFAPGLIERTSLEQFHVAYNPKARGALNLHLVSKNYPVDMFVMFSSVLDLLGNKGQAAYGAANSFLGSLVELRRSQGLCGSCLSLPAMKGSGYLAQFKQERQANQFKGL

SEQ ID NO: 12368 - protein, 138 aa, Anaeromyces robustus
  NAD(P)-binding Rossmann-fold domains
LGTVLYALRDRAGGVKPGQSILIQSAAGGVGQAAIKLCKYWGAKIYVSTSTKKREYLKNLYGLEYITDSRNPKIFYEDIMKWTNNEGVDFVLNALAGDGITYGLKCLKKGGCFVEIGKKNIILNTPLGLKSLMNNINF

SEQ ID NO: 12369 - protein, 158 aa, Piromyces finnis
  NAD(P)-binding Rossmann-fold domains
LGLFGMPGMTAWAFFNKVGKPKEGETIFVSAASGAVGQVVCQLAKLKGLKVVACASSPEKIGFLKGAIKVDEAFSYRDFPDKESFVAQLRKVCPNGIDIYFDNVGGYILDSALQLMNVHGRVVMCGMISQYNLKDKYQYTLQDISNRRLTLQGCLFND

SEQ ID NO: 12370 - protein, 189 aa, Piromyces finnis
  NAD(P)-binding Rossmann-fold domains
GTILITGGLGGVGYDISRFLMKQPNLKGLVLTGRRPETDEKVAAKLSSIREVNKAIKVTYITVNVGSQTEMKEVISGIKASGSKLTGIIHTAGVNDDGLIFNQSYERFAKLINSKIEGSHCIAKITEGMNLEFILLFSSMTSFFGNRGQINYCVANMFVNKIAHYYRSHGRKDIITLQLAVWPSGLTSK

SEQ ID NO: 12371 - protein, 182 aa, Piromyces finnis
  NAD(P)-binding Rossmann-fold domains
SKISASTISVNPPTAYRMLKDFVNLKKGDVIIQNGANSAVGQAVIQIAKAWGIKTINVVRDRPNFDELADQLHKLGATLVIKEEDLRANSTRELVKNLGSPVRLGLNCVGGKSANGITRLLGHNASLVTYGGMSKQPLTFGTGPFIFKNLKACGFWNSRWNKEASKKDKQYMFDDLCELIRG

SEQ ID NO: 12372 - protein, 140 aa, Piromyces finnis
  NAD(P)-binding Rossmann-fold domains
VMGTVLYAIRDRAGGIKPGQSILIQSAAGGVGQAAIKLCQYWGAKVYVSTSARKRKYLEDLYGLEHITDSRNPKTFYEDIMKWTNNEGVDFVLNALAGDGITYGLKCLKKGGRFIEIGKKNIIINTPLGLKSLMNNINFC

SEQ ID NO: 12373 - protein, 198 aa, Piromyces finnis
  NAD(P)-binding Rossmann-fold domains
EDKSYIITGAFGGVGLRVALWLQLRGAKNIVLTTSGNAAKRNKNPIVEGLRSKGVNVTVCQCDISNINAVRKLFQETTPQVGGIFHLANKFLPGLIPRTSLEQFHIAYDPKAKGALNLHLVSKDYPIDMFVLFSSVLDLLGNKGQAAYGAANSFLGSLVEFRRSKGLCGSCISLPAMKGSGYLAQFKQERQAKGFEGL

SEQ ID NO: 12374 - protein, 192 aa, Piromyces finnis
  NAD(P)-binding Rossmann-fold domains
NLLITGGLGDVSMDVIENLLSDKETKLDHIFLLGRSSKTSTKVEDKLDRIEKIKKANNKKTEVEYYCCDISNGDSLNDVFNDIRKRQGLQINGIFHTAGTNDDTLFLTQTYEKFEKLAPAKVIGTHNIIKYTEDFKDELKFIILTSSLTALSGLTGQTNYTAANMFIDAIARYCRNHGRNNVMSLELCGWSG

SEQ ID NO: 12375 - protein, 217 aa, Piromyces finnis
  NAD(P)-binding Rossmann-fold domains
ENKSYLITGAFGGIGLKVGLWMQLRGARHIVLTTSSDPESKYKHPIVNALRQKGVHVTITKCDISKYDEVEKLFMETTPAIDGVFHFANKFGPKLIRDSSLDSFNTAFEPKARGALNLHKISQKGFSLSSFVLFSSVLDILGNSGQMAYGAANSYLNNLIYYRRRKGLSGQCFSLPAMKGSGYLSQWNQITQSREFSEVIEFLDSEDLPDILDFFLR

SEQ ID NO: 12376 - protein, 239 aa, Piromyces finnis
  NAD(P)-binding Rossmann-fold domains
FKNKYVLVTGCGRNSIGSQIIKGLLNGGAKIIATTSRFSKVTMQYYRQLYEDHGSKGSCLIVVPFNAASTEDVNRLIEYIYSKDPKNGLGWDLDYVIPFAAISENGRTLENIDSRSELAHRIMLTNLLRMLGKIVSEKEAHKYDTRPAQCILPMSPNHGTFGGDGLYSESKIALETLFNRWHSEGWGGYLTIVGAVIGWTRGTGLMNSNNLVAEGIEMFGVHTFSTHEMAFNLIGLMHN

SEQ ID NO: 12377 - protein, 239 aa, Piromyces finnis; identical to SEQ ID NO: 12376
  NAD(P)-binding Rossmann-fold domains

SEQ ID NO: 12378 - protein, 239 aa, Piromyces finnis; identical to SEQ ID NO: 12376
  NAD(P)-binding Rossmann-fold domains

SEQ ID NO: 12379 - protein, 239 aa, Piromyces finnis; identical to SEQ ID NO: 12376
  NAD(P)-binding Rossmann-fold domains

SEQ ID NO: 12380 - protein, 150 aa, Piromyces finnis
  NAD(P)-binding Rossmann-fold domains
VEYAGIFIVFITAYYSLHVRAGGIKPGQTILIHAAAGGVGQAAVKLCQLWGANIIASASASKQQFLRDTYGIEHVTNSRDPEQFYSDVMKWTNGKGVDFVLNSLSGKSLRMGIKCLKNGGKFVEIGKTDILNDSQLGLHCLLNNISFISS

SEQ ID NO: 12381 - protein, 190 aa, Piromyces finnis
  NAD(P)-binding Rossmann-fold domains
NLTYLVTGAFGGVGLRVVLWLVSRGAKNLLLTTSGSVEKQYEQPIIRSLIEKGVNVMIKTCDITDYNNVQQLFQQTQPRVAGVFHLANRFAPGLISTSDLALLRKGFNAKAEGAWNLHKVTAQKQHQVQLFVVFSSILDVLGNRGQTAYGAANAFLSSIIDHRRENGLSGNCIALPAMRGSGYLAKWNQT

SEQ ID NO: 12382 - protein, 244 aa, Piromyces finnis
  NAD(P)-binding Rossmann-fold domains
LSFKGRVVIVTGAGGGLGRAYAKHFAKLGASVVVNDLGVLLRGRGANTQVADSVVEEIKSMGGIAVPSYDSVEEGEKIVETAIKNFGRVDVIINNAGILRDRSFARMTDTDWMMTYKVHLKGCYKVTKAAWPYMVKQKYGRIINITSAAGLFGNFGQSNYAAAKAGVIGLTNTLALEGKEHNITVNSIAPNAGTRMTATIMPQEMVELLKPEYTAPLISFLTHESCTATGGIYEVGSCWIARIR

SEQ ID NO: 12383 - protein, 239 aa, Piromyces finnis
  NAD(P)-binding Rossmann-fold domains
LRFDERVVVITGAGGGFGRAHAFLFASRGATLVLNDNAIISNNNGQPKYLVDDVVNEITKAGFHAIANYEPIENGDKIIEAAMNAFGRIDILINNAGVTCNKPFNEMSDKDWEYVQSVNLHGAYKVTKAVWPIMQRQRYGRIINIVSAAGLYGSYGQANYSSAKMALHGFTLSLAREGYRYNIYCNCVSPYVALNYDASIKDKSVQVVKPEFLSPLLVFLTHENTRENGSHFEAGAGYI

SEQ ID NO: 12384 - protein, 87 aa, Piromyces finnis; identical to SEQ ID NO: 12334
  NAD(P)-binding Rossmann-fold domains

SEQ ID NO: 12385 - protein, 169 aa, Anaeromyces robustus
  NODB
KHWAMTYDDGPTEFADAILDLLKEKGIKATFFIVGHMYMDNNSSDWSRIIKRMDSEGHIVGNHTYDHQDLTGLSSDQIISQMKQVEDRIFKIIGKRPAFMRPPYGSGNGNQNVMNALQQAGYTAAINWNVDPQDYSNGGDANYARQVINQAKGQPIITLNHLKYNGASQ

SEQ ID NO: 12386 - protein, 310 aa, Neocallimastix californiae
  Oligoxyloglucan reducing end-specific cellobiohydrolase
STHWAPNVVGFEETAINDIEAPPSGPGIPKLLTALGDLGGFTQDDINEAVEMWVNPTYTTGNSVEYAVSNPKIVVSCGTDNAAYSTDGGYTWTPMKTLPYEKATGGHITISGDGKVVTWIPNQSQIPYYTTDNGATWTAVDTCKNCNQVRPDGKNPKLMYGFDYQTLYISEDGGKTYIKQGGNMGAGQLMSPYNVEGHLWLACTYWGGVQFSSDMGKTFKEVDPKFKSADSVGFGKAAPGSDAPYTVYIVGKYDDYYGVYRSTDLGSTWELLNDDSHQWGVYNSKVIGDPDIFGRVYIATNGRGVVVGDD

SEQ ID NO: 12387 - protein, 370 aa, Neocallimastix californiae
  Oligoxyloglucan reducing end-specific cellobiohydrolase
YNWYNTKIGGGGFVTNLIYNPGEEGLLYLRTDMGGSYRYDQTNKSWIPIQDVFGGSEWWLFGCESLGVDTKEPNRVYIAAGTYMSYGENGAIISSDDYGKTWKHRWDAPFHFGANDDGRGRGERLAVNPVDNNIIFFGTRKNGLYKSTNYGESFEPVKGFPADHDIPFILFVPGSKGKTVIVATDDTKAPLYISKDGGSSFDKISGQPNIGYFPQHGAFSADGKYLYVTYANSIGPNGATQGDVYRISLPDFTFKEITPVHGSYETQQFGYTGVQTSGTNAGVVIVSTLNLWWPSDEVYMSTDYGETWSEGVASHAELDISEYPWLDFGKEDNLKFGWWIAALAMDPFNDDNVSYGTGATVYTTTEFTKA

SEQ ID NO: 12388 - protein, 290 aa, Neocallimastix californiae
  Oligoxyloglucan reducing end-specific cellobiohydrolase
ATGDAHLLSVMGDIGGFRHTDLDKCPEINFRSPTFTTGYSIDYAENVPNFWVRVGTEPYIAISWGNGESWYSGQAPGGVTEGGIVAVGADGDVVWAPKPYDLGVFYGKESFKSSKGIPGGARICSDRVNGKIFYGYLGDTFYRSTDTGVTFSKVYTGLPEIEPGYAKNIKAVAGHEGDVWLAGNKGGLYHTEDGGETFTSIDGVEIANTIGFGKAAEGSDYPALYITGKIGNVNGIFRSDDKGKNWVRINDDDHQYGTINFCITGDPRIYGRVYVCTNGYGIVYGDIDGD

SEQ ID NO: 12389 - protein, 397 aa, Neocallimastix californiae
  Oligoxyloglucan reducing end-specific cellobiohydrolase
YKWKNAEIVGGGFVPGIVFSEAEKDLVYARTDIGGLYRLNKSTKRWENLSEWVGVDNWGYAGIDTMCADPVDANRVYAAVGMYTNDWDPNNGAIISSTDRGDNWSISELPFKVGGNDPGRGMGERIAVDPNNNKILFFGARAGKGLWKSTDYAKTWSQVKSFTNVGKYAADNQYFTEAIGISFVTFDRYSGKKGSPTPNIYVGVADNSTSTVYVSKDAGVSWTAIPDQPAHYFPHKGKITEDGMLYVTYTDGCGPYDGQAGAIYRYNTKTGEWKDISPHQEPYFGYGGLAIDAQNQKTLVVATLNSWWPDAILFRSTDGGDTWSHIWEWDGYPQRKLKYEIDPSISPWIEDDMKQIPEPTTKLGWMIESLEIDPFNSDRIMWGTGATIWGSEDLTNW

SEQ ID NO: 12390 - protein, 368 aa, Neocallimastix californiae
  Oligoxyloglucan reducing end-specific cellobiohydrolase
YNWYNTNIGGGGFVTNLIYNPAEEGLLYLRTDMGGSYRYDQANKSWIPIQDVFSGSEWWLFGCESIGIDTKEPNRVYIAAGTYMSYGENGAIISSDDYGKTWKHRWDAPFHFGANDDGRGRGERLAVNPVDNNIIYFGTRKSGLYKSSNYGESFEQVKGFPTNHDIPFILFVPGSKGKTIIVATDDTKAPLYISNDGGSSFKQISGQPNIGYYPQHGAFSADGKYLYVTYANSIGPNGATQGDVYRISLPDYKFKEVTPVHGSYETQQFGYTGVQTSGTNPGVVIVSTLNLWWPSDELYMSSDYGETWSEGVASHAELDISEYPWLDFGKADNLKFGWWIAALAMDPFNDNNVSYGTGATVYTTTDFT

SEQ ID NO: 12391 - protein, 308 aa, Neocallimastix californiae
  Oligoxyloglucan reducing end-specific cellobiohydrolase
HWAPNVRGFEETAINDIEAPPAGPGIPQLLTALGDLGGFTQDDIHETVEMWVNPTYTTGNSVEYAVSNPKIVVSCGTDNAAYSTDGGHSWTPMKSLPYEKATGGHITISGDGKVVTWIPNQSQKPYYTTNYGASWTAVNSCNNCIQIRPDGKNPTLMYGYDHQDLYISEDGGKTYKKQASNMSSGQLMSPYEVEGHLWLACTYWGGVQISTDKGKTFKEVDPKFKTADSVGFGKAAPGSSAPYTVYVVGKYDGYYGVYRSTDLGSTWELLNDDSHQWGVYNSKVIGDPNIFGRVYVATNGRGVIVGDD

SEQ ID NO: 12392 - protein, 397 aa, Neocallimastix californiae
  Oligoxyloglucan reducing end-specific cellobiohydrolase
YQWKNAEIVGGGFIPGIIFSEAEKDLIYARTDIGGLYRMNKSTKRWENLLKWVGVDNWNYGGVDTMCADPIDSNRVYAAVGMYTNDWDQNNGAIISSNDHGDTWSITELPFKVGGNDPGRGMGERIAVDPNDNKILFFGARAGKGLWKSIDYAKTWSQVKSFTNVGKYSPSPEYFPAAIGISFVTFDKYSGNKGSPTPNIYVGVADNSTSTVYVSKDAGVSWTPIPDQPAHYFPHKGKITKDGMLYITYSDGCGPYDGQAGAIYRYNTKTGEWKDISPHQEPYFGYGGLAIDAQNQKNIVVATLNSWWPDAILFRSTDGGDTWSHIWEWDGYPNRKLKYEIDASISPWIEDDTKQIPEPTTKLGWMIESLEIDPFNSDRIMWGTGATIWGSEDLTNW

SEQ ID NO: 12393 - protein, 284 aa, Neocallimastix californiae
  Oligoxyloglucan reducing end-specific cellobiohydrolase
TGEAHLMSVMYDIGGFMHTDLDTCPKTQFRTPNFSSGNSIDYAENVPNFWVRVGTEPYIAYSWGSGSSWYAGHAPNGVTEGGLVAVGAEGDVLWAPKPYELGVFYGKESFQSSKGIPGGARICSDRVNGKIFYGYLGDTFYRSTDTGATFTKMYTGLPEIETGFAKNIKAVADHEGDVWLAANKGGLFHTEDGGKTFTQINGITIANTIGFGKAADGSDYPALYITGKIGDVNGIFRSDDKGQNWVRINDDKNQYGTINFCITGDPRIYGRVYVCTNGFGIVYG

SEQ ID NO: 12394 - protein, 308 aa, Piromyces finnis
  Oligoxyloglucan reducing end-specific cellobiohydrolase
HWAPNVHGFEECAINDIEAPPAGPGNPQLLTALGDLGGFTQDDINEAVEMWTNPTYTTGSSVEYAYSNPQIVVSCGTDNAAYSNDGGHTWTPMKSLPYENATGGHITISGDGKVVTWVPNQSNVPYWTTDHGATWTKVTTCPQCTQIRPDGKNLTLMYGYDYQSVYLSKDGGKTYSKLSSGLSAGQLNSPFDVEGHLWLACTYWGGVQMSTDYGKTFKEVDPLFKTADSVGFGKPDPNSNAPYTVYIVGKYDGYYGVYRSTDLGNTWTLLNDDNHQWGVYNSKVIGDPNIFGRVYIATNGRGVVVGDD

SEQ ID NO: 12395 - protein, 370 aa, Piromyces finnis
  Oligoxyloglucan reducing end-specific cellobiohydrolase
YNWYNTKIGGGGFVTNLIYNPGEQGLLYLRTDMGGSYRYDQNNKSWTPIQDIFGGSEWWLFGCESLGVDTKEPNRVYIAAGTYMSYGENGAIIASDDYGQTWKTRWDAPFHFGANDDGRGRGERLAVHPEQNNIIYFGTRKNGLYKSTNYAESFSQVASFPTDYDIPFILFVPGTKGKTIIVATDNSKGPLYRSDDGGSTFKQISGQPNTGYYPHHGAFSADNKYLYVTYANSIGPNGATQGAVYRIKLADYSFKEITPVKGSYETQQFGYTGVQTSGTNPGVVIVSTLNLWWPSDEVYKSNDYGETWSEGVASHAELDISEYPWLDFGKEDGLKFGWWIASLAMDPFDDNNVSYGTGATVYTTTDFTNA

SEQ ID NO: 12396 - protein, 397 aa, Piromyces finnis
  Oligoxyloglucan reducing end-specific cellobiohydrolase
YTWKNAEIVGGGFVPGIVFSEAEKDLVYARTDIGGLYRLNTSTKRWENLSKWVGVDNWGYAGIDTMCADPVDADRVYAAVGMYTNNWDPNNGAIISSTDRGDNWSITELPFKVGGNDPGRGMGERIAVDPNNNKILFFGARAGNGLWKSTDYAKTWTQVKSFTNVGKYATDTQYFTEAIGISFVTFDKYSGKKGSPTPNIYVGVADNSTSTVYVSKDAGASWVPIPDQPLHYFPHKGKITKDGMLYITYTDGCGPYDGQAGAIYRYNTKTGEWKDISPHQEPYFGYGGLAIDAQDQKTIVVATLNSWWPDAILFRSTDGGDTWSHIWEWNGYPERKFKYEIDPSISPWIEDNMKQIPEPTTKLGWMIESLEIDPFNSDRIMWGTGATIWGSEDLTNW

SEQ ID NO: 12397 - protein, 299 aa, Piromyces finnis
  Oligoxyloglucan reducing end-specific cellobiohydrolase
TAVQDLVSPPSGDAHLLSVMGDLGGFRHTDLDTCPEVNFRSPTFSSGFSIDYAENVPNFWVRVGTEPYIALSWGNGESWYGVQAPGGVTEGGIVAVGAEGDVVWAPKPYDLGVFYGKETFKSSKGIPGGARICSDRVNGKIFYGYLGDTFYRSIDTGVSFTKMYTGLPEMEPGYAKNIKAVAGHEGDVWLAGNKGGLYHTEDGGETFYQIDGVEIANTIGFGKAAEGYDYPALYITGKIGNINGIFRSDDKGQNWVRINDDNNQYGTINFCITGDPRIYGRVYVCTNGFGIVYGDIDGD

SEQ ID NO: 12398 - protein, 229 aa, Neocallimastix californiae
  Pectin lyase-like
RQGENINNLEVVVPKLDTIIEMRGNTPLKSYVQNIVFNGITFAYSDWNLYELNDGGKLSHGYASVQGAIVMSAFGQEDQHNDIYRTYDVPVSAIYINSSRNVKFLNGEIRHTGSIGMHLENDVNDIEVTGNYIAKTSGAGIVIGHPTHVYENDNNRHSVGSNFAGPDKEKFKNGTESVPKNISVTNNYLLENCYSFSGHSPITSFYTYNLQVLHNFVYKCSYSGMSIGW

SEQ ID NO: 12399 - protein, 90 aa, Neocallimastix californiae
  Pectin lyase-like
PDFYVSVDGSDSNDGSKDSPFATLDKARQAVRGLSKTKNIVVEIADGFYPVDKTIKFTSEDSGNNKSTIYYKSAKGAHPIISGGEKITGS

SEQ ID NO: 12400 - protein, 233 aa, Neocallimastix californiae
  Pectin lyase-like
LTAKQNYSKPIAFPGADGGGKFATGGRGGEVYYVTNLNDSGAGSFRDAVSRSNRIVVFKVSGTIELKSDVVVKGNITVAGQTAPGGHGVVLKNFKIGLGGTNIILRFIGSRPGERGSNADYDAFGGAEGSNSIVDHCSIGWANDEQWGLYSKSDDMTVQYSVIGPSNSFSYHSKGIHGFAIMLGRKNVSYHHNLIAHNVSRNFRGKVPDKNACDFTNNVIYNWGSQTTYGTIG

SEQ ID NO: 12401 - protein, 76 aa, Neocallimastix californiae
  Pectin lyase-like
IYLTGNRFLNSNNTPYNDFSNNNWKGITYKNNSKNEGNTKSNSPFVMNNGSDNSSTIAHVESAEKAYDNVLAHAGN

SEQ ID NO: 12402 - protein, 91 aa, Neocallimastix californiae
  Pectin lyase-like
ADFYVATNGDDSNPGTKDAPFASLDKARQAVRNVSKTKNIIVEIADGFYPVDKTIKFTSEDSGNNRSTILYRAAQGAKPVISGGELITGTW

SEQ ID NO: 12403 - protein, 47 aa, Anaeromyces robustus
  Pectin lyase-like
SKNNHVNYNRVEEICSLLSDAGGIYTLGKQGNSDWSEYSEMSYNYIN

SEQ ID NO: 12404 - protein, 139 aa, Anaeromyces robustus
  Pectin lyase-like
VSAIYINSSRNIKFINGEIRHTGSLGIHLENDVNDIDVTGNYIAKTSGAGIVIGHPTHVYENDTNNHSVGYDFAGPDKEKFKRGTESVPKNISVTNNYLLENCYSFSGHSPITSFYTYNLQVLHNFIYKCSYSGMSIGW

SEQ ID NO: 12405 - protein, 23 aa, Anaeromyces robustus
  Pectin lyase-like
RGNTPLSSYVQNIIFDGITFAYS

SEQ ID NO: 12406 - protein, 90 aa, Anaeromyces robustus
  Pectin lyase-like
ADFYVATNGDDSNPGTKDAPFASLDKARQAVRNVSKTKNIIVEIADGFYPVDKTIKFTSEDSGNNRSTILYRAAQGAKPVISGGELITGT

SEQ ID NO: 12407 - protein, 227 aa, Anaeromyces robustus
  Pectin lyase-like
YSKPVAFPGADGGGKFATGGRGGEVIYVTNLNDSGAGSFRDAVSKPNRIVVFKVSGTIELKSDVVVKSNITIAGQTAPGGHGVVLKNFKLGFGGTNVICRFIGSRPGERGSNADYDAWGGAEGSNTIVDHCSIGWANDEQWGLYSKSDDLTVQYSVIGPSNSFSYHSKGIHGFGIMLGRKNVSYHHNLIAHNVSRNFRGKVPDKNTCDFTNNVIYNWGSQTTYGTIG

SEQ ID NO: 12408 - protein, 77 aa, Anaeromyces robustus
  Pectin lyase-like
IYLTGNRFLNSNNTPYNDFSANNWRGITYKNNSKNEGNTKSNTPFAMTNGSDNSSTIAKVEPAEQAYNNVLAYAGNG

SEQ ID NO: 12409 - protein, 107 aa, Neocallimastix californiae
  Pectin_lyas_fold
PDFYVSVDGSDSNDGSKDSPFATLDKARQAVRGLSKTKNIVVEIADGFYPVDKTIKFTSEDSGNNKSTIYYKSAKGAHPIISGGEKITGSWTRATEVNWLRNGLTAY

SEQ ID NO: 12410 - protein, 269 aa, Neocallimastix californiae
  Pectin_lyas_fold
SAFGQEDQHNDIYRTYDVPVSAIYINSSRNVKFLNGEIRHTGSIGMHLENDVNDIEVTGNYIAKTSGAGIVIGHPTHVYENDNNRHSVGSNFAGPDKEKFKNGTESVPKNISVTNNYLLENCYSFSGHSPITSFYTYNLQVLHNFVYKCSYSGMSIGWGWCEFDGFDGRSLYDMNANQFDGYSKGPARIVGVPTETSKNNHINYNRVEEICSLLSDAGGIYTLGKQGNQDWTEYSEMSYNYINCKRNGQQADGSRRVNGFHPDEGSAYI

SEQ ID NO: 12411 - protein, 80 aa, Neocallimastix californiae
  Pectin_lyas_fold
ENYLIYLTGNRFLNSNNTPYNDFSNNNWKGITYKNNSKNEGNTKSNSPFVMNNGSDNSSTIAHVESAEKAYDNVLAHAGN

SEQ ID NO: 12412 - protein, 219 aa, Neocallimastix californiae
  Pectin_lyas_fold
AFPGADGGGKFATGGRGGEVYYVTNLNDSGAGSFRDAVSRSNRIVVFKVSGTIELKSDVVVKGNITVAGQTAPGGHGVVLKNFKIGLGGTNIILRFIGSRPGERGSNADYDAFGGAEGSNSIVDHCSIGWANDEQWGLYSKSDDMTVQYSVIGPSNSFSYHSKGIHGFAIMLGRKNVSYHHNLIAHNVSRNFRGKVPDKNACDFTNNVIYNWGSQTTYG

SEQ ID NO: 12413 - protein, 90 aa, Neocallimastix californiae
  Pectin_lyas_fold
EADFYVATNGDDSNPGTKDAPFASLDKARQAVRNVSKTKNIIVEIADGFYPVDKTIKFTSEDSGNNRSTILYRAAQGAKPVISGGELITG

SEQ ID NO: 12414 - protein, 108 aa, Anaeromyces robustus
  Pectin_lyas_fold
EADFYVATNGDDSNPGTKDAPFASLDKARQAVRNVSKTKNIIVEIADGFYPVDKTIKFTSEDSGNNRSTILYRAAQGAKPVISGGELITGTWTKATEVNWLRNGLTAY

SEQ ID NO: 12415 - protein, 204 aa, Anaeromyces robustus
  Pectin_lyas_fold
MRGNTPLSSYVQNIIFDGITFAYSDWNLYELNDNGKLSHGYASVQGAIVMAAFGQEDQHNDIYRTYDVPVSAIYINSSRNIKFINGEIRHTGSLGIHLENDVNDIDVTGNYIAKTSGAGIVIGHPTHVYENDTNNHSVGYDFAGPDKEKFKRGTESVPKNISVTNNYLLENCYSFSGHSPITSFYTYNLQVLHNFIYKCSYSGM

SEQ ID NO: 12416 - protein, 80 aa, Anaeromyces robustus
  Pectin_lyas_fold
ENYSIYLTGNRFLNSNNTPYNDFSANNWRGITYKNNSKNEGNTKSNTPFAMTNGSDNSSTIAKVEPAEQAYNNVLAYAGN

SEQ ID NO: 12417 - protein, 219 aa, Anaeromyces robustus
  Pectin_lyas_fold
AFPGADGGGKFATGGRGGEVIYVTNLNDSGAGSFRDAVSKPNRIVVFKVSGTIELKSDVVVKSNITIAGQTAPGGHGVVLKNFKLGFGGTNVICRFIGSRPGERGSNADYDAWGGAEGSNTIVDHCSIGWANDEQWGLYSKSDDLTVQYSVIGPSNSFSYHSKGIHGFGIMLGRKNVSYHHNLIAHNVSRNFRGKVPDKNTCDFTNNVIYNWGSQTTYG

SEQ ID NO: 12418 - protein, 291 aa, Neocallimastix californiae
  Peptidase_S8
IYILDSGIYGDHIDFDTGHRTVSCDAMFGKTRVINQPGSSNYKNCYLENELKFHGSMVASVAAGKYFGVAKNANIHMIVHDRTALNILYAYDYVKKYAKNPHKTVINLSFGNYIRIPEEEKMINSLAEMGFIVIAAAGNDYTNACTNNPRQVKQEGQTVTVTSKMYPAAYSNVIAVGATNNDIQSLDVTNVSNLYNVASFSNYGNCLDIFGPGYVYGAYPGYDYRNNNSIQAYAGGTSFSCPIVAGVAASIISEHPEIEFNVTILRQWLLDNAVRNIIGNSSQFDSPDIFL

SEQ ID NO: 12419 - protein, 84 aa, Neocallimastix californiae
  Peptidase_S8
NNNSIQAYAGGTSFSCPIVAGVAASIISEHPEIEFNVTILRQWLLDNAVRNIIGNSSQFDSPDIFLNNGKKTVYSANGQYNGCG

SEQ ID NO: 12420 - protein, 285 aa, Neocallimastix californiae
  Peptidase_S8
IYILDSGIDVHHADFELDTGNTGNGYRTVSCDAMFGDKEIINQPGSSSYKNCFLEEKIKYHGSMVASIAAGKIHGVAKNANIHMVVHNRQSTGILLAYNFVKNNLKDPHKTVINLSFGSYKKIPEEVSLINSLIEMGCIVVAAGGNDNISSCTTEPRYVVSDDDNKVKTLIQEKIYPASLENVIGVGSIRNKIKETDVSSVQNLYSLADFSNYGDCLDLFAPGYAYAAYPPPNNNDKSSSDLEGYGGGSSFSAPLVAGVAASIISEHPEMTFNHSLMKKMLLEIS

SEQ ID NO: 12421 - protein, 220 aa, Anaeromyces robustus
  Peptidase_S8
VAHPYEGEDKKKCKFAEDSYPGHGNMVSSLAGGKLYGAAKKANLHMIVSYYELYETIVALDYIKQNGKPYQSIISFSRGAYKKYSQFLQDKLDELNDAGFITVVAAGNETEDICHEKNKYFYSIAGYKNVIIVGSTESTYNNDIENGYKIASYSNYGECIDIFAPGQARYANYQLNRKAQGTSVSTAITAGVIATIMSEHPDIKFNVDTMKEKLFELSLK

SEQ ID NO: 12422 - protein, 27 aa, Neocallimastix californiae
  Peptidase_S8/S53_dom
SEELYNIIKDLPDVVSCNEDVVIPFPN

SEQ ID NO: 12423 - protein, 318 aa, Neocallimastix californiae
  Peptidase_S8/S53_dom
DVTVFENTYHHLSLISQSKYDRNLVGKYDRNFYYPISAGRGVDIYILDSGIYGDHIDFDTGHRTVSCDAMFGKTRVINQPGSSNYKNCYLENELKFHGSMVASVAAGKYFGVAKNANIHMIVHDRTALNILYAYDYVKKYAKNPHKTVINLSFGNYIRIPEEEKMINSLAEMGFIVIAAAGNDYTNACTNNPRQVKQEGQTVTVTSKMYPAAYSNVIAVGATNNDIQSLDVTNVSNLYNVASFSNYGNCLDIFGPGYVYGAYPGYDYRNNNSIQAYAGGTSFSCPIVAGVAASIISEHPEIEFNVTILRQWLLDNAVR

SEQ ID NO: 12424 - protein, 61 aa, Neocallimastix californiae
  Peptidase_S8/S53_dom
VYGAYPGYDYRNNNSIQAYAGGTSFSCPIVAGVAASIISEHPEIEFNVTILRQWLLDNAVR

SEQ ID NO: 12425 - protein, 323 aa, Neocallimastix californiae
  Peptidase_S8/S53_dom
RENTYNHLSLISQSKFDKNLIGQYDSNYYYPSSAGKGVDIYILDSGIDVHHADFELDTGNTGNGYRTVSCDAMFGDKEIINQPGSSSYKNCFLEEKIKYHGSMVASIAAGKIHGVAKNANIHMVVHNRQSTGILLAYNFVKNNLKDPHKTVINLSFGSYKKIPEEVSLINSLIEMGCIVVAAGGNDNISSCTTEPRYVVSDDDNKVKTLIQEKIYPASLENVIGVGSIRNKIKETDVSSVQNLYSLADFSNYGDCLDLFAPGYAYAAYPPPNNNDKSSSDLEGYGGGSSFSAPLVAGVAASIISEHPEMTFNHSLMKKMLLEI

SEQ ID NO: 12426 - protein, 27 aa, Neocallimastix californiae
  Peptidase_S8/S53_dom
SEELYEIIKELPDVVSCNENVIIPFPN

SEQ ID NO: 12427 - protein, 281 aa, Anaeromyces robustus
  Peptidase_S8/S53_dom
NNYYYPSSAGKGIDIFLIDKGLYLDNDDFDRYEGTEDERTLTCDALVVYGVAHPYEGEDKKKCKFAEDSYPGHGNMVSSLAGGKLYGAAKKANLHMIVSYYELYETIVALDYIKQNGKPYQSIISFSRGAYKKYSQFLQDKLDELNDAGFITVVAAGNETEDICHEKNKYFYSIAGYKNVIIVGSTESTYNNDIENGYKIASYSNYGECIDIFAPGQARYANYQLNRKAQGTSVSTAITAGVIATIMSEHPDIKFNVDTMKEKLFELSLKNIISGLNNVTP

SEQ ID NO: 12428 - protein, 706 aa, Neocallimastix californiae
  PERIPLASMIC BETA-GLUCOSIDASE-RELATED
WSESEDLAKALVEEMTLDEKIGMVTGSQNSFGPCVGYIEPIERLGFKGMCFQDGPAGVRSAKHTTTLPSGLNIASTFDPEIMKKIGVVLGEESRAKGVNAILGPAMNMYRSPAAGRNWEGYGEDTYLASVASKNVVAGIASQGVLATIKHFAGNEQETNRETSNSEIDERVLQEVYFPPFKAGIVSGAGGVMAAYNDLNGIPSANNTWLLNKVLKKQMLFHGFVTSDWWGTKDKYEIMNGLDINMPGGKQWGPTVTESYWGEELKEAVESGEIDVSYVDEACTRILTMLYKYRQFDDYPEINLDADATEGHAEVVREAAAASVVLLKNDEDILPISGDKYKKIAIIGDGALPTKQCTDNGCSEGKMSGVVALGWGSGTTNMENISDPLSALTERAEKDGITITSFTDDDSDTDKAAEVAADADLAIVVVVADSGEEYISVEGNKGDRKNLDLWHNGNELVSAVAAANKNTVVVIYSPGVVNLPFIDEVNGLVYAGMPGQEAGHGLADILFNDVAPSGKLPFTWGKKREDYCCDVVTGGKGKTQVPYEEGYYIGYKWFDKKNIEPHFSFGHGLTYAKFKIHDDGQSYWNVQTQRLLNLINGISTTFTIENTSDFDGYVTPQAYLTMPSPKDDPRIGEYPEFQLKGFEKYFLKAGEKRKVNLLVPYAETKYFNTTTNTWETTIDGKYKVSIGLSHDDIYIRNEIENYN

SEQ ID NO: 12429 - protein, 698 aa, Neocallimastix californiae
  PERIPLASMIC BETA-GLUCOSIDASE-RELATED
TTWEEADQKAKTFMSDLTESEKIDIVTGYMNNQGSCVGNVKPLSRKNFKGICLQDGPAGVRFNDGTSTTWQVGINNAATFNKELLYKIGKDQGAEFKAKGINIALAPSMNILRAPASGRVWENFGEDPYLSGVCGTEMTKGYQDSGCIVSAKHYVANDVEHNREASTSNMDEQTLMEIHVEPFYRTVTEGQAGSVMASYNAVNDVYVVQNKKVLTEILKEKMNFQGFVMSDWWAIHDLEGSFNAGVDLNMPGGKAWGPDYINDSFWGNNISTAIRNGKVSSARLDDAVRRIIRTLYRFDQMSGYPNVNIRAQSMHAETNRQAAIESTVLLKNADSILPLTNKYKKIAIIGKDADKAQKCNDSACTNGNIIQGWGSGTTDFVGVSDPFSAIKNRASKDGISVVSSLSDNSSEGANAARGADVALVFVRASSGEEYIVVDNNKGDRNNLDLWHGGNDLVKSVAAVNKNTIVVIHAPATVNLPFLDNVKAVIHAGMPGAESGNAIASILFGDSNPSGHLPFTWAPREDYCCDVSYPGELPKGGNSKTVYDYKEGLFVGYRWFDKKGIVPTFPFGHGLSYTTFDYSNLSVSLQKSGTDVTGIKATFDVKNSGSVEGATVPMLFLGYPEVSELKNYPIRGLKAFDKINLKAGEKKTVTLTVDQHGLSYYNTSQGKFVVPSGGEYTVYVGKSAGDLPLKLAIKN

SEQ ID NO: 12430 - protein, 706 aa, Neocallimastix californiae
  PERIPLASMIC BETA-GLUCOSIDASE-RELATED
WSESEDLAKAFVEKMTLDEKIGMITGSKNSFGPCVGYIEPIERLDFKGMCLQDGPAGVRNANHSTTFPSGLNIASTFDPEIMKKLGVALGEECRAKGVNALLGPAMNMYRSPAAGRNWEGYGEDTYLASVTSKNVVAGVVSQGVLATVKHFAGNEQETRREHSNSVVDERVLQEVYFPPFKAAIVSGAGGVMAAYNDLNGIPAANNTWLLNKVLKKQMMFHGFVTSDWWGTKDKYEIMNGLDINMPGGTDWGESVTESYWGEELKASVESGEIDVSYVDDACVRIMTMLYKYRQFDDYPEINLDADATEGHAEIAREAAAASVVLLKNDEEILPISADKYKKIAIIGNGALPTEVCTDNGCKSQISGVVALGWGSGTTNMENISDPLSALTERAEKDGITITSFTEDDSDTEKAAEVAADADLAIVVVVADSGEGYLTVEGNSGDRKDLDLWHNGNDLVAAVAAANKNTVVVIYSPGVVNLPFLDDINGLVYAGMPGQEAGHGLADVLFNDVAPSGKLPFTWGKKREDYCCDIVPGRGNEITQVKYTEGYYIGYKWFDKEKIEPHFSFGHGLTYAKFKIHDDGQSYWNVQTQRLLNLINGISTTFTIENTSEFDGYVTPQAYLTMPSAKDDPRIGEYPEFQFKGFDKIFLKAGEKKKINLLVPYAETKYFNTTTNTWETTIDGKYKVSIGLSHDDIYIRNEVENYN

SEQ ID NO: 12431 - protein, 690 aa, Neocallimastix californiae
  PERIPLASMIC BETA-GLUCOSIDASE-RELATED
LDEKINMVTGSQNSFGPCVGYLEPIERLGFKGLCLQDGPAGVRSAKHSTTFPSGLNIASTFDPELMKSLGVALGEEVRAKGVNAILGPAMNMYRSPVGGRNWEGYGEDTYLASVAAKNVVAGITSQGVIATIKHFVGNEQETKRESSNSIIDERVLQEVYFPPFKAAIVSGAGGAMAAYNDLNGIPCANNTWLLNKVLKKQMLFHGFVTSDWWGVKDKYGIMNGLDLNMPGGKEWGPTVKDSYWGEELKEAVESGEIDEMYLDEACIRVMTMLYKYRQFDDYPEINLDADATEGHAEIVRKAAANSVVILKNDDDVLPISPKKYKKIAIIGDGALPMKLCEDNGCKDKISGVVALGWGSGTTNMENISDPLSAITERAEKDGITITSFTEDDDDTDKAAEVAADADLAIVVVVADSGEGYLTVEGNSGDRKDLDLWHNGNELVAAVAAANKNTVVVIYSPGVVNLPFVDDVKTILYAGMPGQEAGHGLADILFNDVAPTGKLPFTWGKKREDYCCDVVKGKGNSITQVEYSEGYYIGYKWFDKQNIKPLFPFGHGLTYAKFKINENAQSYWNVQTQRLVNLINGISTVVTIENTSDIDGYATLQAYLTMPSAEDDPRIGEYPEYMLKAFEKVFLKAHEKKQVNLLVPYAETKYFNTTTNTWQETIDGKYKVSIGLSHDDIYIRNEIENRN

SEQ ID NO: 12432 - protein, 91 aa, Neocallimastix californiae
  PERIPLASMIC BETA-GLUCOSIDASE-RELATED
VEGATVPMLFLGFPNVSEMGDYPVRNLKAFDKINLKAGESKTVTLEVDQHGLSYYNTNKKKFVVPTGGEYTVYVGKSAGDLPLKVTLKNTQ

SEQ ID NO: 12433 - protein, 706 aa, Anaeromyces robustus
  PERIPLASMIC BETA-GLUCOSIDASE-RELATED
WSESEDLAKAFVEEMTLDEKINMVTGSQNSFGPCVGYLEPIERLGFKGLCLQDGPAGVRSAKHSTTFPSGLNIASTFDPELMKSLGVALGEEVRAKGVNAILGPAMNMYRSPVGGRNWEGYGEDTYLASVAAKNVVAGITSQGVIATIKHFVGNEQETKRESSNSIIDERVLQEVYFPPFKAAIVSGAGGAMAAYNDLNGIPCANNTWLLNKVLKKQMLFHGFVTSDWWGVKDKYGIMNGLDLNMPGGKEWGPTVKDSYWGEELKEAVESGEIDEMYLDEACIRVMTMLYKYRQFDDYPEINLDADATEGHAEIVRKAAANSVVILKNDDDVLPISPKKYKKIAIIGDGALPMKLCEDNGCKDKISGVVALGWGSGTTNMENISDPLSAITERAEKDGITITSFTEDDDDTDKAAEVAADADLAIVVVVADSGEGYLTVEGNSGDRKDLDLWHNGNELVAAVAAANKNTVVVIYSPGVVNLPFVDDVKTILYAGMPGQEAGHGLADILFNDVAPTGKLPFTWGKKREDYCCDVVKGKGNSITQVEYSEGYYIGYKWFDKQNIKPLFPFGHGLTYAKFKINENAQSYWNVQTQRLVNLINGISTVVTIENTSDIDGYATLQAYLTMPSAEDDPRIGEYPEYMLKAFEKVFLKAHEKKQVNLLVPYAETKYFNTTTNTWQETIDGKYKVSIGLSHDDIYIRNEIENRN

SEQ ID NO: 12434 - protein, 697 aa, Anaeromyces robustus
  PERIPLASMIC BETA-GLUCOSIDASE-RELATED
SWEEADKKASSFVSDLSEAEKIDIVTGYMNMQGTCVGNIKPNSRKNFKGLCLQDGPAGVRFNEGTSTTWQTGINSAATFNKDLLYKIGKDQGAEFYAKGINVALAPSMNILRAPASGRVWENFGEDPYLSGVCGTQITKGMQDSGVIVSAKHYVANDIEHNREASTSNMDEQTLMEIHVEPFYRTVTEGEAGSVMASYNAVNGVYVVQNKKVLTEILKEGMNFQGFIVSDWWAIHDLEGSFNAGVDMNMPGGKAWGPNYINDSFWGSNISNAIRSGKVSSARLDDAVKRIIRSMYKMNQMGNFPNVNLRAQSMHTETHRQAATESQILLKNDDNVLPLTKKYRKIAVIGKDADKAESCTDTACTNGNIIQGFGSGTTDFTGITDPYSSIKNRASKEGITVVGSISDSANEGANAARDADVAIVFVRATSGEEYIVVDNNKGDRNNLDLWHGGNDLVKSVAAVNKNTIVVIHAPATVNLPFINNVKAIIHAGMPGAESGNAIASVLFGDHNPSGHLPFTWAKREEYCCDVSYPGELPHGGDSKTTYDYKEGLFVGYRWFDKKGTKPIYPFGHGLSYTTFEYSNLSSSLVKSGTEVTGLKATFTVSNTGSVEGATVPMLFLGFPNVSEMGDYPVRNLKAFDKINLKAGESKTVTLEVDQHGLSYYNTNKKKFVVPTGGEYTVYVGKSAGDLPLKVTLKN

SEQ ID NO: 12435 - protein, 706 aa, Anaeromyces robustus
  PERIPLASMIC BETA-GLUCOSIDASE-RELATED
WSESEDLAKEFVSQMTLDEKIGMVTGSQNSFGPCIGYLEPIERLGFKGLCLQDGPAGVRSAKHSTTFPSGLNIASTFDVELMHDLGVALGEECRAKGVNVILGPAMNMYRSPAAGRNWEGYGEDTYLASVASKNVVAGIQSQGVLATAKHFVGNEQEYKRDSSNSIIDERVLQEVYLPPFKAAVVSGAGAFMASYNSINGIPATNHTQLLNKVLKKQFLFHGFVTSDWWGTKDKIEITNGLDMNMPGGKVWGPTVKESYWGEELKDAIENEEIDISYLDESCERIMTMLYKYKQMDDFPDLNLDADATEGHTELVRKAAAASVVLLKNDEDILPISPKKYKKIAIIGDGARPTKPCTDNGCAQGKMSGVVVLGWGSGTTNMENISDPLSALTERAEKDGITITSFTEDDSDTDKAAEVAADADLAIVVVTASSGEEYITVEGNQGDRKNLDLWHNGNELVSAVAAANKNTVVVIYSPGVVNLPFLDDIKGLVYAGMPGQEAGHGLADILFNDVAPSGKLPFTWGKKREDYCCDIVYGNDKIIDIPYSEGFYLGYKWFDKEKIEPHFSFGHGLTYAKFKIHDNAQSYWNIQTQRLVNLINGISTTFTVENTSDFGGYITPEVYLTMPSEKDDPRIGQYPELNFKNFTKIYLEGGEKRQVNLLVAYADTKYFNMTTMNWDTTIDGKYQISIGFSHDDIVIHTEIDNLN

SEQ ID NO: 12436 - protein, 706 aa, Piromyces finnis
  PERIPLASMIC BETA-GLUCOSIDASE-RELATED
WSESEDLAKAFVEEMTLDEKINMVTGSENSFGPCVGYIPPIERLGFKGLCLQDGPAGVRSAKHSTTFPSGLNIASTFDQNLMKKLGVALGEECRAKGVNVILGPAMNMYRSPAAGRNWEGYGEDTFLATVASKNVVAGIQSQGVFATAKHFAGNEQEYKRESSNSIIDERVLQEVYFPPFKAAVVSGAGAFMSAYNDLNGIPSANNTYLLNQVLKKQFKFHGFVTSDWWGTKDKYEITNGLDVNMPGGKQWGPTEKESYWGEELKAAIESEEIDISYLDEACERILTMMYKYKQMDDFPELNLDADGTEGHTELVREAAAASVVLLKNDKDILPISGKKYGKIAIIGDGALPTKLCTDNGCTQGKMSGVVALGWGSGTTNMEDISDPLSALTERAEKDGITVTSFTDDDEDTEKAAQVASDADLAIVVVTANSGEGYLTVEGNSGDRKNLDLWHNGNELVAAVAAANPNTVVVIYSPGVVNLPFIDDVDGLVYAGMPGKEAGHGLADILFHDVSPSGKLPFTWGKKREDYCCDVVYGNDKIIDVPYTEGFYLGYKWFDKEKIEPHFSFGHGLTYAKFKIHDDAFSYWNIQTQRLLNLINGISTTFTIENTSDFGGYITPEVYLTMPTVEADPRIGVYPELNFKNFTKIYLEAGEKRKVNLLVAYADTQYFNTTKNEWQTTIDGTYKVHVGFSHDDIVFTTEIENLN

SEQ ID NO: 12437 - protein, 706 aa, Piromyces finnis
  PERIPLASMIC BETA-GLUCOSIDASE-RELATED
WSESEDLAKAFVEEMTLDEKINMVTGSENSFGPCVGYIPPIERLGFKGLCLQDGPAGVRSAKHSTTFPSGLNIASTFDQNLMKKLGVALGEECRAKGVNVILGPAMNMYRSPAAGRNWEGYGEDTFLATVASKNVVAGIQSQGVFATAKHFAGNEQEYKRESSNSIIDERVLQEVYFPPFKAAVVSGAGAFMSAYNDLNGIPSANNTYLLNQVLKKQFKFHGFVTSDWWGTKDKYEITNGLDVNMPGGKQWGPTEKESYWGEELKAAIESEEIDISYLDEACERILTMMYKYKQMDDFPELNLDADGTEGHTELVREAAAASVVLLKNDKDILPISGKKYGKIAIIGDGALPTKLCTDNGCTQGKMSGVVALGWGSGTTNMEDISDPLSALTERAEKDGITVTSFTDDDEDTEKAAQVASDADLAIVVVTANSGEGYLTVEGNSGDRKNLDLWHNGNELVAAVAAANPNTVVVIYSPGVVNLPFIDDVDGLVYAGMPGKEAGHGLADILFHDVSPSGKLPFTWGKKREDYCCDIVSNNDVYPKIEYSEGFYLGYKWFDKEKIEPHFSFGHGLTYAKFKIHDDAFSYWNIQTQRLLNLINGISTTFTIENTSDFGGYITPEVYLTMPTVEADPRIGVYPELNFKNFTKIYLEAGEKRKVNLLVAYADTQYFNTTKNEWQTTIDGTYKVHVGFSHDDIVFTTEIENLN

SEQ ID NO: 12438 - protein, 355 aa, Neocallimastix californiae; identical to SEQ ID NO: 799
  PERIPLASMIC BROAD-SPECIFICITY ESTERASE/LIPASE/PROTEASE

SEQ ID NO: 12439 - protein, 229 aa, Neocallimastix californiae
  PERIPLASMIC BROAD-SPECIFICITY ESTERASE/LIPASE/PROTEASE
DTVKIMPVGDSITFGEGERGGYRKYLYSALTQKGYKIDMVGPEGSNSASANGIQYDDNNAGYSGFQIKEIPGWGQQQGGEGSLYNKLKSKNAVKQSQPDIILLIIGTNDMTANRSMDACANDLRALLDYMLADMPANSIIFMGSIPEFTAYGGNAQRIANYNGTVKKVADEYANKGKNVRFADVHGCLNGMSDIGSDRLHPSGNGYKKIGNFWAGVIDEYLQSIKNDSN

SEQ ID NO: 12440 - protein, 227 aa, Neocallimastix californiae
  PERIPLASMIC BROAD-SPECIFICITY ESTERASE/LIPASE/PROTEASE
DAIKIMPVGDSITFGMGENGGYRKYLYSALTQKGYNIDMVGPEGSSRATANGISYDDNHAGYSGFQIKEIPDWGRQQGGDGSLYNKLKSKNAVKQAQPDIILLIIGTNDMTANRSMDACASDLRALLDYMLGDMPSGGIIFMGSIPEFTAYGGNAQRVANYNGTVKKVAEEYASKGKNVRFADVHGSLNGTGDLGGDGLHPNGNGYKKMGNFWADVIDKYLKESAPA

SEQ ID NO: 12441 - protein, 227 aa, Anaeromyces robustus; identical to SEQ ID NO: 12440
  PERIPLASMIC BROAD-SPECIFICITY ESTERASE/LIPASE/PROTEASE

SEQ ID NO: 12442 - protein, 339 aa, Neocallimastix californiae; identical to SEQ ID NO: 9334
  PEROXISOMAL MULTIFUNCTIONAL ENZYME TYPE 2

SEQ ID NO: 12443 - protein, 339 aa, Neocallimastix californiae; identical to SEQ ID NO: 9335
  PEROXISOMAL MULTIFUNCTIONAL ENZYME TYPE 2

SEQ ID NO: 12444 - protein, 339 aa, Anaeromyces robustus; identical to SEQ ID NO: 9336
  PEROXISOMAL MULTIFUNCTIONAL ENZYME TYPE 2

SEQ ID NO: 12445 - protein, 339 aa, Piromyces finnis; identical to SEQ ID NO: 9338
  PEROXISOMAL MULTIFUNCTIONAL ENZYME TYPE 2

SEQ ID NO: 12446 - protein, 98 aa, Neocallimastix californiae
  PHL pollen allergen
NIYIRILPGANQWYFAINVVNVANMGSLVAVEVLRNGKWAPLVRDPNYSSTRPQERYGSWVVPPLKEGEQSEPFTTPLTLRFTDSAFNTLTAPDAIKE

SEQ ID NO: 12447 - protein, 93 aa, Neocallimastix californiae
  PHL pollen allergen
NIHVWLRPGAGPWYFALTVVNVANMGSLVAVEVQQADGIWVPLVRDPNYSSTRPQERYGSWTVKQGTGPFSVPMNMRFTDSAFNTLTAEGAIK

SEQ ID NO: 12448 - protein, 97 aa, Neocallimastix californiae
  PHL pollen allergen
NMYIWLRKDAGPYWFAFSVVNSAGFGAIAVLEAKNDEGKWVKMIRDPNYTMSRPQERYGVWVTPQDTGPYNLPVDIRLTDGSGVTIVAEKAIKSFTP

SEQ ID NO: 12449 - protein, 75 aa, Neocallimastix californiae
  PHL pollen allergen
IKLKWKMASSVYWGGIQAFNTRYPVTSIERWDDASNDWVHLRRDDMFHYMWDTTIPGGPMKVRVTQGDGVQVVVD

SEQ ID NO: 12450 - protein, 106 aa, Neocallimastix californiae
  PHL pollen allergen
NMYIWLREDAGPYWFAFSVVNSAGFGAIAVLEAKNDEGKWVKMIRDPNYTMSRPQERYGVWVTPQDTGPYNLPIDIRLTDGSGVTVVAEEAIKSFDPPADAIKGYY

SEQ ID NO: 12451 - protein, 94 aa, Neocallimastix californiae
  PHL pollen allergen
NIHVWLRPGAGPWYFALTVVNVANMGSLVAVEVQQADGVWVPLVRDPNYSSTRPQERYGSWTVKQGTGPFTVPMNMRFTDSAFNTLTAEGAIKD

SEQ ID NO: 12452 - protein, 106 aa, Neocallimastix californiae
  PHL pollen allergen
NMYIWLREDAGPYWFAFSVVNSAGFGAIAVLEAKNDEGKWVKMIRDPNYTMSRPQERYGVWVTPQDTGPYNLPIDIRLTDGSGVTIVAEKAIKSFDPPADAIKGYY

SEQ ID NO: 12453 - protein, 97 aa, Neocallimastix californiae
  PHL pollen allergen
NMYIWLRQNASPYWFSFTVVNSAGFGGIAILEAKNDEGKWVKLIRDPNYTMARPQERFGTWATPQDSGPYNLPIDIRLTDGSGITIVAEEAIKSFTP

SEQ ID NO: 12454 - protein, 76 aa, Neocallimastix californiae
  PHL pollen allergen
AIKFQFKSGSTQFWGEVQVFNTRYPVAKVEFLSGGKYVGLYRRAYNYWALNSGGFGAGPYTFRVTLADSTVIEAKN

SEQ ID NO: 12455 - protein, 98 aa, Neocallimastix californiae
  PHL pollen allergen
NIYIRILPGANQWYFAINVVNVANMGSLVAVEVLRNGKWAPLARDPNYSSTRPQERYGSWVVPPLKKGEQSEPFETPLTLRFTDSAFNTLTAPDAIKE

SEQ ID NO: 12456 - protein, 88 aa, Neocallimastix californiae
  PHL pollen allergen
NIHVWLRPGAGPWYFALTVVNVANMGSLVAVEVQQEDGVWVPLVRDPNYSSTRPQERYGSWTVKQGTGPFTVPMNMRFTDSAFNTLTA

SEQ ID NO: 12457 - protein, 98 aa, Anaeromyces robustus; identical to SEQ ID NO: 12455
  PHL pollen allergen

SEQ ID NO: 12458 - protein, 94 aa, Anaeromyces robustus
  PHL pollen allergen
NIHVWLRPGAGPWYFALTVVNVANMGSLVAVEVQQEDGVWVPLVRDPNYSSTRPQERYGSWTVKQGTGPFTVPMNMRFTDSAFNTLTANGAIKD

SEQ ID NO: 12459 - protein, 106 aa, Anaeromyces robustus
  PHL pollen allergen
NMYIWLRKDAGPYWFSFSVVNSAGYGAIAVLEAKDDEGNWIKMQRDPNYTMARPQERYGVWATPQGAGPFNLPVDIRLTDGSGVVVVAEKAIKSFTPPADSIEGYY

SEQ ID NO: 12460 - protein, 76 aa, Anaeromyces robustus
  PHL pollen allergen
PIKFQFKSGSTQFWGEVEVFNTRYPVAKVEFLSNGKYESLYRRAYNYWALNSGGFGAGPYTFRVTLADDTVIEAKG

SEQ ID NO: 12461 - protein, 91 aa, Piromyces finnis
  PHL pollen allergen
NIHVWLRPGAGQWYFALTVVNVANMGSLVAVEVQQSDGQWVPLVRDPNYSTTRPQERYGSWTVKQGTGPFTTPMNMRFTDSAFNTLTAEGA

SEQ ID NO: 12462 - protein, 83 aa, Piromyces finnis
  PHL pollen allergen
PLKFQFKSGSTQFWGEVEVFNTRYPVAKVELLLNGKYQSLYRRAYNYWALSSGGFGAGPYTFRVTLADNTVIQATNVEMVIPA

SEQ ID NO: 12463 - protein, 15 aa, Neocallimastix californiae
  PHOSPHOPANTETHEINE
ELGIDSIMMMELRTI

SEQ ID NO: 12464 - protein, 15 aa, Neocallimastix californiae
  PHOSPHOPANTETHEINE
ELGIDSIMMMELRQI

SEQ ID NO: 12465 - protein, 15 aa, Neocallimastix californiae
  PHOSPHOPANTETHEINE
MYGIDSLTTVKLTNL

SEQ ID NO: 12466 - protein, 15 aa, Neocallimastix californiae
  PHOSPHOPANTETHEINE
SSGFNSINSVKLIKL

SEQ ID NO: 12467 - protein, 15 aa, Neocallimastix californiae
  PHOSPHOPANTETHEINE
SSGFNSINSVKLIKL

SEQ ID NO: 12468 - protein, 15 aa, Neocallimastix californiae
  PHOSPHOPANTETHEINE
SSGFNSINSVKLIKL

SEQ ID NO: 12469 - protein, 15 aa, Anaeromyces robustus
  PHOSPHOPANTETHEINE
ELGIDSIMMMELRTI

SEQ ID NO: 12470 - protein, 15 aa, Anaeromyces robustus
  PHOSPHOPANTETHEINE
ELGGDSLNAIRIISM

SEQ ID NO: 12471 - protein, 15 aa, Anaeromyces robustus
  PHOSPHOPANTETHEINE
SFGLNSINSIKLIKL

SEQ ID NO: 12472 - protein, 15 aa, Piromyces finnis
  PHOSPHOPANTETHEINE
ELGIDSIMMMELRTI

SEQ ID NO: 12473 - protein, 15 aa, Piromyces finnis
  PHOSPHOPANTETHEINE
MYGIDSLSTVKLTNI

SEQ ID NO: 12474 - protein, 83 aa, Piromyces finnis
  PI-PLC-X
WGRTQSLDIYQQLMHGIRYLDIRLETNPKKQIYLTHDKFDCINKKTNDLYYLSNVFDEAINFLHYNPSETVIMHLKCDNCHFH

SEQ ID NO: 12475 - protein, 84 aa, Piromyces finnis
  PI-PLC-X
QWGRTQSLDIYQQLMHGIRYLDIRLETNPKKQIYLTHDKFDCINKKTNDLYYLSNVFDEAINFLHYNPSETVIMHLKCDNCHFH

SEQ ID NO: 12476 - protein, 78 aa, Neocallimastix californiae
  PIPLC_X_DOMAIN
LSQYRKTSAQHFILHKTDGNYDTYYITAECSGNAALDVYDQSSDNGAKIDQWNYWGGDNQRFYIIPIDQEPIVYNNNN

SEQ ID NO: 12477 - protein, 106 aa, Piromyces finnis
  PIPLC_X_DOMAIN
INQINIPGTHDSGTYAVDWHSFPIINGFRRQWGRTQSLDIYQQLMHGIRYLDIRLETNPKKQIYLTHDKFDCINKKTNDLYYLSNVFDEAINFLHYNPSETVIMHL

SEQ ID NO: 12478 - protein, 106 aa, Piromyces finnis; identical to SEQ ID NO: 12477
  PIPLC_X_DOMAIN

SEQ ID NO: 12479 - protein, 311 aa, Neocallimastix californiae
  PKS_AT
SFTGQGSIKPGVGKELFRTQPVFRAAMEKCDAVVKKSTGISILDALYDQNQGHHLKKAQIAQPALFAYEYAMYMLWKSWGIKPVIVNGHSLGEIVAAAATGAIDIDLAIDFIIERARCMGEYGEKPGAMVSVFQSEDVVKEAIEEFGYEEEVSIAAINGVTHTVISGYEDEVDDLTEYFNEMKVKTKKLNVTDAFHSPLMDPAIEELNGWIEEKNDAQFRQTLKVKFISNVDSTIKPVGDRLEKDYWGKHARNAVRFVDGVKSMIESEKKLLAVIEVGPAATLTNMSSRFVRETESLRGKGPTFIASSVAD

SEQ ID NO: 12480 - protein, 319 aa, Neocallimastix californiae
  PKS_AT
AFTGQGVAKVGMGKHFYQTQPVFREAMDRCDAVTRRLLGVSIVEVLYNVSNIPNGTEEGEKALKKSSVAQPALFAYEYAMSQLWISWGIKPSMVLGHSLGEIVATTIAGGIDFELAMEFIVERASCMEKYGIKPGAMVSIFTTEDVVKEAIEEFEFENVSIAAINGTTQIVISGNADEVKELEEYFIEQDIKAKQLNVTEAFHSALMDPAIEKLYEWIDSKPDEKFRQPLKYGLISNVTGKLIPAGERLPKNYWGEHARNAVQFVKAVETLLANSETLLNVIEVGPASVLTNMSSRILREKKVDKFAAPFFVASALPRE

SEQ ID NO: 12481 - protein, 300 aa, Neocallimastix californiae
  PKS_AT
TFSGQGTQYPDMGRQLYHSNPYFANIIDYCNEIVLSISKKDLLKETGLFGDLPVNEENLMDPQYSFLAIGIIQLALVEFWKAYGVEPSLVFGHSMGEVAAAYAAGILTLEDAILLLYHYGLISQNLEENNEKSGLIALGCGVDEAKTEYIKDRKKVYIASINSYKDVTLGGDLNQLEEIMDQAKQKNVFTVMLKVNKAFHTPFILSAKEKFLKGIEGIHLRVQPPKIPFISSTHGNEYQGPFDANYWWSNIINPVNFSQAVKIAHTKVDKVLEISSTPVLGIYISSVFQPDSIFYTLSRK

SEQ ID NO: 12482 - protein, 300 aa, Neocallimastix californiae
  PKS_AT
AFSGQGSQFINMGRRMYQVNGLFKRIVDYCAAVLVTYNGGEDIFEKYHIFKGDVSQISEADLSLPQYSILAIGVAQIALTEIWKAMGVTPEAVFGHSMGEVAAAYAAGILTLEDAILLLYMRGHILAQLDGTGKGMLALGCSVEQAQYFMNNKPNVFISAVNSANSITLAGDISQINAIAQEAKAQNLFAVVLKVKQAFHSPYVEGAEQAFKESIRGISERTSAPKCKFISACFGQEYEGPFDENYWWANIRNPVSFYAAASIGTQFSKRVLEIGAHPVLSVYLKEIYGKEYVYQSLSRK

SEQ ID NO: 12483 - protein, 463 aa, Neocallimastix californiae
  PKS_AT
VFTGQGAQEVGMGQDLYNKSAVAKAVWDRADAYLMKKYGYSILEIVRTNPKSLTVYFGGEDGEKIRENYINMTCEIIDSNGKVQTKRMFPEIDENTLYYEYKSPTGLLNATQFTQPAITLTEKAAFEDMYEKGYICDDAVYAGHSLGEYAALSCVANTLSIESMAEIVFYRGLVMQSSVERDELNRSDYAMCAVNPVRVHPYFSFDLLVEVVKKINAEHGGLLEIVNYNVENYQYVVTGDLTSLEALKNLLTNLRAEAKKFITLYKEDATQAMELLNEKVRTYVKLAEERKAKEGFFNIERGAATIPLRGIDVPFHSSYLLWGVPTFRELLHQRVRREDVDVKCLVGRYIPNLMGEPFSVEKDYAIRLQKRTNSAYLEKIIEEWDQHLFEIPYIIMVELLSYQLASAVQWIKTQEFLFSSQKKGGADIERLIEFGPTPTLVGMAKRTLGMKYVKSDLALGKKR

SEQ ID NO: 12484 - protein, 302 aa, Neocallimastix californiae
  PKS_AT
VFRGMSQLNSNIGYSLYQYNQKFAEIVDYCDKVLEKVSGGVCSLKREFGLFQSENLNFLSLQNPKMSIIGNGMIQLALGHLLKSYGIKPSSVVGYNSGEIAAAYTAGIISLEDAILVLYQYSTILEKVPNKKNIFTLELGCSAGQAQTNIINQLSSTIYISGNNADNICTLCGSRESLNQAVSIAQQNGIPVLSNLIPGSCGICTPYLNDFKDEFFASLKGIGNNCKTPVIKFISTTLGQPFNGPLNEYYWWANLSSTVNFSHALSLAMNEQQKGSGYILDVGSGYANAALFTNYFGAFTTA

SEQ ID NO: 12485 - protein, 467 aa, Neocallimastix californiae
  PKS_AT
VFTGQGAQEVGMGMDLYEKSPVAREIWDRADAHLMENYGFSIIDIVKNNPTEITIYFGNVKGQQIRKNYQQMTYEHVNSDGVVESLSLFPEIDDDSVSYTFRHIGGLLSATQFTQPSLVLMEKAAFEEMRSRGFIQQNSAFAGHSLGEYAALTAIGDVLSIETLVDVVFYRGMTMQRAVQRDSKGRSDYAMCAVNPTRVSRTFNESALQYLVANIKKVTEGLIEIVNYNVDNWQYVVSGDLISLQVLTLVLNYLKAEKIDLTVLLNTLSVEEVQKQVNEIISTSFEKAKEQKKKHGYIKLERGAASIPLRGIDVPFHSSFLLRGVAPFRQYLMSKFDPNLIDVNRLIGNYIPNLTAEPFSLKKEFIENIYAKTNSSRIKNVLKGWTDDKYASPRLQQKLGYILLIELLAYQFASAVRWIETQDRLFVDIGVERLIEIGPGPTLSGMAQKTLKFKYEYYDDATSYRRE

SEQ ID NO: 12486 - protein, 467 aa, Neocallimastix californiae; identical to SEQ ID NO: 12485
  PKS_AT

SEQ ID NO: 12487 - protein, 286 aa, Neocallimastix californiae
  PKS_AT
CRDFYCNNSYFADCIDYCDQVLKMISGRSLLEDYGLFQSVKEEEKEKEKEKKNKLREDLLKDPTTTLLINGIIQLGLVALYRYYGISPNAVIGYGAGEIAAAYAAEKIDLKSAVQILYHYGRVLSMVKKDDNLSKVYSILVGCPVGKLSQVILSKLSPTEKELISISGVPSPTQCVLNGEMEILKKIMEQAKTEKIPILGSLMDSFAIHTKKISEAMKEELVKRLTNIKSKPSSIAMFSTTKFSKEGKPYTDALDGQYWWMNMRNPVLYAHSLSQTANFLPTDGKN

SEQ ID NO: 12488 - protein, 467 aa, Neocallimastix californiae
  PKS_AT
VFTGQGAQEVGMGMDLYEKSPVAREIWDRADAHLMESYGFSIIDIVKNNPTEITIYFGNVKGQQIRKNYQQMTYEHVNADGVIESLSLFPEIDDDSDSYTFHHIGGLLSATQFTQPSLVLMEKAAFEEMRTRGFIQQNSAFAGHSLGEYAALTAIGDVLSIETLVDVVFYRGMTMQRAVQRDSKGRSDYAMCAVNPTRVSRTFNESALQYLVANIKKVTEGLIEIVNYNVDNWQYVVSGDLISLQVLTLVLNYLKAEKIDLTVLLNTLSVEEVQKQVIEMITTAFEKAKDQKKRHGFIKLERGAASIPLRGIDVPFHSSFLLRGVAPFRQYLMSKFDPNLIDVNRLIGNYIPNLTAEPFSLKKEFIENIYAKTNSSRIKNVLKGWTDDKYASPRLQQKLGYILLIELLAYQFASAVRWIETQDRLFVDIGVERLIEIGPGPTLSGMAQKTLKFKYEYYDDATSSRRE

SEQ ID NO: 12489 - protein, 463 aa, Neocallimastix californiae
  PKS_AT
VFTGQGAQEVGMGQELYNKSAVAKAVWDRADAYLMKKYGYSILEIVRTNPKSLTVYFGGEEGEKIRENYINMTCEIIDSNGKVQTKRMFPEIDENTLYYEYKSPTGLLNATQFTQPAITLTEKAAFEDMLENGYICDDAVYAGHSLGEYAALSCVANTLSIESMAEIVFYRGLVMQSSVERDELNRSDYAMCAVNPVRVHPYFSYDLLVEVVKKINSEHGGLLEIVNYNVENYQYVVTGDLTSLEALKNLLTNLRAESKKFIALYKEDATQAMDLLNEKVCIYVKLAEERKAKEGFFNIERGAATIPLRGIDVPFHSSYLLWGVPTFRELLHQRVRREDVDVKCLVGRYIPNLMGEPFSVEKDYAIRLQKRTNSTYLEKIIEEWDDHLFEIPYIIMVELLAYQLASAVQWIKTQEFLFSSKNKGGADVERLIEFGPTPTLVGMAKRTLGMNFAKSDLALGKKR

SEQ ID NO: 12490 - protein, 261 aa, Neocallimastix californiae
  PKS_AT
SFTGQGSIKPGVGQELFRSQPVFHAAMEKCDAVVKKVTGVSIIDALYDQSQAHHLKKAQIAQPALFAYEYAMCMLWKSWGVEPVIVNGHSLGEIVAAAVTGAIDIDLAIDFIIERARCMGEYGEKPGAMVSIFQNEKTVKEAIEEFGYEEEVAIAAINGVTHTVISGYEEEVDDITQYFSEMNIKTKKLNVTDAFHSPLMDPAIEELNNWIEEKDDAKFRQSLKVKFISNLDGTIKPVGDRLEEDYWAKHARNAVRFVDGV

SEQ ID NO: 12491 - protein, 244 aa, Neocallimastix californiae
  PKS_AT
LFCPGNRNVQKEDKLKEDLLKDPSTALLISGIVQFSLVSLYKYYGITPSVVIGYGAGEITAAYAAEKIDLKDAVQILYHYGQVLSMANNSSPKVYSFLVGCPVGRLNHMMVSKLTPSEKDLISISGIPNPRQCILCGEMEILKKVMKMIKDEKVPILSGFMESFGIHSKIITEAMKDELTKRLENISSHSSSIAMFSTAKFNEKSEPYTGALDGSYWWMNMRNPVLYAHTLSQTVNYLPSDGKN

SEQ ID NO: 12492 - protein, 464 aa, Anaeromyces robustus
  PKS_AT
VFTGQGAQEVGMGQELYNKSAVAKSVWDRADAYLMKKYGYSILEIVRTNPKSLTVYFGGEEGEKIRENYMNMTCEIIDSNGKVQTKRMFPEIDENTLYYEYKSPNGLLNATQFTQPAITLTEKAAFEDMLENGYICDDAVYAGHSLGEYAALSCVANTLSIESMAEIVFYRGLVMQSSVERDALNRSDYAMCAVNPVRVHPYFSYDLLVEVVKKINSEHDGGLLEIVNYNVENYQYVVTGDITSLEALKNLLTNLRAEAKKFITLYKEDASQAMDLLNEKVVHYVKEAEERKAKEGWFNLERGAATIPLRGIDVPFHSSYLLWGVPTFRELLHQRVRREDVDVKCLVGRYIPNLMGEPFSVEKDYAIRLQKRTNSTYLEKIIEEWDQHLFEIPYIIMIELLAYQLASAVQWIKTQEFLFSSEKKGGVDIERLIEFGPTPTLVGMAKRTLAKNYSQSDLALGKKR

SEQ ID NO: 12493 - protein, 302 aa, Anaeromyces robustus
  PKS_AT
TFSGQATQYPDMGRQLYHSNPYFASIINYCNEIIIRLSQKDLIKDTGLFSDTPVDEEKLIDPQYSFLAIGIIQLALVEFWKLYGVEPALVFGHSMGEVAAAYAAGILTIEDAILLLYNYGLISQNVDDIHEKSGMLALGCSAEEAKTTYLNGKDKNRVYIASINSEKDITLGGDLNQLDAIMTQAKNNNVFTVMLKVKKAFHTPYIITAKQKFIQGIQGIGSRVNSPKIPFISSTYGKEYQGPFDEEYWWTNIINPVNFSQATKVARTKVEKVLEIGSTPVLGIYMSKIFNPDNIFYSLSRK

SEQ ID NO: 12494 - protein, 318 aa, Anaeromyces robustus
  PKS_AT
AFTGQGVAKVGMGKHFYQTQPVFRKAMDKCDEVTRRLLNVSIVEVLYNISNAPNGIEKGENALKKSSVAQPALFAYEYAMSQLWISWGVEPSMVLGHSLGEIVATTIAGGIDFELAMEFIVQRASCMEKYGIKPGAMVSIFTTESAVKEAIEEFEFENVSIAAINGTTQTVISGNADEVKELEEYFIEQEIKAKPLNVTEAFHSALMNPAIEKLYEWIETKPDDKFRKPLKYGLISNVTGELIPAGERLPKNYWGEHARNAVQFVKAVETLLANSETLLNVIEVGPSNVLTNMSARILREKKIDKYTNPFFVASASPR

SEQ ID NO: 12495 - protein, 312 aa, Anaeromyces robustus
  PKS_AT
SFTGQGSIKPGVGQELYRSQPVFRDAIDKCDTVLKKVTGISLVDVLYNPQQAHHLKKAQIAQPALFAFEYAMCMLWKSWGVEPTIVNGHSLGEIVAAAVTGAMDIDLAIDFIVERARCIGEYGEKPGTMVSIFEKEDVVKKAIEEFDTQEEVAVAAINGVAHTVISGYEDEVDDITEYFKQMNVKTKKLNVTDAFHSPLMEPAIEELDKWIEGKDDEKFRQPLKVRFISNVDGKIKEVGERLDENYWAEHARSTVRFVDGVKSMIESENNNILAVIEVGPAATLSHMSARYVRENEALRGKGPHFIPSGSAD

SEQ ID NO: 12496 - protein, 467 aa, Anaeromyces robustus
  PKS_AT
VFTGQGAQEVGMGMDLYEKSAVAREIWDRADAHLMETYGFSIIDIVKNNPTEITIYFGNVKGQQIRKNYQQMTYEHVNADGVIESLSLFPEIDDDSTSYTFHHIGGLLSATQFTQPSLVLMEKAAFEEMRSRGFIQQNSAFAGHSLGEYAALTAIGDVLSIETLVDVVFYRGMTMQRAVQRDSKGRSDYAMCAVNPTRVSSTFNENALQYLVANIQKVTEGLIEIVNYNVDNWQYVVSGDLISLQVLTNVLNYLKAEKIDLTVLLNTLSVEEVQKQVIEIVTNAFEKAKEQKRKRGFINLERGAASIPLRGIDVPFHSSFLLRGVAPFRQYLMSKFDPNLIDVNRLIGNYIPNLTAEPFSLEKKFIENIYAKTNSSRIKNVLKGWTDDKYASPRLQQKLGYILLIELLAYQFASAVRWIETQDRLFVDIGVERLIEIGPGPTLSGMAQKTLKFKYEYYDDATSYRRE

SEQ ID NO: 12497 - protein, 277 aa, Anaeromyces robustus
  PKS_AT
LYKYNQKFAKIVDYCDKVLEKVSQGLSLKRDYGLFQKENFDETTLRDPKISVIGSGIIQLTMAHLLKSYAIIPSSVVGYSIGEISAAYAAGIISLEDAVLILYQYSSILEKVPGKEDIYTVELGCSSDQAQVNILSQLSAPVYIVSNSTSNICTLCGNSTFLNQAIQMAQQLNIPILSNLTPGSNGICTPYLNDFKDEFYESLRDIGSRCKDPVIPFISTTLGQPFNGPLNEFYWWANLTSTVNFSSALSLAMNEQPNGSGYILDVGSGYSSTLFHN

SEQ ID NO: 12498 - protein, 311 aa, Piromyces finnis
  PKS_AT
SFTGQGSIKSGVGLELYRTQPVFRDALNKCDVVVKKATGISLIDALYNPSQSHHLNKAQIAQPALFAYEYAMCMLWKSWGINPTIVNGHSLGEIVAAASTGAMDIDLAIDFIIERARCMGEYGEKPGTMVSVFEKEDVIKEAIEEFGYDEEVSVAAINGVTHTVISGYEDEVDDITEYFSQMNIKTKKLNVTDAFHSPLMDPAVSELNKWIERKDDSKFRQDLKVKFISNVDGNIKPVGSRLEEDYWGKHARNAVRFVDGVKSMIESEKKLLAVIEVGPAATLTNMSSRFVRETESLRGTGPTFIASSVAD

SEQ ID NO: 12499 - protein, 281 aa, Piromyces finnis
  PKS_AT
LGYSLYQNNKMFADVVDYCDKILEKISQGYSVKKNTGLFLKENLDAATLQSPKISVVGSGMIQLAMAHLLKTYGIVPSSVVGYNTGEIAAAYATGIISLEDAILILYQFSNILEKVPGKEDIYTLELGCSAEQAQSSIINQLSTSAYITGNNASNICTLCGSSAALNQAIQLAQQSNIPILSNLIPGSCGICTPFLNNFKNEFHEALKDIGSRCKAPATPFISTTLSQPFNGPLNEYYWWANFTSTVNFNVALSLAMNEQQKGSGYILDVGCGYSNALFNN

SEQ ID NO: 12500 - protein, 318 aa, Piromyces finnis
  PKS_AT
AFTGQGVAKVGMGKHFYQTQPVFRKAMDKCDEVTRRLLDVSIVEVLYNISNSPNGVEEGEKALKKSSVAQPALFAYEYAMSQLWISWGVEPSMVLGHSLGEIVATTIAGGIDFELAMEFIVQRASCMEKYGVKPGTMVSVFTTQDVVEEAIEEFGFENVSIAAINGTTQIVISGNTDEVKELEEYFTQQEIKAKQLNVTEAFHSALMDPAIEKLYEWINTKPDEKFRQPLKYGLISNVTGELIEAGERLPKNYWGEHARNAVQFVKAVETLLANSETLLNVIEVGPANVLTNMSSRILREKRIDKFATPFFVASAAPR

SEQ ID NO: 12501 - protein, 318 aa, Piromyces finnis; identical to SEQ ID NO: 12500
  PKS_AT

SEQ ID NO: 12502 - protein, 287 aa, Piromyces finnis
  PKS_AT
CCRNLYCNNKYFSDCIDYCDGIFKALSQRSLLQDYGLFTTEMMDNNKFKKFNSDLRKDPLVMIMFGGMVQLTLSALLKYYGLFPNAVIGYGAGEIVAAYVADKMDLKTTVKVLYHYGRVLSHAYSQENKVYTLTLICPISKIKQTIFTKLNQDEKDGISISGIPSPKFCLLSGDYNIMKKVSDIAKSENIAIYGAMQNNYGLHSMMINDKMKEDLVNSLKDIPLQTSDIAFFTTTKLNKDGKPYEGKLDGEYWWMNMRNPVLYAHALSQTVAFLPIDGKNIIEIGFG

SEQ ID NO: 12503 - protein, 467 aa, Piromyces finnis
  PKS_AT
VFTGQGAQEVGMGMDLYEKSPVAREIWDRADKHLMENYGFSIIDIVKNNPTEITIYFGNVKGQQIRKNYQQMTYEHVNNEGVVESLSLFPEIDDDSVSYTFRHIGGLLSATQFTQPSLVLMEKAAFEEMRSRGYIQQNSAFAGHSLGEYAALTAIGDVLSIETLVDVVFYRGMTMQRAVQRDSKGRSDYAMCAVNPVRVGSTFNESALQYLVASIKKVTNGLIEIVNYNVDNWQYVVSGDLISLQVLTLVLNYLKFEKIDLTVLLKTLSEEELQKQVNEIINNAYVKAKDQKKKHGFIKLERGAASIPLRGIDVPFHSSFLLRGVAPFRQYLMSKFDPKLIDVNRLIGNYIPNLTAEPFSLEKKFIENIYAKTNSTRIKNVLKGWTDDKYASPLLQQKLGYILLIELLAYQFASAVRWIETQDRLFVDIGVERLIEIGPGPTLSGMAQKTLKFKYEYYDDATSYRRE

SEQ ID NO: 12504 - protein, 467 aa, Piromyces finnis; identical to SEQ ID NO: 12503
  PKS_AT

SEQ ID NO: 12505 - protein, 467 aa, Piromyces finnis; identical to SEQ ID NO: 12503
  PKS_AT

SEQ ID NO: 12506 - protein, 467 aa, Piromyces finnis; identical to SEQ ID NO: 12503
  PKS_AT

SEQ ID NO: 12507 - protein, 300 aa, Piromyces finnis
  PKS_AT
TFSGQGTQYPEMGLQLYNMNPYFASIIDYCNSIHTQISKKDLLKETGLFGKGPVNEEKLLDPQYSFPAIGIIELALVELWKRYGVEPALVFGHSMGEVAAAYAAGILTIEDAILLLYNYGQISENVVDAGAKSGMLAIGCSSEEAQSIYLKGKDKVFIASINSPKDITLGGDLEQLNEIMAEARKNNVFSVMLKVKKAFHTSYIITAKDKFLQSIQGIGNRVKAPKIPFISSTYGREYQGPFDEEYWWTNIISPVNFSQATKIARSKIDKVLEIGSTPVLGIYMSNDFHQDNIFYTLSRK

SEQ ID NO: 12508 - protein, 300 aa, Piromyces finnis
  PKS_AT
AFSGQGSQFINMGRRMYQTNDLFKKVVDYCAAVLVTINGGEDIFEKYSIFKGDVAQISETDLSLPQFSVLAIGIAQIALIEVWKSMGVTPKAVYGHSMGEVAAAYAAGVLTIDDAVLLLYMRGHILAQLDGTGKGMLALGCSVENAQRFMANKPNVFISAVNSANSITLAGDLEQINAVAREAQAEKLFAVVLKVKQAFHSPYVEGAEKAFKESIRGIGERTKAPNCKFVSACFGQEYEGPFDENYWWANIRNPVSFHAAASIATQFSKRVLEIGAHPVLGMYLKEIYGKDNVYFSLSRK

SEQ ID NO: 12509 - protein, 229 aa, Piromyces finnis
  PKS_AT
CYLYRTQPVYAKALEECDKIITELSNFKILLVNLVICMGELIQPELLQEYKKQVDEDPCMAQFIALSMNYALIKLLEHLSISPNLVVGYKFGEITAALACGKISLRNAFLIIHYICKIIRKNIQLSDETITSDITQLMIIKDESKAFSSAKNNDYSYRMEHSQSFYSSIHQQVFSKGQNLNGDYWVKFVKSMISKEEDHNTSMINQYKKAIEKFNSDLCLFIHTSFMEG

SEQ ID NO: 12510 - protein, 326 aa, Neocallimastix californiae
  PKS_ER
ALNAKEKLQPYEYTPEPLADDQIEVKVTHNGLCHSDIHMKDNDWGNSSYPFIPGHEVIGNVVALGANAEKLSGLKVGDRVGYGWIRDSCGFCECCIEGQENLCEKGYEGTIVGHHGGFQDRIRMPAKFAFKIPEKLPSEYAAPLMCAGATVYNPLRLFIEKPNVKVGVIGIGGLGHLAVQFASKMGYEVTALSTSYNKKEEATGFGCHNFVLLKEAAEKVPNYFDLIINTSPYDMDWKMLLGLLRPNGKLCLIGIPAVDMKVPVMPIIFSQKTICGSIVAGRKFTNEMLEFAALNGVKPKIELMKLSQCNEAIEKVLANKARYRIV

SEQ ID NO: 12511 - protein, 339 aa, Neocallimastix californiae
  PKS_ER
GEPGWVEKEKPKCGPMDAICKPLAIAVCTSDVHTVWEGAIGDRHDMILGHECCAEVVEVGSEVKDFKPGDRVIVPAITPDWNSLEAQAGYSMHSHGMLAGWKFSNIKDGVFSEYFHVNDADGNLAHLPSSINTVDACMLSDMVPTGFHAVELADIQFGDVVLQIGIGPVGLMSVAGASLRGASRIICVGTRKVCQDVARKYGATDFISYKNGTIEEQVMKLTDGKGVDRVCIAGGTVKTFESAIKCLKPGGKIGNVNYLGSGEFVTIPRVEWGVGMGHKDIRGGLMPGGRLRMEKLASLVVAGRLDLSPLSTHVYNGWEEVPKALQIMKDKPADLIKPV

SEQ ID NO: 12512 - protein, 333 aa, Neocallimastix californiae
  PKS_ER
GMVKLDDMKIVKSVVPELGENDVLLKNLCCSVDPFMRGRMRKGVKSYVASFEEGKPMPVFSVTQVAKIGSAVTDINVGDKYMCFNGIEKYTVLPQQVIKGEGEKNLGSFNKIDPNNPLKDSFYLGLFGMPGMTAWAFFNKAGKPKEGETIFVTAAAGAVGQVVCQLAKLKGLRVVACASSPEKIGFLKQAIKVDEAFSYRDFPDKESFTAQLRKVCPNGIDIYYDNVGGYILDSALELMNIHGRVIMCGMISQYNLTEKYKYTLRDITSRRLTLQGCLFNDYFPQCMGEFMQDMIPKLQQGKLIYKEHIYKGVEKTPEAFLGLFNSENFGKVV

SEQ ID NO: 12513 - protein, 334 aa, Neocallimastix californiae
  PKS_ER
GQPKDVLSLKELKIPKIRDNEVLVKFLAAPINPSDINQIEGVYPIKPRFREYGAVGGNEGVAEVVAAGSKVKNLTIGDWVIPDSKAFGTWQTFAASSENELQKISKNGISKISAATISVNPPTAYRMLKDFVNLKKGDVVIQNGANSAVGQSVIQIAKAWGIKTINVIRDRPNFEEVAGELHKLGATLVIKEEDLRSNSTRELVKNLGSPVRLALNCVGGKSASGITRLLGQNATIVTYGGMSKQPLTFGTGPFIFKNLRASGFWISRWNKEASKKDKQYMFDDICELVRGGHLAEPWHEETKWETSDDNKTLNKKFMTALGKAGASFGNKKQI

SEQ ID NO: 12514 - protein, 328 aa, Neocallimastix californiae
  PKS_ER
NQFSNFGVSLVERRALRDDDVEIDIKYCGICHSDIMIVQINQPGKGVVPGHEITGVVKSVGKAVTNFKVGDHVGVGCFVNSCSNCEYCKRGDEQFCDKGVVVVFNSKDYDGAITYGGYTQTIIVKDKFVLHIPDSLDLAVASPLLCAGITTYSPLKRYNIGKGSRVAIMGLGGLGHLGVQFAHAMGAEVTVLGHSESKKEEAKKLGADCYEILKTDEDFKKYYRTFDFILNCATANLNLDNHFKLLKPNGVLCFVSIVPEEQRFSELNLFGNQASITVSNVGGIGITQEMLNFSAEKGIKPMIEMIKVKDIPEAYQKIIDCKVHYRYV

SEQ ID NO: 12515 - protein, 317 aa, Neocallimastix californiae
  PKS_ER
GQIGQMKYSECIGLPAYTDDEVVIKVKGVSMQFKDIMTAMDALIGFDSYEPGMECIGRVVAIGKNVASNPRNQLQIGDPVIAFSHKYGHLLRTYGVVDPLSLQKIPESMYKVEYAGIFIVFITAYYSLHVRAGGIKPGQTILIHAAAGGVGQAAVKLCQLWGANIIASASASKQQFLRDTYGLEHVTNSRDPEEFYRDVMKWTDGKGVDFVLNSLSGKSLKMGIKCLKNGGKFVEIGKTDILNDSKLGLHCLLNNISFVSSHIDLLNNQQMNYYKNILFEMFSTGKLTPIPAKIFPGNKYKEAFFYLASGRNIGKTC

SEQ ID NO: 12516 - protein, 315 aa, Neocallimastix californiae
  PKS_ER
GQIGKLKFREVFGLPECGPDEVIIKIHSVALQFKDIMSVMNNLPGYNVYEPGMESNGYVVKIGENAKKHIQLQIGQPVFAFTHKYGHMVSTYGKAHYKLVKPMNTNDMNPESYSSVIVLGTVLYALRDRAGGVKRGQSILIHSGAGGVGQAAIKLCQYWGAKIFVSTSAKKVQYLKDMYGLEYITNSRDSKTFYNDIMKWTNNEGVDFVLNALAGDGITYGLKCLKKGGHFVEIGKKNIIFNTPLGLKSLMNNINFCSAHIDLLDVDKLSSLMNESFELLNSGKITPIPVTLVPIKQYLSAFFNMASGNNVGKTC

SEQ ID NO: 12517 - protein, 311 aa, Neocallimastix californiae
  PKS_ER
GSNSSSSSSNGSGSSGRERDKECVIVKVKTISLQNNDVLQNSYPELAEIMKGSSVIECVGTIVNVGSKVKKFKRGDFVFGISFYGDYVPSTYVKIPQDLVFAVDRKDTLKQQQLISSVYAYTVALYLLNEIQANESVLLTTNAVDLMQALVVIAQQKQISIVLDDRSKKYSRSPNPIFSNLFKSQRMIHSDGDRNQCVQQVKAFTNNQGVHYVIDANVKFDHEEVLEACLREGGEYIKVGNLDHHVKKRTTHKVVQMSALSVKQMAPLVREAIEKINKCTVEAIELKSYPLTKMNNATIEIISGRSQGKSC

SEQ ID NO: 12518 - protein, 322 aa, Neocallimastix californiae
  PKS_ER
SQFSNFGVSLVERRALRDDDVEIDIKYCGICHSDIMIVQNNQPGNGIVPGHEIAGVVKSVGKAVTNFKVGDHVGIGCFVNSCSNCEYCKRGDEQFCDKGVVIVFNSKDYDGAITYGGYTQTIIVRDKFVLHIPESLDLAMASPLLCAGVTTYSPLKRYNIGKGSRVAIMGLGGLGHLGVQFAHAMGAEVTVLGHSESKKEEAKKLGADCYEILKTDEDFKKYYRTFDFILNCATANLSLDNHIKLLKPNGVLCFVSIVPEEQKFTEMNLFGNQATITVSNVGGIDITQEMLNFSAEKGIKPMIEMIKVKDIPEAYQKIIDCK

SEQ ID NO: 12519 - protein, 315 aa, Neocallimastix californiae
  PKS_ER
GHINRMMFHKEYGIPELKKSSEKDNESVVVKVRMISLQNNDVLHNSYPELADIMKCSNVVECVGTIVNVGSRVKNFKRGDFVFGISFYADYVPSSYVKIPQDLVVVINEKDSQKQQRLISSVYAYTVALYLLNDIKEDESILFSTGANDLMQALVTVAKQKRIPILLDDVSQKYSRSGNPIFTNLLKDQRIVNSGDHDQCLHHVKQLTNGHGVHYVIDANVKSDRENVLKECLSHKGEYIRVGHFSQNVIKKSISNRVIQMNALSTKEISPIVRKAIEMINDYSVEAIELKTYPLSQMNRAILEIISGRSQGKSC

SEQ ID NO: 12520 - protein, 334 aa, Anaeromyces robustus
  PKS_ER
GQPKDVLSLKELKISKIKDNEVLVKFLASPINPSDINQIEGVYPIKPRFKEFGAVGGNEGVAEVIAAGPKVKNLVVGDWVIPDTKAFGTWQTFAASPENEFQKINKNGISKISAATISVNPPTAYRMLKDFVNLKKGDVVIQNGANSAVGQSVIQIAKAWGIKTINVVRDRPNFDEFAAELHKLGATLVIKEEDLRANSTRELVKNLGNPVRLALNCVGGKSASGITRLLGNNATIVTYGGMSKQPLTFGTGPFIFKNLRACGFWVSRWNKEASKKDKQYMFDDICELIRGGHLAEPWHEETKWETSDDNKTLNKKFKSALSKAGASFGNRKQI

SEQ ID NO: 12521 - protein, 331 aa, Anaeromyces robustus
  PKS_ER
VTVDNMKVVKSPVPELGENDVLLKNLCCSIDPFMRGRMRENVKSYVPSFEKGKVMQVFSVTQVEKIGSAVTDINVGDKYMCFNGIEKYTVLPQQVIKGDGKQSLGSFTKIDQRNPIKDSFYLGLFGMPGMTAWAFFNKVGKPKEGETIFITAATGAVGQVVCQLAKLKGLRVVACASSPEKIGFLKQALKVDEAFSYRDFPDKKSFTEQLRKVCPNGIDIYYDNVGGYILDSALEVMNIHGRVIMCGMISQYNLKDKYQYTLRDITSRRLTLQGCLFNDFFPQCMGEFMQDMIPKLEKGQIIYKEDIYEGVEKAPEAFIGLFNSNNFGKVV

SEQ ID NO: 12522 - protein, 315 aa, Anaeromyces robustus
  PKS_ER
GQIGKLKFREVFGLPECSPDEVVIKIHSVALQFKDVMSVMNNLPGYNVYEPGMESNGYVVKIGENAKKHINLKIGQPVFAFTHKYGHMVSTYGKAHYKLVKPMMNNDMNPENYSSVIVLGTVLYALRDRAGGVKPGQSILIQSAAGGVGQAAIKLCKYWGAKIYVSTSTKKREYLKNLYGLEYITDSRNPKIFYEDIMKWTNNEGVDFVLNALAGDGITYGLKCLKKGGCFVEIGKKNIILNTPLGLKSLMNNINFCSAHIDLLDVDKLSSLMNESFEFINTGKITPIPVTLVPVKKYLSAFFNMASGNNVGKTC

SEQ ID NO: 12523 - protein, 244 aa, Piromyces finnis
  PKS_ER
KPKDVLRLKELTIPKIKDDEVLVKFLAAPINPSDINQIEGVYPIKPRFKKYGAVGGNEGVAEVVAAGNKVKNLTVGDWVIPDTKAFGTWQTFAASPENELQKISKNISKISASTISVNPPTAYRMLKDFVNLKKGDVIIQNGANSAVGQAVIQIAKAWGIKTINVVRDRPNFDELADQLHKLGATLVIKEEDLRANSTRELVKNLGSPVRLGLNCVGGKSANGITRLLGHNASLVTYGGMSKQP

SEQ ID NO: 12524 - protein, 315 aa, Piromyces finnis
  PKS_ER
GQIGKLKFREVFGLPECGPDEIIIKIQSVALQFKDIMSVMNNLPGYNVYEPGMESNGYVVKIGENAKKHVNFKIGQPVFAFTHKYGHMVSTYGKAHYKLVKPMINNDMNPENYSSVVVMGTVLYAIRDRAGGIKPGQSILIQSAAGGVGQAAIKLCQYWGAKVYVSTSARKRKYLEDLYGLEHITDSRNPKTFYEDIMKWTNNEGVDFVLNALAGDGITYGLKCLKKGGRFIEIGKKNIIINTPLGLKSLMNNINFCSAHIDLLDVDKLSSLMNESFKLINTGKITPIPVTQVPIKKYLSAFFNLASGNNVGKTC

SEQ ID NO: 12525 - protein, 311 aa, Piromyces finnis
  PKS_ER
GNINKTIFRKTYGIPDLSKHEMDKESVVVKVSTISLQNNDILQNSLPDLSSLMKDSSVAECIGTIVHTGSNVKNFKKGDVVFGLNLQANDIPSTYVKIHQDLVFPVNTMDMDKQNNLLSSVYAYTVAIYLLNEIPTGESVLISTDASDLMQALATIAQQKGINLFIDDTSSKYSKANSNAFKNIKAQMINTRQASEYVRLVKQHTNGEGVGVIIDINVKFDKENTLEKCLRIDGEYIKVGNIDQSTKKRTTHKIVQMSHFKDNVITPVVRQAVEMIIHGKVEAIDLKTYPVSKINSATLEILSGRLQGKSC

SEQ ID NO: 12526 - protein, 317 aa, Piromyces finnis
  PKS_ER
GQIGQMKFTECIGLPKYNDDQIVIKTKGVSMQFKDIMTAMDTLVGFDDYEPGMECIGRVVAIGKNVASDPKNVLQIGDPVVAFAHKYGHLLRTYGVADPLSVQKIPESMYKVEYAGIFIVFITAYYSLHVRAGGIKPGQTILIHAAAGGVGQAAVKLCQLWGANIIASASASKQQFLRDTYGIEHVTNSRDPEQFYSDVMKWTNGKGVDFVLNSLSGKSLRMGIKCLKNGGKFVEIGKTDILNDSQLGLHCLLNNISFISSHIDLLNNQQMSFYKNIIFDMFKTGKLTPIPAKIFSANKYKEAFFYLASGRNVGKTC

SEQ ID NO: 12527 - protein, 187 aa, Neocallimastix californiae
  PKS_KR
GTILITGGLGGVGFDISRYLMRQPNLKALVLTGRRPETDEKVAGKLAELRALNPKIKITYVTANVGSETEMKKVIDDINAGSPEEALVGVFHTAGTNDDGLIFNQSYERFAKLINSKIEGTLCIAKLTNDLNLKFTILFSSMTAFFGNRGQINYCTANMFINKVCDYYRNHGRKDILSLELAGWPSG

SEQ ID NO: 12528 - protein, 189 aa, Neocallimastix californiae
  PKS_KR
KVVIITGAGGGLGRAYAKHFAKLGASVVVNDLGVLLRGRGANTQVADSVVEEIKQMGGIAVPSYDSVEEGEKIVETAIKNFGRVDIIINNAGILRDRSFGRMTDTDWMMTYRVHLKGTYKVTRAAWPYMMKQKYGRIINITSAAGLFGNFGQSNYAAAKSGVIGLTNALALEGKEYNITVNSVAPNAGT

SEQ ID NO: 12529 - protein, 189 aa, Neocallimastix californiae
  PKS_KR
RVVIVTGAGGGLGRAYAKHFAKLGASVVVNDLGVLLRGRGANTQVADGVVEEIKKMGGIAVPSYDSVEEGEKIVETAIKNFGRVDIIINNAGILRDRSFARMTDTDWMMTYRVHLKGTYKVTRAAWPYMMKQKYGRIINITSAAGLFGNFGQSNYAAAKSGVIGLTNALALEGKEHNITINSVAPNAGT

SEQ ID NO: 12530 - protein, 193 aa, Neocallimastix californiae
  PKS_KR
GNILITGGLGDVSMDVVNSLLADKDSKLEHIFLLGRSSKTNSRVIEKLARIEKVRKDHDKNIQIEYYSCDISDESSLAEVFNDIRKRQGLQITGIFHTAGVNSDANFLSQSYEKLVEIAPSKIIGTHNIMKLSEEFKDELKFVVFVSSLSAVSGNGGQTNYTAANMFIDALARYYNDHGRTNVIAIELGGWKG

SEQ ID NO: 12531 - protein, 179 aa, Neocallimastix californiae
  PKS_KR
LTYLITGAFGGVGLRVVLWLVSRGAKNILLTTSSSVEKQYEQPIIRSLLEKGINVMIKTCDITDLTSVQQLFQQTTPRIAGVFHLANRFAPGLISTSDLALLRKGFSAKAEGAWNLHLVTLQKAHQVQLFVVFSSILDVLGNRGQTAYGAANAFLSSIVDHRREKGLSGNCIALPAMRG

SEQ ID NO: 12532 - protein, 177 aa, Neocallimastix californiae
  PKS_KR
KAYLITGAFGGVGLRVAEWLQLRGAKNIVLTTSGNIEKRNRNPIVETLRSKGVHVTVTQCDISNIHAVRKLFQETTPQIAGIFHLANKFAPGLIQRTSLEQFHVAYNPKARGALNLHLVSKDYPIDMFVMFSSVLDLLGNKGQAAYGAANSFLGSLVELRRSQGLCGSCLSLPAMKG

SEQ ID NO: 12533 - protein, 178 aa, Neocallimastix californiae
  PKS_KR
KSYLVTGAFGGVGLRVCLWMQLRGAHHLVLTTSSNPESKKDHPIVKALRQRGAQVSIVKCDISKYDEVEKLFKETSPSLDGVFHFANKFGPKLIRDSGLESFIATYEPKARGALNLHKISQKGYPLSTFVLFSSVLDLLGNTGQIAYGGANAFLGNLVYYRRRQGLSGQCFSLPAMKG

SEQ ID NO: 12534 - protein, 188 aa, Neocallimastix californiae
  PKS_KR
GTVLITGGTGGVGFDICRYLVKQANLKGLVLTGRRPETDEKVAGRLAEIRALNPKIKITYVTANVGSEQEMKKVFDDINSGSPEEALVGVIHTAGTNDDGLIFNQSYERFAKLINSKIEGALCIAKLTEGLNLKFTILFSSMTAFFGNRGQINYCTANMFLNKVCQFYRSHNGRKDIMSLELAAWPSG

SEQ ID NO: 12535 - protein, 178 aa, Neocallimastix californiae
  PKS_KR
KSYLVTGAFGGVGLRVCLWMQLRGAHHLVLTTSSNPEMKYHHPIVNALRQRGAEVTIVKCDISKYNEVEKLFKETTPVIDGVFHFANKFGPKLIRDSNLSGFISTYEPKARGALNLHKVSQQGYPLSNFVLFSSVLDLLGNTGQIAYGGANSFLGNLVYYRRSKGLSGQCFSLPAMKG

SEQ ID NO: 12536 - protein, 189 aa, Anaeromyces robustus
  PKS_KR
RVVIVTGAGGGLGRAYAKHFAKLGASVVVNDLGVLLRGRGANTQVADSVVEEIKKMGGIAVPSYDSVEEGEKIVETAIKNFGRVDVIINNAGILRDRSFARITDTDWMMTYKVHLKGTYKVTKAAWPYMIKQKYGRIINITSAAGLFGNFGQSNYAAAKSGVIGFTNALALEGKEHNITINSVAPNAGT

SEQ ID NO: 12537 - protein, 193 aa, Anaeromyces robustus
  PKS_KR
GNLLITGGLGDISIDIMKYFFSLDHCKLDHIFLIGRSSKSSAKVNDKLARLDKSMKDNGKNIDIQYYPCDISNEAALAEVFNDIRKRQGLQINGILHTAGTNSDASFINQTYDKLVEIAPAKIHGTHNIIKLTEEFNDEIKYIVLFSSITALSGFSGQTNYTAVNLFIDNIAKYCKNHGRDNVMSIELTIWEN

SEQ ID NO: 12538 - protein, 185 aa, Anaeromyces robustus
  PKS_KR
GTILITGGLGGVGYDVSKYLITKPNLKALVLTGRRPETDEKVAAKLNDLRSASKNVKIIYAVANVNSEEEMKKLFDDIAASENPLTGIIHTAGTNDDGLIFNQSYERFMKLVPGKVEGPLIITKLTKDIPNLKFTILLSSMSSFFGNRGQINYTTSNVFINKLCRYYRAHGRKDMVALQLAAWPS

SEQ ID NO: 12539 - protein, 177 aa, Anaeromyces robustus
  PKS_KR
KSYLITGAFGGVGLRVALWLQLRGAKNIILTTSGNAEKRNKNPIVEGLRNKGVNVLVRQCDISDINAVRKLFQEANPPIAGIFHLANKFAPGLIERTSLEQFHVAYNPKARGALNLHLVSKNYPVDMFVMFSSVLDLLGNKGQAAYGAANSFLGSLVELRRSQGLCGSCLSLPAMKG

SEQ ID NO: 12540 - protein, 185 aa, Piromyces finnis
  PKS_KR
GTILITGGLGGVGYDISRFLMKQPNLKGLVLTGRRPETDEKVAAKLSSIREVNKAIKVTYITVNVGSQTEMKEVISGIKASGSKLTGIIHTAGVNDDGLIFNQSYERFAKLINSKIEGSHCIAKITEGMNLEFILLFSSMTSFFGNRGQINYCVANMFVNKIAHYYRSHGRKDIITLQLAVWPSG

SEQ ID NO: 12541 - protein, 177 aa, Piromyces finnis
  PKS_KR
KSYIITGAFGGVGLRVALWLQLRGAKNIVLTTSGNAAKRNKNPIVEGLRSKGVNVTVCQCDISNINAVRKLFQETTPQVGGIFHLANKFLPGLIPRTSLEQFHIAYDPKAKGALNLHLVSKDYPIDMFVLFSSVLDLLGNKGQAAYGAANSFLGSLVEFRRSKGLCGSCISLPAMKG

SEQ ID NO: 12542 - protein, 193 aa, Piromyces finnis
  PKS_KR
GNLLITGGLGDVSMDVIENLLSDKETKLDHIFLLGRSSKTSTKVEDKLDRIEKIKKANNKKTEVEYYCCDISNGDSLNDVFNDIRKRQGLQINGIFHTAGTNDDTLFLTQTYEKFEKLAPAKVIGTHNIIKYTEDFKDELKFIILTSSLTALSGLTGQTNYTAANMFIDAIARYCRNHGRNNVMSLELCGWSG

SEQ ID NO: 12543 - protein, 178 aa, Piromyces finnis
  PKS_KR
KSYLITGAFGGIGLKVGLWMQLRGARHIVLTTSSDPESKYKHPIVNALRQKGVHVTITKCDISKYDEVEKLFMETTPAIDGVFHFANKFGPKLIRDSSLDSFNTAFEPKARGALNLHKISQKGFSLSSFVLFSSVLDILGNSGQMAYGAANSYLNNLIYYRRRKGLSGQCFSLPAMKG

SEQ ID NO: 12544 - protein, 179 aa, Piromyces finnis
  PKS_KR
LTYLVTGAFGGVGLRVVLWLVSRGAKNLLLTTSGSVEKQYEQPIIRSLIEKGVNVMIKTCDITDYNNVQQLFQQTQPRVAGVFHLANRFAPGLISTSDLALLRKGFNAKAEGAWNLHKVTAQKQHQVQLFVVFSSILDVLGNRGQTAYGAANAFLSSIIDHRRENGLSGNCIALPAMRG

SEQ ID NO: 12545 - protein, 185 aa, Piromyces finnis
  PKS_KR
RVVIVTGAGGGLGRAYAKHFAKLGASVVVNDLGVLLRGRGANTQVADSVVEEIKSMGGIAVPSYDSVEEGEKIVETAIKNFGRVDVIINNAGILRDRSFARMTDTDWMMTYKVHLKGCYKVTKAAWPYMVKQKYGRIINITSAAGLFGNFGQSNYAAAKAGVIGLTNTLALEGKEHNITVNSIAP

SEQ ID NO: 12546 - protein, 437 aa, Neocallimastix californiae
  PKS_KS
VAVVGIALRLPGGINTVDKYWKSLENGRFCVSPTGTNRHLHHNMTHNEELKPGEHYIFNYCRYDSTPDAAPITDFDPMFFNMNPNEATVLDPKFRWVLETTYEVLQDAGINPDSLSGTHTNIYTAPGQVDEMNAYATNASPTGYSVLNGMSMHSCASASLPGRISFMYNLFGAAHTVDTACSSGLVAIHDAFKDLNIGETDLAIVNAAHCPFQSSSFSLLSIAKMVSRNCRCASYDEAADGYVPGEGCVSVILKRKDDAIRDHNKIYGLINATAVGQSGSRASMSTPTVLGQKYIHKKVLEKANLTPGDIDYMEGHGTGTKLGDRIEAEAINEVFKGTHSESRPLTLASVKTNIGHTEEVSGLASLVKVLLAMKHKTVPPHLHFNKPSPLIDFDSVPLHIPTQKEEWKPAEGKKRVALVSSYGLSGSVCDAIVEEYI

SEQ ID NO: 12547 - protein, 438 aa, Neocallimastix californiae
  PKS_KS
IAVVGMGLRLPGGINTPSKYWNALVNGKDCISPTPANRHLHQYLRPFCPPNELGPFDHYIHRAGYYDVTPDAAPISDFDPTFFNISPLEAKFTEPKFRWIYETVYEAFQDACINVSELNGTRTSVFTTVGSTADYIALTKAFTKVESMTSQTMHGSAASSCAGRISFNYGFIGPSDTIDTACSSGLNDCHNACKSLSMGDSDVAVVSAVHQQFVSTQFHVISVAHMASQIGRCATFDAEADGYAPGEGCISIILKRLDDAVTDHDHIYGVITGITTSQSGIRPSISSPAVGPQVENIQKALQIANVSPADVDYVEAHGTGTQVGDAIETETLNIAFGGTHNAKKPLIVGSVKTNIGHTEEVSGLAGLCKVLLSMSHRTIPPHLHLKNLNPRIDTSVIPMTIPQKKCIWKSPRGKKRVGVVSSFGLQGSVANAVIEEFK

SEQ ID NO: 12548 - protein, 427 aa, Neocallimastix californiae
  PKS_KS
FAIIGIGCHFPEGIESKEAFWKMLEDARCITKDIPKDRWDKNEWYSKEPIQGTIQTKRGAFLKNPYLFDNKYFYISMPEAKEMSPEQRWLLELTVETLEDANIKPEAVRGSRTGVFIGSSGCDYLATQISHANDINSHSPTGFELSILANRLSYVFDLQGPSISCNTACSSAFSALNIGLNAMITDDCEMALVAGSNFMNCPGGFVAFSQLRVVSPDGSCKPFDEKANGYARLEGAGMVLIKPYEKAVRDGDKIYCAIVGCGSNEDGRSPSLTMPSYEAQYKLLSHVCEKSGILPSEIDYVEAHGTGTKVGDPIESHAIGDAYGRSKGVRGPNDPPVLVSSVKGNTGHGENSSGIVSIIKTSLMLHKRKLVPTVAYHHMNPAIDAEKLGIKVCETLEDWKTPHTLHAAVNSFGFGGANTNTILEEVK

SEQ ID NO: 12549 - protein, 421 aa, Neocallimastix californiae
  PKS_KS
IAIIGMAFRLPGAISNSKSLWMALAKSRDCILPPVKTRDLHHGYVNKPANQLGPKEHYLARVGCYDVRPNVAKPSEFDADFFNCSPEEATALDPRHRWILETSWEALENAGIVPSSLKNTITGVFVGMNNDHEHEDLLKKCGKVPPLAAHATAQSSIAGRLSYFYELFGPSYTIDTACSTGSSALHSACQSMQCGDCDLSIVSGVKYMYSSDEFHKTCAARMTSPNSRCATFDASADGFAQSEGCVTFVLKRLEDAIRDKDNILSVILGSSSGQSGLRQSISAPSSEGQRITIQRAMKVAGITPDQVSYVEAHGTGTPLGDAIEVHALNQVYAGSHTEENPLVVGSIKSNIGHTCEAAGLAGIAKVIVAMKHNTIPKNIHFNELNPEIDLSVIPMKIPTKNLPWNSSEEGKPLIAQVSSFG

SEQ ID NO: 12550 - protein, 442 aa, Neocallimastix californiae
  PKS_KS
YAVIGVGCRFPGNIKSKEDFWEMLTSGRCLTSEIPNDRWNTAEWYNKEPKRGTMQTTRGAFMEDAFYFDNKYFSISQNEAKEMSPEQRWLMELAVETFEDANINPKKLKGSRTGVFVGSSGMDFVSAQISHANDLTQHSATGLELSILANRISYFFDLNGPSICTNTACSASMTALNLAINSMITDDCDAALVAGTNLLFTPGSYVAYSQLRVVSTDGSCKPFDKNADGYSRIEGAGMILIKPYEKAVKDGDKIYCAILGSGTNEDGHTPSLTMPSYSSQCKLLTHVCEKFDIDPASIDYVEAHGTGTAVGDPIEARSIGYAYGRRVREGKQIKTTRPGETEEILDQPTFPLLIGSSKGNTGHGEYSSGIIGMIKAILMLYHRTMVPTIAHKEMNPAIDAEGLGIKVATKLEPWTTPHTLRIAVNSFGFGGSNGNAIFEEVV

SEQ ID NO: 12551 - protein, 421 aa, Neocallimastix californiae
  PKS_KS
IAIIGMALRLPGTINNSKSLWMSLAKGRDCVLPPVKTRDLHHGYVNKSFNELGPDEHYLPRIGCYDTRSNAAKPSEFDASFFNCTAEEAISLDPRHRWILETSWEALENAGIAPNSLENTLTGVYVGINNEHEHEDLLKECGIVPPVASHTLNQSSIAGRLSYFYKLFGPSFTIDTACSTGSSALHTACRAMQYGECDLSIVTGVKYMYSSKEFHKTCSAHMTSPNGRCATFDESADGFAQSEGCVTFILKRLDDAIRDNDNILTVILSSVSGQSGFRQSISAPSYEGQAINIERAMKIAGIKPEQVSYVEAHGTGTPLGDAIEIHALNKVYGGSHTEENPLIVGSIKSNIGHTCEAAGLAGIAKVIVSMKHNLIPKNIHFNKLNPEIDISAIPMKIPTKHIPWTSPNEDEPLIAQVSSFG

SEQ ID NO: 12552 - protein, 430 aa, Neocallimastix californiae
  PKS_KS
IAIIGVGCRLPGDILTKDDFWNMLVTKRVVTTEIPADRWDRDEWYSDEPIPGTIQTKHGGFLTNAYDFDNKYFSISQAEALEITPEQRWLCELAVETMEDANIRPEELKGSQTGVFVGSAGIDFGGNQLVNTLQMSAHTMTGLEPSIFSNRISYIFDLHGPSITSNTACSASMSSLSMACNAIAVGDCDKAFVAGSNFLPSPGGYVAFSQLRVVSKTGSCKPFDEKADGYARLEGACMLLIKDYEKAVRDNDKIYACIIGSGTNEDGRTLSITMPSSDAQCTLMKWVCEKSNIKADTIDYVEAHGTGTPTGDPIEARSIGNAFGKAVRAPGSKPLPVGTVKGNVGHGEFLSGAIGLLKTSLMLFNKQLVPTAAFEKLNPKIDVSGLGIRVADKNEPMVKLNGKENTPLRAAVNSFGFGGANANAILESVE

SEQ ID NO: 12553 - protein, 433 aa, Neocallimastix californiae
  PKS_KS
VAVIGMALRLPGAINNSKSFWMSLAKGRDCVLAPVKDRKLHLGYVDKPSNLLGENEHNIPKCGCYDSRSNAAKPSEFDAEFFNCLPEEVNSMDPRQRWVLETSWEAFENAGIAPNTLENTTTGVFVGVNDDHDYQDLLKENGIAQPISAHSTPSGIAGRLSYFYKLFGPSFTIDTACSTGASALHSACRSLQFGDCDLSVVSGVKYLYSASEFHRTSVARMTSPHGRCATFDKDADGFAPGEGCVTFILKRLEDAVRDGDNILSVILGTSSGQSGLRQSISAPSSDGQVLNLKRALKFAGVDPSEVSFVEAHGTGTPLGDAIEVDALNQVYGGSHTEENPLVIGSVKTNIGHTNEAAGLAGMAKVILAMQHKYIPKNLHFNTLNPEIDIHSIPIQIATKTMPWETQDNKPRIAQVSSFGLQGSIVHIILQEYI

SEQ ID NO: 12554 - protein, 425 aa, Neocallimastix californiae
  PKS_KS
FAIIGTGIRLPGEINNKDDFWKVMTDKKVITGLIPEDRWDREEWYSKVEKPGTIQTLHGGFIENAFDFDNKYFGISQNEALDATPEQRWLCELTVETVEDANMDMDDFKGSHTGVFVGTSGMDYGSYVFSVPEKITKYTYSGIEPSIHANRVSYLFNLHGPSLSTNTACSSSMTALSIACNSMAAGDCEMALVAGTNFFQAPANGVAYSQLRVVSKKGACRPFDIGADGYARLEGAAMVLLKPYEKAIKDNNRIYATILSTACNEDGKTSSLTTPSSEAQCQLMKRVYSKGHIDPCTIDFVEAHGTGTSVGDPIEARSIGEAYGKVNKANGHPLLPVGSVKGNVGHGEYLSGIVGLIKGALILHKNTIVPQTAFETLNPKIHCDELGIRIADKVEPLPGKGRHRAAVNSFGFGGANANVILEEEP

SEQ ID NO: 12555 - protein, 434 aa, Neocallimastix californiae
  PKS_KS
IAIIGMGLRLPGAINNEKTLWSALVKGRDCVSNIPKDRKLHESYVNKPSNELNPGEHNVKKCGYYDSRTSGEKVSQFDAEFFNCLPEEAIGLDPKHRWILETSWEALENAGISPDSLEDSNTGVFVGIGDQQDHAQFMKECHRKKVVSYHNSNPSAIAGRLSYFYKLYGPSVTVDTACSTGATALHTACRSMIYGDCRLAMVTASKYLFYPEEFEMTSKARMTSPNGRCATFDKDADGYAPAEGCVTFILKCLEDAERDKDHILGVILGTSSGQSGFRQSISVPSFEGQARNIKRVMEIAGVNPSDISYVETHGTGTPYGDAIEIQGINQVYAGSHTPEHPLVIGSIKTNIGHTAETSGLAGIAKVLVAMKNKTIPRHLHFKTLNPEIDLKSVPLAIPTHNMKWETEEGKPRTALVSSYGLQGSAVNIILQEYI

SEQ ID NO: 12556 - protein, 435 aa, Neocallimastix californiae
  PKS_KS
IAIIGMGLRLPGAINSAKSLWLALAKGKDCVLPPIKTRDLHRNYVNKPSDQLDPTEHNIPRLGLYDTRNSVAKPSQFDAKFFNCLPDEALALDPRHRWILETSWEALENAGIPPNSLENSSTGVFVGINDDHEYSDLLTECGVKSPIAAHGQSPSGIAGRLSYFYRLYGPSFTMDTACSTGASALHTACRSLQCGDCDLSIVSGVKFMYSSKDFYMTCSARMTSPHGRCATFDKDADGFVPGEGCVTFILKRLEDAVRDNDHILSVVLSTSSGQSGLRQSISAPSSEGQAINMRKAMKFAGIKPEDVSYVEAHGTGTPLGDALEVHALNEIYGGSHTEENPLVVGSIKTNIGHTCETAGLAGIAKVIVSMQHKHIPRNLHFNTLNPEIDIKSIPIQIPTKTLPWNSTEPNKPLIAQVSSYGLQGSIVHVFLQEYI

SEQ ID NO: 12557 - protein, 437 aa, Neocallimastix californiae
  PKS_KS
VAVVGIALRLPGGINTVDKYWKSLESGRFCISPTGTNRLLHHNLTHNEHLNPGEHYIFNYCRYDSTSDVSPITDFDPLFFNMNPSEATVLDPKFRWVLETTYEAFQDAGINPDTLSGTRTNVYTAPGQVDEMNTYTIDASPTGYSILNGMSMHSCAAASLPGRISFMYNLYGAAHTVDTACSSGLVATHDAFKDLNIGETDLAIVNAAHCPFQSSGFSLLSVAKMVSRNCRCAAYDEAADGYVPGEGCVSIILKRKDDAIRDHNKIYGLINATAVGQSGSRASMSTPSAIGQKIIHEEVLKNANLTPKDIDYMEGHGTGTKLGDRIEGEAINEVFKGSHSESRPLTLASVKTNIGHTEEVSGLASLVKVLLAMKYKTIPPHLHFHKPSSSIDFDSVPLHIPTQKEEWKAHDGKNRIALVSSYGLSGSVCDAVVEEYV

SEQ ID NO: 12558 - protein, 448 aa, Neocallimastix californiae
  PKS_KS
IAIVGIGLRLPGGINSTKKFWFSLIKGKNCLSATPTDRELHLGMVDMSKKPPEYRLNKNEHYVCRYGIYDSHYASSGVKYTDFDANFFDCSTEEAISMDVKQRWMLETSWEALEDAGIDPSSIENSDTGVFIGMNNCYHQTKLLSSKKATNISSSFNPTTLHCTDLSSVAGRISYFYKIYGPAISMDTACSTGATALHTAYRSMQYGECDLAIVSGARFLYYNDEFINTSHAKMASPNGRCATFDEDADGFAPAEGCVTLILKRLDRAEENNDNIYGILLGSSNGQSGGRQSISVPSSEAQVRNIKNALKDAHVSPKDISFVEAHGTGTPYGDAIEIHALNQIFKDSHSKKSPLYIGSVKTNIGHTCEAAGLAGIVKVLLSMKHNVIPKHINFKKLNPEIDLSMVPFCIPSQKNIRWTSPDPSKPLIAEVSSYGLQGSITNVILQQYL

SEQ ID NO: 12559 - protein, 448 aa, Neocallimastix californiae; identical to SEQ ID NO: 12558
  PKS_KS

SEQ ID NO: 12560 - protein, 448 aa, Neocallimastix californiae
  PKS_KS
IAIVGIGLRLPGGINSTKKFWHSLLQGKNCLSTTPVDRQLHLGMIDMAKQQPGYKLNKNEHYIHKYGYYDSIHTASIAKPTKFDANFFECTNEEAIGMDVKQRWMLETSWEALEDAGIDPSTLENSNTGVFIGMNNSNHHIKLLSSEKATNVGPNFSSVTLHGTDLSSAAGRISYFYKLYGPAISIDTACSTGATALHTAYRSMQYGDCDLAIVSGARFLYYNDEFINISHAKMTSPKGRCATFDESADGFAPAEGCVTLILKRLDDAEESNDDIYGILLGSSNGQSGGRQSISVPSSEAQVRNIRNALMDAQISPKDISYIEAHGTGTPYGDALEIHALNQVFGESHTKNSPLYIGSVKTNIGHTCEAAGLAGIVKVLLSMKHQIIPKHINFKKLNPEIDLETIPLCIPSQKNIHWTSSDPSKPLIAQISSYGLQGSVTNIILQQYL

SEQ ID NO: 12561 - protein, 234 aa, Neocallimastix californiae
  PKS_KS
WEALENAGIAPNSLENTLTGVYVGINNEHEHEDLLKKCGIVPPLGSHTLNQSSIAGRLSYFYKLFGPSFTIDTACSTGSSALHIACNAMKRGECDLSIVTGVKYMYSSKEFHKTCSAHMTSPKGRCATFDASADGFAQSEGCVTFVLKRLDDAIRDKDNILTVILGSVSGQSGLRQSISAPSYEGQALNIERAMKIAGISPDQVSYVEAHGTGTPLGDAIEIHALNEVYAGSHS

SEQ ID NO: 12562 - protein, 433 aa, Anaeromyces robustus
  PKS_KS
IAIIGMALRLPGAINNAKSFWMALAKGKDCISTPVKDRKLHLGYVNKPSHLLNENEHNIPRCGCYDSRSNVAKPSEFDAEFFNCLPEEAMALDPRHRWILETSWEALENSGIAPNSLENTITGVFLGINDSHDYHDLMKENGITPPIAAHSTPSGIVGRLSYFYKLFGPSFTIDTACSTGASALHSACRSLQFGDCDLSIVSGVKYLYTSNDFHRTSIARMTSPKGRCATFDKDADGFVPSEGCVTFILKRYEDAIRDHDNILSVILGTSSGQSGIRQSISAPSSDGQVINLKRALHFAGVDPSDISFVETHGTGTPLGDAIEVNALNQVYKGTHTSENPLIIGSVKTNIGHTTEVAGLAGVAKVILSMQHKYIPKNLHFNTLNPEIDIESIPIQIATKTIPWENKNNKPRIAQVSSFGLQGSIVHIILQEYL

SEQ ID NO: 12563 - protein, 433 aa, Anaeromyces robustus
  PKS_KS
IAIIGMALRLPGAINNAKSFWMALAKGKDCVTTPVKDRKLHLGYVDKPSHLLGENEHNIPRCGCYDTRSNVAKPSEFDAEFFNCLPEEAMALDPRHRWILETSWEALENSGIAPNSLENTITGVFLGINDSHDYHDLMKENGITPPIAAHSTPSGIVGRLSYFYKLFGPSFTIDTACSTGASALHSACRSLQFGDCDLSIVSGVKYLYTSNDFHRTSIARMTSPKGRCATFDKDADGFAPGEGCVTFILKRYEDAIRDHDNILSVILGTSSGQSGIRQSISAPSSDGQVINLKRALHFAGVNPSDISFVETHGTGTPLGDAIEVNALNQVYKGTHTSENPLVIGSVKTNIGHTTEVAGLAGVAKVILSMQHKYIPKNLHFNTLNPEIDIESIPIQIATKTIPWENKNNKPRIAQVSSFGLQGSIVHIILQEYI

SEQ ID NO: 12564 - protein, 427 aa, Anaeromyces robustus
  PKS_KS
FAIIGIGCHFPEGIESKEDFWQMLEDARCITKDIPKERWDKDEWYSEEPIQGTIQTKRGAFLKNPYLFDNKYFYISMPEAKEMSPEQRWLLELTVETLEDANIKPETLKGTRTGVFIGSSGCDYLATQISHANDINSHSPTGFELSILANRLSYVFDLQGPSISCNTACSSAFSALNIGLNAMITDDCEMALVAGSNFMNCPGGFVAFSQLRVVSPDGSCKPFDEKANGYARLEGAGMVLIKPYEKAVRDGDKIYCAIVGCGSNEDGRSPSLTMPSYEAQYKLLTHVCEKSGIHPTQIDYVEAHGTGTKVGDPIESRAIGDAYGKSKGIRGPNDPPILISSVKGNTGHGENSSGIVSIIKTSMMLHKRRLVPTVAYHHMNPAINAEKLGIKVCETLEDWKTPHLLHAAVNSFGFGGANTNTILEEVP

SEQ ID NO: 12565 - protein, 435 aa, Anaeromyces robustus
  PKS_KS
IAIIGMSLRLPGSINSAKSFWMALAKGKNCVLPPVKNRDLHHGYVNKPSDQLNPGEHNIPYIGCYDTRSNVAKPSQFDAEFFNCLPDEALALDPRHRWVLETSWEALENAGIPPNSLEDSLTGVFVGMSQDHEYADLLAERNIIAPIAAHSNTQSGIAGRLSYFYRLYGPSLTMDTACSTGGSAIHTAVRSLQNRDCNLSIVSCVRYMYTSKTFYKTCAARMTSPHGRCATFDKDADGFASGEGCVCFVLKRLDDAIRDNDHILSVIIGTSSGQSGLRQSISAPSSEGQAINIKRAMEIADIKPEDVSYVEAHGTGTPLGDALEIHSLNQVYAGSHNEENPLVVGSVKTNIGHTGEVAGLASIAKVILAMQHKHIPKNLHFNTLNPEIDIESIPIKIPTKTIPWTSPVPNKPLIAQVSSFGLQGSIVHLFLEEYI

SEQ ID NO: 12566 - protein, 438 aa, Anaeromyces robustus
  PKS_KS
IAVIGMGIRLPGGINTPGKYWSALVSGRDCTSPTPTNRHLHHYLKPGCPANELGPMEHYIHRGGFYDTTPDAAPLSDFDPTFFNISPLEAKATDPKFRWVYETVYEAFQDACINISELNGSRTSVYCTVGQILDYVSVARAFNKSENMTSQTMHGSNPSSCAGRIAFNYGFTGPSDTIDTACSSGLNDVNNACKALSCGDTDLAVVSAVHQQIIGTQFHVISVAQMASHLGRCATFDAEADGYAPGEGCISLILKRLDEAVTDHDRIYGVITGISTAQSGTRRSISTPAVGPQAENMRRVLSMANINASDVDYLEAHGTGTPVGDAIETETLNLVFGKTHTEKKPLIVGSVKTNLGHTEEVSGLAGLCKVLLSMSHRIIPPHLHLKNLNPRIDLSVIPMTIPQKKCIWKSPRGKKRIGVVSSFGLQGSIANAVVEEFK

SEQ ID NO: 12567 - protein, 437 aa, Anaeromyces robustus
  PKS_KS
VAVVGIALRLPGGINTVDKYWDVLVNGKFCATPTGTNRHLHHYMTTAEHLKPGEHYVTKYCRYDSTPDAAPITDFDPMFFNMNPSEAAALDPKFRWVLETTYEALQDACINPDSLSGTRTNIYTAPGQVHEMNNYTTSASPTGFSVLNGQSMHGVACASLPGRISFMYNLYGAAHTVDTACSSGLVAAHDAFKDLNIGETDLAIVNAAHCPFIGSGFSLLSIAQMVSRNCRCAAYDEAADGYVPGEGCVTVILKRKDDAIRDHNKIYGLINAAAVGQSGSRSSMSTPTVEGQSRIHKEVLKLAHLEPKDIDYMEGHGTGTSLGDRIEGEAINLIFKGTHSETRPLTLASVKTNIGHTEEVSGLASLVKVLLAMKNKTVPPHLHFHNPNPSIDFKSVPLHIPTQVEEWKPVEGKKRVALVSSYGLSGSVCDAVVEEYV

SEQ ID NO: 12568 - protein, 430 aa, Anaeromyces robustus
  PKS_KS
IAIIGVGCRLPGDITTKEDFWNMLVTKRVVTSEIPADRWDREEWYSKEPIPGTIQTKHGGFLSNAYDFDNKYFSISQAEALEITPEQRWLCELAVETMEDANIRPEELKGSQTGVFVGSAGIDFGGNQLVNTLQMSAHTMTGLEPSIFSNRISYIFDLHGPSITSNTACSASMSSLSMACNAIAVGDCDKAFVAGSNFLPTPGGYVAFSQLRVVSKTGSCKPFDEKADGYARLEGACMLLIKDYEKAIRDNDKIYATIIGSGTNEDGRTLSITLPSSDAQCALMKWVCEKSNIKADTIDYVEAHGTGTPTGDPIEARSIGNAFGKVVRTPGSKPLPVGTVKGNVGHGEFLSGAIGLLKTSLMLFNKQLVPTAAYEKLNPKIDVNGLGIRVADKNEPMIKINGKVNTPLRAAVNSFGFGGANANAILEAVE

SEQ ID NO: 12569 - protein, 435 aa, Anaeromyces robustus
  PKS_KS
IAIIGMALRLPGAINNAKSLWMTLLKGKNCVVAPVKNRDLHTNYVNKPSNQLLPNEHNIPYFGCYDTKSNVAKPSQFDAEFFNCLPDEALSLDPRHRWILETTWEALENAGIPINSLKNTTTGVFVGINDDHEYSDLLEENGISIPISSHSNHPSDIAGRLSYFYNLYGPSYTMDTACSTGASAIHVACRSLQNRDCNLCMVTGVKYMYSSKSLSKACSARMISPHGRCATFDIDADGFVPGEGCVTYILKRLNDAIEDNDNILSVIIGSSSGQSGLRQSISAPSSEGQALNIRKAMEFAQVKPEDISYVEAHGTGTPLGDAMEIHALNEVYAGTHSKENPLIVGSIKTNIGHTCEVAGLAGLAKVIVSLQHKHIPRNLHFNKPNPDFDLNSIPIKIPTKTLPWNSLKPGKPLIAQVSSFGLQGSIIHLIIEEYI

SEQ ID NO: 12570 - protein, 445 aa, Anaeromyces robustus
  PKS_KS
IAIVGIGLRLPGGINSTQKFWLSLIKGRNCLSNTPTDRQLHQGFVDMQKNPNKNLDINEHYIGKYGYYESVRGTAKPTDFDADFFECSKDEAIGMDVKQRWILETSWEALEDAGIDPSIIENSNTGIFVGMNNCNHHVKLMASKEATNINSNYNSITTHGTELCSVAGRLSYFYKLYGPAISIDTACSTGATAVHVACRSIQMGECDLAIVSGARYLYYNDEFINTSHAKMTSPNNRCATFDESADGFASSEGCVTLILKRLDEAEENNDNIYGVILGSSNGQSGGRQSISVPSSEAQERNIRNAMKNANVSPKDISYIEAHGTGTPYGDALEIHAINQIFGHTHTQDSPLYIGSVKTNIGHTCEASGLAGLVKVLLSMKHQLIPKHINFRKINPEINLDLVPLNIPYQKCIPWKSSDPTKPLIAEVSSYGLQGSVTNIILQQYI

SEQ ID NO: 12571 - protein, 437 aa, Piromyces finnis
  PKS_KS
IAVVGIALRLPGGINTVDKYWNSLVDGRFCISPIGTNRHLHHYMSKEENLKPGEHYIYNYGRYDSTPDAAPISDFDPMFFNMNPNEASALDPKFRWVLETTYEAFQDAGIDPDVLSGTNTSVYTAPGQVDEMNRYAILASDTGFSVLNGMSMHSCAAASLPGRISFMYNLLGAAHTVDTACSSGLVATHDAVKDLNLGETDLAIVNAAHCPFMSSGFSLLSVAKMVSRNCRCAAYDEAADGYVPGEGCVTIILKRKDDAIRDHNKIYGLINAAAVGQSGSRASMSSPTVIGQTNIHKQVLKKAGVNPSDIDYMEGHGTGTKLGDRIEAEAINNVFKGSHSKERPLVLASVKTNIGHTEEVSGLASLVKVLLAMKNKTVAPHLHFKNPSPLIDFDSVPLHIPTQKEEWKPAEGKKRTALISSYGLSGSVSDVIVEEYI

SEQ ID NO: 12572 - protein, 421 aa, Piromyces finnis
  PKS_KS
IAIIGMALRLPGAINNSKSLWMALAKGKDCVLPPVKTRDLHTRYANKSADQLELDEHYLPRIGCYDTRNSVAKPSEFDASFFNCLPDEAVALDPRHRWILETSWEALENAGIAPNSLKKTTTGVFIGINNEHEHEDLLHDCGIIPPLASHATAQSSIAGRLSYFYQLFGPSYTIDTACSTGSSALHSACQSLQCNDCNLSIVTGVKYMYSSKEFHKTCSARMTSPNGRCATFDASADGFAQSEGCVTFILKRFDDAVRDNDNILAVVLGSASGQSGLRQSISAPSSEGQTVSIKRAMEKAGITPEQVSFVEAHGTGTPLGDALEVHALNQVYGGSHTEENPLIVGSIKSNIGHTCEAAGLASIAKVIVAMKYNLIPRNIHFNELNPEIDLSTIPMKIPTKTLPWNPPNDDTPLIAQVSSFG

SEQ ID NO: 12573 - protein, 337 aa, Piromyces finnis
  PKS_KS
ILETSWEALENANIAPNSLENSSTGVFVGINDDHEYSDLMTECGIETSIASHGSSPSGIAGRLSYFYRLYGPSFTIDTACSTGATALHTACRSLQHHDCNLSIVSGVKYMYSSKNFYKTCAARMTSPHGRCATFDKDADGFVPSEGCVTFILKRLDDAIRDNDNILSVILSTSSGQSGLRQSISAPSSEGQAINMRKAMEFAGIKPEDVSYIEAHGTGTPLGDALEVHALNEIYAGSHTEENPLVVGSIKTNIGHTCETAGLAGIAKVIVSMQHKYIPKNLHFNTLNPEIDVKLIPMKIPTKNLPWNSSDPNKPLIAQVSSYGLQGSIIHVFLEEYI

SEQ ID NO: 12574 - protein, 416 aa, Piromyces finnis
  PKS_KS
IAIIGVGCRLPGDISTKEDFWNMLVTKRVVTSEIPSDRWDREEWFSEDPVPGTIQTKCGGFITNAYDFDNKYFSISQAEAFEITPEQRWLCELAVETMEDANIRPEELKGSQTGVFVGSAGIDFGGTQLANTLQMSAHTMTGLEPSIFSNRISYIFDLHGPSITSNTACSASMSSLSMACNAIAVGDCDKAFVAGSNFLPTPGGFVAFSQLRVVSKTGSCKPFDEKADGYARLEGACMLLIKDYEKAVRDNDKIYATIISSGTNEDGRTLSITLPSSDAQCALMQWVCEKSNIKADTIDYVEAHGTGTPTGDPIEARSIGNAFGKKVRSPNSKPLPVGTVKGNVGHGEFLSGAIGLLKVSLMLFNRQLVPTAAFEKLNPKIDVDGLGIRVADKNEPLVKINGKINTPFRAAVNSFG

SEQ ID NO: 12575 - protein, 236 aa, Piromyces finnis
  PKS_KS
IAVIGMGIRLPGGINTPTKYWNALVNGKDCISPTPNNRHLHHFLRPNCPHNELGPYDHYVHRAGYYDVVPDAAPITDFDPTFFNISPLEAKFTEPKFRWVYETVYEAFQDACIDISELNGSRTGIYCTVGGTFDYIGLTKAFVSGQTMTSQTMHGSAASSCAGRIAFNYGFIGPSDTVDTACSSGLNDVNNACKSLSCGDTDIAVASAVHHQYVSTQFHVISVAHMASQTGRCATF

SEQ ID NO: 12576 - protein, 346 aa, Piromyces finnis
  PKS_KS
FAIIGTGIRLPGDINNKDDFWKVMIEKKVITGLTPEDRWDRDEWYCKTEKPGTIQTLYGGFIENAFDFDNKFFSISQKEALDATPEQRWLCELTVETIEDANINIDKFKGSNTGVFVGTSGIDYGSYVFSVPEKITKYTYSGIEPSIHANRVSYLFDLHGPSLSTNTACSSSLTALSIACNSMAAGDCEMAIVAGTNFFQAPANGVAYSQLRVVSKKGACRPFDSGADGYARLEGAGMVLLKPYEKAIRDNNKIYATILSTACNEDGKTASLTTPSSKAQYKLMKRVYEKGHIDPCTIDFIEAHGTGTAVGDPIEASSIGEAYGKINKANGNPAIPVGSVKGNVGH

SEQ ID NO: 12577 - protein, 427 aa, Piromyces finnis
  PKS_KS
FAVIGIGCHFPEGIESKESFWKMLEDGKCITKDIPKERWDKDEWYSKEPVQGTIQTKRGAFLENPYLFDNKYFYISMPEAKEMSPEQRWLLELTVETLEDANIKPETLKGSRTGVFIGSSGIDYLVTQISHANDINSHSPTGFELSILANRLSYVFDFQGPSISCNTACSSAFSALNIGLNAMITDDCEMAIVAGSNFMSCPGSFVAYSQLRVVSKDGSCKPFDEKADGYAKLEGAGMILVKPYEKAVRDGDKIYCAIVGCGSNEDGRSPSLTMPSYEAQYKLLTHVCEKSGINPTQIDYVEAHGTGTKVGDPIESHAIGDAYGRGKGIRGPNDPPVLVSSVKGNTGHGENSSGIVSIIKTSMMLYKRKLVPTAAYHRLNQAIDAEKLGIKVCEKLEDWNTPHILHAAVNSFGFGGANTNALLEEVK

SEQ ID NO: 12578 - protein, 442 aa, Piromyces finnis
  PKS_KS
YAVIGVGCRFPGNIKSKEDFWEMLTTGRCLTSETPKDRWDSAEWYNKEPKRGTVQTTRGAFMEDAFYFDNKYFSISQNEAKEMSPEQRWLLELAVETFEDANINPKKLKGSRTGVFVGSSGMDFVAAQISHANDLTQHSATGLELSILANRISYYFDLNGPSICTNTACSASMTALNLAINSMITDDCDAALIAGTNLLFTPGSCVAYSQLRVVSVDGSCKPFDKRADGYSRVEGAGMLLIKPYEKAVRDGDKIYCAILGSSTNEDGHTPSLTMPSYDSQCKLLTHVCEKFDIDPASIDYVEAHGTGTAVGDPIEARSIGYAYGRRVREGKQIKTTRPGETEEILDQPTYPLIIGSSKGNTGHGEYSSGIIGMIKAVLMLHHRTMVPTIAHEEMNPAIDAEGLGIKVATKLEPWTTPHTLRIAVNSFGFGGSNGNAIFEEVV

SEQ ID NO: 12579 - protein, 434 aa, Piromyces finnis
  PKS_KS
IAIIGMGLRLPGAINSDKSLWSTLVKGRDCITAIPKDRKLHENYVDKQSSELNMGEHNVKRCGYYDSRSSGKKISQFDAEFFNCLPDEAIGLDPKHRWILETSWEALENAGISPESLENTDTGVFVGIGDQQEHVKFMQECQKEKVVAHHNSNPSAIAGRLSYFYKLYGPSVTVDTACSTGATALHTACRSMIFGDCNLSIVTASKFLFYSEEFEMTSKARMTSPSGRCATFDKNADGYVPAEGCVTFILKRLEDAERDKDHILGVILGTSSGQSGFRQSISVPSSEGQARNIERAMAVAGVQPSDISYIEAHGTGTPYGDAIEIQGINQVYAGSHTSEHPLVIGSIKTNIGHTAETAGLASIAKVLLAMKNKTIPRNLHFKNLNPEIDLGVVPLSVPTHNVKWETVDGKPRTALVSSYGLQGSAVNIILQEYV

SEQ ID NO: 12580 - protein, 59 aa, Neocallimastix californiae
  PKS_PP
FEVMELELKKVLQYGENDEIDPYQSLSELGIDSIMMMELRTILKNVTGINIPLVVFSTQ

SEQ ID NO: 12581 - protein, 55 aa, Neocallimastix californiae
  PKS_PP
TKDITEKLQSMLGLIDEEIDVTIPLRVYGLDSLTAMELTKWIESEMNIEFNQSQL

SEQ ID NO: 12582 - protein, 55 aa, Neocallimastix californiae
  PKS_PP
TKDITEKLQSMLGLIDEEIDVTIPLRVYGLDSLTAMELTKWIESEMNIEFSQSQL

SEQ ID NO: 12583 - protein, 59 aa, Neocallimastix californiae
  PKS_PP
KNEVVEKLQDLLGLVDENIDTNVPLQVYGLDSLTSMEIVKWVENDKKVELPQSALLSSE

SEQ ID NO: 12584 - protein, 59 aa, Neocallimastix californiae
  PKS_PP
KNEICDRLQNMLGLVDEKIDPAIPLRVYGLDSLTTMELTNWIQSELKVTLPQSQLLSDE

SEQ ID NO: 12585 - protein, 55 aa, Neocallimastix californiae; identical to SEQ ID NO: 12582
  PKS_PP

SEQ ID NO: 12586 - protein, 55 aa, Neocallimastix californiae; identical to SEQ ID NO: 12582
  PKS_PP

SEQ ID NO: 12587 - protein, 55 aa, Neocallimastix californiae; identical to SEQ ID NO: 12582
  PKS_PP

SEQ ID NO: 12588 - protein, 55 aa, Neocallimastix californiae; identical to SEQ ID NO: 12582
  PKS_PP

SEQ ID NO: 12589 - protein, 55 aa, Neocallimastix californiae
  PKS_PP
TKDITDKLQSMLGLIDEEIDVTIPLRVYGLDSLTAMELTKWIESEMNIEFSQSQL

SEQ ID NO: 12590 - protein, 55 aa, Neocallimastix californiae; identical to SEQ ID NO: 12582
  PKS_PP

SEQ ID NO: 12591 - protein, 55 aa, Neocallimastix californiae; identical to SEQ ID NO: 12582
  PKS_PP

SEQ ID NO: 12592 - protein, 55 aa, Neocallimastix californiae; identical to SEQ ID NO: 12582
  PKS_PP

SEQ ID NO: 12593 - protein, 53 aa, Anaeromyces robustus
  PKS_PP
NEILKREVRRMLMYNDNDELDELQPLSELGLDSIMMMEFRQIIKAVTNIVVPL

SEQ ID NO: 12594 - protein, 59 aa, Anaeromyces robustus
  PKS_PP
YAIMESELKRILQYSENDEIDPYQSLTELGIDSIMMMELRTILRTATGVNIPLVVFSTQ

SEQ ID NO: 12595 - protein, 71 aa, Anaeromyces robustus
  PKS_PP
EKIICKIYSNVFNINENSVGLMNEFYELGGDSLIVISILSLIEKELKIKLNVKDILSHPLIKDLCDYIETI

SEQ ID NO: 12596 - protein, 71 aa, Anaeromyces robustus
  PKS_PP
EKLICNVYSKTLNIDESKIGKMSDFFELGGDSLNAIRIISMIEKELNIKLYIKDILSHPLVSEISEYIEDI

SEQ ID NO: 12597 - protein, 59 aa, Piromyces finnis
  PKS_PP
YEIMEHELKNVLQYGENDEIDPYQSLTELGIDSIMMMELRTIMRTATGINIPLVVFSTQ

SEQ ID NO: 12598 - protein, 56 aa, Piromyces finnis
  PKS_PP
QDILKKEIRRMLMYNEDDEIDEMQPLSELGMDSIMMMEFRQVIKAVTDIMIPLSII

SEQ ID NO: 12599 - protein, 55 aa, Piromyces finnis
  PKS_PP
TKDISEKLQSMLGLIDEEIDVTIPLRVYGLDSLTAMELTKWIESEMNIEFSQSQL

SEQ ID NO: 12600 - protein, 55 aa, Piromyces finnis; identical to SEQ ID NO: 12599
  PKS_PP

SEQ ID NO: 12601 - protein, 55 aa, Piromyces finnis; identical to SEQ ID NO: 12599
  PKS_PP

SEQ ID NO: 12602 - protein, 55 aa, Piromyces finnis; identical to SEQ ID NO: 12599
  PKS_PP

SEQ ID NO: 12603 - protein, 55 aa, Piromyces finnis; identical to SEQ ID NO: 12599
  PKS_PP

SEQ ID NO: 12604 - protein, 55 aa, Piromyces finnis; identical to SEQ ID NO: 12599
  PKS_PP

SEQ ID NO: 12605 - protein, 55 aa, Piromyces finnis; identical to SEQ ID NO: 12599
  PKS_PP

SEQ ID NO: 12606 - protein, 59 aa, Piromyces finnis
  PKS_PP
KNEVITKLQDLLGLVDEEIDVNVPLQVYGLDSLTSMEIVKWIENDKNVDLPQTALLNSE

SEQ ID NO: 12607 - protein, 72 aa, Piromyces finnis
  PKS_PP
ILIYQSIKEIIPSTPDFDQFDPEMSFTMYGIDSLSTVKLTNILSRKLKKNYSPSIIFNYASPLLLAQYLSQP

SEQ ID NO: 12608 - protein, 41 aa, Neocallimastix californiae
  Plant lectins/antimicrobial peptides
CGRDYGKCPDGLCCSQYGWCGVTSDYCDNNCQPEFGRCNNM

SEQ ID NO: 12609 - protein, 42 aa, Neocallimastix californiae
  Plant lectins/antimicrobial peptides
CGIFSGKRSCSNNECCSSSTGYCGRNDDYCGSDCQSEFGYCT

SEQ ID NO: 12610 - protein, 41 aa, Neocallimastix californiae
  Plant lectins/antimicrobial peptides
CGKGYGTCPDDECCSRYGWCGTTSEYCGYKCQSDYGRCDNI

SEQ ID NO: 12611 - protein, 41 aa, Neocallimastix californiae
  Plant lectins/antimicrobial peptides
CGKGYGSCPNNECCSQYGWCGTTSEYCDYKCQLDYGRCNNI

SEQ ID NO: 12612 - protein, 41 aa, Anaeromyces robustus
  Plant lectins/antimicrobial peptides
RCGKGYGSCPDNACCSQWGWCGFTSDHCGAGCNKEYGRCDN

SEQ ID NO: 12613 - protein, 194 aa, Piromyces finnis
  PLC-like phosphodiesterases
MSKYLNNTRINQINIPGTHDSGTYAVDWHSFPIINGFRRQWGRTQSLDIYQQLMHGIRYLDIRLETNPKKQIYLTHDKFDCINKKTNDLYYLSNVFDEAINFLHYNPSETVIMHLKCDNCHFHKYNKDGSMKEKGDLKEEEFYEAIANLSINNSDRPYEKFYKDYFYQDNKSNELFPTLGKARGTIIIYTRGDY

SEQ ID NO: 12614 - protein, 64 aa, Piromyces finnis
  PLC-like phosphodiesterases
FYDRNNNDVLTINFMNIQAVWEVFSSVYTHASSINKKLVEYFNNNNPKIHNQWMILDFPDVHLT

SEQ ID NO: 12615 - protein, 25 aa, Piromyces finnis
  PLC-like phosphodiesterases
YGNNYLVQDNYNAGVNEKWSIIKDM

SEQ ID NO: 12616 - protein, 25 aa, Piromyces finnis
  PLC-like phosphodiesterases
YGNNYLVQDNYNAGVNEKWSIIKDM

SEQ ID NO: 12617 - protein, 197 aa, Piromyces finnis
  PLC-like phosphodiesterases
SNWMSKYLNNTRINQINIPGTHDSGTYAVDWHSFPIINGFRRQWGRTQSLDIYQQLMHGIRYLDIRLETNPKKQIYLTHDKFDCINKKTNDLYYLSNVFDEAINFLHYNPSETVIMHLKCDNCHFHKYNKDGSMKEKGDLKEEEFYEAIANLSINNSDRPYEKFYKDYFYQDNKSNELFPTLGKARGTIIIYTRGDY

SEQ ID NO: 12618 - protein, 64 aa, Piromyces finnis; identical to SEQ ID NO: 12614
  PLC-like phosphodiesterases

SEQ ID NO: 12619 - protein, 115 aa, Piromyces finnis
  PLC-like_Pdiesterase_TIM-brl
NNYLVQDNYNAGVNEKWSIIKDMLDHNILTTWDKNKDIFNIYGKDHANTTMFYDRNNNDVLTINFMNIQAVWEVFSSVYTHASSINKKLVEYFNNNNPKIHNQWMILDFPDVHLT

SEQ ID NO: 12620 - protein, 223 aa, Piromyces finnis
  PLC-like_Pdiesterase_TIM-brl
MSKYLNNTRINQINIPGTHDSGTYAVDWHSFPIINGFRRQWGRTQSLDIYQQLMHGIRYLDIRLETNPKKQIYLTHDKFDCINKKTNDLYYLSNVFDEAINFLHYNPSETVIMHLKCDNCHFHKYNKDGSMKEKGDLKEEEFYEAIANLSINNSDRPYEKFYKDYFYQDNKSNELFPTLGKARGTIIIYTRGDYKYTKNNQTIQIGKKIDIPGMGSCDDLSWV

SEQ ID NO: 12621 - protein, 226 aa, Piromyces finnis
  PLC-like_Pdiesterase_TIM-brl
SNWMSKYLNNTRINQINIPGTHDSGTYAVDWHSFPIINGFRRQWGRTQSLDIYQQLMHGIRYLDIRLETNPKKQIYLTHDKFDCINKKTNDLYYLSNVFDEAINFLHYNPSETVIMHLKCDNCHFHKYNKDGSMKEKGDLKEEEFYEAIANLSINNSDRPYEKFYKDYFYQDNKSNELFPTLGKARGTIIIYTRGDYKYTKNNQTIQIGKKIDIPGMGSCDDLSWV

SEQ ID NO: 12622 - protein, 115 aa, Piromyces finnis; identical to SEQ ID NO: 12619
  PLC-like_Pdiesterase_TIM-brl

SEQ ID NO: 12623 - protein, 181 aa, Piromyces finnis
  PLCXc
INQINIPGTHDSGTYAVDWHSFPIINGFRRQWGRTQSLDIYQQLMHGIRYLDIRLETNPKKQIYLTHDKFDCINKKTNDLYYLSNVFDEAINFLHYNPSETVIMHLKCDNCHFHKYNKDGSMKEKGDLKEEEFYEAIANLSINNSDRPYEKFYKDYFYQDNKSNELFPTLGKARGTIIIYT

SEQ ID NO: 12624 - protein, 181 aa, Piromyces finnis; identical to SEQ ID NO: 12623
  PLCXc

SEQ ID NO: 12625 - protein, 288 aa, Neocallimastix californiae
  PLP-dependent transferases
ANIANVALFTTLVTRSDYIFYDSSSSKHVLDAISFSKAKTLSYSHVNAIENIENQVKLVHEKFPKSKKVIVSSSIFMNEGDICQLKDIHRIAQNYQCIVVIDDTFGCGFFDGSSNNILEFFKFKGQIDFITGSFSGIMESNGGFIVYGENQKSFMNSLKINYERDAILPNTAGALLASYQCLETPLNTSSSGKINRRLQLFKNILHWKNGLKRIGLDIPNHSKSTVIPIFMPTNESGIAVQKALQTQGLYVSYESNEKDVQHHYKIITSIQTRMTSDEIDQALEIMGR

SEQ ID NO: 12626 - protein, 362 aa, Neocallimastix californiae
  PLP-dependent transferases
YSECIDIACPTNRKINFCSTSYLGLNQDPRMKQAAYEAIEQYGLSPLGSAPFGGLTNLHEKLGYRLGKIYGLPYGITTSGATLANMTIIPLIVGAKDFVFSDELNHTTIIDGIDLSKAKMIKYKHNDMEDLEKNVKLIHEKFPNSVKLIIFDGVFSMEGDVCDLPNIVRIAKKYNCKTMIDECHALGIIGPHGYGTLDYFNMPGSVDFVTGTLVKSLCSHGGYICCRRDYQNKLENSSGIIFSTNNTPAYAATSLKALDLIEEEGPNSVRARLQRNVKHWKEGVRNLGFEIIEGVSCVCPIMIYDEINGLKFQKRLYEEGLNFSAVAFPAVPKNMARLRTTVLGSLTDEDIDEALSILGRVA

SEQ ID NO: 12627 - protein, 334 aa, Neocallimastix californiae
  PLP-dependent transferases
SKLIDLSFHSYLGLNQNKQLKLTTCNVINEFGCGILKGITSYHEKTEDILKSIYQFPSCYTLSGDGNSFIIPLIVGKNDAIFIDECAKTSINDSAELSNSKIYYYKHNNASGLEACLLKASQELPNSKKLIIIEGVYNITGEISNLVEFINVSKKFGGIVLVDESHALGVLGKEGKGSLEYANIHEGVDVITGSLEYSLCSNGSYILLNNELSKQFNDLIFINDTITPLSAAISSTTLDILRQDSKTVDQLKNNVSWWRSHCQQNGIELIDSNSAISAIRIDDKGILLNLQRRLYDEGLNVMVSTRPYGLLKFILSASLTEDLLEEAMDILLRV

SEQ ID NO: 12628 - protein, 360 aa, Neocallimastix californiae
  PLP-dependent transferases
SSNKFINFNSTSYLSLNKELKVKLVAERVIKEYGIGSYGIFTPYHVELYQHLKEIYGEDYDHIQTYQGDIRDVFFSKLFDSNDFIFYDEQLNSSFRQVLRALHFKKNQLVEFNHNDAFDLSEKLEAIDLISPDAHKYIITEGVFELQGDLCHLQDIFNISKKYDCYVILDESNALGVIGKEGLGSYNYHQCQEKADIVFCSMDKVLCASGQFYVFNQRISTLLARRLTDLFNETIYPPVSTLAAAVAKTVLDIIVEDSVDFKNVGEDTTGVHAQLMDKIKYWKKKCQSIGLKFIESPSPMTCMILDEIDTESLAQLLFKNKIKCSYVCHKKNMNYNLLKFNIIRSMDLRLLDEAYHILQS

SEQ ID NO: 12629 - protein, 350 aa, Anaeromyces robustus
  PLP-dependent transferases
KKSLNFCSSLPFEFGKISTVKKAAVEAIELYGLNADNQCPLKIQLEKKLSNEYDYPYSTVFSGANICNVALFTTLATKNDYIFYDSSSSKHVLDAISFSKAKILSYSHVNAIENLEKQVKIVHEKFPNSKKIIVSSSVFINEGDICQLNDINKIAQSYQCIVVIDDTFGCGYFDGSANNILEFYKLKGQIDFICGSFSGIMESNGGFIVYGENQKSFMDLISKNYERDAILPNIASAILASYECLEVPLNSSIGKINRRLQLFKNMLQWKNGLKKIGLDIPSHSKSATLPIFMPSDDIGMAVQKALQEEGLYVSYESNERNSVHKYKLLTSIQVNMTKDIIDKALEIIGR

SEQ ID NO: 12630 - protein, 254 aa, Anaeromyces robustus
  PLP-dependent transferases
FINEGSKTSIKDGAELSNANVYYYKHNDISSLEASLVKANQELPNGKKLITVEGVYEITGEVVNLSEFITVAKKYGGLVLLDESHALGVLGAKGKGSMENANIHDGVDIITGSLEYSLCSNGSYFLLNQNLSQQFSDLIFINDIITPLSAAISSTTLEILRQDAKMIQQLKDNISWWRSHCQQNGIELIDSNSAIAAIRIDDDSVLLNLQKRLYEEGLNVMVSNNPYGLLKFIFSASLTEDLLEEAMDILLRVL

SEQ ID NO: 12631 - protein, 334 aa, Piromyces finnis
  PLP-dependent transferases
KSIDLSLHSYLGLNQNKQLKLITSQVINEFGCGIFRGLTTYHKKTEDILKAIYQFPTCYTLSGDGNSFVIPLMVGKGDAIFVDVEAKTSIKDGSELSNATVYYYSHNDPISLESCLLKANQEVPNGKKLVVIEGVYKISGDVAKLNEFIPIAKKYDATILVDESHALGVLGARGRGSLEQFNVREGVDIITGSLEYSLCSNGSYFLLNKQLTQQFSGFISINDTITPLSAAIASTTLDILRQDTKMIEQLKSNISWWRTNCQQNGIELIDSTSSITAIKIDDENVLLNLQKRLFEEGLNVMVSTSPYGLLKFILSASLTEDLLEKAMNILLHVL

SEQ ID NO: 12632 - protein, 360 aa, Piromyces finnis
  PLP-dependent transferases
STNKYFNFKSSSFLSLNKELKVKLEAEKAIKEYGLGSYGIFTPYHAELTEYIEKIYGEDCSIRTFQNDIRDILFNSLVSSQDFIFIDEQLNTSFKQTIKSLFLEKGHIIEYTHNTPLDLKSQLKAIQLKFPTVNKFIITEGVFENIGDVCYLNDIMDISKEFGCTLVLDESNALGVIGQKGFGSYDYHQCQQKADIIFCSMDKTLCSSGQFYVFNNKSISILLKNNTSLFDESIYYPINALSAAVAKTVLNIIFENTTDFKNITSSIDVHTQLVDNINYWKQKCQSIGLKLIDSPSAITSIIIDDVDAESLVELLFKNNIKCSFTKQINHNINTNILKFNILRSMTKKFINEAFNILQSV

SEQ ID NO: 12633 - protein, 350 aa, Piromyces finnis
  PLP-dependent transferases
NKTLNFCSSLPFEFGKIDKVKKAAIEAIEKYGLNSDIQCPLKIQLEQKLSKDYGYQYAATFSGANVANISLFTTLVTRMDYIFYDSSSSKNVIDAVLFSKAKTLSYSHANAIENLEKQVKLVHEKFPKSKKVIASSSIFVNEGDICQLKEINRIAQTYQCIVVIDDTFGCGFFDGSSNNILEFYKLKGQVDFITGSFSGIMESNGGFIAYGENQKEFMDRIIKRNEKEVILPNTANALLASYSSLEEPMNLSSGRITRRHQLFKNILQWKNGLKGIGLDVPSHSKSATIPIFMPTDDAGIAFHKALQEQGLYVSYESSERDAIHKYKILTTVQANKTKDEIDSALKIIGR

SEQ ID NO: 12634 - protein, 357 aa, Piromyces finnis
  PLP-dependent transferases
DIACPADRKINFSSTSYLGLNQDPRMKEAAYKAIEQYGLSPLGSAPFGGLTNLHEKLGYRLGKIYGLPYGITTSGATLANMTIIPLIVGAKDFVFSDELNHTTIIDGIDLSKAKMIKYKHNDMEDLEKNVKLIHEKFPDRVKLIIFDGVFSMEGDVCDLPNIVRIAKQYNCKTMMDECHALGIIGPHGYGTLDYFNMPGSVDFVTGTLVKSLCAHGGYICCRRDYQNKLENSSGIIFSTNNTPAYAATSLKALDLIEEEGPNSVRARLQRNIKHWKDGIRNLGFKIIEGVSCVCPIMIYDEINGLKFQRRLYEEGLNFSAVAFPAVPKNQARLRTTILASLTDDDIDEALSIIGRVA

SEQ ID NO: 12635 - protein, 1974 aa, Neocallimastix californiae
  POLYKETIDE SYNTHASE-RELATED
GIAHATALDFSPLFKQSNLEYLSQLIMTMKQMTQKPGVNPEYQNLIQVAVVGIALRLPGGINTVDKYWKSLENGRFCVSPTGTNRHLHHNMTHNEELKPGEHYIFNYCRYDSTPDAAPITDFDPMFFNMNPNEATVLDPKFRWVLETTYEVLQDAGINPDSLSGTHTNIYTAPGQVDEMNAYATNASPTGYSVLNGMSMHSCASASLPGRISFMYNLFGAAHTVDTACSSGLVAIHDAFKDLNIGETDLAIVNAAHCPFQSSSFSLLSIAKMVSRNCRCASYDEAADGYVPGEGCVSVILKRKDDAIRDHNKIYGLINATAVGQSGSRASMSTPTVLGQKYIHKKVLEKANLTPGDIDYMEGHGTGTKLGDRIEAEAINEVFKGTHSESRPLTLASVKTNIGHTEEVSGLASLVKVLLAMKHKTVPPHLHFNKPSPLIDFDSVPLHIPTQKEEWKPAEGKKRVALVSSYGLSGSVCDAIVEEYIDPEEREIYPVNDTYHVLTISAKNHSALIAVAEQYISLLESLEADAPIADLCYSSNVCRQHMNYRYAVTGRNASELAAELTNYVSQGKKTIRTDKHEVGMSFTGQGSIKPGVGKELFRTQPVFRAAMEKCDAVVKKSTGISILDALYDQNQGHHLKKAQIAQPALFAYEYAMYMLWKSWGIKPVIVNGHSLGEIVAAAATGAIDIDLAIDFIIERARCMGEYGEKPGAMVSVFQSEDVVKEAIEEFGYEEEVSIAAINGVTHTVISGYEDEVDDLTEYFNEMKVKTKKLNVTDAFHSPLMDPAIEELNGWIEEKNDAQFRQTLKVKFISNVDSTIKPVGDRLEKDYWGKHARNAVRFVDGVKSMIESEKKLLAVIEVGPAATLTNMSSRFVRETESLRGKGPTFIASSVADQNSEQYLYNALAKFYMLGGNIDWTSFHKRVDPVSGKAITLGLYDLPLYPFQRSRYWLETEEQCLKPLQAGSNAANWDLYKSITVVNTGKNELVVTAPLTPQYVKYLCKNHVVSGNGCVPAAAYTEFIFAAVKAMNNNTDDVIEIADELLVRGPLTIKEDSEVDFILKKKGDRLSLYTKLDGGIENHMLNASANLLRDGENVNIRDTLPTPAQAKALINKILTKDNIHSSKLIYDSISKNISYNGGFPSVKHFGLGNDDDGQYVLVSRIDSKDKTLNNIRSGLNQVYLFDASLHSNAGRSSIEEEKKGEGREEENEPFLPSSFENIIKFKATPDECFVVHRYIGNTDPNSEFTTFSVYDLDGNICEYVGAFQTRKVKIETKETSPEFSLWSIDFKEVPTPVQEINTTPYFYLLADHHGYADAFVKYMTAKVKDFRYVKVDMPTKEECTDEFVEGNLNALGIKESGMENETLAVVNFMGMDLERQFVSSIDAKDAHFSELLKNTYERNLVFIQSFTRVVDEYDCQKSFCYVTKNATDYWKGEVDVLQGIISGISKSFWREYTQIRVFDLDVDYTTTPDELSPRLHTEVISSVDRYNVTYEVVYGKEGHRYEGKIKHVVAPSVEYSSEVEFEYSGTILITGGLGGVGFDISRYLMRQPNLKALVLTGRRPETDEKVAGKLAELRALNPKIKITYVTANVGSETEMKKVIDDINAGSPEEALVGVFHTAGTNDDGLIFNQSYERFAKLINSKIEGTLCIAKLTNDLNLKFTILFSSMTAFFGNRGQINYCTANMFINKVCDYYRNHGRKDILSLELAGWPSGLSTIIKDLTFTLNGKNSISLISNLMLHVSDIPYAVLGSPVVNWENVYDTSICDPIFRAVRPANRPKVDWKTANDQDYIKDSSSRSLNASYSSISGNGNGNANANGNGNNTTETGNVRELNEDNIFEVMELELKKVLQYGENDEIDPYQSLSELGIDSIMMMELRTILKNVTGINIPLVVFSTQNICLYRLVEYVKTKLVKEKEEAAKSKATVITEEEKQVKAAEEKKAKEEEAKLIKDDQIDQWIVMVPGCEQISDPLNIFI

SEQ ID NO: 12636 - protein, 2139 aa, Neocallimastix californiae
  POLYKETIDE SYNTHASE-RELATED
KAVPEKFEDFNSKVKFSDLAIDRSKYEDIEIAVSKEIGRRCYISPYLDRSTPEVLEQFIGYAKYINSNLPKKLDSPRYMVPIAVVGMGLRLPGGINTPSKYWNALVNGKDCISPTPANRHLHQYLRPFCPPNELGPFDHYIHRAGYYDVTPDAAPISDFDPTFFNISPLEAKFTEPKFRWIYETVYEAFQDACINVSELNGTRTSVFTTVGSTADYIALTKAFTKVESMTSQTMHGSAASSCAGRISFNYGFIGPSDTIDTACSSGLNDCHNACKSLSMGDSDVAVVSAVHQQFVSTQFHVISVAHMASQIGRCATFDAEADGYAPGEGCISIILKRLDDAVTDHDHIYGVITGITTSQSGIRPSISSPAVGPQVENIQKALQIANVSPADVDYVEAHGTGTQVGDAIETETLNIAFGGTHNAKKPLIVGSVKTNIGHTEEVSGLAGLCKVLLSMSHRTIPPHLHLKNLNPRIDTSVIPMTIPQKKCIWKSPRGKKRVGVVSSFGLQGSVANAVIEEFKLPKNTDRRLDEGYDLSMYHILTVSAKNKNALIQQVEDYISLFESMNEDDSIADICYSSNIGRQHFGYRYSAYGRNASEIIESLTDILQRVSNVRRYLQKSTAFAFTGQGVAKVGMGKHFYQTQPVFREAMDRCDAVTRRLLGVSIVEVLYNVSNIPNGTEEGEKALKKSSVAQPALFAYEYAMSQLWISWGIKPSMVLGHSLGEIVATTIAGGIDFELAMEFIVERASCMEKYGIKPGAMVSIFTTEDVVKEAIEEFEFENVSIAAINGTTQIVISGNADEVKELEEYFIEQDIKAKQLNVTEAFHSALMDPAIEKLYEWIDSKPDEKFRQPLKYGLISNVTGKLIPAGERLPKNYWGEHARNAVQFVKAVETLLANSETLLNVIEVGPASVLTNMSSRILREKKVDKFAAPFFVASALPREPQEEKALFEAVSKVYNVGMDINWRVFHTREDIYTHVRPTLKKVTLPLYPFQRSRYWAGPDTTKYDIPYCTGVDTRELANNIEKAGYVIDGDNDSNEVKQDNDNLDIAISEGSKNWNRYETPTVIDLDHLEGSKVVKSAEESSCIISVPLSSPYIHYLRKSHVINGKGFSPATSFIDFVFYGLKFAYPNDQFKINEYFITNGPLSLSYDHDVVYIMVKKGEEITIYSQTYGGQQEMRGSVIVSVANSIDSEKATDELGFDVKKDYVEKYLSGPGAKDSSNYGEGKELYEEMDKSLVYGSFFRSVQSFYSGKEQDGTEFLISHIKHNVKQVEESLVNSGASQVGILDAAIHCMSGDGIVAKKNGVEGSKDSFLPTSFEGIIKYKEIPNEVYVLHRVKSVNETSKFTQYWVFDVDGKLVFSTDNFQVKKFDISKLSGNREFRLSFTEWEELPVKRVVNENVHVIVLKDKKGYADAFIKAFKDRNIPGYIVGVDLPLSEEPNAAFAHIYPTIKAKRTAEGVLALYNFSLLDAEEYNGKETAEELVAKYKDLYTQCIEYTKAFIRTSDEMKFKKDIQFVTMGASKINTAESSVGPIVSVARGILKNLNHEMLDLHGCLFDLEVGTSVDVAANYCLDELLGGVDRYDMPVNVSYRNGKRMTPVLTASDNSYERCEREELVGNILITGGLGDVSMDVVNSLLADKDSKLEHIFLLGRSSKTNSRVIEKLARIEKVRKDHDKNIQIEYYSCDISDESSLAEVFNDIRKRQGLQITGIFHTAGVNSDANFLSQSYEKLVEIAPSKIIGTHNIMKLSEEFKDELKFVVFVSSLSAVSGNGGQTNYTAANMFIDALARYYNDHGRTNVIAIELGGWKGAGSSDQLVNDFMVITSEAGFNMFKIVFTANSRLNDRVYTVIPERSYDKCDEYYFHDYLYIKYRPRDRPRQDLTTITREGAYDQGELDAKKKSVTKDNIPEILKEEVRRMLMYNENDELDIFQPLSELGIDSIMMMELRQIIKAVTNITVPLSIITTPNLTLSKIFEYLKGKMNGNSGNEKSQEKSEINEKPKTSVAAKREALRAKKAQRKAAAAAIDFDNLNDYGDWIVRLDTNKDTTNSFFLIPAAGSSINMYNSWSKYMNKSALFAISYPGHLARIDETPIDDFKVLVKSIGEEILNNIKNGKISKDKPIYFFGHSLGALVSYETVLYL

SEQ ID NO: 12637 - protein, 886 aa, Neocallimastix californiae
  POLYKETIDE SYNTHASE-RELATED
AIIGIGCHFPEGIESKEAFWKMLEDARCITKDIPKDRWDKNEWYSKEPIQGTIQTKRGAFLKNPYLFDNKYFYISMPEAKEMSPEQRWLLELTVETLEDANIKPEAVRGSRTGVFIGSSGCDYLATQISHANDINSHSPTGFELSILANRLSYVFDLQGPSISCNTACSSAFSALNIGLNAMITDDCEMALVAGSNFMNCPGGFVAFSQLRVVSPDGSCKPFDEKANGYARLEGAGMVLIKPYEKAVRDGDKIYCAIVGCGSNEDGRSPSLTMPSYEAQYKLLSHVCEKSGILPSEIDYVEAHGTGTKVGDPIESHAIGDAYGRSKGVRGPNDPPVLVSSVKGNTGHGENSSGIVSIIKTSLMLHKRKLVPTVAYHHMNPAIDAEKLGIKVCETLEDWKTPHTLHAAVNSFGFGGANTNTILEEVKHLHPQDIQLAITPGKPLVAKISGYNEKLVIQQLKEWRKVPKETLLPQLYLSNTCREDSHYRISFILEDPDKFYDYVDLTLKGRSHVNVIKHSNKISAKPKLAFTFSGQGTQYPDMGRQLYHSNPYFANIIDYCNEIVLSISKKDLLKETGLFGDLPVNEENLMDPQYSFLAIGIIQLALVEFWKAYGVEPSLVFGHSMGEVAAAYAAGILTLEDAILLLYHYGLISQNLEENNEKSGLIALGCGVDEAKTEYIKDRKKVYIASINSYKDVTLGGDLNQLEEIMDQAKQKNVFTVMLKVNKAFHTPFILSAKEKFLKGIEGIHLRVQPPKIPFISSTHGNEYQGPFDANYWWSNIINPVNFSQAVKIAHTKVDKVLEISSTPVLGIYISSVFQPDSIFYTLSRKLKDHNSLCRNIANMYAKKCFDQFNWRQYWIDFMDGVDGETLDKIRSIDYPMPKHAWD

SEQ ID NO: 12638 - protein, 618 aa, Neocallimastix californiae
  POLYKETIDE SYNTHASE-RELATED
YGIDSLSVIKLTNVLSRKFNKKYSPAILFTYGTTASLAKYLKGYENISYLPSQEKDHGASSNKKIAIIGMAFRLPGAISNSKSLWMALAKSRDCILPPVKTRDLHHGYVNKPANQLGPKEHYLARVGCYDVRPNVAKPSEFDADFFNCSPEEATALDPRHRWILETSWEALENAGIVPSSLKNTITGVFVGMNNDHEHEDLLKKCGKVPPLAAHATAQSSIAGRLSYFYELFGPSYTIDTACSTGSSALHSACQSMQCGDCDLSIVSGVKYMYSSDEFHKTCAARMTSPNSRCATFDASADGFAQSEGCVTFVLKRLEDAIRDKDNILSVILGSSSGQSGLRQSISAPSSEGQRITIQRAMKVAGITPDQVSYVEAHGTGTPLGDAIEVHALNQVYAGSHTEENPLVVGSIKSNIGHTCEAAGLAGIAKVIVAMKHNTIPKNIHFNELNPEIDLSVIPMKIPTKNLPWNSSEEGKPLIAQVSSFGLQGSIIVTFLEQYLPPKEEEEEKKKEKVLTGESSGAITIASTKSVKKTSNVEGEGEGKDRHFLTISTKTYAALLDLYDNYLNIIENMNEDEDIRDLCYTSNVGRQHFAYRLIANGRNVSELSDSLEEEMSKLE

SEQ ID NO: 12639 - protein, 2283 aa, Neocallimastix californiae
  POLYKETIDE SYNTHASE-RELATED
AVIGVGCRFPGNIKSKEDFWEMLTSGRCLTSEIPNDRWNTAEWYNKEPKRGTMQTTRGAFMEDAFYFDNKYFSISQNEAKEMSPEQRWLMELAVETFEDANINPKKLKGSRTGVFVGSSGMDFVSAQISHANDLTQHSATGLELSILANRISYFFDLNGPSICTNTACSASMTALNLAINSMITDDCDAALVAGTNLLFTPGSYVAYSQLRVVSTDGSCKPFDKNADGYSRIEGAGMILIKPYEKAVKDGDKIYCAILGSGTNEDGHTPSLTMPSYSSQCKLLTHVCEKFDIDPASIDYVEAHGTGTAVGDPIEARSIGYAYGRRVREGKQIKTTRPGETEEILDQPTFPLLIGSSKGNTGHGEYSSGIIGMIKAILMLYHRTMVPTIAHKEMNPAIDAEGLGIKVATKLEPWTTPHTLRIAVNSFGFGGSNGNAIFEEVVNEKPEDFSMKIKDPKNPVVATFSAYDEKTLQNLLKKWSTEVPNETLLQELFVISQCHESESMRSAMIFSSVDEAKALIEEMRNGNVEKFKRHEKIYMKRVKINEKPGINFAFSGQGSQFINMGRRMYQVNGLFKRIVDYCAAVLVTYNGGEDIFEKYHIFKGDVSQISEADLSLPQYSILAIGVAQIALTEIWKAMGVTPEAVFGHSMGEVAAAYAAGILTLEDAILLLYMRGHILAQLDGTGKGMLALGCSVEQAQYFMNNKPNVFISAVNSANSITLAGDISQINAIAQEAKAQNLFAVVLKVKQAFHSPYVEGAEQAFKESIRGISERTSAPKCKFISACFGQEYEGPFDENYWWANIRNPVSFYAAASIGTQFSKRVLEIGAHPVLSVYLKEIYGKEYVYQSLSRKMDDVDSMCRTTAALFIDNAVEFMDYTQIWEGKVDLQRVKTGDVVPLKKLRSINFSIPKHVWNRKAIRKEYTDRFGTDSNHEIYTTREFVLKEMGLSEDDLKLLKNIKSGKVAPAAGAANETSFTVQSPVSIAKPKPKPKVVPQLPKATFIPTNANVIYSSGNQWNFENHRYLQDHVVNKKIVLPAAGSVSRAFSGFATAHPLKVAQRAIISLEDLKFDRMGIFDKTIDFNTATGPMPITYEEERSNQTYKIIFNEDVEVSSGKFNNNDETETLKNIPAVDYFINQCSSIAGGQGVTPAMFYNRTQEIGLDYGEEFRLYKAIRSGKNVAYGKLTVSKEHQKMVCHPAVLDNCIQIVFASGVAAGDCQALPVGMKKVVLSQGGHFPEGTLIVATELVKQDIKECVSNVYIYDENKNIFGYVEGLTMSFRRSRAEKAIDWIHVLGFEEKAPTANEYLPVDCRNVIVMCTETQQDEANAFATHIGSVVAGLQNIWVLPGNYIENIQQMVENKMIKPKETFIIDASFIDSPEIDRAFMILKTVVNYEIPTLFAASKYIKDESAQSHAVATSKAVIGMVRAARAECKVPLFTAHTDKFEDLYLAALRSGLTMDDPEVEIIDGKVQCVRFIKLDKEPVVKSSNIKLERSANGQIGQMKYSECIGLPAYTDDEVVIKVKGVSMQFKDIMTAMDALIGFDSYEPGMECIGRVVAIGKNVASNPRNQLQIGDPVIAFSHKYGHLLRTYGVVDPLSLQKIPESMYKVEYAGIFIVFITAYYSLHVRAGGIKPGQTILIHAAAGGVGQAAVKLCQLWGANIIASASASKQQFLRDTYGLEHVTNSRDPEEFYRDVMKWTDGKGVDFVLNSLSGKSLKMGIKCLKNGGKFVEIGKTDILNDSKLGLHCLLNNISFVSSHIDLLNNQQMNYYKNILFEMFSTGKLTPIPAKIFPGNKYKEAFFYLASGRNIGKTCIEFEDNMSYECTPVTLIDPNLTYLITGAFGGVGLRVVLWLVSRGAKNILLTTSSSVEKQYEQPIIRSLLEKGINVMIKTCDITDLTSVQQLFQQTTPRIAGVFHLANRFAPGLISTSDLALLRKGFSAKAEGAWNLHLVTLQKAHQVQLFVVFSSILDVLGNRGQTAYGAANAFLSSIVDHRREKGLSGNCIALPAMRGSGYLAKWNQTKQSKDFEQLIALLDTDELVNVMDGLIRYDLPANIYMAKNWANMSYDATFVAPVTRSISHLRGVNPVPVVTFPTEKKLDLPSLIRNCGGHYIAEPTHIPRSSATTTSSVRSFTPVAVKSFSPVPVSPVPVSVRTFTQDSVAPAVQVRSFQPTSLATPVAVQARYTPAPAPVPVPASVPVADAKPISSLNKNKLTKDITDKLQSMLGLIDEEIDVTIPLRVYGLDSLTAMELTKWIESEMNIEFSQSQLLGDDITTEDLINIIM

SEQ ID NO: 12640 - protein, 588 aa, Neocallimastix californiae
  POLYKETIDE SYNTHASE-RELATED
IDSLAIIKLTNILSRKFNERYSPAILFNYGTTSLLAQYITGHDSDNININKTMNNIQMPKESNSKTSDKIAIIGMALRLPGTINNSKSLWMSLAKGRDCVLPPVKTRDLHHGYVNKSFNELGPDEHYLPRIGCYDTRSNAAKPSEFDASFFNCTAEEAISLDPRHRWILETSWEALENAGIAPNSLENTLTGVYVGINNEHEHEDLLKECGIVPPVASHTLNQSSIAGRLSYFYKLFGPSFTIDTACSTGSSALHTACRAMQYGECDLSIVTGVKYMYSSKEFHKTCSAHMTSPNGRCATFDESADGFAQSEGCVTFILKRLDDAIRDNDNILTVILSSVSGQSGFRQSISAPSYEGQAINIERAMKIAGIKPEQVSYVEAHGTGTPLGDAIEIHALNKVYGGSHTEENPLIVGSIKSNIGHTCEAAGLAGIAKVIVSMKHNLIPKNIHFNKLNPEIDISAIPMKIPTKHIPWTSPNEDEPLIAQVSSFGLQGSIIVTFLQQYIPKKEEKVYETNENHILTISAKTYLALYDLYESYINILENMNDDDDISNLCYTSNIGRQHFKYRLVASGRNPFELCNNLEEEMEK

SEQ ID NO: 12641 - protein, 2175 aa, Neocallimastix californiae
  POLYKETIDE SYNTHASE-RELATED
EDLLEEAMDILLRVIVNEFPQILKVSPPKIILDSKNPTEEYSMLKDTPNSDRLNLPLPKIAIIGVGCRLPGDILTKDDFWNMLVTKRVVTTEIPADRWDRDEWYSDEPIPGTIQTKHGGFLTNAYDFDNKYFSISQAEALEITPEQRWLCELAVETMEDANIRPEELKGSQTGVFVGSAGIDFGGNQLVNTLQMSAHTMTGLEPSIFSNRISYIFDLHGPSITSNTACSASMSSLSMACNAIAVGDCDKAFVAGSNFLPSPGGYVAFSQLRVVSKTGSCKPFDEKADGYARLEGACMLLIKDYEKAVRDNDKIYACIIGSGTNEDGRTLSITMPSSDAQCTLMKWVCEKSNIKADTIDYVEAHGTGTPTGDPIEARSIGNAFGKAVRAPGSKPLPVGTVKGNVGHGEFLSGAIGLLKTSLMLFNKQLVPTAAFEKLNPKIDVSGLGIRVADKNEPMVKLNGKENTPLRAAVNSFGFGGANANAILESVEKIDVETVDIVKKENTLPLMVSFTGFSAKALIATIKEYLELPVEQLLPKLYLMTTTRQVHTHRVTFLLDNANEFYELASAFIENRPHPKVIHNLVKASFKQGITFVFRGMSQLNSNIGYSLYQYNQKFAEIVDYCDKVLEKVSGGVCSLKREFGLFQSENLNFLSLQNPKMSIIGNGMIQLALGHLLKSYGIKPSSVVGYNSGEIAAAYTAGIISLEDAILVLYQYSTILEKVPNKKNIFTLELGCSAGQAQTNIINQLSSTIYISGNNADNICTLCGSRESLNQAVSIAQQNGIPVLSNLIPGSCGICTPYLNDFKDEFFASLKGIGNNCKTPVIKFISTTLGQPFNGPLNEYYWWANLSSTVNFSHALSLAMNEQQKGSGYILDVGSGYANAALFTNYFGAFTTADKIFTTYDTTGSSSNEALTLLYTIVHLFERNAIPLPAMDKIWENSADVVGVDSFKKIRSVNFILPPHVWEHKKIKKIYNKEVFISLKKNQELNERQKEQIKLTGGVAIDHDDKLSVEIEKLKKEINDITQKDAKKAQEVAKENAQRMKDMKKQFELEKEEEIKKKVDEEKKTILKEARRFITREIEKAKNSAAEAIKATKAAEAAEDISHSFRNKNTLSAVKDSDSTSKPTVISYSGNSEAWNFENHKYLVDHIVGKDVVFPAAGSISRAMYGFKQSRGEYNFDKDRNIVFENLEFLHLAVFEKSVQEQLNKKGPIPISLVEEGDGKYTIVQKNGNPVSKGQFYEAQLTQSKEENSNLLSDVPTFNEFINRCSTKVGGNGVTSEQLYHRTDELGLKYGPNFRLVQNCRAGDNVGYARIKVDEEKSKLICHPAVLDACFHSIIGTGIANGDRQPLPNKIRRFVMGRGGYFPQGTIICAADIIKQDLKNVIVNIYIYDEDKKPIAKIEEMDMTIRQLNVLRKERWIKYMGEEVLTSLTHDQLPIQNCTGILVIGEKSQENEINYSLLPRLAAIQPLIYMILDSYDEKFKAMLDANVLVPQTTLVIDVRYLANPSIDYAYSTMKLLIENNFNFVYGNIEHGDKLIFNETYENMAFGNSIAGLLQVARAESKTNKIYSIQAENLEKFTHGLLRGNLTVEDPDIRVKEDFRITAQRIIKEPVIPEIKTKNYTLEHSNTGQIGKLKFREVFGLPECGPDEVIIKIHSVALQFKDIMSVMNNLPGYNVYEPGMESNGYVVKIGENAKKHIQLQIGQPVFAFTHKYGHMVSTYGKAHYKLVKPMNTNDMNPESYSSVIVLGTVLYALRDRAGGVKRGQSILIHSGAGGVGQAAIKLCQYWGAKIFVSTSAKKVQYLKDMYGLEYITNSRDSKTFYNDIMKWTNNEGVDFVLNALAGDGITYGLKCLKKGGHFVEIGKKNIIFNTPLGLKSLMNNINFCSAHIDLLDVDKLSSLMNESFELLNSGKITPIPVTLVPIKQYLSAFFNMASGNNVGKTCLVMDDSYEPNCKPVNLVKENKAYLITGAFGGVGLRVAEWLQLRGAKNIVLTTSGNIEKRNRNPIVETLRSKGVHVTVTQCDISNIHAVRKLFQETTPQIAGIFHLANKFAPGLIQRTSLEQFHVAYNPKARGALNLHLVSKDYPIDMFVMFSSVLDLLGNKGQAAYGAANSFLGSLVELRRSQGLCGSCLSLPAMKGSGYLAQFKQERQANQFKGLITMLDSDDLPELLDDV

SEQ ID NO: 12642 - protein, 670 aa, Neocallimastix californiae
  POLYKETIDE SYNTHASE-RELATED
VAVIGMALRLPGAINNSKSFWMSLAKGRDCVLAPVKDRKLHLGYVDKPSNLLGENEHNIPKCGCYDSRSNAAKPSEFDAEFFNCLPEEVNSMDPRQRWVLETSWEAFENAGIAPNTLENTTTGVFVGVNDDHDYQDLLKENGIAQPISAHSTPSGIAGRLSYFYKLFGPSFTIDTACSTGASALHSACRSLQFGDCDLSVVSGVKYLYSASEFHRTSVARMTSPHGRCATFDKDADGFAPGEGCVTFILKRLEDAVRDGDNILSVILGTSSGQSGLRQSISAPSSDGQVLNLKRALKFAGVDPSEVSFVEAHGTGTPLGDAIEVDALNQVYGGSHTEENPLVIGSVKTNIGHTNEAAGLAGMAKVILAMQHKYIPKNLHFNTLNPEIDIHSIPIQIATKTMPWETQDNKPRIAQVSSFGLQGSIVHIILQEYIPENGKEEDVKKSKDSKEDHILTISAKTPAALNELCESYLNFLEGMEDNEENIEDLCYTSNVGRQHFDYRISAIGKNAHELYDDLEKKMEIFDDDEDNSEAIFKQVASKSNGISQHLEIYSENAGDLQIPKKVYDTVKELLSTENSFKKTFEFCDSEIQKIAEGISLKQMIEEEKNGKESELNNSFFILSFYYSLHQLVESIMIKNNSSKKIYGGFGFGEIISLVLSGGLSFSSAISL

SEQ ID NO: 12643 - protein, 2374 aa, Neocallimastix californiae
  POLYKETIDE SYNTHASE-RELATED
HILQSVLIQHYPNVIHMSMIPKEIQIENMMDPTETSSSVLEEHVIDSDPKVLYPKEYPKFAIIGTGIRLPGEINNKDDFWKVMTDKKVITGLIPEDRWDREEWYSKVEKPGTIQTLHGGFIENAFDFDNKYFGISQNEALDATPEQRWLCELTVETVEDANMDMDDFKGSHTGVFVGTSGMDYGSYVFSVPEKITKYTYSGIEPSIHANRVSYLFNLHGPSLSTNTACSSSMTALSIACNSMAAGDCEMALVAGTNFFQAPANGVAYSQLRVVSKKGACRPFDIGADGYARLEGAAMVLLKPYEKAIKDNNRIYATILSTACNEDGKTSSLTTPSSEAQCQLMKRVYSKGHIDPCTIDFVEAHGTGTSVGDPIEARSIGEAYGKVNKANGHPLLPVGSVKGNVGHGEYLSGIVGLIKGALILHKNTIVPQTAFETLNPKIHCDELGIRIADKVEPLPGKGRHRAAVNSFGFGGANANVILEEEPQVDKNNISVLMKRNKKGEIIPCAYVAFFSASNLRLLKETLKKWRTVPKQELLPMLYLNATTRNVLTHRLFIFTKDADEFYDTIRQFIEDEEDSISSGYRATEQFMYIETASDRKKGVTMAFDEPFFSTTSFLRNATFYDTCRDFYCNNSYFADCIDYCDQVLKMISGRSLLEDYGLFQSVKEEEKEKEKEKKNKLREDLLKDPTTTLLINGIIQLGLVALYRYYGISPNAVIGYGAGEIAAAYAAEKIDLKSAVQILYHYGRVLSMVKKDDNLSKVYSILVGCPVGKLSQVILSKLSPTEKELISISGVPSPTQCVLNGEMEILKKIMEQAKTEKIPILGSLMDSFAIHTKKISEAMKEELVKRLTNIKSKPSSIAMFSTTKFSKEGKPYTDALDGQYWWMNMRNPVLYAHSLSQTANFLPTDGKNILEIGLHFDHLVFKSSSLGFYQKDRIYNCFHYEENSSRDNSSNLNLNRNSNSNSTTVTATNYDIRFNQFIRFLCTMYGYNVCQKLKFGHLWETMVNVEGGDRTLQQLSSMHYDLPTRCWNHKYLRKLYKAKRNGLPGDVNIVKTKDVVYLEKMALTASSKKLEEKIEAKAKATSASLKNEGENMESKMMIKSATISTLRDEKKVGKDKKLEEISKKQNNSTPNLSMNTGNSNSNNNTGTSGPVDTKDRSGSSKSIPGKTQMISLVPYNYQKTKNSTLNGNSAVYSSKNLQKYSSTSSLSSTSSSSSSSSSTSLKNEKSTSKPASVLAAPISIPIPIKVSASEVKDRSTIKEEPLKKSVTKMPFTAKKEEAIENKEKEVLNEVKRNDDMMTKATEEDEFWVYENNQYLVDHKVNNQIVFPAAGSVSRALYGYERSRGIIESESIVTLNDLEFVGLTVFQKTVESQLRSKGLIPMKLYEDEDHQFILKQNDGSVISKGTFPPLHSPKESEVLSNFPEFSEVIKSCSTVKGGEGIRKEQIYQRANTIELQYGPQFQLIQHGRSGKKYSYAKIAVREDHAQMICHPAVLDNCFHSIICLGLGCGNRQVLPYKIKRLEMKNGGRFKEGILTCVSQLIYQDLSRVMVNLFIYDDAGEPFMKIDHMEFLIRKLKPIRPLEWYNVLCTEKLEENLEKRFPLSCHHVAVLCDKKQEEEVNRHLVSILSTFNHLSVYLITENHQESIQAILQSGSVPKEDFGMVDVTLLEDASLPTAFLKIQYYVKEGLNFVMGNIRLDHVKVSEDIENLFTASNGVPGMLKAARSESRKSQMFSIQANTVEQFAKGLFAGYLSIEEPDVMVNDSGELQAYRLIHQTTIPSIRSKNFVSEPKLVGHVNRMIFRKTYGIPDLQGSNSSSSSSNGSGSSGRERDKECVIVKVKTISLQNNDVLQNSYPELAEIMKGSSVIECVGTIVNVGSKVKKFKRGDFVFGISFYGDYVPSTYVKIPQDLVFAVDRKDTLKQQQLISSVYAYTVALYLLNEIQANESVLLTTNAVDLMQALVVIAQQKQISIVLDDRSKKYSRSPNPIFSNLFKSQRMIHSDGDRNQCVQQVKAFTNNQGVHYVIDANVKFDHEEVLEACLREGGEYIKVGNLDHHVKKRTTHKVVQMSALSVKQMAPLVREAIEKINKCTVEAIELKSYPLTKMNNATIEIISGRSQGKSCLIMEEEEEEEEKEKEKGRKGEQSVGYECLPGNIFKEDKSYLVTGAFGGVGLRVCLWMQLRGAHHLVLTTSSNPESKKDHPIVKALRQRGAQVSIVKCDISKYDEVEKLFKETSPSLDGVFHFANKFGPKLIRDSGLESFIATYEPKARGALNLHKISQKGYPLSTFVLFSSVLDLLGNTGQIAYGGANAFLGNLVYYRRRQGLSGQCFSLPAMKGSGYLSQWKQEGQFREFSEIIEFLDSEDLPDILDFFI

SEQ ID NO: 12644 - protein, 710 aa, Neocallimastix californiae
  POLYKETIDE SYNTHASE-RELATED
SNAIAIIGMGLRLPGAINNEKTLWSALVKGRDCVSNIPKDRKLHESYVNKPSNELNPGEHNVKKCGYYDSRTSGEKVSQFDAEFFNCLPEEAIGLDPKHRWILETSWEALENAGISPDSLEDSNTGVFVGIGDQQDHAQFMKECHRKKVVSYHNSNPSAIAGRLSYFYKLYGPSVTVDTACSTGATALHTACRSMIYGDCRLAMVTASKYLFYPEEFEMTSKARMTSPNGRCATFDKDADGYAPAEGCVTFILKCLEDAERDKDHILGVILGTSSGQSGFRQSISVPSFEGQARNIKRVMEIAGVNPSDISYVETHGTGTPYGDAIEIQGINQVYAGSHTPEHPLVIGSIKTNIGHTAETSGLAGIAKVLVAMKNKTIPRHLHFKTLNPEIDLKSVPLAIPTHNMKWETEEGKPRTALVSSYGLQGSAVNIILQEYIPPVQDEVDHANDHSVEKQLSRDIIGIKEKSLLTISARDKAALLVLGQKYINILDNMDADEDINNLCYTTNVGRQHFENRIVAVGEDVKSLSESLQDVMDKVFSFTEEEAASDEDEETSNNGKVDLDDHQTLAKKRVFKNIGMIFSSHYNQANSITDEMYKFACYLYRTYPVYAKALEECDRIISELSNFKVLLVNLIICMGELVQPDLLKEYKKQVDEDPCMAQFIILSMNYALTALLRHLNISINLVMGDGFGEVSAALACQKITLRNAFIL

SEQ ID NO: 12645 - protein, 535 aa, Neocallimastix californiae
  POLYKETIDE SYNTHASE-RELATED
NGKIAIIGMGLRLPGAINSAKSLWLALAKGKDCVLPPIKTRDLHRNYVNKPSDQLDPTEHNIPRLGLYDTRNSVAKPSQFDAKFFNCLPDEALALDPRHRWILETSWEALENAGIPPNSLENSSTGVFVGINDDHEYSDLLTECGVKSPIAAHGQSPSGIAGRLSYFYRLYGPSFTMDTACSTGASALHTACRSLQCGDCDLSIVSGVKFMYSSKDFYMTCSARMTSPHGRCATFDKDADGFVPGEGCVTFILKRLEDAVRDNDHILSVVLSTSSGQSGLRQSISAPSSEGQAINMRKAMKFAGIKPEDVSYVEAHGTGTPLGDALEVHALNEIYGGSHTEENPLVVGSIKTNIGHTCETAGLAGIAKVIVSMQHKHIPRNLHFNTLNPEIDIKSIPIQIPTKTLPWNSTEPNKPLIAQVSSYGLQGSIVHVFLQEYIPENKEQGEAKEAETEVENDKENHVLTISAKTYSALIELCNNYMNVLEKMEEENEDVSDLCFSSNIGRQHFDEFRLSVSGKNASELYSNLEKELEKLE

SEQ ID NO: 12646 - protein, 361 aa, Neocallimastix californiae
  POLYKETIDE SYNTHASE-RELATED
IDYFNEVELDSSGTVLITGGTGGVGFDICRYLVKQANLKGLVLTGRRPETDEKVAGRLAEIRALNPKIKITYVTANVGSEQEMKKVFDDINSGSPEEALVGVIHTAGTNDDGLIFNQSYERFAKLINSKIEGALCIAKLTEGLNLKFTILFSSMTAFFGNRGQINYCTANMFLNKVCQFYRSHNGRKDIMSLELAAWPSGLSSIIKDDTFMFNEINSINLISNLLNHVADIPAVVFGGPVINWNRVYDSSICDPIFRAVRPADRPRIDWRTANDSEYVKTVLTSGQNSSENIAEDAAVASDPKEISKDNIFEIMETELKRILQYGENDEIDPYQSLTELGIDSLMMMEFRTILKNVTTVNI

SEQ ID NO: 12647 - protein, 491 aa, Neocallimastix californiae
  POLYKETIDE SYNTHASE-RELATED
VECVGTIVNVGSRVKNFKRGDFVFGISFYADYVPSSYVKIPQDLVVVINEKDSQKQQRLISSVYAYTVALYLLNDIKEDESILFSTGANDLMQALVTVAKQKRIPILLDDVSQKYSRSGNPIFTNLLKDQRIVNSGDHDQCLHHVKQLTNGHGVHYVIDANVKSDRENVLKECLSHKGEYIRVGHFSQNVIKKSISNRVIQMNALSTKEISPIVRKAIEMINDYSVEAIELKTYPLSQMNRAILEIISGRSQGKSCLVMGEEDIEYDCLPSRVFKEDKSYLVTGAFGGVGLRVCLWMQLRGAHHLVLTTSSNPEMKYHHPIVNALRQRGAEVTIVKCDISKYNEVEKLFKETTPVIDGVFHFANKFGPKLIRDSNLSGFISTYEPKARGALNLHKVSQQGYPLSNFVLFSSVLDLLGNTGQIAYGGANSFLGNLVYYRRSKGLSGQCFSLPAMKGSGYLSQWKQDEQSREFSEVIEFLDAEDLPDILDFFL

SEQ ID NO: 12648 - protein, 797 aa, Neocallimastix californiae
  POLYKETIDE SYNTHASE-RELATED
VAVVGIALRLPGGINTVDKYWKSLESGRFCISPTGTNRLLHHNLTHNEHLNPGEHYIFNYCRYDSTSDVSPITDFDPLFFNMNPSEATVLDPKFRWVLETTYEAFQDAGINPDTLSGTRTNVYTAPGQVDEMNTYTIDASPTGYSILNGMSMHSCAAASLPGRISFMYNLYGAAHTVDTACSSGLVATHDAFKDLNIGETDLAIVNAAHCPFQSSGFSLLSVAKMVSRNCRCAAYDEAADGYVPGEGCVSIILKRKDDAIRDHNKIYGLINATAVGQSGSRASMSTPSAIGQKIIHEEVLKNANLTPKDIDYMEGHGTGTKLGDRIEGEAINEVFKGSHSESRPLTLASVKTNIGHTEEVSGLASLVKVLLAMKYKTIPPHLHFHKPSSSIDFDSVPLHIPTQKEEWKAHDGKNRIALVSSYGLSGSVCDAVVEEYVDPEVKEVYPVNNTYHVLTISAKNNTALTAVAEQYITLLESLDKNAPIADLCYTSNVGRQHFNYRYAVAGRNASELAAELTEFVNQNKKAVRTFKEEVGMSFTGQGSIKPGVGQELFRSQPVFHAAMEKCDAVVKKVTGVSIIDALYDQSQAHHLKKAQIAQPALFAYEYAMCMLWKSWGVEPVIVNGHSLGEIVAAAVTGAIDIDLAIDFIIERARCMGEYGEKPGAMVSIFQNEKTVKEAIEEFGYEEEVAIAAINGVTHTVISGYEEEVDDITQYFSEMNIKTKKLNVTDAFHSPLMDPAIEELNNWIEEKDDAKFRQSLKVKFISNLDGTIKPVGDRLEEDYWAKHARNAVRFVDGV

SEQ ID NO: 12649 - protein, 733 aa, Neocallimastix californiae
  POLYKETIDE SYNTHASE-RELATED
IAIVGIGLRLPGGINSTKKFWFSLIKGKNCLSATPTDRELHLGMVDMSKKPPEYRLNKNEHYVCRYGIYDSHYASSGVKYTDFDANFFDCSTEEAISMDVKQRWMLETSWEALEDAGIDPSSIENSDTGVFIGMNNCYHQTKLLSSKKATNISSSFNPTTLHCTDLSSVAGRISYFYKIYGPAISMDTACSTGATALHTAYRSMQYGECDLAIVSGARFLYYNDEFINTSHAKMASPNGRCATFDEDADGFAPAEGCVTLILKRLDRAEENNDNIYGILLGSSNGQSGGRQSISVPSSEAQVRNIKNALKDAHVSPKDISFVEAHGTGTPYGDAIEIHALNQIFKDSHSKKSPLYIGSVKTNIGHTCEAAGLAGIVKVLLSMKHNVIPKHINFKKLNPEIDLSMVPFCIPSQKNIRWTSPDPSKPLIAEVSSYGLQGSITNVILQQYLPPNWTTKVRSINKKISEQNVNPGNGKEWNIDNFSGRKEVQEGEEDDEYEEDDEDIRHKKYFLVTVSAKNEAALLHLTEEYISSLEEIEEDKKHWKRRLANYCYSSNVSRKHFNVRISAVGENISKLTEELENQMDGLSSKLNVSNPKLKSSPISSPQWNTSSIGVYYGDESDFNLNFIQSIKDVYQNYDYYKECFIYCEQKIQKLGGDKKYPMFDVVFEHDKINIDTLDPIVKRLIIFSHFYSLHKLFLNFNISINAISGKGIGEYFTLAISYALSLEDSLRLLI

SEQ ID NO: 12650 - protein, 733 aa, Neocallimastix californiae; identical to SEQ ID NO: 12649
  POLYKETIDE SYNTHASE-RELATED

SEQ ID NO: 12651 - protein, 728 aa, Neocallimastix californiae
  POLYKETIDE SYNTHASE-RELATED
IAIVGIGLRLPGGINSTKKFWHSLLQGKNCLSTTPVDRQLHLGMIDMAKQQPGYKLNKNEHYIHKYGYYDSIHTASIAKPTKFDANFFECTNEEAIGMDVKQRWMLETSWEALEDAGIDPSTLENSNTGVFIGMNNSNHHIKLLSSEKATNVGPNFSSVTLHGTDLSSAAGRISYFYKLYGPAISIDTACSTGATALHTAYRSMQYGDCDLAIVSGARFLYYNDEFINISHAKMTSPKGRCATFDESADGFAPAEGCVTLILKRLDDAEESNDDIYGILLGSSNGQSGGRQSISVPSSEAQVRNIRNALMDAQISPKDISYIEAHGTGTPYGDALEIHALNQVFGESHTKNSPLYIGSVKTNIGHTCEAAGLAGIVKVLLSMKHQIIPKHINFKKLNPEIDLETIPLCIPSQKNIHWTSSDPSKPLIAQISSYGLQGSVTNIILQQYLPPRWTTKVNNTTKKTIEENINGDYMKEENINNKVEIEAYEVEDEGEEDEVQHNKYFLVTISAKNEASLIQLTKEYINELEELEEDKNHWKRKLTNFCYSSNICRKHFNTRIAAVGENVSDLIEELENRIEDLSLMLKIVNQKSKNSPQSSPQWNSSNIIIYYGEENDFNLEFIQSIKEIYQYYDYYKECFIYCEQKIQSLGGNKKHPMFDVVFDSNYSDIKNLDPIVKRLIIFSHFYSLHKLFLNFNVSINSIGGEGIGEYFALAISGVLSLEESLKLLI

SEQ ID NO: 12652 - protein, 232 aa, Neocallimastix californiae
  POLYKETIDE SYNTHASE-RELATED
EDLLKDPSTALLISGIVQFSLVSLYKYYGITPSVVIGYGAGEITAAYAAEKIDLKDAVQILYHYGQVLSMANNSSPKVYSFLVGCPVGRLNHMMVSKLTPSEKDLISISGIPNPRQCILCGEMEILKKVMKMIKDEKVPILSGFMESFGIHSKIITEAMKDELTKRLENISSHSSSIAMFSTAKFNEKSEPYTGALDGSYWWMNMRNPVLYAHTLSQTVNYLPSDGKNILEI

SEQ ID NO: 12653 - protein, 233 aa, Neocallimastix californiae
  POLYKETIDE SYNTHASE-RELATED
WEALENAGIAPNSLENTLTGVYVGINNEHEHEDLLKKCGIVPPLGSHTLNQSSIAGRLSYFYKLFGPSFTIDTACSTGSSALHIACNAMKRGECDLSIVTGVKYMYSSKEFHKTCSAHMTSPKGRCATFDASADGFAQSEGCVTFVLKRLDDAIRDKDNILTVILGSVSGQSGLRQSISAPSYEGQALNIERAMKIAGISPDQVSYVEAHGTGTPLGDAIEIHALNEVYAGSH

SEQ ID NO: 12654 - protein, 551 aa, Anaeromyces robustus
  POLYKETIDE SYNTHASE-RELATED
KDINSNKIAIIGMALRLPGAINNAKSFWMALAKGKDCISTPVKDRKLHLGYVNKPSHLLNENEHNIPRCGCYDSRSNVAKPSEFDAEFFNCLPEEAMALDPRHRWILETSWEALENSGIAPNSLENTITGVFLGINDSHDYHDLMKENGITPPIAAHSTPSGIVGRLSYFYKLFGPSFTIDTACSTGASALHSACRSLQFGDCDLSIVSGVKYLYTSNDFHRTSIARMTSPKGRCATFDKDADGFVPSEGCVTFILKRYEDAIRDHDNILSVILGTSSGQSGIRQSISAPSSDGQVINLKRALHFAGVDPSDISFVETHGTGTPLGDAIEVNALNQVYKGTHTSENPLIIGSVKTNIGHTTEVAGLAGVAKVILSMQHKYIPKNLHFNTLNPEIDIESIPIQIATKTIPWENKNNKPRIAQVSSFGLQGSIVHIILQEYLPEKEQNEPKEPKEPKEQKEQNNEIENMENNKDSKDSKKEEDHILTISAKSPLALLELSNNYLNILESMEDNNENIENLCYTSNIGRQHFNYRISAIGKNANELYEDLEQKI

SEQ ID NO: 12655 - protein, 543 aa, Anaeromyces robustus
  POLYKETIDE SYNTHASE-RELATED
IPKSIASNKKDSDSNKIAIIGMALRLPGAINNAKSFWMALAKGKDCVTTPVKDRKLHLGYVDKPSHLLGENEHNIPRCGCYDTRSNVAKPSEFDAEFFNCLPEEAMALDPRHRWILETSWEALENSGIAPNSLENTITGVFLGINDSHDYHDLMKENGITPPIAAHSTPSGIVGRLSYFYKLFGPSFTIDTACSTGASALHSACRSLQFGDCDLSIVSGVKYLYTSNDFHRTSIARMTSPKGRCATFDKDADGFAPGEGCVTFILKRYEDAIRDHDNILSVILGTSSGQSGIRQSISAPSSDGQVINLKRALHFAGVNPSDISFVETHGTGTPLGDAIEVNALNQVYKGTHTSENPLVIGSVKTNIGHTTEVAGLAGVAKVILSMQHKYIPKNLHFNTLNPEIDIESIPIQIATKTIPWENKNNKPRIAQVSSFGLQGSIVHIILQEYIPEKEQKEQNNEIEKIEKNKDSKEDHILTISAKSPLALLELSNNYLNVLESMEDNEENIENLCYTSNIGRQHFNYRMSAIGKNANELYEDLEQKI

SEQ ID NO: 12656 - protein, 847 aa, Anaeromyces robustus
  POLYKETIDE SYNTHASE-RELATED
AIIGIGCHFPEGIESKEDFWQMLEDARCITKDIPKERWDKDEWYSEEPIQGTIQTKRGAFLKNPYLFDNKYFYISMPEAKEMSPEQRWLLELTVETLEDANIKPETLKGTRTGVFIGSSGCDYLATQISHANDINSHSPTGFELSILANRLSYVFDLQGPSISCNTACSSAFSALNIGLNAMITDDCEMALVAGSNFMNCPGGFVAFSQLRVVSPDGSCKPFDEKANGYARLEGAGMVLIKPYEKAVRDGDKIYCAIVGCGSNEDGRSPSLTMPSYEAQYKLLTHVCEKSGIHPTQIDYVEAHGTGTKVGDPIESRAIGDAYGKSKGIRGPNDPPILISSVKGNTGHGENSSGIVSIIKTSMMLHKRRLVPTVAYHHMNPAINAEKLGIKVCETLEDWKTPHLLHAAVNSFGFGGANTNTILEEVPHLNSKDIQLHISQEKPIVAKISGYSEKLVLQQLEKWRQVPIETLLPQLYLSNTCREDSHYRISFILDDPNKFYEYTDLVLKGRSHINVIKYNNKISAKPKLAFTFSGQATQYPDMGRQLYHSNPYFASIINYCNEIIIRLSQKDLIKDTGLFSDTPVDEEKLIDPQYSFLAIGIIQLALVEFWKLYGVEPALVFGHSMGEVAAAYAAGILTIEDAILLLYNYGLISQNVDDIHEKSGMLALGCSAEEAKTTYLNGKDKNRVYIASINSEKDITLGGDLNQLDAIMTQAKNNNVFTVMLKVKKAFHTPYIITAKQKFIQGIQGIGSRVNSPKIPFISSTYGKEYQGPFDEEYWWTNIINPVNFSQATKVARTKVEKVLEIGSTPVLGIYMSKIFNPDNIFYSLSRKLKDYHSLSRNIANMYA

SEQ ID NO: 12657 - protein, 677 aa, Anaeromyces robustus
  POLYKETIDE SYNTHASE-RELATED
EKIAIIGMSLRLPGSINSAKSFWMALAKGKNCVLPPVKNRDLHHGYVNKPSDQLNPGEHNIPYIGCYDTRSNVAKPSQFDAEFFNCLPDEALALDPRHRWVLETSWEALENAGIPPNSLEDSLTGVFVGMSQDHEYADLLAERNIIAPIAAHSNTQSGIAGRLSYFYRLYGPSLTMDTACSTGGSAIHTAVRSLQNRDCNLSIVSCVRYMYTSKTFYKTCAARMTSPHGRCATFDKDADGFASGEGCVCFVLKRLDDAIRDNDHILSVIIGTSSGQSGLRQSISAPSSEGQAINIKRAMEIADIKPEDVSYVEAHGTGTPLGDALEIHSLNQVYAGSHNEENPLVVGSVKTNIGHTGEVAGLASIAKVILAMQHKHIPKNLHFNTLNPEIDIESIPIKIPTKTIPWTSPVPNKPLIAQVSSFGLQGSIVHLFLEEYIPKEQQDNESTKKIETETEVANGSEVSDEEEKEEVEEINENDRENHILTISTKSYSALNELSNSYMNILEEMEDENKDIRDLCYTSNIGREHFNDYRISAYGKNATELYNHLEEALEKFEEKMEVINKQKENETNNMNNSKKPNQILNVYSENIKQGIINDIFKKLMFELYIVRSEFKKVIEFCDNYIYQISNKEFSLIDYLTNENNVEISKEYQNIIILVFYCGLSKILNKDIDCTQPVN

SEQ ID NO: 12658 - protein, 916 aa, Anaeromyces robustus
  POLYKETIDE SYNTHASE-RELATED
PIAVIGMGIRLPGGINTPGKYWSALVSGRDCTSPTPTNRHLHHYLKPGCPANELGPMEHYIHRGGFYDTTPDAAPLSDFDPTFFNISPLEAKATDPKFRWVYETVYEAFQDACINISELNGSRTSVYCTVGQILDYVSVARAFNKSENMTSQTMHGSNPSSCAGRIAFNYGFTGPSDTIDTACSSGLNDVNNACKALSCGDTDLAVVSAVHQQIIGTQFHVISVAQMASHLGRCATFDAEADGYAPGEGCISLILKRLDEAVTDHDRIYGVITGISTAQSGTRRSISTPAVGPQAENMRRVLSMANINASDVDYLEAHGTGTPVGDAIETETLNLVFGKTHTEKKPLIVGSVKTNLGHTEEVSGLAGLCKVLLSMSHRIIPPHLHLKNLNPRIDLSVIPMTIPQKKCIWKSPRGKKRIGVVSSFGLQGSIANAVVEEFKLPKSDDQRLDEGYDLSMYHILTVSGKNKNALIQQIEEYISIFEAMNEDDSIADICYSTNIGRQHFSPYRYSAYGRNPSELIENLTGFLQHVDVGRRYQSKSSAFAFTGQGVAKVGMGKHFYQTQPVFRKAMDKCDEVTRRLLNVSIVEVLYNISNAPNGIEKGENALKKSSVAQPALFAYEYAMSQLWISWGVEPSMVLGHSLGEIVATTIAGGIDFELAMEFIVQRASCMEKYGIKPGAMVSIFTTESAVKEAIEEFEFENVSIAAINGTTQTVISGNADEVKELEEYFIEQEIKAKPLNVTEAFHSALMNPAIEKLYEWIETKPDDKFRKPLKYGLISNVTGELIPAGERLPKNYWGEHARNAVQFVKAVETLLANSETLLNVIEVGPSNVLTNMSARILREKKIDKYTNPFFVASASPRVEEEKGLFEAVSKVYNVGKDINWRSFHKREDIYTHVCPILKKTSIPLYPFQRSRY

SEQ ID NO: 12659 - protein, 2192 aa, Anaeromyces robustus
  POLYKETIDE SYNTHASE-RELATED
FKQSSLELLSQLLITMKQITQKPGINPEYENLIQVAVVGIALRLPGGINTVDKYWDVLVNGKFCATPTGTNRHLHHYMTTAEHLKPGEHYVTKYCRYDSTPDAAPITDFDPMFFNMNPSEAAALDPKFRWVLETTYEALQDACINPDSLSGTRTNIYTAPGQVHEMNNYTTSASPTGFSVLNGQSMHGVACASLPGRISFMYNLYGAAHTVDTACSSGLVAAHDAFKDLNIGETDLAIVNAAHCPFIGSGFSLLSIAQMVSRNCRCAAYDEAADGYVPGEGCVTVILKRKDDAIRDHNKIYGLINAAAVGQSGSRSSMSTPTVEGQSRIHKEVLKLAHLEPKDIDYMEGHGTGTSLGDRIEGEAINLIFKGTHSETRPLTLASVKTNIGHTEEVSGLASLVKVLLAMKNKTVPPHLHFHNPNPSIDFKSVPLHIPTQVEEWKPVEGKKRVALVSSYGLSGSVCDAVVEEYVDDNDNNREVYPVNDSYQVLTISAKNNAALIAVAEQYISLLESLDSDAPIADLCYTSNIGRQHMNYRYAVTGRNASELAAKLTEYVHQGKKTVRSDKTEVGMSFTGQGSIKPGVGQELYRSQPVFRDAIDKCDTVLKKVTGISLVDVLYNPQQAHHLKKAQIAQPALFAFEYAMCMLWKSWGVEPTIVNGHSLGEIVAAAVTGAMDIDLAIDFIVERARCIGEYGEKPGTMVSIFEKEDVVKKAIEEFDTQEEVAVAAINGVAHTVISGYEDEVDDITEYFKQMNVKTKKLNVTDAFHSPLMEPAIEELDKWIEGKDDEKFRQPLKVRFISNVDGKIKEVGERLDENYWAEHARSTVRFVDGVKSMIESENNNILAVIEVGPAATLSHMSARYVRENEALRGKGPHFIPSGSADQNSEQYLFDALSNFYMVGGNIDWNAFHKARVDSATGKEIPHHLYNLPLYPFQRSRYWLETAEQMKTPFDSGNNANWDLYKSVTVINGNNDNEVIVSAPLTPQYVKYLSKNHVIIGHGCVPAAAYTEFIFTAMKALNNNRDDLIEITDEMFVRNPLDIEEDSEVDFIMKKRGDRFAIYAKLDGGVENHMLNGSACLLKDGDNANLLETLPSKEEMKSFINKYLNEETMYSSQIIYDSIFEHSFYGGGFPSVKGFNVAKDEKGGFLISRLDSKDKTLNNIRSGLSQVYLFDSSIHSNAGRMCLEKLQKKEEDTGPNVPFLPSTFENIIKIKPTPDECYVIHRFIEGTEANSNFTSFSVYDLDGNIVEYIGSYQTRRVNMENFQTSPEFEIYDYEFVEVKSPHKDMKTLPYFYILGDHKGYADAFVEYMKSKEGNNFHYIKADFPNKEACNEELIEGHLKELGITTSGMENEVIATVNFMAFDLPHLQPENIDHTSDEFKELLRHTYEDNLIFIQNFTRVIDTYEIERSFCFVTKNASDYYENEVDLLQALIYGITKSYWREFTDTRVFEVDNHESATPKEVSEHVYTEVVSSVDRYDVTREVVYGKDNKRYENKIRKVVAPSVNYTGEGSLDFSGTILITGGLGGVGYDVSKYLITKPNLKALVLTGRRPETDEKVAAKLNDLRSASKNVKIIYAVANVNSEEEMKKLFDDIAASENPLTGIIHTAGTNDDGLIFNQSYERFMKLVPGKVEGPLIITKLTKDIPNLKFTILLSSMSSFFGNRGQINYTTSNVFINKLCRYYRAHGRKDMVALQLAAWPSGLSSIIQEPTFHLNEINSINLISNFASVPGDIPASAFGGPVIKWNDVQDHAICDPMYRPVRPANRPRVNWKVDNDTAYVPKSVSSSSLALNAGMGSKGDSGIGNKSSSNEVTEDNVYAIMESELKRILQYSENDEIDPYQSLTELGIDSIMMMELRTILRTATGVNIPLVVFSTQNICLSRLVDYVKSKLAKEKEEAAKKTPEITEEEKKAKAAEEQKAREEEAKLISNDQIDQWIVPVPGCEDVEDPLNVFIFFPSADEGEIDYSEYVEKMEDSLLFTVNLPGYGVRKDEPFINDWDLLIKNITKAIIQTDISGKFKECKTIHFVGNSFGGIVAWKTLLQIQAYEDEDKEVPIISTLIISRAIAPTAKRPIELGGEVLSNLPNEGIATFLKGIESKVDFSDDKAYLLPIIHNEYLMNDAVTNESNMKIRSKLLMFSGKQDKIIDDNNTSLWKKEVSDEFSEFTQHIKMRGNHWFVMKDTSKYLKNIMENL

SEQ ID NO: 12660 - protein, 2113 aa, Anaeromyces robustus
  POLYKETIDE SYNTHASE-RELATED
KIAIIGVGCRLPGDITTKEDFWNMLVTKRVVTSEIPADRWDREEWYSKEPIPGTIQTKHGGFLSNAYDFDNKYFSISQAEALEITPEQRWLCELAVETMEDANIRPEELKGSQTGVFVGSAGIDFGGNQLVNTLQMSAHTMTGLEPSIFSNRISYIFDLHGPSITSNTACSASMSSLSMACNAIAVGDCDKAFVAGSNFLPTPGGYVAFSQLRVVSKTGSCKPFDEKADGYARLEGACMLLIKDYEKAIRDNDKIYATIIGSGTNEDGRTLSITLPSSDAQCALMKWVCEKSNIKADTIDYVEAHGTGTPTGDPIEARSIGNAFGKVVRTPGSKPLPVGTVKGNVGHGEFLSGAIGLLKTSLMLFNKQLVPTAAYEKLNPKIDVNGLGIRVADKNEPMIKINGKVNTPLRAAVNSFGFGGANANAILEAVESIKVETVDIIKRENTLPLMVSFTGFTAKALVAMIKEYLKLPVEQLLPKLYLATTTRQIHTHRVTFLLDNANEFYELGNAFVENKSHPKVIYNLVKASHKQGITFVFRGISELNSNFSYSLYKYNQKFAKIVDYCDKVLEKVSQGLSLKRDYGLFQKENFDETTLRDPKISVIGSGIIQLTMAHLLKSYAIIPSSVVGYSIGEISAAYAAGIISLEDAVLILYQYSSILEKVPGKEDIYTVELGCSSDQAQVNILSQLSAPVYIVSNSTSNICTLCGNSTFLNQAIQMAQQLNIPILSNLTPGSNGICTPYLNDFKDEFYESLRDIGSRCKDPVIPFISTTLGQPFNGPLNEFYWWANLTSTVNFSSALSLAMNEQPNGSGYILDVGSGYSSTLFHNYLTAYTSEDKIFATYDSTGNNDAYAFLYTIVNLFERNAIPLPAMDKIWETSADVVGVDSFKKIRSVNFILPPHVWEHKTIKKIYNKDVFISLKKNQELTERQKEQVLLTGGITVDHDDKLNVEIANLKKEISEMTKKEAQKARDLAIENAKKINEMKKKFETEKEQEIKKKVDEEKRIILKEARGFISNEMQKMKKNASSISRTASPVPVPVPVQNSNPVKTAPSVISYSGNNEAWNYENHKYLVDHIVGKDVVFPAAGSVSRAMYGFKQSRGEHNFDSEKIIVLEDLEFLHLAVFQKSVQDQLNMKGPIPLSLIEEGEGKYTLIQKDGTPVSKGHFYEPQLTQTREENANLLNDVPPFEEFVNRCSTKVGGNGVTASQLYHRTDELGLKYGPNFQLVQNGRAGDNVGYARIKVDEDKSKLICHPAVLDACFHSIIGIGIANGDRQPLPNKIKRLIIGRGGYFPQGTIICAADVIKHDLKNVVVNIYIYDEEKKPIAKIEEMDMIIHPLSILRNERWIKYMGEEVLAPSAQDQLPLQNCTSIVVIGEKKQEFEINSLLLPRIAPLQSIIYMILDNYDEQFKAMLAANVLVPSSTFVIDVRYLINPSIDYAYSTMKFLLENHFNFVYGNIDTGDNLVFDETYENMAFGNSIAGLLQVARAESKTNMIYSIQAENLEKFTHGLLRGNLRIEDPDIRVKEDFRITAQRIIKNPVIPDIKTKNYTLEHSSTGQIGKLKFREVFGLPECSPDEVVIKIHSVALQFKDVMSVMNNLPGYNVYEPGMESNGYVVKIGENAKKHINLKIGQPVFAFTHKYGHMVSTYGKAHYKLVKPMMNNDMNPENYSSVIVLGTVLYALRDRAGGVKPGQSILIQSAAGGVGQAAIKLCKYWGAKIYVSTSTKKREYLKNLYGLEYITDSRNPKIFYEDIMKWTNNEGVDFVLNALAGDGITYGLKCLKKGGCFVEIGKKNIILNTPLGLKSLMNNINFCSAHIDLLDVDKLSSLMNESFEFINTGKITPIPVTLVPVKKYLSAFFNMASGNNVGKTCIVMDDDYEPSCKPVNLVKESKSYLITGAFGGVGLRVALWLQLRGAKNIILTTSGNAEKRNKNPIVEGLRNKGVNVLVRQCDISDINAVRKLFQEANPPIAGIFHLANKFAPGLIERTSLEQFHVAYNPKARGALNLHLVSKNYPVDMFVMFSSVLDLLGNKGQAAYGAANSFLGSLVELRRSQGLCGSCLSLPAMKGSGYLAQFKQERQANQFKGLITMLDSDDLPELLDEVIHYSMPPSVLIL

SEQ ID NO: 12661 - protein, 605 aa, Anaeromyces robustus
  POLYKETIDE SYNTHASE-RELATED
NTNNTIPRSLNDETHYEKIAIIGMALRLPGAINNAKSLWMTLLKGKNCVVAPVKNRDLHTNYVNKPSNQLLPNEHNIPYFGCYDTKSNVAKPSQFDAEFFNCLPDEALSLDPRHRWILETTWEALENAGIPINSLKNTTTGVFVGINDDHEYSDLLEENGISIPISSHSNHPSDIAGRLSYFYNLYGPSYTMDTACSTGASAIHVACRSLQNRDCNLCMVTGVKYMYSSKSLSKACSARMISPHGRCATFDIDADGFVPGEGCVTYILKRLNDAIEDNDNILSVIIGSSSGQSGLRQSISAPSSEGQALNIRKAMEFAQVKPEDISYVEAHGTGTPLGDAMEIHALNEVYAGTHSKENPLIVGSIKTNIGHTCEVAGLAGLAKVIVSLQHKHIPRNLHFNKPNPDFDLNSIPIKIPTKTLPWNSLKPGKPLIAQVSSFGLQGSIIHLIIEEYIPKNISINKNEIKNENENKNINEKEYEIKNENEDENKNINENENENHILTISAKSYAALIELGYNYINTLERMEEENEDICDLCYTSNIGREHFNEYRLSAYGKNANELCNSLEKALDDLENKIHDENKLNHHNNNNNISSSPSSSSLSSSRK

SEQ ID NO: 12662 - protein, 464 aa, Anaeromyces robustus
  POLYKETIDE SYNTHASE-RELATED
GSIPKSLSTDKSLTDNLIAIVGIGLRLPGGINSTQKFWLSLIKGRNCLSNTPTDRQLHQGFVDMQKNPNKNLDINEHYIGKYGYYESVRGTAKPTDFDADFFECSKDEAIGMDVKQRWILETSWEALEDAGIDPSIIENSNTGIFVGMNNCNHHVKLMASKEATNINSNYNSITTHGTELCSVAGRLSYFYKLYGPAISIDTACSTGATAVHVACRSIQMGECDLAIVSGARYLYYNDEFINTSHAKMTSPNNRCATFDESADGFASSEGCVTLILKRLDEAEENNDNIYGVILGSSNGQSGGRQSISVPSSEAQERNIRNAMKNANVSPKDISYIEAHGTGTPYGDALEIHAINQIFGHTHTQDSPLYIGSVKTNIGHTCEASGLAGLVKVLLSMKHQLIPKHINFRKINPEINLDLVPLNIPYQKCIPWKSSDPTKPLIAEVSSYGLQGSVTNIILQQYIPP

SEQ ID NO: 12663 - protein, 1934 aa, Piromyces finnis
  POLYKETIDE SYNTHASE-RELATED
FFQQSSLELLSQLLMTMNQMVQKPSVNPEYQNQVQIAVVGIALRLPGGINTVDKYWNSLVDGRFCISPIGTNRHLHHYMSKEENLKPGEHYIYNYGRYDSTPDAAPISDFDPMFFNMNPNEASALDPKFRWVLETTYEAFQDAGIDPDVLSGTNTSVYTAPGQVDEMNRYAILASDTGFSVLNGMSMHSCAAASLPGRISFMYNLLGAAHTVDTACSSGLVATHDAVKDLNLGETDLAIVNAAHCPFMSSGFSLLSVAKMVSRNCRCAAYDEAADGYVPGEGCVTIILKRKDDAIRDHNKIYGLINAAAVGQSGSRASMSSPTVIGQTNIHKQVLKKAGVNPSDIDYMEGHGTGTKLGDRIEAEAINNVFKGSHSKERPLVLASVKTNIGHTEEVSGLASLVKVLLAMKNKTVAPHLHFKNPSPLIDFDSVPLHIPTQKEEWKPAEGKKRTALISSYGLSGSVSDVIVEEYIEPETKEVYPINDTYHVLTISGKSNAALIAVAKQYIELLESLDSNAPIADICYTSNVCRQHMKYRYAVIGRNAAELAAELNEYVNQNKKNARSDKTEVGMSFTGQGSIKSGVGLELYRTQPVFRDALNKCDVVVKKATGISLIDALYNPSQSHHLNKAQIAQPALFAYEYAMCMLWKSWGINPTIVNGHSLGEIVAAASTGAMDIDLAIDFIIERARCMGEYGEKPGTMVSVFEKEDVIKEAIEEFGYDEEVSVAAINGVTHTVISGYEDEVDDITEYFSQMNIKTKKLNVTDAFHSPLMDPAVSELNKWIERKDDSKFRQDLKVKFISNVDGNIKPVGSRLEEDYWGKHARNAVRFVDGVKSMIESEKKLLAVIEVGPAATLTNMSSRFVRETESLRGTGPTFIASSVADQNSEQYLFNALCKFYMIGGNIDWNVFHQRIDPTSGKVIPHSLYDLPLYPFQRSRYWLETAEQCAQPIDGGSNKANWDLYKSVTIISNNESELIVAAPLTPQYVEYLFKNHVITGYGCIPAAAYTEFIYTAMKAINNYEDDIIEICDEMLIRSPLNIKADSNVDFLMKKKGDRIAVYAKVDGGIENHMLNASALLLKEGENADLFDTLPKPDEVKALIEKIMTKENTHSSDILYDSIRESSLYGGGFPSVKEFAVGTNDEGSTVLVSRLDSKDRTINNINSGLSQVYLFDAALHSDAGKDTLVAIKKENMGDPFLPSSFENLIKYKPIPDDCYVIHKHMEGTEPNAAFTSFSVYDLDGNICQYCGAFQTRRVKMKTKETDPEFELYTIDFKEIPTPPKEITKTPFFYILADNKGYADTFVKYMKSKVSDFRHVKINMPTKDECSKELIQQNLKELGIKESGMEEETIAVVNFMAMGLEVQEASSIDPSSTAFNDILRSTYENNLVFIQNFTQIIDVYDCKKSFCYVTKNATDYWKGEIDLLQGIVSGISKSFWKEYMDIRVFDLDNDRNASKEDISSRIYTEVMSSVDRYNVSFEVIYDKNGKRYEGRIKNFKSPAVNFAGESEHNYTGTILITGGLGGVGYDISRFLMKQPNLKGLVLTGRRPETDEKVAAKLSSIREVNKAIKVTYITVNVGSQTEMKEVISGIKASGSKLTGIIHTAGVNDDGLIFNQSYERFAKLINSKIEGSHCIAKITEGMNLEFILLFSSMTSFFGNRGQINYCVANMFVNKIAHYYRSHGRKDIITLQLAVWPSGLTSKILDNTFQFNEYNSINLVSNLISHPGDIAPVVFGTPIVQWENVFDHNICDPIYRSVRPANRPKLDFKTANDQNYIREDTTTTQKVTESNSKKEISEDNIYEIMEHELKNVLQYGENDEIDPYQSLTELGIDSIMMMELRTIMRTATGINIPLVVFSTQNICLYRLVEYVKSKMVNEKKEEADAKTPVISEEEKNAKKIEEQKAKEEAAKLISDDEVNQWIVPVEGCEGIEDPLNVFI

SEQ ID NO: 12664 - protein, 587 aa, Piromyces finnis
  POLYKETIDE SYNTHASE-RELATED
YGIESLATIKLANILSRKFNKRYSPAILFNYGTTMLLAKHITGYENTSYSSQLLDKIPKELDNKSSNKIAIIGMALRLPGAINNSKSLWMALAKGKDCVLPPVKTRDLHTRYANKSADQLELDEHYLPRIGCYDTRNSVAKPSEFDASFFNCLPDEAVALDPRHRWILETSWEALENAGIAPNSLKKTTTGVFIGINNEHEHEDLLHDCGIIPPLASHATAQSSIAGRLSYFYQLFGPSYTIDTACSTGSSALHSACQSLQCNDCNLSIVTGVKYMYSSKEFHKTCSARMTSPNGRCATFDASADGFAQSEGCVTFILKRFDDAVRDNDNILAVVLGSASGQSGLRQSISAPSSEGQTVSIKRAMEKAGITPEQVSFVEAHGTGTPLGDALEVHALNQVYGGSHTEENPLIVGSIKSNIGHTCEAAGLASIAKVIVAMKYNLIPRNIHFNELNPEIDLSTIPMKIPTKTLPWNPPNDDTPLIAQVSSFGLQGSIIVTFLEQYVPEKKIALPKKEQHILTISAKTYPALLDLYDNYCSILENMDDDEDISNLCYTSNIGREHFAYRLVATGTNPLTLYNSLEEEMEKL

SEQ ID NO: 12665 - protein, 366 aa, Piromyces finnis
  POLYKETIDE SYNTHASE-RELATED
LETSWEALENANIAPNSLENSSTGVFVGINDDHEYSDLMTECGIETSIASHGSSPSGIAGRLSYFYRLYGPSFTIDTACSTGATALHTACRSLQHHDCNLSIVSGVKYMYSSKNFYKTCAARMTSPHGRCATFDKDADGFVPSEGCVTFILKRLDDAIRDNDNILSVILSTSSGQSGLRQSISAPSSEGQAINMRKAMEFAGIKPEDVSYIEAHGTGTPLGDALEVHALNEIYAGSHTEENPLVVGSIKTNIGHTCETAGLAGIAKVIVSMQHKYIPKNLHFNTLNPEIDVKLIPMKIPTKNLPWNSSDPNKPLIAQVSSYGLQGSIIHVFLEEYIPKNKNTENNANKKNSNINRNENENKNENEN

SEQ ID NO: 12666 - protein, 118 aa, Piromyces finnis
  POLYKETIDE SYNTHASE-RELATED
SIPSSSPHEKKNSEKIAIIGMGLRLPGAINNAKSLWMSLAKGKDCVLPPLKNRDLHRNYVNKPSELLDPSEHNIPRLGLYDTRSNVAKPSQFDAAFFNCLPDEALSLDPRHRWILETS

SEQ ID NO: 12667 - protein, 1697 aa, Piromyces finnis
  POLYKETIDE SYNTHASE-RELATED
VNSFGFGGANANAILESVDKIDVESVDIVKRGNTLPLMVTLTGFSAKALVSVVKEYMKLPVKQLLPKLYLMTTTRQIHSHRVTFLLDDANEFYELANAFVNNQPHPKVIHHLVKASHKQGITFVFRGISELKTNLGYSLYQNNKMFADVVDYCDKILEKISQGYSVKKNTGLFLKENLDAATLQSPKISVVGSGMIQLAMAHLLKTYGIVPSSVVGYNTGEIAAAYATGIISLEDAILILYQFSNILEKVPGKEDIYTLELGCSAEQAQSSIINQLSTSAYITGNNASNICTLCGSSAALNQAIQLAQQSNIPILSNLIPGSCGICTPFLNNFKNEFHEALKDIGSRCKAPATPFISTTLSQPFNGPLNEYYWWANFTSTVNFNVALSLAMNEQQKGSGYILDVGCGYSNALFNNYLASYAEADKIFATHDVTGANDALAFVYTIANLFERNAIPLPSMDKLWETSADVIGVDAFKKIRSVNFILPPHVWEHKTIKKAYNKEIFISLKKNQELTEKQKEQVSLTGGITVDHDNKYNVEIEKLKKEINEISQKEAKKAQEVAKENAKKIEDMKKQFELEKEQEIKKRVDEEKKIILKEARGYITNEMTKLRKSAANSRTASPLPVKTPAEKIPAAPAVMHYSGNNESWNYENHKYLVDHVVGKDVVFPAAGSVSRAMYGFKQSRGEYNFDNTRNIVFENLEFLNLAVFQKSAQEQLNKKGPIPLSLVEEGEGKFSIVQKNGIPVSKGQFYEPQLTQSKEENANLLDDVPPFEEFVNRCSTKVGGNGVTAAQLYKRTDALGLMYGPNFQLVQNGRAGDNVGYARIEVDEEKSKLICHPAVLDACFHSIIGTGIANGDRQPLPNKIKKFIMGRGGYFPQGTIICAADIIKHDLKNVVVNIYIYDEEKKPIAKIEEMDMIIRQLNVLNNKRWIKYMGEEVLASSQQDLLPLQNSSAVLIIGEKQQESEITSILLPRIAPLQSVIYMILDNYDEQFKAMLSSNVLIPQTTLVIDVRYLVNPSIDYAFTTMKLLIENNFNLVYGNIDSANKLVIDETYQNMAFGNSIAGLLQVARAESKNNLIFSIQSENLDKFTHGLLRGNLRIEDPDIRVKEDYRITAQRIIKNPVIPEIKTKNYTLEHSSTGQIGKLKFREVFGLPECGPDEIIIKIQSVALQFKDIMSVMNNLPGYNVYEPGMESNGYVVKIGENAKKHVNFKIGQPVFAFTHKYGHMVSTYGKAHYKLVKPMINNDMNPENYSSVVVMGTVLYAIRDRAGGIKPGQSILIQSAAGGVGQAAIKLCQYWGAKVYVSTSARKRKYLEDLYGLEHITDSRNPKTFYEDIMKWTNNEGVDFVLNALAGDGITYGLKCLKKGGRFIEIGKKNIIINTPLGLKSLMNNINFCSAHIDLLDVDKLSSLMNESFKLINTGKITPIPVTQVPIKKYLSAFFNLASGNNVGKTCIVMDDEYEPSCKPVNLVKEDKSYIITGAFGGVGLRVALWLQLRGAKNIVLTTSGNAAKRNKNPIVEGLRSKGVNVTVCQCDISNINAVRKLFQETTPQVGGIFHLANKFLPGLIPRTSLEQFHIAYDPKAKGALNLHLVSKDYPIDMFVLFSSVLDLLGNKGQAAYGAANSFLGSLVEFRRSKGLCGSCISLPAMKGSGYLAQFKQERQAKGFEGLITMLDSDDLPELLDEAIHYSMPPNVLIL

SEQ ID NO: 12668 - protein, 417 aa, Piromyces finnis
  POLYKETIDE SYNTHASE-RELATED
KIAIIGVGCRLPGDISTKEDFWNMLVTKRVVTSEIPSDRWDREEWFSEDPVPGTIQTKCGGFITNAYDFDNKYFSISQAEAFEITPEQRWLCELAVETMEDANIRPEELKGSQTGVFVGSAGIDFGGTQLANTLQMSAHTMTGLEPSIFSNRISYIFDLHGPSITSNTACSASMSSLSMACNAIAVGDCDKAFVAGSNFLPTPGGFVAFSQLRVVSKTGSCKPFDEKADGYARLEGACMLLIKDYEKAVRDNDKIYATIISSGTNEDGRTLSITLPSSDAQCALMQWVCEKSNIKADTIDYVEAHGTGTPTGDPIEARSIGNAFGKKVRSPNSKPLPVGTVKGNVGHGEFLSGAIGLLKVSLMLFNRQLVPTAAFEKLNPKIDVDGLGIRVADKNEPLVKINGKINTPFRAAVNSFG

SEQ ID NO: 12669 - protein, 977 aa, Piromyces finnis
  POLYKETIDE SYNTHASE-RELATED
TGTPLGDAIETETLNKAFGGSHTEKKPLVVGSVKTNIGHTEEVSGLAGLTKVILSMSHRIIPPHLHLNTLNPKIDLSVIPMSIPQKKSIWKCPRGKKRIGLVSSFGLQGSVANAVIEEFKQPKSSDIRYEQGYDLSMYHILTISGKNKNAIIQQIEEYIRIFEAMNEEDSIADICYSSNIGRQHFAYRCSASGRNAPELIESLTDLLQRMTSVRRYLPKSSAFAFTGQGVAKVGMGKHFYQTQPVFRKAMDKCDEVTRRLLDVSIVEVLYNISNSPNGVEEGEKALKKSSVAQPALFAYEYAMSQLWISWGVEPSMVLGHSLGEIVATTIAGGIDFELAMEFIVQRASCMEKYGVKPGTMVSVFTTQDVVEEAIEEFGFENVSIAAINGTTQIVISGNTDEVKELEEYFTQQEIKAKQLNVTEAFHSALMDPAIEKLYEWINTKPDEKFRQPLKYGLISNVTGELIEAGERLPKNYWGEHARNAVQFVKAVETLLANSETLLNVIEVGPANVLTNMSSRILREKRIDKFATPFFVASAAPRVEEERGLFEAVTKVYNVGMNIKWKNFHHREDINTHVCPILKKVSIPLYPFQRSRYWAGPDTTKYDIPFAMGIDPCEINRIAKEVGYKMEGFSNEGKNENDENGEVEDEYNNEFSNEQFNRFETPTVVDLDMNSNSGQKSASESNIIITVPLSTQYIRFLRRKHQISSTGFSPATSYIDFVFYALKYAYPNEQFKIDEYFITNGPLKLTDDQEVVYIMIKKGEEVTIYSQSRGSPQEVRGSVMISVVNNLDNEEATSKLDFDIKKDYVEKYLTVENANKSPNYGEGKELYQELDKSIVYGSFFRSVKSFYSGKDENGHDFLVSHIMHNVSDKDESLVNSGASQVGILDACIHCMGGDGIISNRNNTNNEKSKDTFLPTSFEGIIKYKDIPNEVYVLHRVKNVNETSKFTEYFVFNTEGKLVFSTDNFQVKKFDTTQI

SEQ ID NO: 12670 - protein, 1749 aa, Piromyces finnis
  POLYKETIDE SYNTHASE-RELATED
TGTPLGDAIETETLNKAFGGSHTEKKPLVVGSVKTNIGHTEEVSGLAGLTKVILSMSHRIIPPHLHLNTLNPKIDLSVIPMSIPQKKSIWKCPRGKKRIGLVSSFGLQGSVANAVIEEFKQPKSSDIRYEQGYDLSMYHILTISGKNKNAIIQQIEEYIRIFEAMNEEDSIADICYSSNIGRQHFAYRCSASGRNAPELIESLTDLLQRMTSVRRYLPKSSAFAFTGQGVAKVGMGKHFYQTQPVFRKAMDKCDEVTRRLLDVSIVEVLYNISNSPNGVEEGEKALKKSSVAQPALFAYEYAMSQLWISWGVEPSMVLGHSLGEIVATTIAGGIDFELAMEFIVQRASCMEKYGVKPGTMVSVFTTQDVVEEAIEEFGFENVSIAAINGTTQIVISGNTDEVKELEEYFTQQEIKAKQLNVTEAFHSALMDPAIEKLYEWINTKPDEKFRQPLKYGLISNVTGELIEAGERLPKNYWGEHARNAVQFVKAVETLLANSETLLNVIEVGPANVLTNMSSRILREKRIDKFATPFFVASAAPRVEEERGLFEAVTKVYNVGMNIKWKNFHHREDINTHVCPILKKVSIPLYPFQRSRYWAGPDTTKYDIPFAMGIDPCEINRIAKEVGYKMEGFSNEGKNENDENGEVEDEYNNEFSNEQFNRFETPTVVDLDMNSNSGQKSASESNIIITVPLSTQYIRFLRRKHQISSTGFSPATSYIDFVFYALKYAYPNEQFKIDEYFITNGPLKLTDDQEVVYIMIKKGEEVTIYSQSRGSPQEVRGSVMISVVNNLDNEEATSKLDFDIKKDYVEKYLTVENANKSPNYGEGKELYQELDKSIVYGSFFRSVKSFYSGKDENGHDFLVSHIMHNVSDKDESLVNSGASQVGILDACIHCMGGDGIISNRNNTNNEKSKDTFLPTSFEGIIKYKDIPNEVYVLHRVKNVNETSKFTEYFVFNTEGKLVFSTDNFQVKKFDTTQISKNNDFVLCNVEWTEYPVKPIVNGGLHVIVIKDKKGYADAFIKALKDRNITENVIGIDLPLQDNSNSTFVNCYRAIKAKSTAEGILALYNFSLLDLEEYTTKETGDELVKKYKDFYINSLETTQAFVRTTSEMKLKRTIAFVTMACSAINSSGANVNPLGYLVLGILKNANHEFLDIHGCSFDLEAGTPIDIATNQCIDEILGGVDRYDMPYNIAYKDGKRMTAVLTYDRSYDRAITEPVSGNLLITGGLGDVSMDVIENLLSDKETKLDHIFLLGRSSKTSTKVEDKLDRIEKIKKANNKKTEVEYYCCDISNGDSLNDVFNDIRKRQGLQINGIFHTAGTNDDTLFLTQTYEKFEKLAPAKVIGTHNIIKYTEDFKDELKFIILTSSLTALSGLTGQTNYTAANMFIDAIARYCRNHGRNNVMSLELCGWSGAGNADVLSSRSEVFVLDKIGGGNMFKLLFKLGGQTKESCCVGFPDVSHENCDEAIFHDYLYRVNLRPKNRPRTDLTTLSHHNLGQHDIEISEEDKSLSVQDILKKEIRRMLMYNEDDEIDEMQPLSELGMDSIMMMEFRQVIKAVTDIMIPLSIISSPNVYLSKIYQYLNNKAGSDITGGSKTQKSMSSSSVSEKKKSSVVAKREELKAKRAQKKSKAASSNEIEEGMKDYGEWLIRLDTNNNITNSFFLFPAAGSSISMYGNWNSYMKNSALFGVSYPGHLVRLDETPIDDLKTLVSAIAKEIMENIKNGNIPKDQPLYCFGHSLGALVSYEVVMLL

SEQ ID NO: 12671 - protein, 237 aa, Piromyces finnis
  POLYKETIDE SYNTHASE-RELATED
PIAVIGMGIRLPGGINTPTKYWNALVNGKDCISPTPNNRHLHHFLRPNCPHNELGPYDHYVHRAGYYDVVPDAAPITDFDPTFFNISPLEAKFTEPKFRWVYETVYEAFQDACIDISELNGSRTGIYCTVGGTFDYIGLTKAFVSGQTMTSQTMHGSAASSCAGRIAFNYGFIGPSDTVDTACSSGLNDVNNACKSLSCGDTDIAVASAVHHQYVSTQFHVISVAHMASQTGRCATF

SEQ ID NO: 12672 - protein, 93 aa, Piromyces finnis
  POLYKETIDE SYNTHASE-RELATED
GRCATFDASADGYAPGEGCISLVLKRLDDALTNHDRIYGVITGISTSQSGSRPSISSPAIIPQVMNIKNALQIANVTPEEVDYVEAHGTGTPL

SEQ ID NO: 12673 - protein, 504 aa, Piromyces finnis
  POLYKETIDE SYNTHASE-RELATED
NVGHGEYLSGIIGLIKSTLILHKNMIVPQTAFDTLNPKIECEKLGIRIANKIEKFPGQGRHRVAVNSFGFGGANANAIIEEEPQFDKNNISVLLKKNKNGEEIPCPYVAFFSNSSLRLLKETLKKWLSVPEKELLPMIYLNSTTRTVLAYRIFIFAKTTEEFYRTIRNFIADDSLDNGYKVTDQMMYIETKSNRKKGTLMAFDEPLTYVNSFLKHSTYYNCCRNLYCNNKYFSDCIDYCDGIFKALSQRSLLQDYGLFTTEMMDNNKFKKFNSDLRKDPLVMIMFGGMVQLTLSALLKYYGLFPNAVIGYGAGEIVAAYVADKMDLKTTVKVLYHYGRVLSHAYSQENKVYTLTLICPISKIKQTIFTKLNQDEKDGISISGIPSPKFCLLSGDYNIMKKVSDIAKSENIAIYGAMQNNYGLHSMMINDKMKEDLVNSLKDIPLQTSDIAFFTTTKLNKDGKPYEGKLDGEYWWMNMRNPVLYAHALSQTVAFLPIDGKNIIEI

SEQ ID NO: 12674 - protein, 405 aa, Piromyces finnis
  POLYKETIDE SYNTHASE-RELATED
NILQSVLINYYPHLIHMSTIPKEIQIENMIDPTQQTSSLLNENIIDSSDVTDYPKAYPKFAIIGTGIRLPGDINNKDDFWKVMIEKKVITGLTPEDRWDRDEWYCKTEKPGTIQTLYGGFIENAFDFDNKFFSISQKEALDATPEQRWLCELTVETIEDANINIDKFKGSNTGVFVGTSGIDYGSYVFSVPEKITKYTYSGIEPSIHANRVSYLFDLHGPSLSTNTACSSSLTALSIACNSMAAGDCEMAIVAGTNFFQAPANGVAYSQLRVVSKKGACRPFDSGADGYARLEGAGMVLLKPYEKAIRDNNKIYATILSTACNEDGKTASLTTPSSKAQYKLMKRVYEKGHIDPCTIDFIEAHGTGTAVGDPIEASSIGEAYGKINKANGNPAIPVGSVKGNVGH

SEQ ID NO: 12675 - protein, 504 aa, Piromyces finnis
  POLYKETIDE SYNTHASE-RELATED
AECIGTIVHTGSNVKNFKKGDVVFGLNLQANDIPSTYVKIHQDLVFPVNTMDMDKQNNLLSSVYAYTVAIYLLNEIPTGESVLISTDASDLMQALATIAQQKGINLFIDDTSSKYSKANSNAFKNIKAQMINTRQASEYVRLVKQHTNGEGVGVIIDINVKFDKENTLEKCLRIDGEYIKVGNIDQSTKKRTTHKIVQMSHFKDNVITPVVRQAVEMIIHGKVEAIDLKTYPVSKINSATLEILSGRLQGKSCLEMCKKGEDDIEFECLPSRVFKENKSYLITGAFGGIGLKVGLWMQLRGARHIVLTTSSDPESKYKHPIVNALRQKGVHVTITKCDISKYDEVEKLFMETTPAIDGVFHFANKFGPKLIRDSSLDSFNTAFEPKARGALNLHKISQKGFSLSSFVLFSSVLDILGNSGQMAYGAANSYLNNLIYYRRRKGLSGQCFSLPAMKGSGYLSQWNQITQSREFSEVIEFLDSEDLPDILDFFLRDDVDPCLQLLSG

SEQ ID NO: 12676 - protein, 886 aa, Piromyces finnis
  POLYKETIDE SYNTHASE-RELATED
AVIGIGCHFPEGIESKESFWKMLEDGKCITKDIPKERWDKDEWYSKEPVQGTIQTKRGAFLENPYLFDNKYFYISMPEAKEMSPEQRWLLELTVETLEDANIKPETLKGSRTGVFIGSSGIDYLVTQISHANDINSHSPTGFELSILANRLSYVFDFQGPSISCNTACSSAFSALNIGLNAMITDDCEMAIVAGSNFMSCPGSFVAYSQLRVVSKDGSCKPFDEKADGYAKLEGAGMILVKPYEKAVRDGDKIYCAIVGCGSNEDGRSPSLTMPSYEAQYKLLTHVCEKSGINPTQIDYVEAHGTGTKVGDPIESHAIGDAYGRGKGIRGPNDPPVLVSSVKGNTGHGENSSGIVSIIKTSMMLYKRKLVPTAAYHRLNQAIDAEKLGIKVCEKLEDWNTPHILHAAVNSFGFGGANTNALLEEVKHLNPQDIQLNISQGKPIVAKISGYNEKLVMQQLEEWRKVPMETLLPQLYISNTCREDSHYRISFILDDPAKFYDYVDIILKGRNHINVIKYNNKISVKPKVAFTFSGQGTQYPEMGLQLYNMNPYFASIIDYCNSIHTQISKKDLLKETGLFGKGPVNEEKLLDPQYSFPAIGIIELALVELWKRYGVEPALVFGHSMGEVAAAYAAGILTIEDAILLLYNYGQISENVVDAGAKSGMLAIGCSSEEAQSIYLKGKDKVFIASINSPKDITLGGDLEQLNEIMAEARKNNVFSVMLKVKKAFHTSYIITAKDKFLQSIQGIGNRVKAPKIPFISSTYGREYQGPFDEEYWWTNIISPVNFSQATKIARSKIDKVLEIGSTPVLGIYMSNDFHQDNIFYTLSRKLNNNNSLSRNIANMYAKKCFNNFNWRQYYIDFMDGIDGETLDKIRSIDYPMPKHVWD

SEQ ID NO: 12677 - protein, 2033 aa, Piromyces finnis
  POLYKETIDE SYNTHASE-RELATED
AVIGVGCRFPGNIKSKEDFWEMLTTGRCLTSETPKDRWDSAEWYNKEPKRGTVQTTRGAFMEDAFYFDNKYFSISQNEAKEMSPEQRWLLELAVETFEDANINPKKLKGSRTGVFVGSSGMDFVAAQISHANDLTQHSATGLELSILANRISYYFDLNGPSICTNTACSASMTALNLAINSMITDDCDAALIAGTNLLFTPGSCVAYSQLRVVSVDGSCKPFDKRADGYSRVEGAGMLLIKPYEKAVRDGDKIYCAILGSSTNEDGHTPSLTMPSYDSQCKLLTHVCEKFDIDPASIDYVEAHGTGTAVGDPIEARSIGYAYGRRVREGKQIKTTRPGETEEILDQPTYPLIIGSSKGNTGHGEYSSGIIGMIKAVLMLHHRTMVPTIAHEEMNPAIDAEGLGIKVATKLEPWTTPHTLRIAVNSFGFGGSNGNAIFEEVVNEKPEDLVMNIKDAKNPVVATFSAYDEKTLQQLLKKWNTEIPNEDLLQELFISSQCREYESMRSAMIFSSIDEARSLIQEMAEGDVEKFKRHEKIYMKRVKISEKPGINFAFSGQGSQFINMGRRMYQTNDLFKKVVDYCAAVLVTINGGEDIFEKYSIFKGDVAQISETDLSLPQFSVLAIGIAQIALIEVWKSMGVTPKAVYGHSMGEVAAAYAAGVLTIDDAVLLLYMRGHILAQLDGTGKGMLALGCSVENAQRFMANKPNVFISAVNSANSITLAGDLEQINAVAREAQAEKLFAVVLKVKQAFHSPYVEGAEKAFKESIRGIGERTKAPNCKFVSACFGQEYEGPFDENYWWANIRNPVSFHAAASIATQFSKRVLEIGAHPVLGMYLKEIYGKDNVYFSLSRKMDDVDSMCRTTANLFIENAVDILDYTQIWDGKVDLYNAKSGVAVPLKKLRSINYVLPKHVWNRKEIRKVYTDYIGTNPIHEIYTTRENVLKDMGVTEDDLKLLKSIKEGKATVPTSVKPKPVSAAAPKTTFIPSQSNIVYSSGNQWNFENHRYLQDHVVNKKIVLPACGSVSRAFSGYANAHPLMMAQKAIISLEDLKFDRMGIFDKAIDFNTVTGPMPLTFKEEGSTNTYKVIFNEDTEVSSGKFNDADETEALKQIPSADYFIKQCSSVSGGQGVTPDMFYNRTHEIGLDYGKEFRLYKAIRSGKNVAYGKLAVSKEHQKMVCHPAVLDNCIQIVFASGVASGDCQALPVGMKKVVLSQGGHFPEGTLIVATELVKQDIKECVSNVYIYDENKNIFGFVEGLTMSFRRGRAEKAIDWIHLLGYEEKAPTSTEKLPVACRNVIVMCTESQQNEANALATHIGSVIAGLQNIWVLPNNHVENIQQMVESAMIKPKETFVIDASFIDSPEIDRAFMTLKTMVNYEIPVLFAASKYIKDESANSRAIATSKAVIGMVRAARAECQVPLFTAHANRFEDLYLAVLRSDLTMDDPEVEIIDGKVQCVRFMKLDKVPDVKSTNVKLEKSANGQIGQMKFTECIGLPKYNDDQIVIKTKGVSMQFKDIMTAMDTLVGFDDYEPGMECIGRVVAIGKNVASDPKNVLQIGDPVVAFAHKYGHLLRTYGVADPLSVQKIPESMYKVEYAGIFIVFITAYYSLHVRAGGIKPGQTILIHAAAGGVGQAAVKLCQLWGANIIASASASKQQFLRDTYGIEHVTNSRDPEQFYSDVMKWTNGKGVDFVLNSLSGKSLRMGIKCLKNGGKFVEIGKTDILNDSQLGLHCLLNNISFISSHIDLLNNQQMSFYKNIIFDMFKTGKLTPIPAKIFSANKYKEAFFYLASGRNVGKTCIEFQDNVAIDCNPVTIVDPNLTYLVTGAFGGVGLRVVLWLVSRGAKNLLLTTSGSVEKQYEQPIIRSLIEKGVNVMIKTCDITDYNNVQQLFQQTQPRVAGVFHLANRFAPGLISTSDLALLRKGFNAKAEGAWNLHKVTAQKQHQVQLFVVFSSILDVLGNRGQTAYGAANAFLSSIIDHRRENGLSGNCIALPAMRGSGYLAKWNQTKQSKEFEQLIALLDTDELVNVMDGLIRYDL

SEQ ID NO: 12678 - protein, 697 aa, Piromyces finnis
  POLYKETIDE SYNTHASE-RELATED
FNSNKSNSIAIIGMGLRLPGAINSDKSLWSTLVKGRDCITAIPKDRKLHENYVDKQSSELNMGEHNVKRCGYYDSRSSGKKISQFDAEFFNCLPDEAIGLDPKHRWILETSWEALENAGISPESLENTDTGVFVGIGDQQEHVKFMQECQKEKVVAHHNSNPSAIAGRLSYFYKLYGPSVTVDTACSTGATALHTACRSMIFGDCNLSIVTASKFLFYSEEFEMTSKARMTSPSGRCATFDKNADGYVPAEGCVTFILKRLEDAERDKDHILGVILGTSSGQSGFRQSISVPSSEGQARNIERAMAVAGVQPSDISYIEAHGTGTPYGDAIEIQGINQVYAGSHTSEHPLVIGSIKTNIGHTAETAGLASIAKVLLAMKNKTIPRNLHFKNLNPEIDLGVVPLSVPTHNVKWETVDGKPRTALVSSYGLQGSAVNIILQEYVPPQNREVEDVTDKSVEKQLNSDIIGIKEKSLLTISAKDKIALLDLCNKYSNILDSMNNDESIQNLCYTSNVGRQHFENRIVAVGEDVETLSDNLQKVMDKIFDDEVKVESFGKKRVFKNTGMSFTSYYQQPNLITDEMYKFSCYLYRTQPVYAKALEECDKIITELSNFKILLVNLVICMGELIQPELLQEYKKQVDEDPCMAQFIALSMNYALIKLLEHLSISPNLVVGYKFGEITAALACGKISLRNAFLIIH

SEQ ID NO: 12679 - protein, 167 aa, Piromyces finnis
  POLYKETIDE SYNTHASE-RELATED
IVQMSHFKDNVITPVVRQAVEMIIHGKVEAIDLKTYPVSKINSATLEILSGRLQGKSCLEMCKKGEDDIEFECLPSRVFKENKSYLITGAFGGIGLKVGLWMRLRGARHIVLTTSSDPESKYKHPIVNALRQKGVHVTITKCDISKYDEVEKLFMETTPAIDGVFHF

SEQ ID NO: 12680 - protein, 74 aa, Neocallimastix californiae
  Polysac_deacetylase
QNAEIGTWAGFRKGAASFTFDDGAPSHVSDGAPVFEKYGYRATFFLVYNWNPNWSGFQSLANKGHEIGSHSNSH

SEQ ID NO: 12681 - protein, 83 aa, Neocallimastix californiae
  Polysac_deacetylase
AQNAEIGTWAGFRKGAASFTFDDGAPSQVSDCGPVFDKYGYKGTFNLVYNWNPNWSGFQSLADSGHEIASHSNSHGNNMSGEE

SEQ ID NO: 12682 - protein, 83 aa, Anaeromyces robustus; identical to SEQ ID NO: 12681
  Polysac_deacetylase

SEQ ID NO: 12683 - protein, 169 aa, Anaeromyces robustus
  Polysac_deacetylase
KFYTQCNNPKHWAMTYDDGPTEFADAILDLLKEKGIKATFFIVGHMYMDNNSSDWSRIIKRMDSEGHIVGNHTYDHQDLTGLSSDQIISQMKQVEDRIFKIIGKRPAFMRPPYGSGNGNQNVMNALQQAGYTAAINWNVDPQDYSNGGDANYARQVINQAKGQPIITLN

SEQ ID NO: 12684 - protein, 72 aa, Neocallimastix californiae
  Polysacc_deac_1
RKGAASFTFDDGAPSHVSDGAPVFEKYGYRATFFLVYNWNPNWSGFQSLANKGHEIGSHSNSHGQNMSGEEA

SEQ ID NO: 12685 - protein, 71 aa, Neocallimastix californiae
  Polysacc_deac_1
RKGAASFTFDDGAPSQVSDCGPVFDKYGYKGTFNLVYNWNPNWSGFQSLADSGHEIASHSNSHGNNMSGEE

SEQ ID NO: 12686 - protein, 71 aa, Anaeromyces robustus; identical to SEQ ID NO: 12685
  Polysacc_deac_1

SEQ ID NO: 12687 - protein, 127 aa, Anaeromyces robustus
  Polysacc_deac_1
CNNPKHWAMTYDDGPTEFADAILDLLKEKGIKATFFIVGHMYMDNNSSDWSRIIKRMDSEGHIVGNHTYDHQDLTGLSSDQIISQMKQVEDRIFKIIGKRPAFMRPPYGSGNGNQNVMNALQQAGYT

SEQ ID NO: 12688 - protein, 62 aa, Neocallimastix californiae
  PP-binding
LKKVLQYGENDEIDPYQSLSELGIDSIMMMELRTILKNVTGINIPLVVFSTQNICLYRLVEY

SEQ ID NO: 12689 - protein, 65 aa, Neocallimastix californiae
  PP-binding
LKEEVRRMLMYNENDELDIFQPLSELGIDSIMMMELRQIIKAVTNITVPLSIITTPNLTLSKIFE

SEQ ID NO: 12690 - protein, 64 aa, Neocallimastix californiae
  PP-binding
ESIKEIIPSTPEFNKFNPDAPFTVYGIDSLSVIKLTNVLSRKFNKKYSPAILFTYGTTASLAKY

SEQ ID NO: 12691 - protein, 64 aa, Neocallimastix californiae
  PP-binding
DITEKLQSMLGLIDEEIDVTIPLRVYGLDSLTAMELTKWIESEMNIEFNQSQLLGDDITTEDLI

SEQ ID NO: 12692 - protein, 66 aa, Neocallimastix californiae
  PP-binding
EVVEKLQDLLGLVDENIDTNVPLQVYGLDSLTSMEIVKWVENDKKVELPQSALLSSEITTEELVNM

SEQ ID NO: 12693 - protein, 63 aa, Neocallimastix californiae
  PP-binding
EICDRLQNMLGLVDEKIDPAIPLRVYGLDSLTTMELTNWIQSELKVTLPQSQLLSDEITTNEL

SEQ ID NO: 12694 - protein, 64 aa, Neocallimastix californiae
  PP-binding
DITEKLQSMLGLIDEEIDVTIPLRVYGLDSLTAMELTKWIESEMNIEFSQSQLLGDDITTEDLI

SEQ ID NO: 12695 - protein, 64 aa, Neocallimastix californiae; identical to SEQ ID NO: 12694
  PP-binding

SEQ ID NO: 12696 - protein, 64 aa, Neocallimastix californiae; identical to SEQ ID NO: 12694
  PP-binding

SEQ ID NO: 12697 - protein, 64 aa, Neocallimastix californiae; identical to SEQ ID NO: 12694
  PP-binding

SEQ ID NO: 12698 - protein, 63 aa, Neocallimastix californiae
  PP-binding
ITDKLQSMLGLIDEEIDVTIPLRVYGLDSLTAMELTKWIESEMNIEFSQSQLLGDDITTEDLI

SEQ ID NO: 12699 - protein, 64 aa, Neocallimastix californiae; identical to SEQ ID NO: 12694
  PP-binding

SEQ ID NO: 12700 - protein, 66 aa, Neocallimastix californiae
  PP-binding
IYESIKEIIPSTPEFEKFDPESPFTVYSIDSLAIIKLTNILSRKFNERYSPAILFNYGTTSLLAQY

SEQ ID NO: 12701 - protein, 65 aa, Neocallimastix californiae
  PP-binding
YQSIKEIIPSTPDFEQFVPEKSFTMYGIDSLTTVKLTNLLSRKLKKNYSPSIIFNYASPLLLAKY

SEQ ID NO: 12702 - protein, 64 aa, Neocallimastix californiae; identical to SEQ ID NO: 12694
  PP-binding

SEQ ID NO: 12703 - protein, 64 aa, Neocallimastix californiae; identical to SEQ ID NO: 12694
  PP-binding

SEQ ID NO: 12704 - protein, 64 aa, Neocallimastix californiae; identical to SEQ ID NO: 12694
  PP-binding

SEQ ID NO: 12705 - protein, 61 aa, Neocallimastix californiae
  PP-binding
ELKRILQYGENDEIDPYQSLTELGIDSLMMMEFRTILKNVTTVNIPLVVFSTQNICLFRLV

SEQ ID NO: 12706 - protein, 66 aa, Neocallimastix californiae
  PP-binding
IYSCMAEIIPSTVPFDEFNIYDTFTSSGFNSINSVKLIKLLNSKLKTNYSTVMLFNFNSPYELARA

SEQ ID NO: 12707 - protein, 66 aa, Neocallimastix californiae; identical to SEQ ID NO: 12706
  PP-binding

SEQ ID NO: 12708 - protein, 62 aa, Neocallimastix californiae
  PP-binding
CITEIIPSTVPFDEFNIHDTFTSSGFNSINSVKLIKLLNSKLKTKYSTVMLFNYNTPYELAK

SEQ ID NO: 12709 - protein, 66 aa, Anaeromyces robustus
  PP-binding
IYQSIKEIIPSTPSYEEFNPERPFNLYGIDSLATVKLTNVLSRKMGKRYSPAILFNYGNSLELAKF

SEQ ID NO: 12710 - protein, 66 aa, Anaeromyces robustus
  PP-binding
LKREVRRMLMYNDNDELDELQPLSELGLDSIMMMEFRQIIKAVTNIVVPLSIITSPNLNLKEIIQF

SEQ ID NO: 12711 - protein, 62 aa, Anaeromyces robustus
  PP-binding
LKRILQYSENDEIDPYQSLTELGIDSIMMMELRTILRTATGVNIPLVVFSTQNICLSRLVDY

SEQ ID NO: 12712 - protein, 61 aa, Anaeromyces robustus
  PP-binding
KEIIPSTPEFEDFNPERPFNFYGIDSLATIKLTNIISRKLGKRYTPAVLFNYGNALELAKF

SEQ ID NO: 12713 - protein, 64 aa, Anaeromyces robustus
  PP-binding
ICNVYSKTLNIDESKIGKMSDFFELGGDSLNAIRIISMIEKELNIKLYIKDILSHPLVSEISEY

SEQ ID NO: 12714 - protein, 64 aa, Anaeromyces robustus
  PP-binding
ICKIYSNVFNINENSVGLMNEFYELGGDSLIVISILSLIEKELKIKLNVKDILSHPLIKDLCDY

SEQ ID NO: 12715 - protein, 61 aa, Anaeromyces robustus
  PP-binding
IVEIIPSTVPFNEFNADEAFSSFGLNSINSIKLIKLLNSKLKTNYSTVMLFNYNSPTELAK

SEQ ID NO: 12716 - protein, 61 aa, Piromyces finnis
  PP-binding
KNVLQYGENDEIDPYQSLTELGIDSIMMMELRTIMRTATGINIPLVVFSTQNICLYRLVEY

SEQ ID NO: 12717 - protein, 64 aa, Piromyces finnis
  PP-binding
QSIKEIIPSTPDFELFNPENPFNIYGIDSLSTIKLTNILSRKLNKYFSPAILFNYGNTYALAKF

SEQ ID NO: 12718 - protein, 50 aa, Piromyces finnis
  PP-binding
LKKEIRRMLMYNEDDEIDEMQPLSELGMDSIMMMEFRQVIKAVTDIMIPL

SEQ ID NO: 12719 - protein, 63 aa, Piromyces finnis
  PP-binding
ISEKLQSMLGLIDEEIDVTIPLRVYGLDSLTAMELTKWIESEMNIEFSQSQLLGDDITTEDLI

SEQ ID NO: 12720 - protein, 63 aa, Piromyces finnis; identical to SEQ ID NO: 12719
  PP-binding

SEQ ID NO: 12721 - protein, 63 aa, Piromyces finnis; identical to SEQ ID NO: 12719
  PP-binding

SEQ ID NO: 12722 - protein, 63 aa, Piromyces finnis; identical to SEQ ID NO: 12719
  PP-binding

SEQ ID NO: 12723 - protein, 63 aa, Piromyces finnis; identical to SEQ ID NO: 12719
  PP-binding

SEQ ID NO: 12724 - protein, 63 aa, Piromyces finnis; identical to SEQ ID NO: 12719
  PP-binding

SEQ ID NO: 12725 - protein, 63 aa, Piromyces finnis; identical to SEQ ID NO: 12719
  PP-binding

SEQ ID NO: 12726 - protein, 66 aa, Piromyces finnis
  PP-binding
EVITKLQDLLGLVDEEIDVNVPLQVYGLDSLTSMEIVKWIENDKNVDLPQTALLNSEITTEELINM

SEQ ID NO: 12727 - protein, 66 aa, Piromyces finnis
  PP-binding
IYQSIKEIIPSTPDFDQFDPEMSFTMYGIDSLSTVKLTNILSRKLKKNYSPSIIFNYASPLLLAQY

SEQ ID NO: 12728 - protein, 65 aa, Neocallimastix californiae
  Probable ACP-binding domain of malonyl-CoA ACP transacylase
PGAMVSVFQSEDVVKEAIEEFGYEEEVSIAAINGVTHTVISGYEDEVDDLTEYFNEMKVKTKKLN

SEQ ID NO: 12729 - protein, 64 aa, Neocallimastix californiae
  Probable ACP-binding domain of malonyl-CoA ACP transacylase
PGAMVSIFTTEDVVKEAIEEFEFENVSIAAINGTTQIVISGNADEVKELEEYFIEQDIKAKQLN

SEQ ID NO: 12730 - protein, 62 aa, Neocallimastix californiae
  Probable ACP-binding domain of malonyl-CoA ACP transacylase
GLIALGCGVDEAKTEYIKDRKKVYIASINSYKDVTLGGDLNQLEEIMDQAKQKNVFTVMLKV

SEQ ID NO: 12731 - protein, 61 aa, Neocallimastix californiae
  Probable ACP-binding domain of malonyl-CoA ACP transacylase
KGMLALGCSVEQAQYFMNNKPNVFISAVNSANSITLAGDISQINAIAQEAKAQNLFAVVLK

SEQ ID NO: 12732 - protein, 65 aa, Neocallimastix californiae
  Probable ACP-binding domain of malonyl-CoA ACP transacylase
PGAMVSIFQNEKTVKEAIEEFGYEEEVAIAAINGVTHTVISGYEEEVDDITQYFSEMNIKTKKLN

SEQ ID NO: 12733 - protein, 65 aa, Anaeromyces robustus
  Probable ACP-binding domain of malonyl-CoA ACP transacylase
KSGMLALGCSAEEAKTTYLNGKDKNRVYIASINSEKDITLGGDLNQLDAIMTQAKNNNVFTVMLK

SEQ ID NO: 12734 - protein, 64 aa, Anaeromyces robustus
  Probable ACP-binding domain of malonyl-CoA ACP transacylase
PGAMVSIFTTESAVKEAIEEFEFENVSIAAINGTTQTVISGNADEVKELEEYFIEQEIKAKPLN

SEQ ID NO: 12735 - protein, 65 aa, Anaeromyces robustus
  Probable ACP-binding domain of malonyl-CoA ACP transacylase
PGTMVSIFEKEDVVKKAIEEFDTQEEVAVAAINGVAHTVISGYEDEVDDITEYFKQMNVKTKKLN

SEQ ID NO: 12736 - protein, 65 aa, Piromyces finnis
  Probable ACP-binding domain of malonyl-CoA ACP transacylase
PGTMVSVFEKEDVIKEAIEEFGYDEEVSVAAINGVTHTVISGYEDEVDDITEYFSQMNIKTKKLN

SEQ ID NO: 12737 - protein, 64 aa, Piromyces finnis
  Probable ACP-binding domain of malonyl-CoA ACP transacylase
PGTMVSVFTTQDVVEEAIEEFGFENVSIAAINGTTQIVISGNTDEVKELEEYFTQQEIKAKQLN

SEQ ID NO: 12738 - protein, 64 aa, Piromyces finnis; identical to SEQ ID NO: 12737
  Probable ACP-binding domain of malonyl-CoA ACP transacylase

SEQ ID NO: 12739 - protein, 62 aa, Piromyces finnis
  Probable ACP-binding domain of malonyl-CoA ACP transacylase
SGMLAIGCSSEEAQSIYLKGKDKVFIASINSPKDITLGGDLEQLNEIMAEARKNNVFSVMLK

SEQ ID NO: 12740 - protein, 61 aa, Piromyces finnis
  Probable ACP-binding domain of malonyl-CoA ACP transacylase
KGMLALGCSVENAQRFMANKPNVFISAVNSANSITLAGDLEQINAVAREAQAEKLFAVVLK

SEQ ID NO: 12741 - protein, 18 aa, Neocallimastix californiae
  PROKAR_LIPOPROTEIN
MFKQVGITALLVASVSAA

SEQ ID NO: 12742 - protein, 20 aa, Neocallimastix californiae
  PROKAR_LIPOPROTEIN
MKFINLVATSILATCALASS

SEQ ID NO: 12743 - protein, 22 aa, Neocallimastix californiae
  PROKAR_LIPOPROTEIN
MKSAIVLSTLTVLLSHSAFAQS

SEQ ID NO: 12744 - protein, 22 aa, Neocallimastix californiae
  PROKAR_LIPOPROTEIN
MKSTIIILTSIVLLSHSAFAQS

SEQ ID NO: 12745 - protein, 20 aa, Neocallimastix californiae
  PROKAR_LIPOPROTEIN
MKFTALIASSILTTCALASS

SEQ ID NO: 12746 - protein, 29 aa, Neocallimastix californiae
  PROKAR_LIPOPROTEIN
MKTTIALTAAAALAAKVSAACWSQSLGYS

SEQ ID NO: 12747 - protein, 18 aa, Neocallimastix californiae
  PROKAR_LIPOPROTEIN
MYKTIGIAALFVASASAA

SEQ ID NO: 12748 - protein, 20 aa, Neocallimastix californiae
  PROKAR_LIPOPROTEIN
MKFFVALSAIAAFASSASAA

SEQ ID NO: 12749 - protein, 18 aa, Anaeromyces robustus
  PROKAR_LIPOPROTEIN
MYKTIGIAALFVASASAA

SEQ ID NO: 12750 - protein, 20 aa, Anaeromyces robustus
  PROKAR_LIPOPROTEIN
MKFFVALSAIAAFASSASAA

SEQ ID NO: 12751 - protein, 20 aa, Anaeromyces robustus
  PROKAR_LIPOPROTEIN
MKFIDILPILVAAGSAMASA

SEQ ID NO: 12752 - protein, 21 aa, Anaeromyces robustus
  PROKAR_LIPOPROTEIN
MKSLYILSIIIALSHSALAQS

SEQ ID NO: 12753 - protein, 20 aa, Anaeromyces robustus
  PROKAR_LIPOPROTEIN
MKFVNLLSSTLFALGALASS

SEQ ID NO: 12754 - protein, 18 aa, Anaeromyces robustus
  PROKAR_LIPOPROTEIN
MNFINKAIIFTFISLIIG

SEQ ID NO: 12755 - protein, 15 aa, Anaeromyces robustus
  PROKAR_LIPOPROTEIN
MKIKNILSLYSLFIA

SEQ ID NO: 12756 - protein, 18 aa, Piromyces finnis
  PROKAR_LIPOPROTEIN
MNFINKSILLTFITFIVG

SEQ ID NO: 12757 - protein, 20 aa, Piromyces finnis
  PROKAR_LIPOPROTEIN
MKFSTVLASSILAAGALASS

SEQ ID NO: 12758 - protein, 22 aa, Piromyces finnis
  PROKAR_LIPOPROTEIN
MKSIFVLSTLTVLLNHSVLSQS

SEQ ID NO: 12759 - protein, 19 aa, Piromyces finnis
  PROKAR_LIPOPROTEIN
MKFSALIGTLFATGALASS

SEQ ID NO: 12760 - protein, 19 aa, Piromyces finnis
  PROKAR_LIPOPROTEIN
MKFSALIGTLFATGALASS

SEQ ID NO: 12761 - protein, 19 aa, Piromyces finnis
  PROKAR_LIPOPROTEIN
MKFSALIGTLFATGALASS

SEQ ID NO: 12762 - protein, 553 aa, Neocallimastix californiae
  PROPROTEIN CONVERTASE SUBTILISIN/KEXIN
AELILDHIDTYQKDDAITEEVQSLMRKRSEMSYEDISNNEAFSKILTEAFSVLDVTVIYAYLSEELYNIIKDLPDVVSCNEDVVIPFPNDTIISINDTNTFEIKSDKKFEKRASYYDLYDIKRDTNWSDVTVFENTYHHLSLISQSKYDRNLVGKYDRNFYYPISAGRGVDIYILDSGIYGDHIDFDTGHRTVSCDAMFGKTRVINQPGSSNYKNCYLENELKFHGSMVASVAAGKYFGVAKNANIHMIVHDRTALNILYAYDYVKKYAKNPHKTVINLSFGNYIRIPEEEKMINSLAEMGFIVIAAAGNDYTNACTNNPRQVKQEGQTVTVTSKMYPAAYSNVIAVGATNNDIQSLDVTNVSNLYNVASFSNYGNCLDIFGPGYVYGAYPGYDYRNNNSIQAYAGGTSFSCPIVAGVAASIISEHPEIEFNVTILRQWLLDNAVRNIIGNSSQFDSPDIFLNNGKKTVYSANGQYNGCGILSGKRTCPGDNCCSASTGYCGRNFCDIDCQSEFGYCNNKNNNSYDDNQKNCWSSNLGYSCCPSGTPVYFTDE

SEQ ID NO: 12763 - protein, 410 aa, Neocallimastix californiae
  PROPROTEIN CONVERTASE SUBTILISIN/KEXIN
IGQYDSNYYYPSSAGKGVDIYILDSGIDVHHADFELDTGNTGNGYRTVSCDAMFGDKEIINQPGSSSYKNCFLEEKIKYHGSMVASIAAGKIHGVAKNANIHMVVHNRQSTGILLAYNFVKNNLKDPHKTVINLSFGSYKKIPEEVSLINSLIEMGCIVVAAGGNDNISSCTTEPRYVVSDDDNKVKTLIQEKIYPASLENVIGVGSIRNKIKETDVSSVQNLYSLADFSNYGDCLDLFAPGYAYAAYPPPNNNDKSSSDLEGYGGGSSFSAPLVAGVAASIISEHPEMTFNHSLMKKMLLEISVEGILDQSGIHDSPNNFLNIGKKTVYSANNQYKGCGIFSGKRSCSNNECCSSSTGYCGRNDDYCGSDCQSEFGYCTSSNSNNNSNGSNNNGNTTNNNDNKSNNDNS

SEQ ID NO: 12764 - protein, 456 aa, Anaeromyces robustus
  PROPROTEIN CONVERTASE SUBTILISIN/KEXIN
NRVDSNDINIYKRSFNSTDSDVEYIPVELNILHHISPILNYYTILVYLSDELVDQVQALPNVISCEKSFKIQDQVYKEEEEILINNNNNNNNNVNNNKEKRDDFDFEKYQEEENMDYGIYYDIDKIKEETKWSGVEVQYNANKHSENDDSHLSLLSQGRFYKEVTGRYDNNYYYPSSAGKGIDIFLIDKGLYLDNDDFDRYEGTEDERTLTCDALVVYGVAHPYEGEDKKKCKFAEDSYPGHGNMVSSLAGGKLYGAAKKANLHMIVSYYELYETIVALDYIKQNGKPYQSIISFSRGAYKKYSQFLQDKLDELNDAGFITVVAAGNETEDICHEKNKYFYSIAGYKNVIIVGSTESTYNNDIENGYKIASYSNYGECIDIFAPGQARYANYQLNRKAQGTSVSTAITAGVIATIMSEHPDIKFNVDTMKEKLFELSLKNIISGLNNVTPNRFLNN

SEQ ID NO: 12765 - protein, 351 aa, Neocallimastix californiae; identical to SEQ ID NO: 854
  PROSTAGLANDIN REDUCTASE 1

SEQ ID NO: 12766 - protein, 350 aa, Anaeromyces robustus; identical to SEQ ID NO: 860
  PROSTAGLANDIN REDUCTASE 1

SEQ ID NO: 12767 - protein, 351 aa, Piromyces finnis; identical to SEQ ID NO: 861
  PROSTAGLANDIN REDUCTASE 1

SEQ ID NO: 12768 - protein, 916 aa, Anaeromyces robustus; identical to SEQ ID NO: 12658
  PROTEIN C41A3.1

SEQ ID NO: 12769 - protein, 2192 aa, Anaeromyces robustus; identical to SEQ ID NO: 12659
  PROTEIN C41A3.1

SEQ ID NO: 12770 - protein, 237 aa, Piromyces finnis; identical to SEQ ID NO: 12671
  PROTEIN C41A3.1

SEQ ID NO: 12771 - protein, 293 aa, Neocallimastix californiae
  PS-DH
NTGKNELVVTAPLTPQYVKYLCKNHVVSGNGCVPAAAYTEFIFAAVKAMNNNTDDVIEIADELLVRGPLTIKEDSEVDFILKKKGDRLSLYTKLDGGIENHMLNASANLLRDGENVNIRDTLPTPAQAKALINKILTKDNIHSSKLIYDSISKNISYNGGFPSVKHFGLGNDDDGQYVLVSRIDSKDKTLNNIRSGLNQVYLFDASLHSNAGRSSIEEEKKGEGREEENEPFLPSSFENIIKFKATPDECFVVHRYIGNTDPNSEFTTFSVYDLDGNICEYVGAFQTRKVKIE

SEQ ID NO: 12772 - protein, 268 aa, Neocallimastix californiae
  PS-DH
SHVINGKGFSPATSFIDFVFYGLKFAYPNDQFKINEYFITNGPLSLSYDHDVVYIMVKKGEEITIYSQTYGGQQEMRGSVIVSVANSIDSEKATDELGFDVKKDYVEKYLSGPGAKDSSNYGEGKELYEEMDKSLVYGSFFRSVQSFYSGKEQDGTEFLISHIKHNVKQVEESLVNSGASQVGILDAAIHCMSGDGIVAKKNGVEGSKDSFLPTSFEGIIKYKEIPNEVYVLHRVKSVNETSKFTQYWVFDVDGKLVFSTDNFQVKKF

SEQ ID NO: 12773 - protein, 259 aa, Neocallimastix californiae
  PS-DH
FENHRYLQDHVVNKKIVLPAAGSVSRAFSGFATAHPLKVAQRAIISLEDLKFDRMGIFDKTIDFNTATGPMPITYEEERSNQTYKIIFNEDVEVSSGKFNNNDETETLKNIPAVDYFINQCSSIAGGQGVTPAMFYNRTQEIGLDYGEEFRLYKAIRSGKNVAYGKLTVSKEHQKMVCHPAVLDNCIQIVFASGVAAGDCQALPVGMKKVVLSQGGHFPEGTLIVATELVKQDIKECVSNVYIYDENKNIFGYVEGLTM

SEQ ID NO: 12774 - protein, 266 aa, Neocallimastix californiae
  PS-DH
ENHKYLVDHIVGKDVVFPAAGSISRAMYGFKQSRGEYNFDKDRNIVFENLEFLHLAVFEKSVQEQLNKKGPIPISLVEEGDGKYTIVQKNGNPVSKGQFYEAQLTQSKEENSNLLSDVPTFNEFINRCSTKVGGNGVTSEQLYHRTDELGLKYGPNFRLVQNCRAGDNVGYARIKVDEEKSKLICHPAVLDACFHSIIGTGIANGDRQPLPNKIRRFVMGRGGYFPQGTIICAADIIKQDLKNVIVNIYIYDEDKKPIAKIEEMDM

SEQ ID NO: 12775 - protein, 256 aa, Neocallimastix californiae
  PS-DH
NQYLVDHKVNNQIVFPAAGSVSRALYGYERSRGIIESESIVTLNDLEFVGLTVFQKTVESQLRSKGLIPMKLYEDEDHQFILKQNDGSVISKGTFPPLHSPKESEVLSNFPEFSEVIKSCSTVKGGEGIRKEQIYQRANTIELQYGPQFQLIQHGRSGKKYSYAKIAVREDHAQMICHPAVLDNCFHSIICLGLGCGNRQVLPYKIKRLEMKNGGRFKEGILTCVSQLIYQDLSRVMVNLFIYDDAGEPFMKIDHM

SEQ ID NO: 12776 - protein, 287 aa, Neocallimastix californiae
  PS-DH
GKNELVVTAPLTPQYVKYLWSNHIVMGVGCVPAAAYTEFIIAATRAMNNGSEEPIEVVDELLTRGPLNIKEDSEVDFILKKRGERLALYTKVDGGMENHMLNAQANLLSDSENPNIRETLPTPEKTKALIKKVLTEDNVHPGKFIYDNIKRSSLYKGGFPSVKNFGIGYDDDGTFVLISHLDSVDRSINNTRSGLNQVYLFDATLHCSAGKDCLRTQDKPEENEPFLPSSFENLVKFKQTPDECYVVHRYLKENAETDPNSEFTSFTVFDIDGNVCEHCSAFQTRRV

SEQ ID NO: 12777 - protein, 254 aa, Neocallimastix californiae
  PS-DH
NNAYLVDHKVNNQIVFPAAGSISRALYGFSRSRGQMEKKSMVSLTDLEFIGLTVFQKDEESQLNSKGPIPMKLYESREHQFALKHQDGSMISKGVFPDSSPKELLDFPELSEIIKSCSTVKGGEGIRKDLIYQRANAIELQYGPEFQLIQHGRSGRSYSYVKIEVREDHCQMICHPAVLDNCFHSVICLGLGCGNRQVLPFKIKQFDMMNGGYFKTGTITCVSQLIYQDLSRAIINFFVYDSDDQPFMKIDHME

SEQ ID NO: 12778 - protein, 292 aa, Anaeromyces robustus
  PS-DH
GNNDNEVIVSAPLTPQYVKYLSKNHVIIGHGCVPAAAYTEFIFTAMKALNNNRDDLIEITDEMFVRNPLDIEEDSEVDFIMKKRGDRFAIYAKLDGGVENHMLNGSACLLKDGDNANLLETLPSKEEMKSFINKYLNEETMYSSQIIYDSIFEHSFYGGGFPSVKGFNVAKDEKGGFLISRLDSKDKTLNNIRSGLSQVYLFDSSIHSNAGRMCLEKLQKKEEDTGPNVPFLPSTFENIIKIKPTPDECYVIHRFIEGTEANSNFTSFSVYDLDGNIVEYIGSYQTRRVNME

SEQ ID NO: 12779 - protein, 265 aa, Anaeromyces robustus
  PS-DH
ENHKYLVDHIVGKDVVFPAAGSVSRAMYGFKQSRGEHNFDSEKIIVLEDLEFLHLAVFQKSVQDQLNMKGPIPLSLIEEGEGKYTLIQKDGTPVSKGHFYEPQLTQTREENANLLNDVPPFEEFVNRCSTKVGGNGVTASQLYHRTDELGLKYGPNFQLVQNGRAGDNVGYARIKVDEDKSKLICHPAVLDACFHSIIGIGIANGDRQPLPNKIKRLIIGRGGYFPQGTIICAADVIKHDLKNVVVNIYIYDEEKKPIAKIEEMD

SEQ ID NO: 12780 - protein, 286 aa, Piromyces finnis
  PS-DH
NNESELIVAAPLTPQYVEYLFKNHVITGYGCIPAAAYTEFIYTAMKAINNYEDDIIEICDEMLIRSPLNIKADSNVDFLMKKKGDRIAVYAKVDGGIENHMLNASALLLKEGENADLFDTLPKPDEVKALIEKIMTKENTHSSDILYDSIRESSLYGGGFPSVKEFAVGTNDEGSTVLVSRLDSKDRTINNINSGLSQVYLFDAALHSDAGKDTLVAIKKENMGDPFLPSSFENLIKYKPIPDDCYVIHKHMEGTEPNAAFTSFSVYDLDGNICQYCGAFQTRRVK

SEQ ID NO: 12781 - protein, 265 aa, Piromyces finnis
  PS-DH
ENHKYLVDHVVGKDVVFPAAGSVSRAMYGFKQSRGEYNFDNTRNIVFENLEFLNLAVFQKSAQEQLNKKGPIPLSLVEEGEGKFSIVQKNGIPVSKGQFYEPQLTQSKEENANLLDDVPPFEEFVNRCSTKVGGNGVTAAQLYKRTDALGLMYGPNFQLVQNGRAGDNVGYARIEVDEEKSKLICHPAVLDACFHSIIGTGIANGDRQPLPNKIKKFIMGRGGYFPQGTIICAADIIKHDLKNVVVNIYIYDEEKKPIAKIEEMD

SEQ ID NO: 12782 - protein, 293 aa, Piromyces finnis
  PS-DH
ASESNIIITVPLSTQYIRFLRRKHQISSTGFSPATSYIDFVFYALKYAYPNEQFKIDEYFITNGPLKLTDDQEVVYIMIKKGEEVTIYSQSRGSPQEVRGSVMISVVNNLDNEEATSKLDFDIKKDYVEKYLTVENANKSPNYGEGKELYQELDKSIVYGSFFRSVKSFYSGKDENGHDFLVSHIMHNVSDKDESLVNSGASQVGILDACIHCMGGDGIISNRNNTNNEKSKDTFLPTSFEGIIKYKDIPNEVYVLHRVKNVNETSKFTEYFVFNTEGKLVFSTDNFQVKKFD

SEQ ID NO: 12783 - protein, 293 aa, Piromyces finnis; identical to SEQ ID NO: 12782
  PS-DH

SEQ ID NO: 12784 - protein, 182 aa, Piromyces finnis
  PS-DH
ENNQYLVDHKVNNQIVFPAAGSVSRAMYGFLNSRNSQKIQESKGHVALTQLEFTSLSVFQKRAEDQLNSKGPIPMKLYEDKNHQFTLKHQDGSIISKGNFVEIAKEFTDFPNLSDVVKSCTTVMGGKGIHKDLIYQRAAAIQLQYGPEFQLIQSGRSGRNYSYVKIRVTEEHSKMICHPAVL

SEQ ID NO: 12785 - protein, 258 aa, Piromyces finnis
  PS-DH
FENHRYLQDHVVNKKIVLPACGSVSRAFSGYANAHPLMMAQKAIISLEDLKFDRMGIFDKAIDFNTVTGPMPLTFKEEGSTNTYKVIFNEDTEVSSGKFNDADETEALKQIPSADYFIKQCSSVSGGQGVTPDMFYNRTHEIGLDYGKEFRLYKAIRSGKNVAYGKLAVSKEHQKMVCHPAVLDNCIQIVFASGVASGDCQALPVGMKKVVLSQGGHFPEGTLIVATELVKQDIKECVSNVYIYDENKNIFGFVEGLT

SEQ ID NO: 12786 - protein, 25 aa, Neocallimastix californiae
  PT
EQPTEEPTEQPTEQPTEEPTEEPIK

SEQ ID NO: 12787 - protein, 21 aa, Neocallimastix californiae
  PT
QPTEEPTEEPTEEPTEEPTEQ

SEQ ID NO: 12788 - protein, 363 aa, Neocallimastix californiae; identical to SEQ ID NO: 605
  PURPLE ACID PHOSPHATASE 23

SEQ ID NO: 12789 - protein, 303 aa, Neocallimastix californiae; identical to SEQ ID NO: 607
  PURPLE ACID PHOSPHATASE 23

SEQ ID NO: 12790 - protein, 315 aa, Neocallimastix californiae; identical to SEQ ID NO: 608
  PURPLE ACID PHOSPHATASE 23

SEQ ID NO: 12791 - protein, 320 aa, Neocallimastix californiae; identical to SEQ ID NO: 609
  PURPLE ACID PHOSPHATASE 23

SEQ ID NO: 12792 - protein, 345 aa, Neocallimastix californiae; identical to SEQ ID NO: 610
  PURPLE ACID PHOSPHATASE 23

SEQ ID NO: 12793 - protein, 329 aa, Anaeromyces robustus; identical to SEQ ID NO: 612
  PURPLE ACID PHOSPHATASE 23

SEQ ID NO: 12794 - protein, 344 aa, Piromyces finnis; identical to SEQ ID NO: 616
  PURPLE ACID PHOSPHATASE 23

SEQ ID NO: 12795 - protein, 305 aa, Piromyces finnis; identical to SEQ ID NO: 617
  PURPLE ACID PHOSPHATASE 23

SEQ ID NO: 12796 - protein, 342 aa, Piromyces finnis; identical to SEQ ID NO: 618
  PURPLE ACID PHOSPHATASE 23

SEQ ID NO: 12797 - protein, 342 aa, Piromyces finnis; identical to SEQ ID NO: 618
  PURPLE ACID PHOSPHATASE 23

SEQ ID NO: 12798 - protein, 80 aa, Neocallimastix californiae
  Purple acid phosphatase, N-terminal domain
ESKLNFGWYSKSKEYPLIRFGVSKDLTEENEVTGTSYQCKNIDDVQYYCNQVTVTGLESLSTYYYQRNLNGKWEDVIEFK

SEQ ID NO: 12799 - protein, 73 aa, Neocallimastix californiae
  Purple acid phosphatase, N-terminal domain
WESVTDNKPYIRISKNSDMTDYKEFSGDNDFYRKLGGSTYYVNKVTVEGLEHNTEYYYQRKLNEDWEEAAKFT

SEQ ID NO: 12800 - protein, 79 aa, Neocallimastix californiae
  Purple acid phosphatase, N-terminal domain
TKLNFGWYSISNEYPLIRFGSTSDLTEKDEVRGINFKCKNINDTQYYCNHITVTGLKSNTIYYYQRNLNGNWEETIEFE

SEQ ID NO: 12801 - protein, 80 aa, Neocallimastix californiae
  Purple acid phosphatase, N-terminal domain
ESQLNFGWYSTTTEYPLIRFGTTKELTEEDEVKGDNYECKAINGVQYYCNQVSVTGLKPNSIYYYKRNLDGTWEETIEFK

SEQ ID NO: 12802 - protein, 49 aa, Neocallimastix californiae
  Purple acid phosphatase, N-terminal domain
FNGKNEYYRELDRKKYYANQVTVTGLKPNSVYYYQRKLDDEWEDVVEFN

SEQ ID NO: 12803 - protein, 47 aa, Neocallimastix californiae
  Purple acid phosphatase, N-terminal domain
GENEFYRKKDDVNYYSNKVTVSGLEPNSVYYYQRKLNNKWEDPVKFN

SEQ ID NO: 12804 - protein, 80 aa, Neocallimastix californiae
  Purple acid phosphatase, N-terminal domain
ESQLNFGWYSTSSDYSLIRFGTSKKLSEKDEFVGSSYVCKNIKNVQYYCNQVTVTGLERNSIYYYQRNLNGKWEDPIEFK

SEQ ID NO: 12805 - protein, 80 aa, Neocallimastix californiae
  Purple acid phosphatase, N-terminal domain
ESQLNFGWYSTTTDYSLIRFGTTKYLTKENEVRGTNYKCKAINGTQYYCNQVTVIGLEPNSTYYYQRNLNGNWEESIEFK

SEQ ID NO: 12806 - protein, 92 aa, Neocallimastix californiae
  Purple acid phosphatase, N-terminal domain
ISVFSGDNESMLNFGWYSTEDTKPVIRFGTQEDMSDAKEFTGNVEYYKNLLIGSRKYSIYSNQVTVSGLERNNTYYYQRYIDGKWEKSVKFV

SEQ ID NO: 12807 - protein, 49 aa, Neocallimastix californiae
  Purple acid phosphatase, N-terminal domain
FTGKTEYYREFYGMNYYSNQVTVTNLKPNSIYYYQRQLNGKWEDPVQFN

SEQ ID NO: 12808 - protein, 79 aa, Neocallimastix californiae
  Purple acid phosphatase, N-terminal domain
TQLNFGWESLTNIEPVIRISSDKNMKIYKDFIGKNEYYRELDGNKYYSNQVTTTGLKPNSVYYYQRKLDGKWEDVVEFN

SEQ ID NO: 12809 - protein, 81 aa, Neocallimastix californiae
  Purple acid phosphatase, N-terminal domain
DESKLNFGWYSSTKSSPIIRFYTNKDKSEYKDFTGSVEYYKKINGKKYYSNKVTVTGLKRNKTYYYRRSLNGEWESSVKFK

SEQ ID NO: 12810 - protein, 44 aa, Anaeromyces robustus
  Purple acid phosphatase, N-terminal domain
NRSKYIRKQGYMINRVTVSGLERNKTYYYQVYMDGEWEKPVEFK

SEQ ID NO: 12811 - protein, 74 aa, Anaeromyces robustus
  Purple acid phosphatase, N-terminal domain
GWYSTSGTEPAIRLSSNKDMSDYTDFIGTVVYYKIQTRVKYYSNKVTVTGLERNSIYYYQRKLNGKWEDPVQFN

SEQ ID NO: 12812 - protein, 74 aa, Anaeromyces robustus
  Purple acid phosphatase, N-terminal domain
GWYSRTDDSPIIRFGPKKDMNKNKEFVGTVNFFRNIKGIPYYTNRVTVTDLKPRSTYYYQRKLNGEWEDIIEFK

SEQ ID NO: 12813 - protein, 84 aa, Anaeromyces robustus
  Purple acid phosphatase, N-terminal domain
TPGEDESKLNFAWYSRSEENPVMRLSENEDMSDYTEFTGTNNYIRKYLGDKYYSNKISIEGLKPKSTYYYQRLLNDEWEAPIKY

SEQ ID NO: 12814 - protein, 75 aa, Anaeromyces robustus
  Purple acid phosphatase, N-terminal domain
FGWYSTTETEPVIRFGSNEDMSNAKEFIGTREFAKALDGKNYYSNKVVVTGLERNSIYYYQRKLNNEWDRPVQFR

SEQ ID NO: 12815 - protein, 74 aa, Anaeromyces robustus
  Purple acid phosphatase, N-terminal domain
GWYSTTNKTPVIRLSSNKDMSNYKDFTGSNELYKTLSGINYYSNKVTVTGLDRNSVYYYQRQLNGIWEDPILFK

SEQ ID NO: 12816 - protein, 78 aa, Anaeromyces robustus
  Purple acid phosphatase, N-terminal domain
SMVNFGWYSTTESNPIIRFSSNQDMSNAKNFIGTIEKYMVLNNKTYYSNKVTVTGLEPHSTYYYQRNLNGKWDEPISF

SEQ ID NO: 12817 - protein, 49 aa, Anaeromyces robustus
  Purple acid phosphatase, N-terminal domain
FVGKIEFYREIGGQSYYSNKVTISGLERSSTYYYQRRLNNKWESAIKFN

SEQ ID NO: 12818 - protein, 84 aa, Anaeromyces robustus
  Purple acid phosphatase, N-terminal domain
VGEDESKLNFGWYSTSNSKPKIRFGSKKDLSDAKDFTGTNSYYKTLNGKKYYSNKVTVTGLKRKSTYYYRRNLNGKWEETIRFN

SEQ ID NO: 12819 - protein, 81 aa, Piromyces finnis
  Purple acid phosphatase, N-terminal domain
DESSLNFGWYSTTETIPSICWGTTKDTSDCEEFKGTVTYFKDLSGTSYYSNAVTVKNIKRNTTYYYKRKLNGQWEKPIQFK

SEQ ID NO: 12820 - protein, 86 aa, Piromyces finnis
  Purple acid phosphatase, N-terminal domain
FVGDNESELNFGWLSLTDKEPAILFGKMKDLSDGEIFTGSNTLYRKIFDESYYSNKVTVTGLERESVYYYKRKLNGRWEDEIIQFK

SEQ ID NO: 12821 - protein, 94 aa, Piromyces finnis
  Purple acid phosphatase, N-terminal domain
VGEDETKINFGWYSTQNSTPKIRIGKNKDMSDAITYRGTTEIQIERIDYGGSFYYNEDNVLLNGKRYFTHRVTVENIERNTTYYYQRYIYGEWE

SEQ ID NO: 12822 - protein, 78 aa, Piromyces finnis
  Purple acid phosphatase, N-terminal domain
LNFGWYSTTKNEVPTICWGTDENLNDCKEFIGTSEKHYKVSGIQYYSNKVSVTGLERNSVYYYKRKLNGQWEKPIQFK

SEQ ID NO: 12823 - protein, 78 aa, Piromyces finnis; identical to SEQ ID NO: 12822
  Purple acid phosphatase, N-terminal domain

SEQ ID NO: 12824 - protein, 69 aa, Piromyces finnis
  Purple acid phosphatase, N-terminal domain
ETKLNFGWYSTTKTLPSIRYSVNKDMSDAVQYDGYFEQHYKLNGTQYYSNKVTIEDLKPNTVYYYQRLL

SEQ ID NO: 12825 - protein, 69 aa, Piromyces finnis; identical to SEQ ID NO: 12824
  Purple acid phosphatase, N-terminal domain

SEQ ID NO: 12826 - protein, 88 aa, Piromyces finnis
  Purple acid phosphatase, N-terminal domain
SVGEDESMLNFGWYSTMDEIPSIRYGTAEEDESQYKEFTGTLLKHRTIKDTVYYSNKVTITGLQRNTIYYYQRKLNGIWEPAVEFKTY

SEQ ID NO: 12827 - protein, 88 aa, Piromyces finnis; identical to SEQ ID NO: 12826
  Purple acid phosphatase, N-terminal domain

SEQ ID NO: 12828 - protein, 88 aa, Piromyces finnis; identical to SEQ ID NO: 12826
  Purple acid phosphatase, N-terminal domain

SEQ ID NO: 12829 - protein, 88 aa, Piromyces finnis; identical to SEQ ID NO: 12826
  Purple acid phosphatase, N-terminal domain

SEQ ID NO: 12830 - protein, 79 aa, Neocallimastix californiae
  Purple_acid_Pase_N
KLNFGWYSKSKEYPLIRFGVSKDLTEENEVTGTSYQCKNIDDVQYYCNQVTVTGLESLSTYYYQRNLNGKWEDVIEFKT

SEQ ID NO: 12831 - protein, 75 aa, Neocallimastix californiae
  Purple_acid_Pase_N
GWYSISNEYPLIRFGSTSDLTEKDEVRGINFKCKNINDTQYYCNHITVTGLKSNTIYYYQRNLNGNWEETIEFET

SEQ ID NO: 12832 - protein, 75 aa, Neocallimastix californiae
  Purple_acid_Pase_N
WQSLLNDDKPKIRISSNSNMSDYKEFVGTNDNYRYVNKDIYYQNKVTVTGIERNSVYYYQRYINKIWENPVEFKT

SEQ ID NO: 12833 - protein, 78 aa, Neocallimastix californiae
  Purple_acid_Pase_N
NFGWYSTTTEYPLIRFGTTKELTEEDEVKGDNYECKAINGVQYYCNQVSVTGLKPNSIYYYKRNLDGTWEETIEFKTK

SEQ ID NO: 12834 - protein, 90 aa, Neocallimastix californiae
  Purple_acid_Pase_N
IALTPGADETQLNFGWESSTSSKPVIRVSSDKDMKNYVDFNGKNEYYRELDRKKYYANQVTVTGLKPNSVYYYQRKLDDEWEDVVEFNTY

SEQ ID NO: 12835 - protein, 74 aa, Neocallimastix californiae
  Purple_acid_Pase_N
WESTTEFEPSIRLSTSRDMENAKIFDGENEFYRKKDDVNYYSNKVTVSGLEPNSVYYYQRKLNNKWEDPVKFNT

SEQ ID NO: 12836 - protein, 80 aa, Neocallimastix californiae
  Purple_acid_Pase_N
SQLNFGWYSTSSDYSLIRFGTSKKLSEKDEFVGSSYVCKNIKNVQYYCNQVTVTGLERNSIYYYQRNLNGKWEDPIEFKT

SEQ ID NO: 12837 - protein, 81 aa, Neocallimastix californiae
  Purple_acid_Pase_N
SKLNFGWYSTHQETPVIRFGSKQDMSDAKEFMGNSEFHRELKGIRYFSNKVTVDGIKRKSTYYYQRKLNSQWEETIQFDTH

SEQ ID NO: 12838 - protein, 76 aa, Neocallimastix californiae
  Purple_acid_Pase_N
FGWYSTTTDYSLIRFGTTKYLTKENEVRGTNYKCKAINGTQYYCNQVTVIGLEPNSTYYYQRNLNGNWEESIEFKT

SEQ ID NO: 12839 - protein, 81 aa, Neocallimastix californiae
  Purple_acid_Pase_N
TQLNFGWESITDIEPVIRISSREDMKNYKDFTGKTEYYREFYGMNYYSNQVTVTNLKPNSIYYYQRQLNGKWEDPVQFNTY

SEQ ID NO: 12840 - protein, 90 aa, Neocallimastix californiae
  Purple_acid_Pase_N
IALTPGADETQLNFGWESLTNIEPVIRISSDKNMKIYKDFIGKNEYYRELDGNKYYSNQVTTTGLKPNSVYYYQRKLDGKWEDVVEFNTY

SEQ ID NO: 12841 - protein, 82 aa, Neocallimastix californiae
  Purple_acid_Pase_N
DESKLNFGWYSSTKSSPIIRFYTNKDKSEYKDFTGSVEYYKKINGKKYYSNKVTVTGLKRNKTYYYRRSLNGEWESSVKFKT

SEQ ID NO: 12842 - protein, 76 aa, Anaeromyces robustus
  Purple_acid_Pase_N
WYSVGKSYPKVRLSTDKKMSNPIEFEGDLVRNRSKYIRKQGYMINRVTVSGLERNKTYYYQVYMDGEWEKPVEFKT

SEQ ID NO: 12843 - protein, 81 aa, Anaeromyces robustus
  Purple_acid_Pase_N
SQLNFGWYSTSGTEPAIRLSSNKDMSDYTDFIGTVVYYKIQTRVKYYSNKVTVTGLERNSIYYYQRKLNGKWEDPVQFNTY

SEQ ID NO: 12844 - protein, 74 aa, Anaeromyces robustus; identical to SEQ ID NO: 12812
  Purple_acid_Pase_N

SEQ ID NO: 12845 - protein, 81 aa, Anaeromyces robustus
  Purple_acid_Pase_N
SMLNFGWYSTTETEPVIRFGSNEDMSNAKEFIGTREFAKALDGKNYYSNKVVVTGLERNSIYYYQRKLNNEWDRPVQFRTQ

SEQ ID NO: 12846 - protein, 80 aa, Anaeromyces robustus
  Purple_acid_Pase_N
SMLNFAWYSKTESIPTIRLSTKEDMSNYTEFTGINEYHRIYIEDPYYTNKVTVTGINRQSTYYYQRKLNDQWEDPIKFTT

SEQ ID NO: 12847 - protein, 83 aa, Anaeromyces robustus
  Purple_acid_Pase_N
VGEDESMVNFGWYSTTESNPIIRFSSNQDMSNAKNFIGTIEKYMVLNNKTYYSNKVTVTGLEPHSTYYYQRNLNGKWDEPISF

SEQ ID NO: 12848 - protein, 74 aa, Anaeromyces robustus
  Purple_acid_Pase_N
WYSKTKTEPAIRVSKYKNMKPYVDFVGKIEFYREIGGQSYYSNKVTISGLERSSTYYYQRRLNNKWESAIKFNT

SEQ ID NO: 12849 - protein, 87 aa, Anaeromyces robustus
  Purple_acid_Pase_N
VFVGEDESKLNFGWYSTSNSKPKIRFGSKKDLSDAKDFTGTNSYYKTLNGKKYYSNKVTVTGLKRKSTYYYRRNLNGKWEETIRFNT

SEQ ID NO: 12850 - protein, 81 aa, Piromyces finnis
  Purple_acid_Pase_N
SSLNFGWYSTTETIPSICWGTTKDTSDCEEFKGTVTYFKDLSGTSYYSNAVTVKNIKRNTTYYYKRKLNGQWEKPIQFKTY

SEQ ID NO: 12851 - protein, 85 aa, Piromyces finnis
  Purple_acid_Pase_N
GDNESELNFGWLSLTDKEPAILFGKMKDLSDGEIFTGSNTLYRKIFDESYYSNKVTVTGLERESVYYYKRKLNGRWEDEIIQFKT

SEQ ID NO: 12852 - protein, 105 aa, Piromyces finnis
  Purple_acid_Pase_N
ISVFVGEDETKINFGWYSTQNSTPKIRIGKNKDMSDAITYRGTTEIQIERIDYGGSFYYNEDNVLLNGKRYFTHRVTVENIERNTTYYYQRYIYGEWEDAVQYDT

SEQ ID NO: 12853 - protein, 86 aa, Piromyces finnis
  Purple_acid_Pase_N
GEDESQVNFGWYSTTEDKPVIYWCTSEDLSNCEEFTGTNEKHYELQGIQYYSNKVSVTNLDRNSVYYYKRKLNGQWEEDLIEFKTH

SEQ ID NO: 12854 - protein, 81 aa, Piromyces finnis
  Purple_acid_Pase_N
TMLNFGWYSTTKNEVPTICWGTDENLNDCKEFIGTSEKHYKVSGIQYYSNKVSVTGLERNSVYYYKRKLNGQWEKPIQFKT

SEQ ID NO: 12855 - protein, 81 aa, Piromyces finnis; identical to SEQ ID NO: 12854
  Purple_acid_Pase_N

SEQ ID NO: 12856 - protein, 71 aa, Piromyces finnis
  Purple_acid_Pase_N
TKLNFGWYSTTKTLPSIRYSVNKDMSDAVQYDGYFEQHYKLNGTQYYSNKVTIEDLKPNTVYYYQRLLNGE

SEQ ID NO: 12857 - protein, 71 aa, Piromyces finnis; identical to SEQ ID NO: 12856
  Purple_acid_Pase_N

SEQ ID NO: 12858 - protein, 91 aa, Piromyces finnis
  Purple_acid_Pase_N
LSVSVGEDESMLNFGWYSTMDEIPSIRYGTAEEDESQYKEFTGTLLKHRTIKDTVYYSNKVTITGLQRNTIYYYQRKLNGIWEPAVEFKTY

SEQ ID NO: 12859 - protein, 91 aa, Piromyces finnis; identical to SEQ ID NO: 12858
  Purple_acid_Pase_N

SEQ ID NO: 12860 - protein, 91 aa, Piromyces finnis; identical to SEQ ID NO: 12858
  Purple_acid_Pase_N

SEQ ID NO: 12861 - protein, 91 aa, Piromyces finnis; identical to SEQ ID NO: 12858
  Purple_acid_Pase_N

SEQ ID NO: 12862 - protein, 178 aa, Neocallimastix californiae
  PyrdxlP-dep_Trfase_major_sub1
NIANVALFTTLVTRSDYIFYDSSSSKHVLDAISFSKAKTLSYSHVNAIENIENQVKLVHEKFPKSKKVIVSSSIFMNEGDICQLKDIHRIAQNYQCIVVIDDTFGCGFFDGSSNNILEFFKFKGQIDFITGSFSGIMESNGGFIVYGENQKSFMNSLKINYERDAILPNTAGALLASY

SEQ ID NO: 12863 - protein, 221 aa, Neocallimastix californiae
  PyrdxlP-dep_Trfase_major_sub1
PRMKQAAYEAIEQYGLSPLGSAPFGGLTNLHEKLGYRLGKIYGLPYGITTSGATLANMTIIPLIVGAKDFVFSDELNHTTIIDGIDLSKAKMIKYKHNDMEDLEKNVKLIHEKFPNSVKLIIFDGVFSMEGDVCDLPNIVRIAKKYNCKTMIDECHALGIIGPHGYGTLDYFNMPGSVDFVTGTLVKSLCSHGGYICCRRDYQNKLENSSGIIFSTNNTPA

SEQ ID NO: 12864 - protein, 208 aa, Neocallimastix californiae
  PyrdxlP-dep_Trfase_major_sub1
NVINEFGCGILKGITSYHEKTEDILKSIYQFPSCYTLSGDGNSFIIPLIVGKNDAIFIDECAKTSINDSAELSNSKIYYYKHNNASGLEACLLKASQELPNSKKLIIIEGVYNITGEISNLVEFINVSKKFGGIVLVDESHALGVLGKEGKGSLEYANIHEGVDVITGSLEYSLCSNGSYILLNNELSKQFNDLIFINDTITPLSAAI

SEQ ID NO: 12865 - protein, 221 aa, Neocallimastix californiae
  PyrdxlP-dep_Trfase_major_sub1
AERVIKEYGIGSYGIFTPYHVELYQHLKEIYGEDYDHIQTYQGDIRDVFFSKLFDSNDFIFYDEQLNSSFRQVLRALHFKKNQLVEFNHNDAFDLSEKLEAIDLISPDAHKYIITEGVFELQGDLCHLQDIFNISKKYDCYVILDESNALGVIGKEGLGSYNYHQCQEKADIVFCSMDKVLCASGQFYVFNQRISTLLARRLTDLFNETIYPPVSTLAAAV

SEQ ID NO: 12866 - protein, 225 aa, Anaeromyces robustus
  PyrdxlP-dep_Trfase_major_sub1
VKKAAVEAIELYGLNADNQCPLKIQLEKKLSNEYDYPYSTVFSGANICNVALFTTLATKNDYIFYDSSSSKHVLDAISFSKAKILSYSHVNAIENLEKQVKIVHEKFPNSKKIIVSSSVFINEGDICQLNDINKIAQSYQCIVVIDDTFGCGYFDGSANNILEFYKLKGQIDFICGSFSGIMESNGGFIVYGENQKSFMDLISKNYERDAILPNIASAILASYEC

SEQ ID NO: 12867 - protein, 155 aa, Anaeromyces robustus
  PyrdxlP-dep_Trfase_major_sub1
AIFINEGSKTSIKDGAELSNANVYYYKHNDISSLEASLVKANQELPNGKKLITVEGVYEITGEVVNLSEFITVAKKYGGLVLLDESHALGVLGAKGKGSMENANIHDGVDIITGSLEYSLCSNGSYFLLNQNLSQQFSDLIFINDIITPLSAAIS

SEQ ID NO: 12868 - protein, 209 aa, Piromyces finnis
  PyrdxlP-dep_Trfase_major_sub1
QVINEFGCGIFRGLTTYHKKTEDILKAIYQFPTCYTLSGDGNSFVIPLMVGKGDAIFVDVEAKTSIKDGSELSNATVYYYSHNDPISLESCLLKANQEVPNGKKLVVIEGVYKISGDVAKLNEFIPIAKKYDATILVDESHALGVLGARGRGSLEQFNVREGVDIITGSLEYSLCSNGSYFLLNKQLTQQFSGFISINDTITPLSAAIA

SEQ ID NO: 12869 - protein, 220 aa, Piromyces finnis
  PyrdxlP-dep_Trfase_major_sub1
VKLEAEKAIKEYGLGSYGIFTPYHAELTEYIEKIYGEDCSIRTFQNDIRDILFNSLVSSQDFIFIDEQLNTSFKQTIKSLFLEKGHIIEYTHNTPLDLKSQLKAIQLKFPTVNKFIITEGVFENIGDVCYLNDIMDISKEFGCTLVLDESNALGVIGQKGFGSYDYHQCQQKADIIFCSMDKTLCSSGQFYVFNNKSISILLKNNTSLFDESIYYPINAL

SEQ ID NO: 12870 - protein, 198 aa, Piromyces finnis
  PyrdxlP-dep_Trfase_major_sub1
KVKKAAIEAIEKYGLNSDIQCPLKIQLEQKLSKDYGYQYAATFSGANVANISLFTTLVTRMDYIFYDSSSSKNVIDAVLFSKAKTLSYSHANAIENLEKQVKLVHEKFPKSKKVIASSSIFVNEGDICQLKEINRIAQTYQCIVVIDDTFGCGFFDGSSNNILEFYKLKGQVDFITGSFSGIMESNGGFIAYGENQKE

SEQ ID NO: 12871 - protein, 221 aa, Piromyces finnis
  PyrdxlP-dep_Trfase_major_sub1
PRMKEAAYKAIEQYGLSPLGSAPFGGLTNLHEKLGYRLGKIYGLPYGITTSGATLANMTIIPLIVGAKDFVFSDELNHTTIIDGIDLSKAKMIKYKHNDMEDLEKNVKLIHEKFPDRVKLIIFDGVFSMEGDVCDLPNIVRIAKQYNCKTMMDECHALGIIGPHGYGTLDYFNMPGSVDFVTGTLVKSLCAHGGYICCRRDYQNKLENSSGIIFSTNNTPA

SEQ ID NO: 12872 - protein, 91 aa, Neocallimastix californiae
  PyrdxlP-dep_Trfase_major_sub2
NRRLQLFKNILHWKNGLKRIGLDIPNHSKSTVIPIFMPTNESGIAVQKALQTQGLYVSYESNEKDVQHHYKIITSIQTRMTSDEIDQALEI

SEQ ID NO: 12873 - protein, 109 aa, Neocallimastix californiae
  PyrdxlP-dep_Trfase_major_sub2
AATSLKALDLIEEEGPNSVRARLQRNVKHWKEGVRNLGFEIIEGVSCVCPIMIYDEINGLKFQKRLYEEGLNFSAVAFPAVPKNMARLRTTVLGSLTDEDIDEALSILG

SEQ ID NO: 12874 - protein, 96 aa, Neocallimastix californiae
  PyrdxlP-dep_Trfase_major_sub2
STTLDILRQDSKTVDQLKNNVSWWRSHCQQNGIELIDSNSAISAIRIDDKGILLNLQRRLYDEGLNVMVSTRPYGLLKFILSASLTEDLLEEAMDI

SEQ ID NO: 12875 - protein, 95 aa, Anaeromyces robustus
  PyrdxlP-dep_Trfase_major_sub2
TTLEILRQDAKMIQQLKDNISWWRSHCQQNGIELIDSNSAIAAIRIDDDSVLLNLQKRLYEEGLNVMVSNNPYGLLKFIFSASLTEDLLEEAMDI

SEQ ID NO: 12876 - protein, 95 aa, Piromyces finnis
  PyrdxlP-dep_Trfase_major_sub2
TTLDILRQDTKMIEQLKSNISWWRTNCQQNGIELIDSTSSITAIKIDDENVLLNLQKRLFEEGLNVMVSTSPYGLLKFILSASLTEDLLEKAMNI

SEQ ID NO: 12877 - protein, 116 aa, Piromyces finnis
  PyrdxlP-dep_Trfase_major_sub2
AAVAKTVLNIIFENTTDFKNITSSIDVHTQLVDNINYWKQKCQSIGLKLIDSPSAITSIIIDDVDAESLVELLFKNNIKCSFTKQINHNINTNILKFNILRSMTKKFINEAFNILQ

SEQ ID NO: 12878 - protein, 94 aa, Piromyces finnis
  PyrdxlP-dep_Trfase_major_sub2
ITRRHQLFKNILQWKNGLKGIGLDVPSHSKSATIPIFMPTDDAGIAFHKALQEQGLYVSYESSERDAIHKYKILTTVQANKTKDEIDSALKIIG

SEQ ID NO: 12879 - protein, 109 aa, Piromyces finnis
  PyrdxlP-dep_Trfase_major_sub2
AATSLKALDLIEEEGPNSVRARLQRNIKHWKDGIRNLGFKIIEGVSCVCPIMIYDEINGLKFQRRLYEEGLNFSAVAFPAVPKNQARLRTTILASLTDDDIDEALSIIG

SEQ ID NO: 12880 - protein, 147 aa, Neocallimastix californiae
  Rhamnogal_lyase
GVSLTQNNNSYILKNNYATVVISKKDGYITSLKIAGDNQEFLNRAYIDANGSKAGFHAKKSTIIKNTNDHVEIAFTDNVLNMDWEVRYTMLNDTKGVYFSLKLDHKASYADTQFSEIRLVFRLKSNPFNWLQIEDNVGRYLPTAEEQ

SEQ ID NO: 12881 - protein, 169 aa, Anaeromyces robustus
  Rhamnogal_lyase
SAKVNLTENNTSYILSNGLATFTIAKSSGFITSMKYKNNSQEFLNRSYIDANGGKVYFSVTSSSVVIRTDDLVEIVFYDDYSKHVGTGFAIDWEVRYTMRSGVSGLYFSLTQAHKSNYEEAQCSELRLVMRLKSDVFNWLQVDDFTKRVMPTAAQQNKCTTLSPQEACQ

SEQ ID NO: 12882 - protein, 166 aa, Piromyces finnis
  Rhamnogal_lyase
SASVTLTENNTSYILSNGLATFTIAKSSGFITSMKYKNNSQEFLNRSYIDANGGKVYFSVTSSYVATKNSDLVEIVFVDDYSKHVGTGFAIDWEVRYTMKSNVSGIYFSLTQSHKSNYEEAQCSELRLVMRLKSDVFNWLQVDDFNKRVMPTASEQSKCVTLSPSE

SEQ ID NO: 12883 - protein, 165 aa, Piromyces finnis
  Rhamnogal_lyase
VSLTDNGSSYILRNDYAIVTIAKNSGYITSLKLNGNNQEFLNRSYIDANGGKVYFSPQSSKVIKNTSSHVEVAFYDNYNSNSKLGLDWEVRYTMLSDTRGVYYSLTNTHKTNYPETSYSEIRLVLRLKADIFNHLQVEDDVYRDMPSAADQNKCVEMGPKEACQL

SEQ ID NO: 12884 - protein, 263 aa, Neocallimastix californiae
  RhgB_N
LTQNNNSYILKNNYATVVISKKDGYITSLKIAGDNQEFLNRAYIDANGSKAGFHAKKSTIIKNTNDHVEIAFTDNVLNMDWEVRYTMLNDTKGVYFSLKLDHKASYADTQFSEIRLVFRLKSNPFNWLQIEDNVGRYLPTAEEQKNCEVMGPKEACKVKTGEVLHKYDWSIDALKHDVHGFSTKNGLGCWFVLPSMEWKNGGAYNRDLACHNGENDSIQIMYMAGSHYGAGDEYPKKGENWSKVYGPYLIYVNKAGSPQASWK

SEQ ID NO: 12885 - protein, 234 aa, Piromyces finnis
  RhgB_N
LTDNGSSYILRNDYAIVTIAKNSGYITSLKLNGNNQEFLNRSYIDANGGKVYFSPQSSKVIKNTSSHVEVAFYDNYNSNSKLGLDWEVRYTMLSDTRGVYYSLTNTHKTNYPETSYSEIRLVLRLKADIFNHLQVEDDVYRDMPSAADQNKCVEMGPKEACQLPNGEVIHKYDWSVDMLKHHIHGFSSKSTGLGCWFVIPSLEWKNGGAYNRDLSCHQGGSDSLQIMYMNGSHY

SEQ ID NO: 12886 - protein, 135 aa, Neocallimastix californiae
  RICIN
WYYIKNTGSDKYLQANGSSAGANVEIGSFTGYSDQKWKVTTNGEGYITLLNGNGNFNLDVDSAKNENGANILIYDAYGGVAQQFALTAGSGNSFIITTRVSNGGKAIDVYENRTNDGANVCQWSVNGNSNQTWVF

SEQ ID NO: 12887 - protein, 135 aa, Neocallimastix californiae; identical to SEQ ID NO: 12886
  RICIN

SEQ ID NO: 12888 - protein, 135 aa, Neocallimastix californiae
  RICIN
GNYYIKSNFANKYLVVRDGRGANAQNVEIGSTKQKWKITNNDDGTVYIVSEFGNFSLDVDRGSGDNGANIQIYSHHGGEAQKFIIRETNQSGVYVIDTQASNGYRALDVEGERTSEGTNVCQWDDSGKSNQTWTF

SEQ ID NO: 12889 - protein, 134 aa, Neocallimastix californiae
  RICIN
YKIKNPVSGLYLQVANAEGADAQNVEIGTDSEQMWKLTNLGDNYVTLTSSLGNFNLDICMAEDENGTNAQIYTVHNEDPQKFVIMETKDKDVYVIGTKGSNGYKVLDVESYGTTPGSNVYQWENEGKDNQVWTF

SEQ ID NO: 12890 - protein, 134 aa, Neocallimastix californiae
  RICIN
GWYYITNTNSNKYLSVRNGVGANSQNVELGSTQQKWKLTNNSDGSVTLVSEVGDFALDVSGGSSDNGANVQIYSNYGGDAQKFYIREVSSNVYTITTKVSNGEKALDAEGARTSDGTNILQWTDEGKSNQTWTF

SEQ ID NO: 12891 - protein, 134 aa, Neocallimastix californiae; identical to SEQ ID NO: 12890
  RICIN

SEQ ID NO: 12892 - protein, 138 aa, Neocallimastix californiae
  RICIN
GWYYIKNPSTGKYIQVEDGVGRNSANVVIGSERKDDAQKWKVTNTNGYVTFTSALGNYMIDIANGEDRNGANVQIYDAYGGDAQQFIIYKTGRENVYTIGTKASAGDKAIDIEGARNGENVNLLQWTNEYKDNQTWSF

SEQ ID NO: 12893 - protein, 134 aa, Neocallimastix californiae
  RICIN
WYYIKNTGSGKYLNVKDGKAASTQNVVIGSSKQKWKLTNNSDNTVTLLSEVGDFMLDVNGGSSDNGANIQIYNAYGGDAQKFVIRETSQANVYVVSTKVSSGYKVLDVENEGKYDGSNICQWENGERSNQTWTF

SEQ ID NO: 12894 - protein, 135 aa, Neocallimastix californiae
  RICIN
GWYYIKNPSSGKYLVVKDKKGAASQNVEISSSKQKWKLTNNNDNTVTLLSEVGDFMLDVNGGSDKNNANIQIYHAYGGDAQKFIIKETSQSNVYVITTKVSNGSKALDIEKEGKNDGSNVLQWDNGTKSNQTWIF

SEQ ID NO: 12895 - protein, 134 aa, Neocallimastix californiae
  RICIN
WYYIKNTGSGKYLTVKGGVAVAGQNVEIGSTKQKWKLTNNDDNTVTLLSEVGDFMLDIDRGLEENGANIQIYHAYGGDAQRFIIKETGKSKVYVISSKITNGYKVLDVENQATADGSNVCQWENGERSNQTWTF

SEQ ID NO: 12896 - protein, 136 aa, Neocallimastix californiae
  RICIN
NGWYTIKNPESGKYLQVSNGRASDSANVVIGTNAQKWKLENVGNGYVTLVSMYGNYMLDIANGEDKDGSNLQIYSAYGGDAQQFIILKTPQNNVYAIGTKASEGTKVLDIEGGRTSEGSNVLQWTNGGKSNQTWTF

SEQ ID NO: 12897 - protein, 135 aa, Neocallimastix californiae
  RICIN
WYYIKNTGSNKYLQTVGSTANSNVEISSFTGSAAQKWKVTKNSEGYITLLNGVGDFNLDVANGKNENGVNILIYIAYGGEAQQFALSAGSNNSFIITTRVSNGDKALDVYEHRTEDGANVCQWTTSGKPNQTWVF

SEQ ID NO: 12898 - protein, 134 aa, Neocallimastix californiae
  RICIN
WYYIKNTGSNKYLTVKDGRGASSQNVEVNSRKQKWLLTNVGDDEVTLTTELGNYMLDVNSGSENNGANIQIYNSHGGDSQRFIIEETYQSDVYVIGTKVTNGYKVIDVEREGKDDGSNVCQWDNGEKPNQTWVF

SEQ ID NO: 12899 - protein, 136 aa, Neocallimastix californiae
  RICIN
GGKYNIVNRNSGKFLGVNNDSTSDGANVHQWSDNGKTSEQWIISDEGNGYKILNVNANKVLDVNDASYSDGANVILWSDNGNSNQRWIIQELGDGYVTIENYNSGKNLDVEKSSTSDGGNVLQWSNNGQNNQQWKL

SEQ ID NO: 12900 - protein, 134 aa, Neocallimastix californiae
  RICIN
WYYIKNSSSGKYLSVRNGVGANAQNVEIGSSKQKWKVTKNNDGSVVIISEFGNFALDIANGSGDNGANVQIYTTHGGDAQKFIIRETSNSGIFVIDTIASGGSKALDIEGGRSADGTNICQWDDSAKSNQTWTF

SEQ ID NO: 12901 - protein, 135 aa, Neocallimastix californiae
  RICIN
EGTYKLINRRSNKALAVQNDSKDNAANVVQWTESNKTSQQWKITEDGGYRILNVNADKALDVERDSTQNGGNIIIWPDTGNLNQRWTIEDAGNGYVEIVNLSSGKALDVENESTADGANVCQWDAHGSQNQQWKL

SEQ ID NO: 12902 - protein, 135 aa, Neocallimastix californiae
  RICIN
DGTYRIINRNSGKALSVVNDSKNNAASVVQYTYTGKSSQQWKIVEDGGYSFTNVNSNKVLDMNGASLEDGGNAIIWPDIAGPNQRWSIENAGDGYVYIINFNSNKVLDVANVSKEEGGNVHQWTITNGANQQWQL

SEQ ID NO: 12903 - protein, 136 aa, Neocallimastix californiae
  RICIN
GDRYKIINRYTNRVLAVENDSTANNANVLQWGDNGSSGQQWVVAKEGDQYRITSYTTNKALDVSGRSTADGGNVIIYDDKAQGNQRWKFIDAGDGYVIIENVNSGKVLDVDNASKEYGANIMQWRKNGSTNQQWKL

SEQ ID NO: 12904 - protein, 139 aa, Neocallimastix californiae
  RICIN
GWYFIKNPRSGLYLQVSNDYARASANIEIGTGTKSDGQKWKVTNVGDGYITLTTALGDFNIDIANGDDKNGANVQIYDAYGGNAQQFVVMTTSDSNTYTIGSKVSSGGKALDIENESTSDGANVCQWTNSSKGNQLWVF

SEQ ID NO: 12905 - protein, 138 aa, Neocallimastix californiae
  RICIN
KDGWYTIKNTGSGKYLNVDYGRASAGANVVIGSDAQKWKVENNSEGYVTLVSMYGNYMLDIAMGEDKNGANIQIYDAYGGDAQQFSLIETSKKGVYVIATKVSQNDKCLDVESASTAEGSNVLQWTNGGERSNQTWSF

SEQ ID NO: 12906 - protein, 137 aa, Neocallimastix californiae
  RICIN
KDGWYTIKNTGSGKYLQVQNGRASDSANVVIGSNAQKWKIQNIGDGYVTILSMYGDYMLDVANGEDVDGANVQIYSSYGGDPQQFIIAETSRSNVYVIGSKVSEGNKVIDIEHESTEEGSNVHQWTNSEKSNQTWVI

SEQ ID NO: 12907 - protein, 136 aa, Neocallimastix californiae
  RICIN
GGKYKIVNRNSGKVLAVVSDSTSNGADVIQWSDNGKTSQQWVITDEGNGYKIMNVNANKALDVSENSVKDGGDVIIWSDNGHNNQRWNIQDVGNGYVTIKNVNSGKNLDVEKESTSDGADVIQWGNNGNSNQQWKL

SEQ ID NO: 12908 - protein, 136 aa, Neocallimastix californiae
  RICIN
GGKYKIINRNSGKALGIDGDSTSNGANVIQWSDNGKTSQQWVITDEGNGYKIMNVNANKALDVNDNSMKDGGNVIIWNDNGNNNQRWNIQDIGGGYVTIENVNSGKNLDVEKGSTSDGGNVLQWGNNGNSNQQWKL

SEQ ID NO: 12909 - protein, 133 aa, Neocallimastix californiae
  RICIN
GEEYRIAIQLSGKYITAANNGNVHQWENLNDNSQVWYFEDAGNGKFAILSGKNRKLAMTVENGDSKNGNNILLTEYKNTAAQHFILHGVDDAYYITAECSGKASLDVYNQSYDNGANIDQWAYWGGECQKFYI

SEQ ID NO: 12910 - protein, 139 aa, Neocallimastix californiae
  RICIN
GWYFIKNSSSGKYLQVSNENSRAASNIEIGSSRKSDGQKWKLTNVGDGYVTLTSALGNFNVDVANGEDKNGANIQIYDAYGGNAQQFIIMTTSFSNVYTIGTKVSNGEKALDVENGSKSDGANVIQWKNESKDNQSWIF

SEQ ID NO: 12911 - protein, 134 aa, Neocallimastix californiae
  RICIN
GKDYMIMSHLSGKYITIANDGSIHQWEKLSDTKSQVWRFESAGNGRFAILSGNNALTVENGNNKDGNKIILSQYRKTSAQHFILHKTDGNYDTYYITAECSGNAALDVYDQSSDNGAKIDQWNYWGGDNQRFYI

SEQ ID NO: 12912 - protein, 136 aa, Neocallimastix californiae
  RICIN
GWYFIKNPSTGKYLTASGNSVPFNVIISTGYQEDNQKWKVTNAGNGYITLTSGLGDYMLDVANGSANNDANIQVYSAYGGDAQQFKLVEYGSGEFAIVTKSSNDGKAVDIANNGYTDGTNVLQWTNSGKSNQIWVF

SEQ ID NO: 12913 - protein, 139 aa, Neocallimastix californiae
  RICIN
GWYFIKNPSSGKYLQVANENGKNVANIEIGTGRQSDGQKWKLTNVGNGYVTLTSALGEFNIDIANGENKDGTNVQIYEAYGGEAQQFVILTTYTDDVYTIGTRVSNGDKALDIEGGRNSDGTNVLQWTNGSKGNQSWIF

SEQ ID NO: 12914 - protein, 140 aa, Neocallimastix californiae
  RICIN
GWYFIKNPASGKYLQVSGATNGGAGGNVVISTGTKDNGQKWKITNVGNGLVTFTTALGDYMIDVEAGSGKNDANIQLYNAYGGDAQQFMILKTTEKDVYTIGTKVSYFDKALDIAQAKTADGTNVVQWTNEMKANQSWTF

SEQ ID NO: 12915 - protein, 134 aa, Neocallimastix californiae
  RICIN
NGNYYIKNPNSGKYLRVGKAGNSQNVVIGSSAQKWKLTNTDDGYITLVSELGNYMIDVANGSGENNANVQIYDAYGGDAQKFVLLKTSQSNTYVIATKASNGYRVLDIEKNGTAEGSNVLQWDNQEKANQFWVF

SEQ ID NO: 12916 - protein, 137 aa, Neocallimastix californiae
  RICIN
KDGWYTIKNPNSNKYLQVSYGRGGDAVNVVIGSNPQKWKLENVGDGYVTLLTMYGDYMLDVAAGDSKDGANIQIYSAYGGDAQQFAIIPTSNGNTYVIGSKVSNGEKVLDIEKASTSEGSNVLQWVNGEKANQTWIF

SEQ ID NO: 12917 - protein, 135 aa, Neocallimastix californiae
  RICIN
GWYYIKNPASGKYLAVRNGIGADAQNVEISSTKQKWKISNNDDGTVLIISELGDYALDVSAGSSNNGANIQIYSAYGGEAQRFIIRETYTSGNYVITTKVTNGSRALDVEGNKTAEGTNICQWDDGEKSNQIWTL

SEQ ID NO: 12918 - protein, 137 aa, Neocallimastix californiae
  RICIN
EGTYKIVNRKSGKVLAVANDSKANAANVHQWTYIDGNASHHWKISEDGGYRILNVNANKVLDMNAESTADGGNAIIWPDTGGMNQRWVIESAGGNYVYIINSHSGKALDVDKSSNDDGGNIIQWSLSNNSSNQQWQL

SEQ ID NO: 12919 - protein, 132 aa, Neocallimastix californiae
  RICIN
WYTIKNTGSGKYLHVESAGNSENVVISSNASKWKLTNTNDGYITLTSSVGNYMLDVAGGEDKNGVNLQIYSAYSGDAQKFVILKTSNNKVYTIGSKVSNGGKVIDVEKRGTTDGSNVIQYALNGASNQTWTF

SEQ ID NO: 12920 - protein, 133 aa, Neocallimastix californiae
  RICIN
YYIMNTGSQRYLTVKDAKAANSQNIEVNSKKQKWKVMNTSEGTVTMESELGNYMIDVNGGSEANGANIQIYESYGGDAQQFYIRETYQKNVYSIGTKLTGGYKVLDVEKEGKTDGSNVCQWEDGGRSNQTWLF

SEQ ID NO: 12921 - protein, 136 aa, Neocallimastix californiae
  RICIN
GGKYKLINRNSGKALGVDGDSTSNAANVHQWTDNGKTSQQWIITDEGYGYKIMNVNANKALDVNENSTKNGGNVIIWSDNGNLNQRWYIEEIGDGYITLQNINSGLLLDVEKSSTSDGGNVLQWENNGNSNQQWKL

SEQ ID NO: 12922 - protein, 139 aa, Anaeromyces robustus; identical to SEQ ID NO: 12913
  RICIN

SEQ ID NO: 12923 - protein, 136 aa, Anaeromyces robustus; identical to SEQ ID NO: 12912
  RICIN

SEQ ID NO: 12924 - protein, 137 aa, Anaeromyces robustus; identical to SEQ ID NO: 12916
  RICIN

SEQ ID NO: 12925 - protein, 134 aa, Anaeromyces robustus; identical to SEQ ID NO: 12915
  RICIN

SEQ ID NO: 12926 - protein, 140 aa, Anaeromyces robustus; identical to SEQ ID NO: 12914
  RICIN

SEQ ID NO: 12927 - protein, 135 aa, Anaeromyces robustus; identical to SEQ ID NO: 12917
  RICIN

SEQ ID NO: 12928 - protein, 137 aa, Anaeromyces robustus; identical to SEQ ID NO: 12918
  RICIN

SEQ ID NO: 12929 - protein, 136 aa, Anaeromyces robustus; identical to SEQ ID NO: 12921
  RICIN

SEQ ID NO: 12930 - protein, 135 aa, Anaeromyces robustus
  RICIN
WYYIKNTGSNKYLTVKNGKGAAAQNVEINSTKQKWKVTNMDDNTITLLSELGDYMLDVSSGSSENGANIQIYDAYAGDAQKFVLRETSKEGVYVISTKVSNGYKVLDVEREGKSDGSNVCQWDNGGEKAHQTWVF

SEQ ID NO: 12931 - protein, 135 aa, Anaeromyces robustus
  RICIN
EGTYRIINRNSGKALSVANDSKNNAANVHQWTYSNKASQQWKITEDGGYRILNVNANKVLDMDNESLKDGGNALIWPDTGALNQRWLIEDAGNGYVNIINYNSEKALDVEKNSNADGGNVIQWTLTNSANQQWQL

SEQ ID NO: 12932 - protein, 131 aa, Anaeromyces robustus
  RICIN
GKDYNIVSVLSGKYVTAASNGNVQQYEKLNNDKSQIWRLESAGNGRFAILQGNMAMTVENGNNNNGNNIYMSEYRKTTAQHFSINRADNSYYIVAQCTVNAALDVFDQSKENGANIDQWDYWGGDNQKFYI

SEQ ID NO: 12933 - protein, 136 aa, Anaeromyces robustus
  RICIN
GGIYKLLNRNSGKALGIESDSTTDGANVHQWTDNSRTSQQWIFIDEGNGYKIMNVNAKKALDIYGSSVENNGNAIIMTDNGNSSQRWTVKDLGDGYYIIQNVNSGLLLDVERKSTADGGNVLQWPNNGNSNQQWKL

SEQ ID NO: 12934 - protein, 136 aa, Anaeromyces robustus
  RICIN
GNTFKIINRLSGKALSVNGDSTANEANVIQWTDNGKTSQQWIITQESNGYKIINVNANKALDVYKNSRDNGGNVIIWYDNGASNQRWNIQEVGNGYYTLQNLNSGKLLDVEKESRNDGGNVLQWVNNGNTNQQWQI

SEQ ID NO: 12935 - protein, 133 aa, Anaeromyces robustus
  RICIN
WYTIKNTGSGKYLQVSYGRAGDGVNVVIGSNAQKWKLENVSDGYVTLLTMYGDYMLDVAAGEDKDGANLQIYSSYGGDNQQFSILKISDDVYAIATKVSDSTKVLDVEKASTTDGSNVLQWKNKETSNQTWIF

SEQ ID NO: 12936 - protein, 137 aa, Piromyces finnis
  RICIN
SDGWYTIKNTGSGKYLQVSNGRAGDSANVVIGSSAQKWKLTNVDNGYVTLVSMYGNYMLDVANGDSKNGANLQIYTSHGGDAQQFIFLNTSKNNVYVIGTKASSGTKVLDIESEGTADGSNILQWENGEKSNQTWVI

SEQ ID NO: 12937 - protein, 134 aa, Piromyces finnis
  RICIN
WYYIKNTGSEKYLTVKNGKAANSQNVEVNSVKQKWLITNMDDDTITILSELGNYMLDVNGGSDKNGANIHIYDAYSGDPQRFIISETYQSNVYTIGTKVTYGEKVLDVENEGKSDGSNVCQWENGERSNQTWVF

SEQ ID NO: 12938 - protein, 134 aa, Piromyces finnis
  RICIN
GKDYMIVSQLSGKYITVGNNGNIHQWEKLSDTSSQVWRFESAGSGKFAILSGKMALTVENGNNKNGNKMILSQYQNNAAQRFIFHKTDDVYDNYYITAECSGNAALDVYDQSYDNGANIDQWDYWGGDNQKFYV

SEQ ID NO: 12939 - protein, 134 aa, Piromyces finnis
  RICIN
NYYIKSVSSNKYLVVKDGIGANAQNVEIGSTKQKWKISNNSDGTVYIISELGDYALDVDRGLGDNGANIQIYPLHGGEAQKFIIRETYPSGVYVIDTQASNGSKALDIEGERTADGTNVCQWTDGGKDNQSWTF

SEQ ID NO: 12940 - protein, 139 aa, Piromyces finnis
  RICIN
GWYFIKNPSTGKYLQVRDEEGKNVANIEIGSGRKSDGQKWKLTNVGDGYVTLTSALGEYNIDIANGEDKNGANVQIYEAYGGDAQQFVIMTTSTDNAYSIGTKASSGDKVIDIEGGYSTDGTNVCQWKSNSGPNQVWIF

SEQ ID NO: 12941 - protein, 136 aa, Piromyces finnis
  RICIN
NGTYKIINRQSGKVLSVNNDSTANAANVIQWSESNKSSQQWVISEEGDYFSLINVNAKKALDVNENSTENGGNVIIWPDTGALNQRWSIQSTGDGYYTITNANSGKNLDVEKGSMSDGGNVLQWGNNGGANQQWKL

SEQ ID NO: 12942 - protein, 136 aa, Piromyces finnis; identical to SEQ ID NO: 12941
  RICIN

SEQ ID NO: 12943 - protein, 136 aa, Piromyces finnis
  RICIN
NGTYKIINRRSGKALGVINDSTEDSANVHQWTDNGHKSQQWVISNEFNGIKIVNVNANKCLDVSGRSKDNGGNIVIYHDNGYMNQRWTFQDAGNGYITIRSSHSGKLIDVDNRATTDGANVLQWEPNGLDNQQWKL

SEQ ID NO: 12944 - protein, 139 aa, Piromyces finnis
  RICIN
GWYYIKNPASGKYLQVANNQAKATANIEIGSSSQDDGQKWLLTNVGEGYVTLKSALGDFMIDVSSGEDKNGANIQIYTAYGHDAQQFMILKSSVEGAYSITSRVSFQDKGIDIEGARTADGTNVLQWTSEGRANQLWAF

SEQ ID NO: 12945 - protein, 139 aa, Piromyces finnis; identical to SEQ ID NO: 12944
  RICIN

SEQ ID NO: 12946 - protein, 139 aa, Piromyces finnis; identical to SEQ ID NO: 12944
  RICIN

SEQ ID NO: 12947 - protein, 136 aa, Piromyces finnis
  RICIN
WYYIKNTGSNKYLQVKGNNGVANTNVEIGTFAGASGQKWKVTQTSDGYITLTSALGNFMLDVANAKDTDGNNILIYIGYSGDAQKFSLKPAGNSFIITTKVSNGKKALDVYNFGTSDGTNVCQWTVGGQSNQTWVF

SEQ ID NO: 12948 - protein, 139 aa, Piromyces finnis; identical to SEQ ID NO: 12944
  RICIN

SEQ ID NO: 12949 - protein, 136 aa, Piromyces finnis; identical to SEQ ID NO: 12947
  RICIN

SEQ ID NO: 12950 - protein, 134 aa, Piromyces finnis
  RICIN
WYYIKNTGSNKYLSVKGAVGANGQNVQISSTKQKWKIYNNNDGTVLLISEFGDYALDVSNGSGENGANIQIYSIHGGDAQKFIIRETFESNVYVIDTQASNGQRALDVEGARTDEGTNICQWSDEEKSNQTWTI

SEQ ID NO: 12951 - protein, 135 aa, Neocallimastix californiae
  Ricin B-like lectins
QDGWYTIKNTGSGKYLYVDKAGDVENVVIGSTARKWKLTNVSDGYVTLTSELGNYMLDVANGEDVNSANLQIYSAYGGNAQQFVILKTSNSNVYTIGTKASSGQRVLDVEKRGTTDGSNVIQYALNGASNQTWTF

SEQ ID NO: 12952 - protein, 138 aa, Neocallimastix californiae
  Ricin B-like lectins
TDGWYYIKNTGSDKYLQANGSSAGANVEIGSFTGYSDQKWKVTTNGEGYITLLNGNGNFNLDVDSAKNENGANILIYDAYGGVAQQFALTAGSGNSFIITTRVSNGGKAIDVYENRTNDGANVCQWSVNGNSNQTWVF

SEQ ID NO: 12953 - protein, 138 aa, Neocallimastix californiae; identical to SEQ ID NO: 12952
  Ricin B-like lectins

SEQ ID NO: 12954 - protein, 137 aa, Neocallimastix californiae
  Ricin B-like lectins
KDGNYYIKSNFANKYLVVRDGRGANAQNVEIGSTKQKWKITNNDDGTVYIVSEFGNFSLDVDRGSGDNGANIQIYSHHGGEAQKFIIRETNQSGVYVIDTQASNGYRALDVEGERTSEGTNVCQWDDSGKSNQTWTF

SEQ ID NO: 12955 - protein, 142 aa, Neocallimastix californiae
  Ricin B-like lectins
IEDGWYFIKNPKSGLYLQVSNEEARAVANIEIGSGSKSDGQKWKVTNVGDGYVTLTSALGDFNIDIANGEDKNGANVQIYDAYGGDAQQFVIMTTSTSNTYTIGTKISNGGKALDIENDSTYEGTNVCQWTNGSKGNQLWVF

SEQ ID NO: 12956 - protein, 138 aa, Neocallimastix californiae
  Ricin B-like lectins
ADGWYKIKNPVSGLYLQVANAEGADAQNVEIGTDSEQMWKLTNLGDNYVTLTSSLGNFNLDICMAEDENGTNAQIYTVHNEDPQKFVIMETKDKDVYVIGTKGSNGYKVLDVESYGTTPGSNVYQWENEGKDNQVWTF

SEQ ID NO: 12957 - protein, 136 aa, Neocallimastix californiae
  Ricin B-like lectins
INDGWYYITNTNSNKYLSVRNGVGANSQNVELGSTQQKWKLTNNSDGSVTLVSEVGDFALDVSGGSSDNGANVQIYSNYGGDAQKFYIREVSSNVYTITTKVSNGEKALDAEGARTSDGTNILQWTDEGKSNQTWT

SEQ ID NO: 12958 - protein, 136 aa, Neocallimastix californiae; identical to SEQ ID NO: 12957
  Ricin B-like lectins

SEQ ID NO: 12959 - protein, 140 aa, Neocallimastix californiae
  Ricin B-like lectins
EDGWYYIKNPSTGKYIQVEDGVGRNSANVVIGSERKDDAQKWKVTNTNGYVTFTSALGNYMIDIANGEDRNGANVQIYDAYGGDAQQFIIYKTGRENVYTIGTKASAGDKAIDIEGARNGENVNLLQWTNEYKDNQTWSF

SEQ ID NO: 12960 - protein, 138 aa, Neocallimastix californiae
  Ricin B-like lectins
LNDGWYYIKNTGSGKYLNVKDGKAASTQNVVIGSSKQKWKLTNNSDNTVTLLSEVGDFMLDVNGGSSDNGANIQIYNAYGGDAQKFVIRETSQANVYVVSTKVSSGYKVLDVENEGKYDGSNICQWENGERSNQTWTF

SEQ ID NO: 12961 - protein, 138 aa, Neocallimastix californiae
  Ricin B-like lectins
INDGWYYIKNPSSGKYLVVKDKKGAASQNVEISSSKQKWKLTNNNDNTVTLLSEVGDFMLDVNGGSDKNNANIQIYHAYGGDAQKFIIKETSQSNVYVITTKVSNGSKALDIEKEGKNDGSNVLQWDNGTKSNQTWIF

SEQ ID NO: 12962 - protein, 138 aa, Neocallimastix californiae
  Ricin B-like lectins
LNDGWYYIKNTGSGKYLTVKGGVAVAGQNVEIGSTKQKWKLTNNDDNTVTLLSEVGDFMLDIDRGLEENGANIQIYHAYGGDAQRFIIKETGKSKVYVISSKITNGYKVLDVENQATADGSNVCQWENGERSNQTWTF

SEQ ID NO: 12963 - protein, 137 aa, Neocallimastix californiae
  Ricin B-like lectins
KNGWYTIKNPESGKYLQVSNGRASDSANVVIGTNAQKWKLENVGNGYVTLVSMYGNYMLDIANGEDKDGSNLQIYSAYGGDAQQFIILKTPQNNVYAIGTKASEGTKVLDIEGGRTSEGSNVLQWTNGGKSNQTWTF

SEQ ID NO: 12964 - protein, 137 aa, Neocallimastix californiae
  Ricin B-like lectins
DGWYYIKNTGSNKYLQTVGSTANSNVEISSFTGSAAQKWKVTKNSEGYITLLNGVGDFNLDVANGKNENGVNILIYIAYGGEAQQFALSAGSNNSFIITTRVSNGDKALDVYEHRTEDGANVCQWTTSGKPNQTWVF

SEQ ID NO: 12965 - protein, 138 aa, Neocallimastix californiae
  Ricin B-like lectins
LKDGWYYIKNTGSNKYLTVKDGRGASSQNVEVNSRKQKWLLTNVGDDEVTLTTELGNYMLDVNSGSENNGANIQIYNSHGGDSQRFIIEETYQSDVYVIGTKVTNGYKVIDVEREGKDDGSNVCQWDNGEKPNQTWVF

SEQ ID NO: 12966 - protein, 136 aa, Neocallimastix californiae; identical to SEQ ID NO: 12899
  Ricin B-like lectins

SEQ ID NO: 12967 - protein, 138 aa, Neocallimastix californiae
  Ricin B-like lectins
ITDGWYYIKNSSSGKYLSVRNGVGANAQNVEIGSSKQKWKVTKNNDGSVVIISEFGNFALDIANGSGDNGANVQIYTTHGGDAQKFIIRETSNSGIFVIDTIASGGSKALDIEGGRSADGTNICQWDDSAKSNQTWTF

SEQ ID NO: 12968 - protein, 139 aa, Neocallimastix californiae
  Ricin B-like lectins
IIPEGTYKLINRRSNKALAVQNDSKDNAANVVQWTESNKTSQQWKITEDGGYRILNVNADKALDVERDSTQNGGNIIIWPDTGNLNQRWTIEDAGNGYVEIVNLSSGKALDVENESTADGANVCQWDAHGSQNQQWKLV

SEQ ID NO: 12969 - protein, 139 aa, Neocallimastix californiae
  Ricin B-like lectins
LQDGWYTIKNTGSGRYLQVSQGRASDSSNIVIGSNAQKWKLENVDEEYITLLTMYGNYMIDVANGEDKNGSNIQIYSAYGGDAQQFTLIKTSKENVYVIGTKVSQGARVFDVESASTAEGSNVLQWSNGGERSNQTWLF

SEQ ID NO: 12970 - protein, 139 aa, Neocallimastix californiae
  Ricin B-like lectins
IIPDGTYRIINRNSGKALSVVNDSKNNAASVVQYTYTGKSSQQWKIVEDGGYSFTNVNSNKVLDMNGASLEDGGNAIIWPDIAGPNQRWSIENAGDGYVYIINFNSNKVLDVANVSKEEGGNVHQWTITNGANQQWQLI

SEQ ID NO: 12971 - protein, 139 aa, Neocallimastix californiae
  Ricin B-like lectins
VSGDRYKIINRYTNRVLAVENDSTANNANVLQWGDNGSSGQQWVVAKEGDQYRITSYTTNKALDVSGRSTADGGNVIIYDDKAQGNQRWKFIDAGDGYVIIENVNSGKVLDVDNASKEYGANIMQWRKNGSTNQQWKLV

SEQ ID NO: 12972 - protein, 142 aa, Neocallimastix californiae
  Ricin B-like lectins
IEDGWYFIKNPRSGLYLQVSNDYARASANIEIGTGTKSDGQKWKVTNVGDGYITLTTALGDFNIDIANGDDKNGANVQIYDAYGGNAQQFVVMTTSDSNTYTIGSKVSSGGKALDIENESTSDGANVCQWTNSSKGNQLWVF

SEQ ID NO: 12973 - protein, 139 aa, Neocallimastix californiae
  Ricin B-like lectins
VKDGWYTIKNTGSGKYLNVDYGRASAGANVVIGSDAQKWKVENNSEGYVTLVSMYGNYMLDIAMGEDKNGANIQIYDAYGGDAQQFSLIETSKKGVYVIATKVSQNDKCLDVESASTAEGSNVLQWTNGGERSNQTWSF

SEQ ID NO: 12974 - protein, 138 aa, Neocallimastix californiae
  Ricin B-like lectins
FKDGWYTIKNTGSGKYLQVQNGRASDSANVVIGSNAQKWKIQNIGDGYVTILSMYGDYMLDVANGEDVDGANVQIYSSYGGDPQQFIIAETSRSNVYVIGSKVSEGNKVIDIEHESTEEGSNVHQWTNSEKSNQTWVI

SEQ ID NO: 12975 - protein, 139 aa, Neocallimastix californiae
  Ricin B-like lectins
PTTGGKYKIVNRNSGKVLAVVSDSTSNGADVIQWSDNGKTSQQWVITDEGNGYKIMNVNANKALDVSENSVKDGGDVIIWSDNGHNNQRWNIQDVGNGYVTIKNVNSGKNLDVEKESTSDGADVIQWGNNGNSNQQWKL

SEQ ID NO: 12976 - protein, 137 aa, Neocallimastix californiae
  Ricin B-like lectins
TGGKYKIINRNSGKALGIDGDSTSNGANVIQWSDNGKTSQQWVITDEGNGYKIMNVNANKALDVNDNSMKDGGNVIIWNDNGNNNQRWNIQDIGGGYVTIENVNSGKNLDVEKGSTSDGGNVLQWGNNGNSNQQWKL

SEQ ID NO: 12977 - protein, 137 aa, Neocallimastix californiae
  Ricin B-like lectins
VVAGEEYRIAIQLSGKYITAANNGNVHQWENLNDNSQVWYFEDAGNGKFAILSGKNRKLAMTVENGDSKNGNNILLTEYKNTAAQHFILHGVDDAYYITAECSGKASLDVYNQSYDNGANIDQWAYWGGECQKFYII

SEQ ID NO: 12978 - protein, 142 aa, Neocallimastix californiae
  Ricin B-like lectins
IKDGWYFIKNSSSGKYLQVSNENSRAASNIEIGSSRKSDGQKWKLTNVGDGYVTLTSALGNFNVDVANGEDKNGANIQIYDAYGGNAQQFIIMTTSFSNVYTIGTKVSNGEKALDVENGSKSDGANVIQWKNESKDNQSWIF

SEQ ID NO: 12979 - protein, 137 aa, Neocallimastix californiae
  Ricin B-like lectins
IGGKDYMIMSHLSGKYITIANDGSIHQWEKLSDTKSQVWRFESAGNGRFAILSGNNALTVENGNNKDGNKIILSQYRKTSAQHFILHKTDGNYDTYYITAECSGNAALDVYDQSSDNGAKIDQWNYWGGDNQRFYII

SEQ ID NO: 12980 - protein, 142 aa, Neocallimastix californiae
  Ricin B-like lectins
KDGWYFIKNPESGKYLQVSAAKDASSAGNVVISTGTKDNGQKWKLTNVSNGLVTLTSSLGNYNIDVANGKDSNGNNIILYNSYGGEPQQFMILKTSQKNVYTIGTKVSNFDKAFDIENGRSTDGTNVLQWTNEMKPNQLWMF

SEQ ID NO: 12981 - protein, 139 aa, Neocallimastix californiae
  Ricin B-like lectins
VDEGWYFIKNPSTGKYLTASGNSVPFNVIISTGYQEDNQKWKVTNAGNGYITLTSGLGDYMLDVANGSANNDANIQVYSAYGGDAQQFKLVEYGSGEFAIVTKSSNDGKAVDIANNGYTDGTNVLQWTNSGKSNQIWVF

SEQ ID NO: 12982 - protein, 141 aa, Neocallimastix californiae
  Ricin B-like lectins
SDGWYFIKNPSSGKYLQVANENGKNVANIEIGTGRQSDGQKWKLTNVGNGYVTLTSALGEFNIDIANGENKDGTNVQIYEAYGGEAQQFVILTTYTDDVYTIGTRVSNGDKALDIEGGRNSDGTNVLQWTNGSKGNQSWIF

SEQ ID NO: 12983 - protein, 142 aa, Neocallimastix californiae
  Ricin B-like lectins
RDGWYFIKNPASGKYLQVSGATNGGAGGNVVISTGTKDNGQKWKITNVGNGLVTFTTALGDYMIDVEAGSGKNDANIQLYNAYGGDAQQFMILKTTEKDVYTIGTKVSYFDKALDIAQAKTADGTNVVQWTNEMKANQSWTF

SEQ ID NO: 12984 - protein, 135 aa, Neocallimastix californiae
  Ricin B-like lectins
DNGNYYIKNPNSGKYLRVGKAGNSQNVVIGSSAQKWKLTNTDDGYITLVSELGNYMIDVANGSGENNANVQIYDAYGGDAQKFVLLKTSQSNTYVIATKASNGYRVLDIEKNGTAEGSNVLQWDNQEKANQFWVF

SEQ ID NO: 12985 - protein, 139 aa, Neocallimastix californiae
  Ricin B-like lectins
VLKDGWYTIKNPNSNKYLQVSYGRGGDAVNVVIGSNPQKWKLENVGDGYVTLLTMYGDYMLDVAAGDSKDGANIQIYSAYGGDAQQFAIIPTSNGNTYVIGSKVSNGEKVLDIEKASTSEGSNVLQWVNGEKANQTWIF

SEQ ID NO: 12986 - protein, 138 aa, Neocallimastix californiae
  Ricin B-like lectins
VSDGWYYIKNPASGKYLAVRNGIGADAQNVEISSTKQKWKISNNDDGTVLIISELGDYALDVSAGSSNNGANIQIYSAYGGEAQRFIIRETYTSGNYVITTKVTNGSRALDVEGNKTAEGTNICQWDDGEKSNQIWTL

SEQ ID NO: 12987 - protein, 138 aa, Neocallimastix californiae
  Ricin B-like lectins
LKDGWYTIKNTGSGLYLGVNNGRASDSANVVIDSDAQKWKLENVGNGYMTLTSMYGDYKIDIAGADDSNGSNVQIYTTHGEDNQQFIVLKTSKDNVYAIGTKITNGERVLDVESESTSAGSNVHQWLNSEKSNQTWTF

SEQ ID NO: 12988 - protein, 140 aa, Neocallimastix californiae
  Ricin B-like lectins
IPEGTYKIVNRKSGKVLAVANDSKANAANVHQWTYIDGNASHHWKISEDGGYRILNVNANKVLDMNAESTADGGNAIIWPDTGGMNQRWVIESAGGNYVYIINSHSGKALDVDKSSNDDGGNIIQWSLSNNSSNQQWQLI

SEQ ID NO: 12989 - protein, 135 aa, Neocallimastix californiae
  Ricin B-like lectins
QDGWYTIKNTGSGKYLHVESAGNSENVVISSNASKWKLTNTNDGYITLTSSVGNYMLDVAGGEDKNGVNLQIYSAYSGDAQKFVILKTSNNKVYTIGSKVSNGGKVIDVEKRGTTDGSNVIQYALNGASNQTWTF

SEQ ID NO: 12990 - protein, 139 aa, Neocallimastix californiae
  Ricin B-like lectins
IIRDGWYYIMNTGSQRYLTVKDAKAANSQNIEVNSKKQKWKVMNTSEGTVTMESELGNYMIDVNGGSEANGANIQIYESYGGDAQQFYIRETYQKNVYSIGTKLTGGYKVLDVEKEGKTDGSNVCQWEDGGRSNQTWLF

SEQ ID NO: 12991 - protein, 138 aa, Neocallimastix californiae
  Ricin B-like lectins
ASGGKYKLINRNSGKALGVDGDSTSNAANVHQWTDNGKTSQQWIITDEGYGYKIMNVNANKALDVNENSTKNGGNVIIWSDNGNLNQRWYIEEIGDGYITLQNINSGLLLDVEKSSTSDGGNVLQWENNGNSNQQWKL

SEQ ID NO: 12992 - protein, 141 aa, Anaeromyces robustus; identical to SEQ ID NO: 12982
  Ricin B-like lectins

SEQ ID NO: 12993 - protein, 139 aa, Anaeromyces robustus; identical to SEQ ID NO: 12981
  Ricin B-like lectins

SEQ ID NO: 12994 - protein, 139 aa, Anaeromyces robustus; identical to SEQ ID NO: 12985
  Ricin B-like lectins

SEQ ID NO: 12995 - protein, 135 aa, Anaeromyces robustus; identical to SEQ ID NO: 12984
  Ricin B-like lectins

SEQ ID NO: 12996 - protein, 142 aa, Anaeromyces robustus; identical to SEQ ID NO: 12983
  Ricin B-like lectins

SEQ ID NO: 12997 - protein, 138 aa, Anaeromyces robustus; identical to SEQ ID NO: 12987
  Ricin B-like lectins

SEQ ID NO: 12998 - protein, 138 aa, Anaeromyces robustus; identical to SEQ ID NO: 12986
  Ricin B-like lectins

SEQ ID NO: 12999 - protein, 140 aa, Anaeromyces robustus; identical to SEQ ID NO: 12988
  Ricin B-like lectins

SEQ ID NO: 13000 - protein, 138 aa, Anaeromyces robustus; identical to SEQ ID NO: 12991
  Ricin B-like lectins

SEQ ID NO: 13001 - protein, 139 aa, Anaeromyces robustus
  Ricin B-like lectins
IKNGWYYIKNTGSNKYLTVKNGKGAAAQNVEINSTKQKWKVTNMDDNTITLLSELGDYMLDVSSGSSENGANIQIYDAYAGDAQKFVLRETSKEGVYVISTKVSNGYKVLDVEREGKSDGSNVCQWDNGGEKAHQTWVF

SEQ ID NO: 13002 - protein, 138 aa, Anaeromyces robustus
  Ricin B-like lectins
IPEGTYRIINRNSGKALSVANDSKNNAANVHQWTYSNKASQQWKITEDGGYRILNVNANKVLDMDNESLKDGGNALIWPDTGALNQRWLIEDAGNGYVNIINYNSEKALDVEKNSNADGGNVIQWTLTNSANQQWQLI

SEQ ID NO: 13003 - protein, 140 aa, Anaeromyces robustus
  Ricin B-like lectins
ILQNGWYTIKNVGSGKYLQVSYGSASDSANVVIGSNAQKWKLEHVDDDYFTLLSMYGNYMIDIAMGEDKDGSNVQIYSAYGGEAQQFSVIKTSRENVYLIGTKVSGGKRVFDVEKASKAEGSNVLQWVNGGEKDNQIWIF

SEQ ID NO: 13004 - protein, 140 aa, Anaeromyces robustus
  Ricin B-like lectins
IIKNGWYTIKNPISGKYLQIRYGSDADTSNVVIGTNPQKWKLEHVDDDYFTLASMYGDYMLDVNRGENKDGANIQVYSAYGGDAQQFSVVKTSKENVYAIATKISRGTKVLDIELASTADGSNVCQWTNGGEKNHQVWTF

SEQ ID NO: 13005 - protein, 132 aa, Anaeromyces robustus
  Ricin B-like lectins
SGKDYNIVSVLSGKYVTAASNGNVQQYEKLNNDKSQIWRLESAGNGRFAILQGNMAMTVENGNNNNGNNIYMSEYRKTTAQHFSINRADNSYYIVAQCTVNAALDVFDQSKENGANIDQWDYWGGDNQKFYI

SEQ ID NO: 13006 - protein, 138 aa, Anaeromyces robustus
  Ricin B-like lectins
ASGGIYKLLNRNSGKALGIESDSTTDGANVHQWTDNSRTSQQWIFIDEGNGYKIMNVNAKKALDIYGSSVENNGNAIIMTDNGNSSQRWTVKDLGDGYYIIQNVNSGLLLDVERKSTADGGNVLQWPNNGNSNQQWKL

SEQ ID NO: 13007 - protein, 139 aa, Anaeromyces robustus
  Ricin B-like lectins
PTNGNTFKIINRLSGKALSVNGDSTANEANVIQWTDNGKTSQQWIITQESNGYKIINVNANKALDVYKNSRDNGGNVIIWYDNGASNQRWNIQEVGNGYYTLQNLNSGKLLDVEKESRNDGGNVLQWVNNGNTNQQWQI

SEQ ID NO: 13008 - protein, 138 aa, Anaeromyces robustus
  Ricin B-like lectins
VLKNGWYTIKNTGSGKYLQVSYGRAGDGVNVVIGSNAQKWKLENVSDGYVTLLTMYGDYMLDVAAGEDKDGANLQIYSSYGGDNQQFSILKISDDVYAIATKVSDSTKVLDVEKASTTDGSNVLQWKNKETSNQTWIF

SEQ ID NO: 13009 - protein, 102 aa, Piromyces finnis
  Ricin B-like lectins
IKIKSCDDSNYSKWMVLPSRKGYFYSMAYPDYCLQVDDENSGSLALGKCDDQAKLEHTDDAFFKLIGSDDKCIGILDENDMYNNEIELNLNTCIESDNEKFY

SEQ ID NO: 13010 - protein, 54 aa, Piromyces finnis
  Ricin B-like lectins
TYRIRNIKTKQCVLVNNSDGNLIDLGECTTSNHSLWHIANVDEYNNKKITSVKS

SEQ ID NO: 13011 - protein, 137 aa, Piromyces finnis; identical to SEQ ID NO: 12936
  Ricin B-like lectins

SEQ ID NO: 13012 - protein, 137 aa, Piromyces finnis
  Ricin B-like lectins
KDGWYYIKNTGSEKYLTVKNGKAANSQNVEVNSVKQKWLITNMDDDTITILSELGNYMLDVNGGSDKNGANIHIYDAYSGDPQRFIISETYQSNVYTIGTKVTYGEKVLDVENEGKSDGSNVCQWENGERSNQTWVF

SEQ ID NO: 13013 - protein, 138 aa, Piromyces finnis
  Ricin B-like lectins
VLKNGWYTIKNTGSKKYLTSSSNIAGGNIVISSKAQKWKLENVGEGYVTLLSMYGDFMIDVAMGEDKDGSNIQIYTAYGHDAQQFTIIKTTKENVYIIGTRVSEGGKVLDVEREGTADGSNVVQWTGGGEKGNQTWLF

SEQ ID NO: 13014 - protein, 137 aa, Piromyces finnis
  Ricin B-like lectins
IISGKDYMIVSQLSGKYITVGNNGNIHQWEKLSDTSSQVWRFESAGSGKFAILSGKMALTVENGNNKNGNKMILSQYQNNAAQRFIFHKTDDVYDNYYITAECSGNAALDVYDQSYDNGANIDQWDYWGGDNQKFYV

SEQ ID NO: 13015 - protein, 99 aa, Piromyces finnis
  Ricin B-like lectins
DYSFRIKNRKTQECLITNLHSDTSVLLMGDCNHSIWTYDNETLVLNATGKCMYAMNSQDPRMFDCSKPDETINHHIHFKIVDNKYICLKNSVDPEICLN

SEQ ID NO: 13016 - protein, 69 aa, Piromyces finnis
  Ricin B-like lectins
YKCVNNKKNKWFIRQNGQVYFIVSSYDAKCLNLNGENLYMDYCEDNNKYEKFIIKNGKFCSQLDNSKCL

SEQ ID NO: 13017 - protein, 119 aa, Piromyces finnis
  Ricin B-like lectins
NTETYYLYNADTNKCVHSSGVLDSSITLAECDYSTYSLWDIPYTHNGNFHLKFDISHCIMLSDNSSLVLGKCGETGTDFYRDGNFIKSPITPDQCIALADSSSLVMTECNEFDTTQLFY

SEQ ID NO: 13018 - protein, 119 aa, Piromyces finnis
  Ricin B-like lectins
VYWFYHAYTNKCLYAPQKPNKPITVKACDDSDYSKWMVLNSRKGYFYSMAHPDYCLRVADVDTGSLELGKCDDQAKMVHGNDGFLGLIESSDKCVGILNAEDMYKDEIKMNLNTCAKND

SEQ ID NO: 13019 - protein, 119 aa, Piromyces finnis; identical to SEQ ID NO: 13017
  Ricin B-like lectins

SEQ ID NO: 13020 - protein, 69 aa, Piromyces finnis; identical to SEQ ID NO: 13016
  Ricin B-like lectins

SEQ ID NO: 13021 - protein, 121 aa, Piromyces finnis
  Ricin B-like lectins
VYWFYHAYTNKCLYAPQKPNKPITVKACDDSDYSKWMVLNSRKGYFYSMAHPDYCLRVADVDTGSLELGKCDDQAKMVHGNDGFLGLIESSDKCVGILNAEDMYKDEIKMNLNTCAKNDDE

SEQ ID NO: 13022 - protein, 99 aa, Piromyces finnis; identical to SEQ ID NO: 13015
  Ricin B-like lectins

SEQ ID NO: 13023 - protein, 141 aa, Piromyces finnis
  Ricin B-like lectins
DGWYFIKNPESGKYLQVSAATNGSSGGNLVISKGTKDQGQKWKVTNVGKGLVTFTTALGDYMIDVSGGKNENGTNVQLYNAYGGDAQQFMILKTTQENVYTIGTKVSYFDKALDIEGMRTEDGTNVLQWTNEMKPNQGWSF

SEQ ID NO: 13024 - protein, 138 aa, Piromyces finnis
  Ricin B-like lectins
IKDGNYYIKSVSSNKYLVVKDGIGANAQNVEIGSTKQKWKISNNSDGTVYIISELGDYALDVDRGLGDNGANIQIYPLHGGEAQKFIIRETYPSGVYVIDTQASNGSKALDIEGERTADGTNVCQWTDGGKDNQSWTF

SEQ ID NO: 13025 - protein, 141 aa, Piromyces finnis
  Ricin B-like lectins
KDGWYFIKNPSTGKYLQVRDEEGKNVANIEIGSGRKSDGQKWKLTNVGDGYVTLTSALGEYNIDIANGEDKNGANVQIYEAYGGDAQQFVIMTTSTDNAYSIGTKASSGDKVIDIEGGYSTDGTNVCQWKSNSGPNQVWIF

SEQ ID NO: 13026 - protein, 138 aa, Piromyces finnis
  Ricin B-like lectins
VANGTYKIINRQSGKVLSVNNDSTANAANVIQWSESNKSSQQWVISEEGDYFSLINVNAKKALDVNENSTENGGNVIIWPDTGALNQRWSIQSTGDGYYTITNANSGKNLDVEKGSMSDGGNVLQWGNNGGANQQWKL

SEQ ID NO: 13027 - protein, 138 aa, Piromyces finnis; identical to SEQ ID NO: 13026
  Ricin B-like lectins

SEQ ID NO: 13028 - protein, 138 aa, Piromyces finnis
  Ricin B-like lectins
YPNGTYKIINRRSGKALGVINDSTEDSANVHQWTDNGHKSQQWVISNEFNGIKIVNVNANKCLDVSGRSKDNGGNIVIYHDNGYMNQRWTFQDAGNGYITIRSSHSGKLIDVDNRATTDGANVLQWEPNGLDNQQWKL

SEQ ID NO: 13029 - protein, 103 aa, Piromyces finnis
  Ricin B-like lectins
AQKWKLTNMSGGYVTLVSSLGEYMLDIAGGDDGNGTNVQIYSAYAGEAQQFVILKTSKDKVYTIGTRVSNGYRVLDVEKNGTTDGSNVLQWDNSEKSNQTWTF

SEQ ID NO: 13030 - protein, 142 aa, Piromyces finnis
  Ricin B-like lectins
IEDGWYYIKNPASGKYLQVANNQAKATANIEIGSSSQDDGQKWLLTNVGEGYVTLKSALGDFMIDVSSGEDKNGANIQIYTAYGHDAQQFMILKSSVEGAYSITSRVSFQDKGIDIEGARTADGTNVLQWTSEGRANQLWAF

SEQ ID NO: 13031 - protein, 142 aa, Piromyces finnis; identical to SEQ ID NO: 13030
  Ricin B-like lectins

SEQ ID NO: 13032 - protein, 142 aa, Piromyces finnis; identical to SEQ ID NO: 13030
  Ricin B-like lectins

SEQ ID NO: 13033 - protein, 139 aa, Piromyces finnis
  Ricin B-like lectins
DGWYYIKNTGSNKYLQVKGNNGVANTNVEIGTFAGASGQKWKVTQTSDGYITLTSALGNFMLDVANAKDTDGNNILIYIGYSGDAQKFSLKPAGNSFIITTKVSNGKKALDVYNFGTSDGTNVCQWTVGGQSNQTWVFE

SEQ ID NO: 13034 - protein, 142 aa, Piromyces finnis; identical to SEQ ID NO: 13030
  Ricin B-like lectins

SEQ ID NO: 13035 - protein, 139 aa, Piromyces finnis; identical to SEQ ID NO: 13033
  Ricin B-like lectins

SEQ ID NO: 13036 - protein, 137 aa, Piromyces finnis
  Ricin B-like lectins
EDGWYYIKNTGSNKYLSVKGAVGANGQNVQISSTKQKWKIYNNNDGTVLLISEFGDYALDVSNGSGENGANIQIYSIHGGDAQKFIIRETFESNVYVIDTQASNGQRALDVEGARTDEGTNICQWSDEEKSNQTWTI

SEQ ID NO: 13037 - protein, 80 aa, Piromyces finnis
  Ricin B-like lectins
MIDVSGGKNENGTNVQLYNAYGGDAQQFMILKTTQENVYTIGTKVSYFDKALDIEGMRTEDGTNVLQWTNEMKPNQGWSF

SEQ ID NO: 13038 - protein, 105 aa, Neocallimastix californiae
  RICIN_B_LECTIN
STARKWKLTNVSDGYVTLTSELGNYMLDVANGEDVNSANLQIYSAYGGNAQQFVILKTSNSNVYTIGTKASSGQRVLDVEKRGTTDGSNVIQYALNGASNQTWTF

SEQ ID NO: 13039 - protein, 138 aa, Neocallimastix californiae; identical to SEQ ID NO: 12952
  RICIN_B_LECTIN

SEQ ID NO: 13040 - protein, 138 aa, Neocallimastix californiae; identical to SEQ ID NO: 12952
  RICIN_B_LECTIN

SEQ ID NO: 13041 - protein, 105 aa, Neocallimastix californiae
  RICIN_B_LECTIN
STKQKWKITNNDDGTVYIVSEFGNFSLDVDRGSGDNGANIQIYSHHGGEAQKFIIRETNQSGVYVIDTQASNGYRALDVEGERTSEGTNVCQWDDSGKSNQTWTF

SEQ ID NO: 13042 - protein, 109 aa, Neocallimastix californiae
  RICIN_B_LECTIN
SGSKSDGQKWKVTNVGDGYVTLTSALGDFNIDIANGEDKNGANVQIYDAYGGDAQQFVIMTTSTSNTYTIGTKISNGGKALDIENDSTYEGTNVCQWTNGSKGNQLWVF

SEQ ID NO: 13043 - protein, 107 aa, Neocallimastix californiae
  RICIN_B_LECTIN
GTDSEQMWKLTNLGDNYVTLTSSLGNFNLDICMAEDENGTNAQIYTVHNEDPQKFVIMETKDKDVYVIGTKGSNGYKVLDVESYGTTPGSNVYQWENEGKDNQVWTF

SEQ ID NO: 13044 - protein, 104 aa, Neocallimastix californiae
  RICIN_B_LECTIN
STQQKWKLTNNSDGSVTLVSEVGDFALDVSGGSSDNGANVQIYSNYGGDAQKFYIREVSSNVYTITTKVSNGEKALDAEGARTSDGTNILQWTDEGKSNQTWTF

SEQ ID NO: 13045 - protein, 104 aa, Neocallimastix californiae; identical to SEQ ID NO: 13044
  RICIN_B_LECTIN

SEQ ID NO: 13046 - protein, 104 aa, Neocallimastix californiae
  RICIN_B_LECTIN
DDAQKWKVTNTNGYVTFTSALGNYMIDIANGEDRNGANVQIYDAYGGDAQQFIIYKTGRENVYTIGTKASAGDKAIDIEGARNGENVNLLQWTNEYKDNQTWSF

SEQ ID NO: 13047 - protein, 105 aa, Neocallimastix californiae
  RICIN_B_LECTIN
SSKQKWKLTNNSDNTVTLLSEVGDFMLDVNGGSSDNGANIQIYNAYGGDAQKFVIRETSQANVYVVSTKVSSGYKVLDVENEGKYDGSNICQWENGERSNQTWTF

SEQ ID NO: 13048 - protein, 106 aa, Neocallimastix californiae
  RICIN_B_LECTIN
SSSKQKWKLTNNNDNTVTLLSEVGDFMLDVNGGSDKNNANIQIYHAYGGDAQKFIIKETSQSNVYVITTKVSNGSKALDIEKEGKNDGSNVLQWDNGTKSNQTWIF

SEQ ID NO: 13049 - protein, 105 aa, Neocallimastix californiae
  RICIN_B_LECTIN
STKQKWKLTNNDDNTVTLLSEVGDFMLDIDRGLEENGANIQIYHAYGGDAQRFIIKETGKSKVYVISSKITNGYKVLDVENQATADGSNVCQWENGERSNQTWTF

SEQ ID NO: 13050 - protein, 104 aa, Neocallimastix californiae
  RICIN_B_LECTIN
NAQKWKLENVGNGYVTLVSMYGNYMLDIANGEDKDGSNLQIYSAYGGDAQQFIILKTPQNNVYAIGTKASEGTKVLDIEGGRTSEGSNVLQWTNGGKSNQTWTF

SEQ ID NO: 13051 - protein, 138 aa, Neocallimastix californiae
  RICIN_B_LECTIN
VDGWYYIKNTGSNKYLQTVGSTANSNVEISSFTGSAAQKWKVTKNSEGYITLLNGVGDFNLDVANGKNENGVNILIYIAYGGEAQQFALSAGSNNSFIITTRVSNGDKALDVYEHRTEDGANVCQWTTSGKPNQTWVF

SEQ ID NO: 13052 - protein, 106 aa, Neocallimastix californiae
  RICIN_B_LECTIN
NSRKQKWLLTNVGDDEVTLTTELGNYMLDVNSGSENNGANIQIYNSHGGDSQRFIIEETYQSDVYVIGTKVTNGYKVIDVEREGKDDGSNVCQWDNGEKPNQTWVF

SEQ ID NO: 13053 - protein, 137 aa, Neocallimastix californiae
  RICIN_B_LECTIN
IGGKYNIVNRNSGKFLGVNNDSTSDGANVHQWSDNGKTSEQWIISDEGNGYKILNVNANKVLDVNDASYSDGANVILWSDNGNSNQRWIIQELGDGYVTIENYNSGKNLDVEKSSTSDGGNVLQWSNNGQNNQQWKL

SEQ ID NO: 13054 - protein, 105 aa, Neocallimastix californiae
  RICIN_B_LECTIN
SSKQKWKVTKNNDGSVVIISEFGNFALDIANGSGDNGANVQIYTTHGGDAQKFIIRETSNSGIFVIDTIASGGSKALDIEGGRSADGTNICQWDDSAKSNQTWTF

SEQ ID NO: 13055 - protein, 136 aa, Neocallimastix californiae
  RICIN_B_LECTIN
PEGTYKLINRRSNKALAVQNDSKDNAANVVQWTESNKTSQQWKITEDGGYRILNVNADKALDVERDSTQNGGNIIIWPDTGNLNQRWTIEDAGNGYVEIVNLSSGKALDVENESTADGANVCQWDAHGSQNQQWKL

SEQ ID NO: 13056 - protein, 106 aa, Neocallimastix californiae
  RICIN_B_LECTIN
SNAQKWKLENVDEEYITLLTMYGNYMIDVANGEDKNGSNIQIYSAYGGDAQQFTLIKTSKENVYVIGTKVSQGARVFDVESASTAEGSNVLQWSNGGERSNQTWLF

SEQ ID NO: 13057 - protein, 136 aa, Neocallimastix californiae
  RICIN_B_LECTIN
PDGTYRIINRNSGKALSVVNDSKNNAASVVQYTYTGKSSQQWKIVEDGGYSFTNVNSNKVLDMNGASLEDGGNAIIWPDIAGPNQRWSIENAGDGYVYIINFNSNKVLDVANVSKEEGGNVHQWTITNGANQQWQL

SEQ ID NO: 13058 - protein, 137 aa, Neocallimastix californiae
  RICIN_B_LECTIN
SGDRYKIINRYTNRVLAVENDSTANNANVLQWGDNGSSGQQWVVAKEGDQYRITSYTTNKALDVSGRSTADGGNVIIYDDKAQGNQRWKFIDAGDGYVIIENVNSGKVLDVDNASKEYGANIMQWRKNGSTNQQWKL

SEQ ID NO: 13059 - protein, 108 aa, Neocallimastix californiae
  RICIN_B_LECTIN
GTKSDGQKWKVTNVGDGYITLTTALGDFNIDIANGDDKNGANVQIYDAYGGNAQQFVVMTTSDSNTYTIGSKVSSGGKALDIENESTSDGANVCQWTNSSKGNQLWVF

SEQ ID NO: 13060 - protein, 96 aa, Neocallimastix californiae
  RICIN_B_LECTIN
SEGYVTLVSMYGNYMLDIAMGEDKNGANIQIYDAYGGDAQQFSLIETSKKGVYVIATKVSQNDKCLDVESASTAEGSNVLQWTNGGERSNQTWSFE

SEQ ID NO: 13061 - protein, 105 aa, Neocallimastix californiae
  RICIN_B_LECTIN
SNAQKWKIQNIGDGYVTILSMYGDYMLDVANGEDVDGANVQIYSSYGGDPQQFIIAETSRSNVYVIGSKVSEGNKVIDIEHESTEEGSNVHQWTNSEKSNQTWVI

SEQ ID NO: 13062 - protein, 137 aa, Neocallimastix californiae
  RICIN_B_LECTIN
TGGKYKIVNRNSGKVLAVVSDSTSNGADVIQWSDNGKTSQQWVITDEGNGYKIMNVNANKALDVSENSVKDGGDVIIWSDNGHNNQRWNIQDVGNGYVTIKNVNSGKNLDVEKESTSDGADVIQWGNNGNSNQQWKL

SEQ ID NO: 13063 - protein, 137 aa, Neocallimastix californiae; identical to SEQ ID NO: 12976
  RICIN_B_LECTIN

SEQ ID NO: 13064 - protein, 141 aa, Neocallimastix californiae
  RICIN_B_LECTIN
KDGWYFIKNSSSGKYLQVSNENSRAASNIEIGSSRKSDGQKWKLTNVGDGYVTLTSALGNFNVDVANGEDKNGANIQIYDAYGGNAQQFIIMTTSFSNVYTIGTKVSNGEKALDVENGSKSDGANVIQWKNESKDNQSWIF

SEQ ID NO: 13065 - protein, 108 aa, Neocallimastix californiae
  RICIN_B_LECTIN
GTKDNGQKWKLTNVSNGLVTLTSSLGNYNIDVANGKDSNGNNIILYNSYGGEPQQFMILKTSQKNVYTIGTKVSNFDKAFDIENGRSTDGTNVLQWTNEMKPNQLWMF

SEQ ID NO: 13066 - protein, 107 aa, Neocallimastix californiae
  RICIN_B_LECTIN
GYQEDNQKWKVTNAGNGYITLTSGLGDYMLDVANGSANNDANIQVYSAYGGDAQQFKLVEYGSGEFAIVTKSSNDGKAVDIANNGYTDGTNVLQWTNSGKSNQIWVF

SEQ ID NO: 13067 - protein, 130 aa, Neocallimastix californiae
  RICIN_B_LECTIN
SGKYLQVANENGKNVANIEIGTGRQSDGQKWKLTNVGNGYVTLTSALGEFNIDIANGENKDGTNVQIYEAYGGEAQQFVILTTYTDDVYTIGTRVSNGDKALDIEGGRNSDGTNVLQWTNGSKGNQSWIF

SEQ ID NO: 13068 - protein, 147 aa, Neocallimastix californiae
  RICIN_B_LECTIN
KGAQLRDGWYFIKNPASGKYLQVSGATNGGAGGNVVISTGTKDNGQKWKITNVGNGLVTFTTALGDYMIDVEAGSGKNDANIQLYNAYGGDAQQFMILKTTEKDVYTIGTKVSYFDKALDIAQAKTADGTNVVQWTNEMKANQSWTF

SEQ ID NO: 13069 - protein, 105 aa, Neocallimastix californiae
  RICIN_B_LECTIN
SSAQKWKLTNTDDGYITLVSELGNYMIDVANGSGENNANVQIYDAYGGDAQKFVLLKTSQSNTYVIATKASNGYRVLDIEKNGTAEGSNVLQWDNQEKANQFWVF

SEQ ID NO: 13070 - protein, 102 aa, Neocallimastix californiae
  RICIN_B_LECTIN
QKWKLENVGDGYVTLLTMYGDYMLDVAAGDSKDGANIQIYSAYGGDAQQFAIIPTSNGNTYVIGSKVSNGEKVLDIEKASTSEGSNVLQWVNGEKANQTWIF

SEQ ID NO: 13071 - protein, 106 aa, Neocallimastix californiae
  RICIN_B_LECTIN
SSTKQKWKISNNDDGTVLIISELGDYALDVSAGSSNNGANIQIYSAYGGEAQRFIIRETYTSGNYVITTKVTNGSRALDVEGNKTAEGTNICQWDDGEKSNQIWTL

SEQ ID NO: 13072 - protein, 106 aa, Neocallimastix californiae
  RICIN_B_LECTIN
DSDAQKWKLENVGNGYMTLTSMYGDYKIDIAGADDSNGSNVQIYTTHGEDNQQFIVLKTSKDNVYAIGTKITNGERVLDVESESTSAGSNVHQWLNSEKSNQTWTF

SEQ ID NO: 13073 - protein, 138 aa, Neocallimastix californiae
  RICIN_B_LECTIN
PEGTYKIVNRKSGKVLAVANDSKANAANVHQWTYIDGNASHHWKISEDGGYRILNVNANKVLDMNAESTADGGNAIIWPDTGGMNQRWVIESAGGNYVYIINSHSGKALDVDKSSNDDGGNIIQWSLSNNSSNQQWQL

SEQ ID NO: 13074 - protein, 106 aa, Neocallimastix californiae
  RICIN_B_LECTIN
SSNASKWKLTNTNDGYITLTSSVGNYMLDVAGGEDKNGVNLQIYSAYSGDAQKFVILKTSNNKVYTIGSKVSNGGKVIDVEKRGTTDGSNVIQYALNGASNQTWTF

SEQ ID NO: 13075 - protein, 106 aa, Neocallimastix californiae
  RICIN_B_LECTIN
NSKKQKWKVMNTSEGTVTMESELGNYMIDVNGGSEANGANIQIYESYGGDAQQFYIRETYQKNVYSIGTKLTGGYKVLDVEKEGKTDGSNVCQWEDGGRSNQTWLF

SEQ ID NO: 13076 - protein, 143 aa, Neocallimastix californiae
  RICIN_B_LECTIN
SSSVVASGGKYKLINRNSGKALGVDGDSTSNAANVHQWTDNGKTSQQWIITDEGYGYKIMNVNANKALDVNENSTKNGGNVIIWSDNGNLNQRWYIEEIGDGYITLQNINSGLLLDVEKSSTSDGGNVLQWENNGNSNQQWKL

SEQ ID NO: 13077 - protein, 130 aa, Anaeromyces robustus; identical to SEQ ID NO: 13067
  RICIN_B_LECTIN

SEQ ID NO: 13078 - protein, 107 aa, Anaeromyces robustus; identical to SEQ ID NO: 13066
  RICIN_B_LECTIN

SEQ ID NO: 13079 - protein, 102 aa, Anaeromyces robustus; identical to SEQ ID NO: 13070
  RICIN_B_LECTIN

SEQ ID NO: 13080 - protein, 105 aa, Anaeromyces robustus; identical to SEQ ID NO: 13069
  RICIN_B_LECTIN

SEQ ID NO: 13081 - protein, 147 aa, Anaeromyces robustus; identical to SEQ ID NO: 13068
  RICIN_B_LECTIN

SEQ ID NO: 13082 - protein, 106 aa, Anaeromyces robustus; identical to SEQ ID NO: 13072
  RICIN_B_LECTIN

SEQ ID NO: 13083 - protein, 106 aa, Anaeromyces robustus; identical to SEQ ID NO: 13071
  RICIN_B_LECTIN

SEQ ID NO: 13084 - protein, 138 aa, Anaeromyces robustus; identical to SEQ ID NO: 13073
  RICIN_B_LECTIN

SEQ ID NO: 13085 - protein, 143 aa, Anaeromyces robustus; identical to SEQ ID NO: 13076
  RICIN_B_LECTIN

SEQ ID NO: 13086 - protein, 107 aa, Anaeromyces robustus
  RICIN_B_LECTIN
NSTKQKWKVTNMDDNTITLLSELGDYMLDVSSGSSENGANIQIYDAYAGDAQKFVLRETSKEGVYVISTKVSNGYKVLDVEREGKSDGSNVCQWDNGGEKAHQTWVF

SEQ ID NO: 13087 - protein, 136 aa, Anaeromyces robustus
  RICIN_B_LECTIN
PEGTYRIINRNSGKALSVANDSKNNAANVHQWTYSNKASQQWKITEDGGYRILNVNANKVLDMDNESLKDGGNALIWPDTGALNQRWLIEDAGNGYVNIINYNSEKALDVEKNSNADGGNVIQWTLTNSANQQWQL

SEQ ID NO: 13088 - protein, 103 aa, Anaeromyces robustus
  RICIN_B_LECTIN
QKWKLEHVDDDYFTLASMYGDYMLDVNRGENKDGANIQVYSAYGGDAQQFSVVKTSKENVYAIATKISRGTKVLDIELASTADGSNVCQWTNGGEKNHQVWTF

SEQ ID NO: 13089 - protein, 137 aa, Anaeromyces robustus
  RICIN_B_LECTIN
SGGIYKLLNRNSGKALGIESDSTTDGANVHQWTDNSRTSQQWIFIDEGNGYKIMNVNAKKALDIYGSSVENNGNAIIMTDNGNSSQRWTVKDLGDGYYIIQNVNSGLLLDVERKSTADGGNVLQWPNNGNSNQQWKL

SEQ ID NO: 13090 - protein, 137 aa, Anaeromyces robustus
  RICIN_B_LECTIN
NGNTFKIINRLSGKALSVNGDSTANEANVIQWTDNGKTSQQWIITQESNGYKIINVNANKALDVYKNSRDNGGNVIIWYDNGASNQRWNIQEVGNGYYTLQNLNSGKLLDVEKESRNDGGNVLQWVNNGNTNQQWQI

SEQ ID NO: 13091 - protein, 104 aa, Anaeromyces robustus
  RICIN_B_LECTIN
SNAQKWKLENVSDGYVTLLTMYGDYMLDVAAGEDKDGANLQIYSSYGGDNQQFSILKISDDVYAIATKVSDSTKVLDVEKASTTDGSNVLQWKNKETSNQTWIF

SEQ ID NO: 13092 - protein, 105 aa, Piromyces finnis
  RICIN_B_LECTIN
SSAQKWKLTNVDNGYVTLVSMYGNYMLDVANGDSKNGANLQIYTSHGGDAQQFIFLNTSKNNVYVIGTKASSGTKVLDIESEGTADGSNILQWENGEKSNQTWVI

SEQ ID NO: 13093 - protein, 102 aa, Piromyces finnis
  RICIN_B_LECTIN
QKWLITNMDDDTITILSELGNYMLDVNGGSDKNGANIHIYDAYSGDPQRFIISETYQSNVYTIGTKVTYGEKVLDVENEGKSDGSNVCQWENGERSNQTWVF

SEQ ID NO: 13094 - protein, 107 aa, Piromyces finnis
  RICIN_B_LECTIN
SSKAQKWKLENVGEGYVTLLSMYGDFMIDVAMGEDKDGSNIQIYTAYGHDAQQFTIIKTTKENVYIIGTRVSEGGKVLDVEREGTADGSNVVQWTGGGEKGNQTWLF

SEQ ID NO: 13095 - protein, 131 aa, Piromyces finnis
  RICIN_B_LECTIN
SGKYLQVSAATNGSSGGNLVISKGTKDQGQKWKVTNVGKGLVTFTTALGDYMIDVSGGKNENGTNVQLYNAYGGDAQQFMILKTTQENVYTIGTKVSYFDKALDIEGMRTEDGTNVLQWTNEMKPNQGWSF

SEQ ID NO: 13096 - protein, 105 aa, Piromyces finnis
  RICIN_B_LECTIN
STKQKWKISNNSDGTVYIISELGDYALDVDRGLGDNGANIQIYPLHGGEAQKFIIRETYPSGVYVIDTQASNGSKALDIEGERTADGTNVCQWTDGGKDNQSWTF

SEQ ID NO: 13097 - protein, 109 aa, Piromyces finnis
  RICIN_B_LECTIN
SGRKSDGQKWKLTNVGDGYVTLTSALGEYNIDIANGEDKNGANVQIYEAYGGDAQQFVIMTTSTDNAYSIGTKASSGDKVIDIEGGYSTDGTNVCQWKSNSGPNQVWIF

SEQ ID NO: 13098 - protein, 137 aa, Piromyces finnis
  RICIN_B_LECTIN
ANGTYKIINRQSGKVLSVNNDSTANAANVIQWSESNKSSQQWVISEEGDYFSLINVNAKKALDVNENSTENGGNVIIWPDTGALNQRWSIQSTGDGYYTITNANSGKNLDVEKGSMSDGGNVLQWGNNGGANQQWKL

SEQ ID NO: 13099 - protein, 137 aa, Piromyces finnis; identical to SEQ ID NO: 13098
  RICIN_B_LECTIN

SEQ ID NO: 13100 - protein, 137 aa, Piromyces finnis
  RICIN_B_LECTIN
PNGTYKIINRRSGKALGVINDSTEDSANVHQWTDNGHKSQQWVISNEFNGIKIVNVNANKCLDVSGRSKDNGGNIVIYHDNGYMNQRWTFQDAGNGYITIRSSHSGKLIDVDNRATTDGANVLQWEPNGLDNQQWKL

SEQ ID NO: 13101 - protein, 103 aa, Piromyces finnis; identical to SEQ ID NO: 13029
  RICIN_B_LECTIN

SEQ ID NO: 13102 - protein, 148 aa, Piromyces finnis
  RICIN_B_LECTIN
KPVAVKIEDGWYYIKNPASGKYLQVANNQAKATANIEIGSSSQDDGQKWLLTNVGEGYVTLKSALGDFMIDVSSGEDKNGANIQIYTAYGHDAQQFMILKSSVEGAYSITSRVSFQDKGIDIEGARTADGTNVLQWTSEGRANQLWAF

SEQ ID NO: 13103 - protein, 148 aa, Piromyces finnis; identical to SEQ ID NO: 13102
  RICIN_B_LECTIN

SEQ ID NO: 13104 - protein, 148 aa, Piromyces finnis; identical to SEQ ID NO: 13102
  RICIN_B_LECTIN

SEQ ID NO: 13105 - protein, 100 aa, Piromyces finnis
  RICIN_B_LECTIN
QKWKVTQTSDGYITLTSALGNFMLDVANAKDTDGNNILIYIGYSGDAQKFSLKPAGNSFIITTKVSNGKKALDVYNFGTSDGTNVCQWTVGGQSNQTWVF

SEQ ID NO: 13106 - protein, 148 aa, Piromyces finnis; identical to SEQ ID NO: 13102
  RICIN_B_LECTIN

SEQ ID NO: 13107 - protein, 100 aa, Piromyces finnis; identical to SEQ ID NO: 13105
  RICIN_B_LECTIN

SEQ ID NO: 13108 - protein, 106 aa, Piromyces finnis
  RICIN_B_LECTIN
SSTKQKWKIYNNNDGTVLLISEFGDYALDVSNGSGENGANIQIYSIHGGDAQKFIIRETFESNVYVIDTQASNGQRALDVEGARTDEGTNICQWSDEEKSNQTWTI

SEQ ID NO: 13109 - protein, 102 aa, Neocallimastix californiae
  RicinB_lectin_2
RKWKLTNVSDGYVTLTSELGNYMLDVANGEDVNSANLQIYSAYGGNAQQFVILKTSNSNVYTIGTKASSGQRVLDVEKRGTTDGSNVIQYALNGASNQTWTF

SEQ ID NO: 13110 - protein, 89 aa, Neocallimastix californiae
  RicinB_lectin_2
VTDGWYYIKNTGSDKYLQANGSSAGANVEIGSFTGYSDQKWKVTTNGEGYITLLNGNGNFNLDVDSAKNENGANILIYDAYGGVAQQFA

SEQ ID NO: 13111 - protein, 89 aa, Neocallimastix californiae; identical to SEQ ID NO: 13110
  RicinB_lectin_2

SEQ ID NO: 13112 - protein, 102 aa, Neocallimastix californiae
  RicinB_lectin_2
QKWKITNNDDGTVYIVSEFGNFSLDVDRGSGDNGANIQIYSHHGGEAQKFIIRETNQSGVYVIDTQASNGYRALDVEGERTSEGTNVCQWDDSGKSNQTWTF

SEQ ID NO: 13113 - protein, 89 aa, Neocallimastix californiae
  RicinB_lectin_2
EDGWYFIKNPKSGLYLQVSNEEARAVANIEIGSGSKSDGQKWKVTNVGDGYVTLTSALGDFNIDIANGEDKNGANVQIYDAYGGDAQQF

SEQ ID NO: 13114 - protein, 92 aa, Neocallimastix californiae
  RicinB_lectin_2
FKPKKMADGWYKIKNPVSGLYLQVANAEGADAQNVEIGTDSEQMWKLTNLGDNYVTLTSSLGNFNLDICMAEDENGTNAQIYTVHNEDPQKF

SEQ ID NO: 13115 - protein, 90 aa, Neocallimastix californiae
  RicinB_lectin_2
SKINDGWYYITNTNSNKYLSVRNGVGANSQNVELGSTQQKWKLTNNSDGSVTLVSEVGDFALDVSGGSSDNGANVQIYSNYGGDAQKFYI

SEQ ID NO: 13116 - protein, 90 aa, Neocallimastix californiae; identical to SEQ ID NO: 13115
  RicinB_lectin_2

SEQ ID NO: 13117 - protein, 90 aa, Neocallimastix californiae
  RicinB_lectin_2
LEDGWYYIKNPSTGKYIQVEDGVGRNSANVVIGSERKDDAQKWKVTNTNGYVTFTSALGNYMIDIANGEDRNGANVQIYDAYGGDAQQFI

SEQ ID NO: 13118 - protein, 90 aa, Neocallimastix californiae
  RicinB_lectin_2
AVKLNDGWYYIKNTGSGKYLNVKDGKAASTQNVVIGSSKQKWKLTNNSDNTVTLLSEVGDFMLDVNGGSSDNGANIQIYNAYGGDAQKFV

SEQ ID NO: 13119 - protein, 87 aa, Neocallimastix californiae
  RicinB_lectin_2
INDGWYYIKNPSSGKYLVVKDKKGAASQNVEISSSKQKWKLTNNNDNTVTLLSEVGDFMLDVNGGSDKNNANIQIYHAYGGDAQKFI

SEQ ID NO: 13120 - protein, 103 aa, Neocallimastix californiae
  RicinB_lectin_2
KQKWKLTNNDDNTVTLLSEVGDFMLDIDRGLEENGANIQIYHAYGGDAQRFIIKETGKSKVYVISSKITNGYKVLDVENQATADGSNVCQWENGERSNQTWTF

SEQ ID NO: 13121 - protein, 103 aa, Neocallimastix californiae
  RicinB_lectin_2
AQKWKLENVGNGYVTLVSMYGNYMLDIANGEDKDGSNLQIYSAYGGDAQQFIILKTPQNNVYAIGTKASEGTKVLDIEGGRTSEGSNVLQWTNGGKSNQTWTF

SEQ ID NO: 13122 - protein, 87 aa, Neocallimastix californiae
  RicinB_lectin_2
DGWYYIKNTGSNKYLQTVGSTANSNVEISSFTGSAAQKWKVTKNSEGYITLLNGVGDFNLDVANGKNENGVNILIYIAYGGEAQQFA

SEQ ID NO: 13123 - protein, 103 aa, Neocallimastix californiae
  RicinB_lectin_2
KQKWLLTNVGDDEVTLTTELGNYMLDVNSGSENNGANIQIYNSHGGDSQRFIIEETYQSDVYVIGTKVTNGYKVIDVEREGKDDGSNVCQWDNGEKPNQTWVF

SEQ ID NO: 13124 - protein, 86 aa, Neocallimastix californiae
  RicinB_lectin_2
YKILNVNANKVLDVNDASYSDGANVILWSDNGNSNQRWIIQELGDGYVTIENYNSGKNLDVEKSSTSDGGNVLQWSNNGQNNQQWK

SEQ ID NO: 13125 - protein, 103 aa, Neocallimastix californiae
  RicinB_lectin_2
KQKWKVTKNNDGSVVIISEFGNFALDIANGSGDNGANVQIYTTHGGDAQKFIIRETSNSGIFVIDTIASGGSKALDIEGGRSADGTNICQWDDSAKSNQTWTF

SEQ ID NO: 13126 - protein, 89 aa, Neocallimastix californiae
  RicinB_lectin_2
DGGYRILNVNADKALDVERDSTQNGGNIIIWPDTGNLNQRWTIEDAGNGYVEIVNLSSGKALDVENESTADGANVCQWDAHGSQNQQWK

SEQ ID NO: 13127 - protein, 86 aa, Neocallimastix californiae
  RicinB_lectin_2
QDGWYTIKNTGSGRYLQVSQGRASDSSNIVIGSNAQKWKLENVDEEYITLLTMYGNYMIDVANGEDKNGSNIQIYSAYGGDAQQFT

SEQ ID NO: 13128 - protein, 95 aa, Neocallimastix californiae
  RicinB_lectin_2
QWKIVEDGGYSFTNVNSNKVLDMNGASLEDGGNAIIWPDIAGPNQRWSIENAGDGYVYIINFNSNKVLDVANVSKEEGGNVHQWTITNGANQQWQ

SEQ ID NO: 13129 - protein, 90 aa, Neocallimastix californiae
  RicinB_lectin_2
SGDRYKIINRYTNRVLAVENDSTANNANVLQWGDNGSSGQQWVVAKEGDQYRITSYTTNKALDVSGRSTADGGNVIIYDDKAQGNQRWKF

SEQ ID NO: 13130 - protein, 88 aa, Neocallimastix californiae
  RicinB_lectin_2
EDGWYFIKNPRSGLYLQVSNDYARASANIEIGTGTKSDGQKWKVTNVGDGYITLTTALGDFNIDIANGDDKNGANVQIYDAYGGNAQQ

SEQ ID NO: 13131 - protein, 87 aa, Neocallimastix californiae
  RicinB_lectin_2
VKDGWYTIKNTGSGKYLNVDYGRASAGANVVIGSDAQKWKVENNSEGYVTLVSMYGNYMLDIAMGEDKNGANIQIYDAYGGDAQQFS

SEQ ID NO: 13132 - protein, 86 aa, Neocallimastix californiae
  RicinB_lectin_2
KDGWYTIKNTGSGKYLQVQNGRASDSANVVIGSNAQKWKIQNIGDGYVTILSMYGDYMLDVANGEDVDGANVQIYSSYGGDPQQFI

SEQ ID NO: 13133 - protein, 90 aa, Neocallimastix californiae
  RicinB_lectin_2
EGNGYKIMNVNANKALDVSENSVKDGGDVIIWSDNGHNNQRWNIQDVGNGYVTIKNVNSGKNLDVEKESTSDGADVIQWGNNGNSNQQWK

SEQ ID NO: 13134 - protein, 92 aa, Neocallimastix californiae
  RicinB_lectin_2
STTGGKYKIINRNSGKALGIDGDSTSNGANVIQWSDNGKTSQQWVITDEGNGYKIMNVNANKALDVNDNSMKDGGNVIIWNDNGNNNQRWNI

SEQ ID NO: 13135 - protein, 85 aa, Neocallimastix californiae
  RicinB_lectin_2
GEEYRIAIQLSGKYITAANNGNVHQWENLNDNSQVWYFEDAGNGKFAILSGKNRKLAMTVENGDSKNGNNILLTEYKNTAAQHFI

SEQ ID NO: 13136 - protein, 90 aa, Neocallimastix californiae
  RicinB_lectin_2
KDGWYFIKNSSSGKYLQVSNENSRAASNIEIGSSRKSDGQKWKLTNVGDGYVTLTSALGNFNVDVANGEDKNGANIQIYDAYGGNAQQFI

SEQ ID NO: 13137 - protein, 81 aa, Neocallimastix californiae
  RicinB_lectin_2
NNALTVENGNNKDGNKIILSQYRKTSAQHFILHKTDGNYDTYYITAECSGNAALDVYDQSSDNGAKIDQWNYWGGDNQRFY

SEQ ID NO: 13138 - protein, 89 aa, Neocallimastix californiae
  RicinB_lectin_2
KDGWYFIKNPESGKYLQVSAAKDASSAGNVVISTGTKDNGQKWKLTNVSNGLVTLTSSLGNYNIDVANGKDSNGNNIILYNSYGGEPQQ

SEQ ID NO: 13139 - protein, 92 aa, Neocallimastix californiae
  RicinB_lectin_2
VDTVDEGWYFIKNPSTGKYLTASGNSVPFNVIISTGYQEDNQKWKVTNAGNGYITLTSGLGDYMLDVANGSANNDANIQVYSAYGGDAQQFK

SEQ ID NO: 13140 - protein, 89 aa, Neocallimastix californiae
  RicinB_lectin_2
SDGWYFIKNPSSGKYLQVANENGKNVANIEIGTGRQSDGQKWKLTNVGNGYVTLTSALGEFNIDIANGENKDGTNVQIYEAYGGEAQQF

SEQ ID NO: 13141 - protein, 102 aa, Neocallimastix californiae
  RicinB_lectin_2
QKWKITNVGNGLVTFTTALGDYMIDVEAGSGKNDANIQLYNAYGGDAQQFMILKTTEKDVYTIGTKVSYFDKALDIAQAKTADGTNVVQWTNEMKANQSWTF

SEQ ID NO: 13142 - protein, 103 aa, Neocallimastix californiae
  RicinB_lectin_2
AQKWKLTNTDDGYITLVSELGNYMIDVANGSGENNANVQIYDAYGGDAQKFVLLKTSQSNTYVIATKASNGYRVLDIEKNGTAEGSNVLQWDNQEKANQFWVF

SEQ ID NO: 13143 - protein, 86 aa, Neocallimastix californiae
  RicinB_lectin_2
KDGWYTIKNPNSNKYLQVSYGRGGDAVNVVIGSNPQKWKLENVGDGYVTLLTMYGDYMLDVAAGDSKDGANIQIYSAYGGDAQQFA

SEQ ID NO: 13144 - protein, 87 aa, Neocallimastix californiae
  RicinB_lectin_2
SDGWYYIKNPASGKYLAVRNGIGADAQNVEISSTKQKWKISNNDDGTVLIISELGDYALDVSAGSSNNGANIQIYSAYGGEAQRFII

SEQ ID NO: 13145 - protein, 87 aa, Neocallimastix californiae
  RicinB_lectin_2
TLKDGWYTIKNTGSGLYLGVNNGRASDSANVVIDSDAQKWKLENVGNGYMTLTSMYGDYKIDIAGADDSNGSNVQIYTTHGEDNQQF

SEQ ID NO: 13146 - protein, 96 aa, Neocallimastix californiae
  RicinB_lectin_2
HWKISEDGGYRILNVNANKVLDMNAESTADGGNAIIWPDTGGMNQRWVIESAGGNYVYIINSHSGKALDVDKSSNDDGGNIIQWSLSNNSSNQQWQ

SEQ ID NO: 13147 - protein, 102 aa, Neocallimastix californiae
  RicinB_lectin_2
SKWKLTNTNDGYITLTSSVGNYMLDVAGGEDKNGVNLQIYSAYSGDAQKFVILKTSNNKVYTIGSKVSNGGKVIDVEKRGTTDGSNVIQYALNGASNQTWTF

SEQ ID NO: 13148 - protein, 86 aa, Neocallimastix californiae
  RicinB_lectin_2
DGWYYIMNTGSQRYLTVKDAKAANSQNIEVNSKKQKWKVMNTSEGTVTMESELGNYMIDVNGGSEANGANIQIYESYGGDAQQFYI

SEQ ID NO: 13149 - protein, 91 aa, Neocallimastix californiae
  RicinB_lectin_2
ASGGKYKLINRNSGKALGVDGDSTSNAANVHQWTDNGKTSQQWIITDEGYGYKIMNVNANKALDVNENSTKNGGNVIIWSDNGNLNQRWYI

SEQ ID NO: 13150 - protein, 89 aa, Anaeromyces robustus; identical to SEQ ID NO: 13140
  RicinB_lectin_2

SEQ ID NO: 13151 - protein, 92 aa, Anaeromyces robustus; identical to SEQ ID NO: 13139
  RicinB_lectin_2

SEQ ID NO: 13152 - protein, 86 aa, Anaeromyces robustus; identical to SEQ ID NO: 13143
  RicinB_lectin_2

SEQ ID NO: 13153 - protein, 103 aa, Anaeromyces robustus; identical to SEQ ID NO: 13142
  RicinB_lectin_2

SEQ ID NO: 13154 - protein, 102 aa, Anaeromyces robustus; identical to SEQ ID NO: 13141
  RicinB_lectin_2

SEQ ID NO: 13155 - protein, 87 aa, Anaeromyces robustus; identical to SEQ ID NO: 13145
  RicinB_lectin_2

SEQ ID NO: 13156 - protein, 87 aa, Anaeromyces robustus; identical to SEQ ID NO: 13144
  RicinB_lectin_2

SEQ ID NO: 13157 - protein, 96 aa, Anaeromyces robustus; identical to SEQ ID NO: 13146
  RicinB_lectin_2

SEQ ID NO: 13158 - protein, 91 aa, Anaeromyces robustus; identical to SEQ ID NO: 13149
  RicinB_lectin_2

SEQ ID NO: 13159 - protein, 104 aa, Anaeromyces robustus
  RicinB_lectin_2
KQKWKVTNMDDNTITLLSELGDYMLDVSSGSSENGANIQIYDAYAGDAQKFVLRETSKEGVYVISTKVSNGYKVLDVEREGKSDGSNVCQWDNGGEKAHQTWVF

SEQ ID NO: 13160 - protein, 90 aa, Anaeromyces robustus
  RicinB_lectin_2
EDGGYRILNVNANKVLDMDNESLKDGGNALIWPDTGALNQRWLIEDAGNGYVNIINYNSEKALDVEKNSNADGGNVIQWTLTNSANQQWQ

SEQ ID NO: 13161 - protein, 74 aa, Anaeromyces robustus
  RicinB_lectin_2
NASSGYRLYITKGDNSGPIEESVEVPIIFIPEGTYRIINRNSGKALSVANDSKNNAANVHQWTYSNKASQQWKI

SEQ ID NO: 13162 - protein, 84 aa, Anaeromyces robustus
  RicinB_lectin_2
NGWYTIKNVGSGKYLQVSYGSASDSANVVIGSNAQKWKLEHVDDDYFTLLSMYGNYMIDIAMGEDKDGSNVQIYSAYGGEAQQF

SEQ ID NO: 13163 - protein, 83 aa, Anaeromyces robustus
  RicinB_lectin_2
NGWYTIKNPISGKYLQIRYGSDADTSNVVIGTNPQKWKLEHVDDDYFTLASMYGDYMLDVNRGENKDGANIQVYSAYGGDAQQ

SEQ ID NO: 13164 - protein, 84 aa, Anaeromyces robustus
  RicinB_lectin_2
SGKDYNIVSVLSGKYVTAASNGNVQQYEKLNNDKSQIWRLESAGNGRFAILQGNMAMTVENGNNNNGNNIYMSEYRKTTAQHFS

SEQ ID NO: 13165 - protein, 90 aa, Anaeromyces robustus
  RicinB_lectin_2
EGNGYKIMNVNAKKALDIYGSSVENNGNAIIMTDNGNSSQRWTVKDLGDGYYIIQNVNSGLLLDVERKSTADGGNVLQWPNNGNSNQQWK

SEQ ID NO: 13166 - protein, 93 aa, Anaeromyces robustus
  RicinB_lectin_2
APTNGNTFKIINRLSGKALSVNGDSTANEANVIQWTDNGKTSQQWIITQESNGYKIINVNANKALDVYKNSRDNGGNVIIWYDNGASNQRWNI

SEQ ID NO: 13167 - protein, 86 aa, Anaeromyces robustus
  RicinB_lectin_2
KNGWYTIKNTGSGKYLQVSYGRAGDGVNVVIGSNAQKWKLENVSDGYVTLLTMYGDYMLDVAAGEDKDGANLQIYSSYGGDNQQFS

SEQ ID NO: 13168 - protein, 102 aa, Piromyces finnis
  RicinB_lectin_2
AQKWKLTNVDNGYVTLVSMYGNYMLDVANGDSKNGANLQIYTSHGGDAQQFIFLNTSKNNVYVIGTKASSGTKVLDIESEGTADGSNILQWENGEKSNQTWV

SEQ ID NO: 13169 - protein, 102 aa, Piromyces finnis; identical to SEQ ID NO: 13093
  RicinB_lectin_2

SEQ ID NO: 13170 - protein, 103 aa, Piromyces finnis
  RicinB_lectin_2
QKWKLENVGEGYVTLLSMYGDFMIDVAMGEDKDGSNIQIYTAYGHDAQQFTIIKTTKENVYIIGTRVSEGGKVLDVEREGTADGSNVVQWTGGGEKGNQTWLF

SEQ ID NO: 13171 - protein, 79 aa, Piromyces finnis
  RicinB_lectin_2
ALTVENGNNKNGNKMILSQYQNNAAQRFIFHKTDDVYDNYYITAECSGNAALDVYDQSYDNGANIDQWDYWGGDNQKFY

SEQ ID NO: 13172 - protein, 80 aa, Piromyces finnis; identical to SEQ ID NO: 13037
  RicinB_lectin_2

SEQ ID NO: 13173 - protein, 88 aa, Piromyces finnis
  RicinB_lectin_2
IKDGNYYIKSVSSNKYLVVKDGIGANAQNVEIGSTKQKWKISNNSDGTVYIISELGDYALDVDRGLGDNGANIQIYPLHGGEAQKFII

SEQ ID NO: 13174 - protein, 89 aa, Piromyces finnis
  RicinB_lectin_2
KDGWYFIKNPSTGKYLQVRDEEGKNVANIEIGSGRKSDGQKWKLTNVGDGYVTLTSALGEYNIDIANGEDKNGANVQIYEAYGGDAQQF

SEQ ID NO: 13175 - protein, 98 aa, Piromyces finnis
  RicinB_lectin_2
SQQWVISEEGDYFSLINVNAKKALDVNENSTENGGNVIIWPDTGALNQRWSIQSTGDGYYTITNANSGKNLDVEKGSMSDGGNVLQWGNNGGANQQWK

SEQ ID NO: 13176 - protein, 98 aa, Piromyces finnis; identical to SEQ ID NO: 13175
  RicinB_lectin_2

SEQ ID NO: 13177 - protein, 86 aa, Piromyces finnis
  RicinB_lectin_2
IKIVNVNANKCLDVSGRSKDNGGNIVIYHDNGYMNQRWTFQDAGNGYITIRSSHSGKLIDVDNRATTDGANVLQWEPNGLDNQQWK

SEQ ID NO: 13178 - protein, 102 aa, Piromyces finnis
  RicinB_lectin_2
QKWKLTNMSGGYVTLVSSLGEYMLDIAGGDDGNGTNVQIYSAYAGEAQQFVILKTSKDKVYTIGTRVSNGYRVLDVEKNGTTDGSNVLQWDNSEKSNQTWTF

SEQ ID NO: 13179 - protein, 92 aa, Piromyces finnis
  RicinB_lectin_2
AVKIEDGWYYIKNPASGKYLQVANNQAKATANIEIGSSSQDDGQKWLLTNVGEGYVTLKSALGDFMIDVSSGEDKNGANIQIYTAYGHDAQQ

SEQ ID NO: 13180 - protein, 92 aa, Piromyces finnis; identical to SEQ ID NO: 13179
  RicinB_lectin_2

SEQ ID NO: 13181 - protein, 92 aa, Piromyces finnis; identical to SEQ ID NO: 13179
  RicinB_lectin_2

SEQ ID NO: 13182 - protein, 89 aa, Piromyces finnis
  RicinB_lectin_2
DGWYYIKNTGSNKYLQVKGNNGVANTNVEIGTFAGASGQKWKVTQTSDGYITLTSALGNFMLDVANAKDTDGNNILIYIGYSGDAQKFS

SEQ ID NO: 13183 - protein, 92 aa, Piromyces finnis; identical to SEQ ID NO: 13179
  RicinB_lectin_2

SEQ ID NO: 13184 - protein, 89 aa, Piromyces finnis; identical to SEQ ID NO: 13182
  RicinB_lectin_2

SEQ ID NO: 13185 - protein, 87 aa, Piromyces finnis
  RicinB_lectin_2
EDGWYYIKNTGSNKYLSVKGAVGANGQNVQISSTKQKWKIYNNNDGTVLLISEFGDYALDVSNGSGENGANIQIYSIHGGDAQKFII

SEQ ID NO: 13186 - protein, 80 aa, Piromyces finnis; identical to SEQ ID NO: 13037
  RicinB_lectin_2

SEQ ID NO: 13187 - protein, 116 aa, Neocallimastix californiae
  SCP-like
VEGFKASKIFEKLKATLEATPASIRRHKTKTINAVFQFDVRNDKRERQTWYIDYKNGQGDIGIGKPPQSRADLIVAARDEVIIDLASRKITGQKAYMQSKIKLKGNHALAMKLDSI

SEQ ID NO: 13188 - protein, 116 aa, Anaeromyces robustus
  SCP-like
VEGFKASKIFEKLKATLEATPSPERRHKTDTINAVFQFDVRNDKRESQTWYIDYKNGQGEIGIGKPPQSKPDLIVAARDDVIIDLASRKITGQKAYMQSKIKLKGNHALAMKLDSI

SEQ ID NO: 13189 - protein, 116 aa, Piromyces finnis
  SCP-like
VEGFKASKIFEKLKATLEATSGPERRLKTKQINAVFQFDVRNDKRESQTWYIDYKNGQGDIGIGKPTHSKPDLIIAARDEVIIDLASRKITGQKAYMQSKIKLKGNHALAMKLDSI

SEQ ID NO: 13190 - protein, 96 aa, Neocallimastix californiae
  SCP2
PASIRRHKTKTINAVFQFDVRNDKRERQTWYIDYKNGQGDIGIGKPPQSRADLIVAARDEVIIDLASRKITGQKAYMQSKIKLKGNHALAMKLDSI

SEQ ID NO: 13191 - protein, 103 aa, Anaeromyces robustus
  SCP2
KATLEATPSPERRHKTDTINAVFQFDVRNDKRESQTWYIDYKNGQGEIGIGKPPQSKPDLIVAARDDVIIDLASRKITGQKAYMQSKIKLKGNHALAMKLDSI

SEQ ID NO: 13192 - protein, 96 aa, Piromyces finnis
  SCP2
SGPERRLKTKQINAVFQFDVRNDKRESQTWYIDYKNGQGDIGIGKPTHSKPDLIIAARDEVIIDLASRKITGQKAYMQSKIKLKGNHALAMKLDSI

SEQ ID NO: 13193 - protein, 116 aa, Neocallimastix californiae
  SCP2_sterol-bd_dom
EGFKASKIFEKLKATLEATPASIRRHKTKTINAVFQFDVRNDKRERQTWYIDYKNGQGDIGIGKPPQSRADLIVAARDEVIIDLASRKITGQKAYMQSKIKLKGNHALAMKLDSIL

SEQ ID NO: 13194 - protein, 116 aa, Anaeromyces robustus
  SCP2_sterol-bd_dom
EGFKASKIFEKLKATLEATPSPERRHKTDTINAVFQFDVRNDKRESQTWYIDYKNGQGEIGIGKPPQSKPDLIVAARDDVIIDLASRKITGQKAYMQSKIKLKGNHALAMKLDSIL

SEQ ID NO: 13195 - protein, 116 aa, Piromyces finnis
  SCP2_sterol-bd_dom
EGFKASKIFEKLKATLEATSGPERRLKTKQINAVFQFDVRNDKRESQTWYIDYKNGQGDIGIGKPTHSKPDLIIAARDEVIIDLASRKITGQKAYMQSKIKLKGNHALAMKLDSIL

SEQ ID NO: 13196 - protein, 8 aa, Neocallimastix californiae
  SDRFAMILY
GRIINITS

SEQ ID NO: 13197 - protein, 11 aa, Neocallimastix californiae
  SDRFAMILY
GRVDIIINNAG

SEQ ID NO: 13198 - protein, 19 aa, Neocallimastix californiae
  SDRFAMILY
YAAAKSGVIGLTNALALEG

SEQ ID NO: 13199 - protein, 11 aa, Neocallimastix californiae
  SDRFAMILY
GRVDIIINNAG

SEQ ID NO: 13200 - protein, 19 aa, Neocallimastix californiae
  SDRFAMILY
YAAAKSGVIGLTNALALEG

SEQ ID NO: 13201 - protein, 8 aa, Neocallimastix californiae
  SDRFAMILY
GRIINITS

SEQ ID NO: 13202 - protein, 11 aa, Anaeromyces robustus
  SDRFAMILY
GRVDVIINNAG

SEQ ID NO: 13203 - protein, 19 aa, Anaeromyces robustus
  SDRFAMILY
YAAAKSGVIGFTNALALEG

SEQ ID NO: 13204 - protein, 8 aa, Anaeromyces robustus
  SDRFAMILY
GRIINITS

SEQ ID NO: 13205 - protein, 11 aa, Piromyces finnis
  SDRFAMILY
GRVDVIINNAG

SEQ ID NO: 13206 - protein, 19 aa, Piromyces finnis
  SDRFAMILY
YAAAKAGVIGLTNTLALEG

SEQ ID NO: 13207 - protein, 8 aa, Piromyces finnis
  SDRFAMILY
GRIINITS

SEQ ID NO: 13208 - protein, 63 aa, Neocallimastix californiae; identical to SEQ ID NO: 9754
  SERINE PROTEASE INHIBITOR, SERPIN

SEQ ID NO: 13209 - protein, 263 aa, Neocallimastix californiae; identical to SEQ ID NO: 579
  SERINE PROTEASE INHIBITOR, SERPIN

SEQ ID NO: 13210 - protein, 351 aa, Neocallimastix californiae; identical to SEQ ID NO: 580
  SERINE PROTEASE INHIBITOR, SERPIN

SEQ ID NO: 13211 - protein, 358 aa, Anaeromyces robustus; identical to SEQ ID NO: 581
  SERINE PROTEASE INHIBITOR, SERPIN

SEQ ID NO: 13212 - protein, 355 aa, Anaeromyces robustus; identical to SEQ ID NO: 582
  SERINE PROTEASE INHIBITOR, SERPIN

SEQ ID NO: 13213 - protein, 366 aa, Anaeromyces robustus
  SERINE PROTEASE INHIBITOR, SERPIN
DFDFSFLKLENNKENMLYSPLSIKYALRMLLEGAEGNTYTELIKLIGNEELNPYTNIDKVLSLANGLFIRDTYYTCIRPEYIDTLKEKYNADVVKDEFKSAYNANKWIEKNTLGIIKNMLNDNIVQNPETIMLLINALAIEMEWYSPFNCNYTSGTTFYTEDDDETIEATMMSRVTGDNSLSYSINDDVTVVTMDLNKYGSTQFEFMAIMPTKENLSTFIEKVTKETINEIDKNLIFASEKPYGVDITIPKFKFSYDLGLKKDLKNLGINDTFERNEANLSKMENPEELKQNLFVSDILHKADIEFTEKGVKAAAVTVVVILPGSAGPSNKKTPLYITIDRPFMFIIRDKNTKDIWFTGTVYKPNL

SEQ ID NO: 13214 - protein, 393 aa, Anaeromyces robustus
  SERINE PROTEASE INHIBITOR, SERPIN
NEWCGIKDNCESIVKEEDPINNNSTDVSSNNDFEFEFLKMENPKDNMIYSPLSIEYALKMLQEGANSNTLDEINKVVKGMELPKYTNIDNILSLANGFFIRDIYYKNVKTEYINTLKEKYDADVIEDEFENADNVNQWIKDKTLEIIKNVLNDEVVHDPSILMILVNALAIDMQWAKVFDTKETRGEIFYKDNGEKIMATMMFNKEVSCDCISYYIDDDLTVVSMDLREYEGTQLEFMAIMPKDNLSDYVKNVTKEQINEITKNLKSSLNSHDGVNVKIPKFNFDYNLNLKKDLMDLGIIDVFDVNRADLTKISENPIDRLYIADALHKANIEFTESGVKAAAVTVMIGGWGAMMPINKHPINVIINQPFMFIIRDKNTKDIWFTGTVYEPNL

SEQ ID NO: 13215 - protein, 371 aa, Anaeromyces robustus; identical to SEQ ID NO: 583
  SERINE PROTEASE INHIBITOR, SERPIN

SEQ ID NO: 13216 - protein, 495 aa, Neocallimastix californiae
  SERINE/THREONINE PROTEIN KINASE
KFLLIIFILNTIVINTLVSSNSINLNDIEWLDVEHWNQTDFDRLQKRGNYDGQIKKINFYKGVDISSIISLENSGIRFYDTNGQQIDIFKMFASVGVNCIRVRIWNNPKSANGKTYGGGNNDLEVAREIGSRAASAGLPLFVDFHYSDFWADPGKQTIPKDWKNFNLDKRVSEIYRFTKGCLEWLLQNGSLISMVQIGNETTCFMCGDKNMTNVMKMMSNGAKAVREINRDILIALHFTNPNKSDNMLWYASQLASARVDYDVYSTSYYPYWHGTTDNLKWVLGEIANKYGKKVMIAEYSYPYTEVAYTSDNCHYGVVDSKASGTVFRYPISVDGQIQCIRDMYSVMRNTKNGIGAFYWEPAWIAPKARNDMERRQIWEQYGSSWATKTAAEYDSNADRNLTGGTSWDNQAIFDQNGKVLKSIWALGDGTAPSNSVADNNNNNHNNNNNSNNNNNNNNNNNNNNNNNNNNNNNNNNNNNNNNNNNNNNNNNNNCF

SEQ ID NO: 13217 - protein, 353 aa, Neocallimastix californiae
  SERPIN
YFYTKILSKLGGKKNFAYSPESLNIALKLYEEFLVDGEEKKEILNLIGNKNYLDYKNSLSSKIVNRIWIDSKKKYDFSSVVKMEKYLYAIDMSADNAKEIKDAYVSEVTDGFITSTPTEFSSKTIYDFMNILYFKGKWNKDANNFRIKNIFFPFKTIDGKESHATSIGFTKKNGYYLKNDDAIAVNLYYEKEEIENYAGFQMIVILPNEDKSISDIDIRPFLPYDYEDEVTPAKLKNNFDELYFEMPKFSVETEWFIKSGTKEASLFELDHFSGGSLNRNIYNASISAEISQVVRIECDEKGTTAAAVTEVHGSAKALPKTPIIFNFICNRPFIYVLYDNVNDDIGFVGQVMT

SEQ ID NO: 13218 - protein, 348 aa, Neocallimastix californiae
  Serpin
KILSKLGGKKNFAYSPESLNIALKLYEEFLVDGEEKKEILNLIGNKNYLDYKNSLSSKIVNRIWIDSKKKYDFSSVVKMEKYLYAIDMSADNAKEIKDAYVSEVTDGFITSTPTEFSSKTIYDFMNILYFKGKWNKDANNFRIKNIFFPFKTIDGKESHATSIGFTKKNGYYLKNDDAIAVNLYYEKEEIENYAGFQMIVILPNEDKSISDIDIRPFLPYDYEDEVTPAKLKNNFDELYFEMPKFSVETEWFIKSGTKEASLFELDHFSGGSLNRNIYNASISAEISQVVRIECDEKGTTAAAVTEVHGSAKALPKTPIIFNFICNRPFIYVLYDNVNDDIGFVGQVM

SEQ ID NO: 13219 - protein, 10 aa, Neocallimastix californiae
  SERPIN
FICNRPFIYV

SEQ ID NO: 13220 - protein, 40 aa, Neocallimastix californiae
  Serpin
LKLENFKKNMLYSPFSIKYALKMLQEGAANNTFDEINKLI

SEQ ID NO: 13221 - protein, 97 aa, Neocallimastix californiae
  Serpin
LKLENFKKNMLYSPFSIKYALKMLQEGAANDTFDEINKLIGNTKLSKHISIDEVLSLANGLFIRDTFYKYINTNYINTLKENYDAEVVKDEFKSAAN

SEQ ID NO: 13222 - protein, 277 aa, Neocallimastix californiae
  SERPIN
FDFNFSFLKLENFKKNMLYSPFSIKYALKMLQEGAANNTFDEINKLIGNTQLSKYTNIDEVLSLANGLFIRDTFYDYINTNYINTLKENYDAEVVKDEFKNAANANKWIEDKTFNIIKNMLTDEMIKNPTSVMLIINALAIDMEWKEGFSFQYTDGDYFYLDNGEKMKATTMYRKEFGTILSYYIDDSVTVVTLDLKKYGNIQFEFMAIMPKGNLSSFIENFTEEQMDHINKNLNFANNVEDGVVLYIPKFKFNYDLKLKQDLINLGIKDAFNYSKS

SEQ ID NO: 13223 - protein, 269 aa, Neocallimastix californiae
  Serpin
LKLENFKKNMLYSPFSIKYALKMLQEGAANNTFDEINKLIGNTQLSKYTNIDEVLSLANGLFIRDTFYDYINTNYINTLKENYDAEVVKDEFKNAANANKWIEDKTFNIIKNMLTDEMIKNPTSVMLIINALAIDMEWKEGFSFQYTDGDYFYLDNGEKMKATTMYRKEFGTILSYYIDDSVTVVTLDLKKYGNIQFEFMAIMPKGNLSSFIENFTEEQMDHINKNLNFANNVEDGVVLYIPKFKFNYDLKLKQDLINLGIKDAFNYSK

SEQ ID NO: 13224 - protein, 362 aa, Neocallimastix californiae
  SERPIN
FDFNFSFLKLENFKKNMLYSPLSIKYALKMLQEGAANNTFDEINKLIGNTQLSKYTSIDKVLSLANGLFIRDTFYDYINTNYINTLKENYDAEVVKDEFKSAANANKWIEDKTFNIIKNMLDDDIVQNPSSVMLIINALAIDMGWYRSFSFENTNGYDFYLDNGEKMKTTMMSKTEKSTNLSYYIDDNVSVVTSDLKKYDDIQFEFMAIMPKENLSSFIENFTEEQMDHINQNLNFSTTIEDGVVFRIPKFKFDYDLELKQDLMKLGIKDAFNYSKSDFSKMEGSTDPDKKLYVSEALHKADIEFTEEGIKAAAVTVFGMKATSAHNPIIPKPLYITFDKPFMFIIRDKKTQDIWFTGTVYE

SEQ ID NO: 13225 - protein, 355 aa, Neocallimastix californiae
  Serpin
LKLENFKKNMLYSPLSIKYALKMLQEGAANNTFDEINKLIGNTQLSKYTSIDKVLSLANGLFIRDTFYDYINTNYINTLKENYDAEVVKDEFKSAANANKWIEDKTFNIIKNMLDDDIVQNPSSVMLIINALAIDMGWYRSFSFENTNGYDFYLDNGEKMKTTMMSKTEKSTNLSYYIDDNVSVVTSDLKKYDDIQFEFMAIMPKENLSSFIENFTEEQMDHINQNLNFSTTIEDGVVFRIPKFKFDYDLELKQDLMKLGIKDAFNYSKSDFSKMEGSTDPDKKLYVSEALHKADIEFTEEGIKAAAVTVFGMKATSAHNPIIPKPLYITFDKPFMFIIRDKKTQDIWFTGTVYE

SEQ ID NO: 13226 - protein, 10 aa, Neocallimastix californiae
  SERPIN
ITFDKPFMFI

SEQ ID NO: 13227 - protein, 363 aa, Anaeromyces robustus
  SERPIN
FDFAFLKMENKKKNMLYSPLSIEYALKMLQEGANGNTYSEINKIVGNEELPKYISLDKNLSLANGLFIRNTYSEYVKPSYVSTLRDKFYAEVVEDEFNDASNVNEWIEDKTLGIIKDMLRDDIVQNPRTSLILVNALAMDMKWAYPFRDESTHGRTFYKENGQEIEATTLSTTISANGVSYYKDDDLTVLTMDLKKYSEFQFEFVAIMPKNENLSSFVEKVTREQIDEIDEKLISSYDERDGIYIRIPKFKFQYDLELKKDLINLGVNDAFSPIKADLKKIADPEDPDKKLYVGDALHKADIEFSEEGIKAAAVTVIIIMAAGAAPGPRREPQPVNVIIDKPFMFMIRDKNTKNIWFTGTVYE

SEQ ID NO: 13228 - protein, 358 aa, Anaeromyces robustus
  Serpin
LKMENKKKNMLYSPLSIEYALKMLQEGANGNTYSEINKIVGNEELPKYISLDKNLSLANGLFIRNTYSEYVKPSYVSTLRDKFYAEVVEDEFNDASNVNEWIEDKTLGIIKDMLRDDIVQNPRTSLILVNALAMDMKWAYPFRDESTHGRTFYKENGQEIEATTLSTTISANGVSYYKDDDLTVLTMDLKKYSEFQFEFVAIMPKNENLSSFVEKVTREQIDEIDEKLISSYDERDGIYIRIPKFKFQYDLELKKDLINLGVNDAFSPIKADLKKIADPEDPDKKLYVGDALHKADIEFSEEGIKAAAVTVIIIMAAGAAPGPRREPQPVNVIIDKPFMFMIRDKNTKNIWFTGTVYE

SEQ ID NO: 13229 - protein, 10 aa, Anaeromyces robustus
  SERPIN
VIIDKPFMFM

SEQ ID NO: 13230 - protein, 360 aa, Anaeromyces robustus
  SERPIN
FEFLFLKLENHKENMLYSPLSIEYALNMLQEGADGNTYDEINKIIGNDELPKYTNIENNLSLANGVFIKDTFYENVKTDYINTLKEKFDSEVIQDPFESAENVNHWIEDKTLGIIKNVVNDDAVRSPAMAMLLINALAMDMDWKILFDSYDTNEENFYMENGQRIQVSMMNKKEIKSDVVSYYKSNKVKAVTMEFEEYNGTELEFLALMPNEDLSSFVENITLEQIQKLDQKLIPSSETSNGVNLKIPKFKFSYDLALKKNLMDLGINDAFDELKANFTKISDPYSSGMNLFVSDALHKADIEFTEKGVKAAAVTVALTYATSFRPKKGDPIEIVIDKPFMFIIRDKNTKDIWFTGTVYE

SEQ ID NO: 13231 - protein, 356 aa, Anaeromyces robustus
  Serpin
FLKLENHKENMLYSPLSIEYALNMLQEGADGNTYDEINKIIGNDELPKYTNIENNLSLANGVFIKDTFYENVKTDYINTLKEKFDSEVIQDPFESAENVNHWIEDKTLGIIKNVVNDDAVRSPAMAMLLINALAMDMDWKILFDSYDTNEENFYMENGQRIQVSMMNKKEIKSDVVSYYKSNKVKAVTMEFEEYNGTELEFLALMPNEDLSSFVENITLEQIQKLDQKLIPSSETSNGVNLKIPKFKFSYDLALKKNLMDLGINDAFDELKANFTKISDPYSSGMNLFVSDALHKADIEFTEKGVKAAAVTVALTYATSFRPKKGDPIEIVIDKPFMFIIRDKNTKDIWFTGTVYE

SEQ ID NO: 13232 - protein, 10 aa, Anaeromyces robustus
  SERPIN
IVIDKPFMFI

SEQ ID NO: 13233 - protein, 362 aa, Anaeromyces robustus
  SERPIN
FDFSFLKLENNKENMLYSPLSIKYALRMLLEGAEGNTYTELIKLIGNEELNPYTNIDKVLSLANGLFIRDTYYTCIRPEYIDTLKEKYNADVVKDEFKSAYNANKWIEKNTLGIIKNMLNDNIVQNPETIMLLINALAIEMEWYSPFNCNYTSGTTFYTEDDDETIEATMMSRVTGDNSLSYSINDDVTVVTMDLNKYGSTQFEFMAIMPTKENLSTFIEKVTKETINEIDKNLIFASEKPYGVDITIPKFKFSYDLGLKKDLKNLGINDTFERNEANLSKMENPEELKQNLFVSDILHKADIEFTEKGVKAAAVTVVVILPGSAGPSNKKTPLYITIDRPFMFIIRDKNTKDIWFTGTVYK

SEQ ID NO: 13234 - protein, 357 aa, Anaeromyces robustus
  Serpin
LKLENNKENMLYSPLSIKYALRMLLEGAEGNTYTELIKLIGNEELNPYTNIDKVLSLANGLFIRDTYYTCIRPEYIDTLKEKYNADVVKDEFKSAYNANKWIEKNTLGIIKNMLNDNIVQNPETIMLLINALAIEMEWYSPFNCNYTSGTTFYTEDDDETIEATMMSRVTGDNSLSYSINDDVTVVTMDLNKYGSTQFEFMAIMPTKENLSTFIEKVTKETINEIDKNLIFASEKPYGVDITIPKFKFSYDLGLKKDLKNLGINDTFERNEANLSKMENPEELKQNLFVSDILHKADIEFTEKGVKAAAVTVVVILPGSAGPSNKKTPLYITIDRPFMFIIRDKNTKDIWFTGTVYK

SEQ ID NO: 13235 - protein, 10 aa, Anaeromyces robustus
  SERPIN
ITIDRPFMFI

SEQ ID NO: 13236 - protein, 356 aa, Anaeromyces robustus
  SERPIN
FEFLKMENPKDNMIYSPLSIEYALKMLQEGANSNTLDEINKVVKGMELPKYTNIDNILSLANGFFIRDIYYKNVKTEYINTLKEKYDADVIEDEFENADNVNQWIKDKTLEIIKNVLNDEVVHDPSILMILVNALAIDMQWAKVFDTKETRGEIFYKDNGEKIMATMMFNKEVSCDCISYYIDDDLTVVSMDLREYEGTQLEFMAIMPKDNLSDYVKNVTKEQINEITKNLKSSLNSHDGVNVKIPKFNFDYNLNLKKDLMDLGIIDVFDVNRADLTKISENPIDRLYIADALHKANIEFTESGVKAAAVTVMIGGWGAMMPINKHPINVIINQPFMFIIRDKNTKDIWFTGTVYE

SEQ ID NO: 13237 - protein, 362 aa, Anaeromyces robustus
  Serpin
SNNDFEFEFLKMENPKDNMIYSPLSIEYALKMLQEGANSNTLDEINKVVKGMELPKYTNIDNILSLANGFFIRDIYYKNVKTEYINTLKEKYDADVIEDEFENADNVNQWIKDKTLEIIKNVLNDEVVHDPSILMILVNALAIDMQWAKVFDTKETRGEIFYKDNGEKIMATMMFNKEVSCDCISYYIDDDLTVVSMDLREYEGTQLEFMAIMPKDNLSDYVKNVTKEQINEITKNLKSSLNSHDGVNVKIPKFNFDYNLNLKKDLMDLGIIDVFDVNRADLTKISENPIDRLYIADALHKANIEFTESGVKAAAVTVMIGGWGAMMPINKHPINVIINQPFMFIIRDKNTKDIWFTGTVYE

SEQ ID NO: 13238 - protein, 10 aa, Anaeromyces robustus
  SERPIN
VIINQPFMFI

SEQ ID NO: 13239 - protein, 361 aa, Anaeromyces robustus
  SERPIN
FDFSFLKLENNKENMLYSPLSIKYALKMLLEGADGNTYNEISKLVGNSELTKCSNIDKVLSLANGLFIRDTFYTCINPEYIKTLEEKYNSEVVKDEFKNADNVNEWIENKTLGIIKKMLDDKKVQDPSSVMLLINALAIEMDWYSAFKIESTYGNTFYIDDDKKVEATMMSQKVYSNNLSYYLSDELTAVTMDLKEYGGTQFEFMAIMPTKDNLSTFIENVTKKQINEIDEKLILASEAEYGVIIKIPKFKFSYDLKLKDDLKSLGIKDAFDMSRANFSKMENPSELTQNLYVSDALHKADIEFTEKGIKAAAVTVIIITYGSAGPSKPTTPVYVTIDRPFMFIIRDKNTKDIWFTGTVYK

SEQ ID NO: 13240 - protein, 364 aa, Anaeromyces robustus
  Serpin
NSDFDFSFLKLENNKENMLYSPLSIKYALKMLLEGADGNTYNEISKLVGNSELTKCSNIDKVLSLANGLFIRDTFYTCINPEYIKTLEEKYNSEVVKDEFKNADNVNEWIENKTLGIIKKMLDDKKVQDPSSVMLLINALAIEMDWYSAFKIESTYGNTFYIDDDKKVEATMMSQKVYSNNLSYYLSDELTAVTMDLKEYGGTQFEFMAIMPTKDNLSTFIENVTKKQINEIDEKLILASEAEYGVIIKIPKFKFSYDLKLKDDLKSLGIKDAFDMSRANFSKMENPSELTQNLYVSDALHKADIEFTEKGIKAAAVTVIIITYGSAGPSKPTTPVYVTIDRPFMFIIRDKNTKDIWFTGTVYK

SEQ ID NO: 13241 - protein, 10 aa, Anaeromyces robustus
  SERPIN
VTIDRPFMFI

SEQ ID NO: 13242 - protein, 63 aa, Anaeromyces robustus
  Serpin
LKIENNQCNMLYSPLSIEYALKMLQEGANNNTLNEINEVIKDIELTTKYTAIDKVLSLANGLF

SEQ ID NO: 13243 - protein, 347 aa, Neocallimastix californiae
  Serpins
KILSKLGGKKNFAYSPESLNIALKLYEEFLVDGEEKKEILNLIGNKNYLDYKNSLSSKIVNRIWIDSKKKYDFSSVVKMEKYLYAIDMSADNAKEIKDAYVSEVTDGFITSTPTEFSSKTIYDFMNILYFKGKWNKDANNFRIKNIFFPFKTIDGKESHATSIGFTKKNGYYLKNDDAIAVNLYYEKEEIENYAGFQMIVILPNEDKSISDIDIRPFLPYDYEDEVTPAKLKNNFDELYFEMPKFSVETEWFIKSGTKEASLFELDHFSGGSLNRNIYNASISAEISQVVRIECDEKGTTAAAVTEVHGSAKALPKTPIIFNFICNRPFIYVLYDNVNDDIGFVGQV

SEQ ID NO: 13244 - protein, 52 aa, Neocallimastix californiae
  Serpins
EDDFDFNFSFLKLENFKKNMLYSPFSIKYALKMLQEGAANNTFDEINKLIGN

SEQ ID NO: 13245 - protein, 99 aa, Neocallimastix californiae
  Serpins
NFNFSFLKLENFKKNMLYSPFSIKYALKMLQEGAANDTFDEINKLIGNTKLSKHISIDEVLSLANGLFIRDTFYKYINTNYINTLKENYDAEVVKDEFK

SEQ ID NO: 13246 - protein, 286 aa, Neocallimastix californiae
  Serpins
LVVYNAEDDFDFNFSFLKLENFKKNMLYSPFSIKYALKMLQEGAANNTFDEINKLIGNTQLSKYTNIDEVLSLANGLFIRDTFYDYINTNYINTLKENYDAEVVKDEFKNAANANKWIEDKTFNIIKNMLTDEMIKNPTSVMLIINALAIDMEWKEGFSFQYTDGDYFYLDNGEKMKATTMYRKEFGTILSYYIDDSVTVVTLDLKKYGNIQFEFMAIMPKGNLSSFIENFTEEQMDHINKNLNFANNVEDGVVLYIPKFKFNYDLKLKQDLINLGIKDAFNYSKS

SEQ ID NO: 13247 - protein, 362 aa, Neocallimastix californiae; identical to SEQ ID NO: 13224
  Serpins

SEQ ID NO: 13248 - protein, 363 aa, Anaeromyces robustus; identical to SEQ ID NO: 13227
  Serpins

SEQ ID NO: 13249 - protein, 361 aa, Anaeromyces robustus
  Serpins
DFEFLFLKLENHKENMLYSPLSIEYALNMLQEGADGNTYDEINKIIGNDELPKYTNIENNLSLANGVFIKDTFYENVKTDYINTLKEKFDSEVIQDPFESAENVNHWIEDKTLGIIKNVVNDDAVRSPAMAMLLINALAMDMDWKILFDSYDTNEENFYMENGQRIQVSMMNKKEIKSDVVSYYKSNKVKAVTMEFEEYNGTELEFLALMPNEDLSSFVENITLEQIQKLDQKLIPSSETSNGVNLKIPKFKFSYDLALKKNLMDLGINDAFDELKANFTKISDPYSSGMNLFVSDALHKADIEFTEKGVKAAAVTVALTYATSFRPKKGDPIEIVIDKPFMFIIRDKNTKDIWFTGTVYE

SEQ ID NO: 13250 - protein, 377 aa, Anaeromyces robustus
  Serpins
SCSKNVEDIIQGDPDFDFSFLKLENNKENMLYSPLSIKYALRMLLEGAEGNTYTELIKLIGNEELNPYTNIDKVLSLANGLFIRDTYYTCIRPEYIDTLKEKYNADVVKDEFKSAYNANKWIEKNTLGIIKNMLNDNIVQNPETIMLLINALAIEMEWYSPFNCNYTSGTTFYTEDDDETIEATMMSRVTGDNSLSYSINDDVTVVTMDLNKYGSTQFEFMAIMPTKENLSTFIEKVTKETINEIDKNLIFASEKPYGVDITIPKFKFSYDLGLKKDLKNLGINDTFERNEANLSKMENPEELKQNLFVSDILHKADIEFTEKGVKAAAVTVVVILPGSAGPSNKKTPLYITIDRPFMFIIRDKNTKDIWFTGTVYK

SEQ ID NO: 13251 - protein, 364 aa, Anaeromyces robustus
  Serpins
VSSNNDFEFEFLKMENPKDNMIYSPLSIEYALKMLQEGANSNTLDEINKVVKGMELPKYTNIDNILSLANGFFIRDIYYKNVKTEYINTLKEKYDADVIEDEFENADNVNQWIKDKTLEIIKNVLNDEVVHDPSILMILVNALAIDMQWAKVFDTKETRGEIFYKDNGEKIMATMMFNKEVSCDCISYYIDDDLTVVSMDLREYEGTQLEFMAIMPKDNLSDYVKNVTKEQINEITKNLKSSLNSHDGVNVKIPKFNFDYNLNLKKDLMDLGIIDVFDVNRADLTKISENPIDRLYIADALHKANIEFTESGVKAAAVTVMIGGWGAMMPINKHPINVIINQPFMFIIRDKNTKDIWFTGTVYE

SEQ ID NO: 13252 - protein, 403 aa, Anaeromyces robustus
  Serpins
PCCQSCKVLYTDKSGKWGVENGKWCGIKDNCTNDVVVEYNSDFDFSFLKLENNKENMLYSPLSIKYALKMLLEGADGNTYNEISKLVGNSELTKCSNIDKVLSLANGLFIRDTFYTCINPEYIKTLEEKYNSEVVKDEFKNADNVNEWIENKTLGIIKKMLDDKKVQDPSSVMLLINALAIEMDWYSAFKIESTYGNTFYIDDDKKVEATMMSQKVYSNNLSYYLSDELTAVTMDLKEYGGTQFEFMAIMPTKDNLSTFIENVTKKQINEIDEKLILASEAEYGVIIKIPKFKFSYDLKLKDDLKSLGIKDAFDMSRANFSKMENPSELTQNLYVSDALHKADIEFTEKGIKAAAVTVIIITYGSAGPSKPTTPVYVTIDRPFMFIIRDKNTKDIWFTGTVYK

SEQ ID NO: 13253 - protein, 78 aa, Anaeromyces robustus
  Serpins
TSIHHNFEFSFLKIENNQCNMLYSPLSIEYALKMLQEGANNNTLNEINEVIKDIELTTKYTAIDKVLSLANGLFIRDT

SEQ ID NO: 13254 - protein, 260 aa, Neocallimastix californiae
  SGNH hydrolase
NFHIYLAFGQSNMEGQGPIGSQDRTVDKRFQMISTVSGCNGRQMGNWYDAIPPLANCDGKLGPVDYFGRTLVKNLPQEIKVGVAVVAVAGCDIQLFEKNNYRNYRLESYMQGRVNAYGGNPYGRLIEVAKKAQQVGVIKGILLHQGETNTGQQNWPNRVKAIYEDMLKDLGLNAKDVPLLAGEVVQSNQGGQCGSMNSIIQRLPSVIPTAHVISSQGLGQQGDGLHFSSQAYRTFGERYANEMLKILGDVKPVAKTTTTT

SEQ ID NO: 13255 - protein, 255 aa, Neocallimastix californiae
  SGNH hydrolase
NFHIYLAFGQSNMEGQGPIEPQDRIPEKRYQVLSTFGNCDGREVGKWYDAVPPLARCFARVGPMDYFGRTLAKKLPEEIKIGAVIVAVGGCSIQLFEKDNYMNYKLENYMVDVVKNYGGNPYKRLIDVAKLAQKDGVIKGILLHQGESNNGQTNWPYRVKAVYENILNDLGLKAEEVPLLAGEVVQTSEGGQCGGMNKIINTLPNVIPTAHVVSSVGLKQQGDGYHFSTEAYREFGERYAEEMLKILGDVKVIDT

SEQ ID NO: 13256 - protein, 124 aa, Neocallimastix californiae
  SGNH hydrolase
YISDEAHDFSERKAPDLMIIFLGTNDAGNDAKVVAEDYYETLKKFLTRVREIYPETPLAITSLLYDPGNWNEIQSNIVNEFDNIYYIYINDPVINSSPNIYLTNYHLTQKGSCALMKTMVEKVS

SEQ ID NO: 13257 - protein, 45 aa, Neocallimastix californiae
  SGNH hydrolase
IQIVGDSLTAGQYLPNEQADSWSFLFGKYMNAETDIIAKPGICLS

SEQ ID NO: 13258 - protein, 255 aa, Neocallimastix californiae
  SGNH hydrolase
NFHIYLAFGQSNMQGDGKIENQDRVVDKRFKMLATAGGCNNRRVGEWYDAIPPLANCAGGLGPVDYFGRTLLKKLPEQIKVGVAVVAVAGCDIQLFEKDNYRSYNMPDWMVGIVNGYNGNPYGRLIEMGKKAKEAGVIKGILLHQGETNTGQQDWPDRVKKIYQNIINDLSLNADEVPLLVGEVVNADSGGACAYHNEVIKRVPQLIKNSYVISSKGLPQKGDGLHFTSAGYRTFGERFADTMLKILGNVSVVDN

SEQ ID NO: 13259 - protein, 64 aa, Neocallimastix californiae
  SGNH hydrolase
CAYHNEVIKRVPQLIKNSYVISSKGLPQKGDGLHFTSAGYRTFGERFADTMLKILGNVSVVDNG

SEQ ID NO: 13260 - protein, 205 aa, Neocallimastix californiae
  SGNH hydrolase
DYKAVVCFGDSITDGRGVTNDKNNRWTDILATRLQQNPATKNIGVLNQGIGATTVAGTYYNPTSPAGQARFEKDVLKQTNVKYLIILYGVNDILYNNSNAQTIINVYKDLIKKAHNNGIKVFGGTILPFGKNSGFNSNKESQRTTVNNWIMNTPASQGGFDGYIDFASAVADKSNKQWLNTNWNFENDGLHPNAVGYEAMGKAID

SEQ ID NO: 13261 - protein, 167 aa, Neocallimastix californiae
  SGNH hydrolase
QYDDNNAGYSGFQIKEIPGWGQQQGGEGSLYNKLKSKNAVKQSQPDIILLIIGTNDMTANRSMDACANDLRALLDYMLADMPANSIIFMGSIPEFTAYGGNAQRIANYNGTVKKVADEYANKGKNVRFADVHGCLNGMSDIGSDRLHPSGNGYKKIGNFWAGVIDEY

SEQ ID NO: 13262 - protein, 27 aa, Neocallimastix californiae
  SGNH hydrolase
GDTVKIMPVGDSITFGEGERGGYRKYL

SEQ ID NO: 13263 - protein, 250 aa, Neocallimastix californiae
  SGNH hydrolase
NFHIYLAFGQSNMQGAGQIANQDKTVDKRFQMLATAGGCNNRQVGNWYDAIPPLAHCGGGLGPVDYFGRNLIKNLPSQIKVGVVVVAVAGCDIQLFEKDNYRSYNMADWMKSIVNSYGGNPYGRLVEMGKKAQQAGVIKGILFHQGETNSGQQNWPNRVKGIYDNLIKDLGLKASEVPLLAGELVSSAKGGVCGGHNSIIQRLPQVIPNAHVISSSGLDQQGDGLHFTSAAYRTFGQRFAETMLKLLGDV

SEQ ID NO: 13264 - protein, 249 aa, Neocallimastix californiae
  SGNH hydrolase
NFHIYLAFGQSNMEGAGPIENQDRQVDKRFKMLSTVSGCGRQLGNWYDATPPLAHCGGKLGPVDYFGRNLVKNLPEQIKVGVVVVAVAGCDIQLFEKNNYKSYNMPDWMRNTVQNYGGNPYGRLVDMAKKAQQEGVIKGILLHQGETNSGQQNWPNRVKDIYNNLIKDLGLNANDVPLLAGEVVSSEQGGSCGGHNSIIQKLPSVIPTAHVISSKGLGQQGDGLHFTSASYRTFGQRYADEMLKILGNV

SEQ ID NO: 13265 - protein, 261 aa, Neocallimastix californiae
  SGNH hydrolase
NFHIYLAFGQSNMEGQGPIEAQDKTVDSRFKMLSTVDGCNNRSLGEWYEAIPPLANCDGRLGPVDYFGRTLVKKLPEQIKVGAVVVAVAGCDIQLFEKDNYIEYSKEQPDWMVGRINAYGGNPYGRLVDMAKKAQEVGVIKGILFHQGETNNGQVTWPSRVKAVYNDLLSDLGLKAENVPLLAGEVVPESVNGLCAAMNDIIKTLPETIPTAHVISSEGLEPQDDNLHFSSAAYRTFGERYAETMLELLGDVEVVDNTSEC

SEQ ID NO: 13266 - protein, 257 aa, Neocallimastix californiae
  SGNH hydrolase
KDLIVFGDSYTTATIDYSTLQFNGQSSNNEEESKNWPLFLVKKRIMNMWNFACSGAVVDNDIIHSNNALPMTEQYKAFILHMGKGGKHSNWRSDQSLIGIWFGINDIMNRADNDIDYDDDQSIIKSMFKIINKIYDLGARNFLILDVPSLEKLPHFIYSPVKGLDEEVLKFNKMIADSAMNFQKSKPETNVFVYNAYNELNYIMKNENKFGFTITVDDWYHNNERKLEDITKEYFWRDGYHLSKYVQEALSQELDDF

SEQ ID NO: 13267 - protein, 195 aa, Neocallimastix californiae
  SGNH hydrolase
DIIIFGDSYTTVGINFNTMKYTGDNLSGGKNWPQFLIDMHPMNMWNFAISGAVVDAKVVDGNPQYTPMTEQYNWFLKNMAPGKQFSNWKGESSLFAIWFGINDIGSKRRNEGLTSSQIDEKIATSMFNMIDGMYKQGARNFMFIFVPTIEKCPAYSNGNNPNIKSDIPNYNSNLNKYAKNFQASHPDTNVFVYDS

SEQ ID NO: 13268 - protein, 36 aa, Neocallimastix californiae
  SGNH hydrolase
GNQNNCDSNTYFWKDVIHPTPTVHKPLAQDIEDFLI

SEQ ID NO: 13269 - protein, 124 aa, Neocallimastix californiae
  SGNH hydrolase
YDDDAEYDFSKRKAPELIIIYMGNNDSGKEDPIAPEDYFETLKKFITRIRGIYPNSKIIVTSAFDSRPHWDTVQEHIPEYFDDLYYIPTYEFGLIEAPYVYPQNYHYTQLGNCLFLKNIIEKIS

SEQ ID NO: 13270 - protein, 44 aa, Neocallimastix californiae
  SGNH hydrolase
QVIGDSLSAGQYCPNEALDAWAFLLGKAMNVEVDVIAKPGACLT

SEQ ID NO: 13271 - protein, 255 aa, Neocallimastix californiae
  SGNH hydrolase
NFHIYLAFGQSNMQGAGQIENQDKTVDKRFQMIATAAGCNNRRVGEWYDAIPPLAHCGGGLGPVDYFGRTLVKKLPEQIKVGVAVVAVAGCDIQLFEKNNYRSYNMADWMKGIVDSYGGNPYGRLIDMGKKAQQVGVIKGILLHQGETNNGQSDWPNRVKAIYEDILKDLSLKAEEVPLLVGETVDSDSGGVCGYHNSVIARIPQVIKNGHVISSKGLGQQGDGLHFTSAAYRTFGERYADTMLKLLGNVQPVEG

SEQ ID NO: 13272 - protein, 222 aa, Neocallimastix californiae
  SGNH hydrolase
SGDAIKIMPVGDSITFGMGENGGYRKYLYSALTQKGYNIDMVGPEGSSRATANGISYDDNHAGYSGFQIKEIPDWGRQQGGDGSLYNKLKSKNAVKQAQPDIILLIIGTNDMTANRSMDACASDLRALLDYMLGDMPSGGIIFMGSIPEFTAYGGNAQRVANYNGTVKKVAEEYASKGKNVRFADVHGSLNGTGDLGGDGLHPNGNGYKKMGNFWADVIDKY

SEQ ID NO: 13273 - protein, 265 aa, Neocallimastix californiae
  SGNH hydrolase
NFHIYLAFGQSNMEGNGPIESQDRTVDKRFKMLATVSGCNNRQAGNWYDATPPLANCNGKLGPVDYFGRTLVKKLPQEIRIGAVVVAVAGCDIQLFEKDKYRSYQQPDWMRGIVQQYGGNPYGRLIEMAKKAQQEGIIKGILLHQGETNTGQQDWPNRVKGIYENILNDLGLKAEDVPLLAGEVVSSAVGGQCGSHNAVIQRLPSVIKTAHVISSQGLQHQGDGLHFTSAAYRTFGERYAEEMLKILGDVQVVGKTTTTTTVKTT

SEQ ID NO: 13274 - protein, 255 aa, Anaeromyces robustus; identical to SEQ ID NO: 13271
  SGNH hydrolase

SEQ ID NO: 13275 - protein, 222 aa, Anaeromyces robustus; identical to SEQ ID NO: 13272
  SGNH hydrolase

SEQ ID NO: 13276 - protein, 265 aa, Anaeromyces robustus; identical to SEQ ID NO: 13273
  SGNH hydrolase

SEQ ID NO: 13277 - protein, 256 aa, Anaeromyces robustus
  SGNH hydrolase
NFHIYLAFGQSNMYGSGDIEEQDKTVDSRFQMVSTVNDCGSRKLGTWYDAIPPLATCDAGLGPADYFGRTLVETLPKEIKVGIAVVAVPGCDIQLFEKDNYQNYFPDDWMYPFIDEYGGNPYGRLVEMGKQAKELGVIKGILLHQGETNNEQTDWPLRVKAIYENLLTDLELKAEEVPILIGELVQLSENGTCGAMNAIIQTVPSVIPTAHVISSEGLKQRGDGFHFTSPSYRVFGQRYAEVMLDLLKDTTPVNDE

SEQ ID NO: 13278 - protein, 250 aa, Anaeromyces robustus
  SGNH hydrolase
NFHIYLAFGQSNMEGAGPIEGQDKTVDKRFQMLSTTSCNGRQMGNWYDATPPLAHCGGKLGPVDYFGRTLVKKLPEQIKVGVVVVAVAGCDIQLFEKDNYKSYNMPDWMRNTVQNYGGNPYGRLVEMAKKAQQSGVIKGILLHQGETNSGQQNWPGRVKAIYNNLLTDLGLNANDVPLLAGEVVSSGQGGSCGGMNSIIQSLPQTIPTAHVVSSDGLGQQGDGLHFTSASYRTFGERYANEMLKLLGDVK

SEQ ID NO: 13279 - protein, 271 aa, Anaeromyces robustus
  SGNH hydrolase
NFHIYLAFGQSNMEGQGPIGQQDRSVDKRFQMISTVNGCNGRRLGEWYDAVPPLSSCSGKLGPVDYFGRTLVKKLPQEIKVGVAVVAIAGCDIQLFEKNNYRNYQLQSYMVNTVNAYGGNPYGRLIEMGKKAQQVGVIKGILLHQGETNTGQQNWPNRVKAIYEDILKDLGLNAKDVPLLAGEVVSSQQGGQCGSMNSIIQSLPRTIPTAHVISSQGLGQQGDGLHFSSDAYRTFGQRYAEEMLKILGDVQAVKSTTTTRRTTTTRRTTTT

SEQ ID NO: 13280 - protein, 259 aa, Anaeromyces robustus
  SGNH hydrolase
DIVIFGDSYTTVSVDFETMTYTGLNLSGGKNWPQFLIDMHLMKMWNYAVGGACVDLSLINGDPENTPMTDQYAWFLKNMSKGKKFANWDGDTSLFVIWFGINDINGMSGIDDVLNSGINEKIATSIFNMVEGMYKEGAKNFLFIYVPSLVKFPAYANEDGTGVYNENLSYVIDEVPEYNNNLNQYAKNFQEIHPDTNVFVYNAYDEFDYIMENKSEYGIVNIRDKCSYTCNMKTYFWNDNYHPTAHVHKILAKDINTYL

SEQ ID NO: 13281 - protein, 193 aa, Anaeromyces robustus
  SGNH hydrolase
DLIIFGDSYTTVGIDFNTMKYTGSNMSGGKNWPQFLVDMHPMNMWNFAISGASVDAKIVGNAQFTPMTEQYSYFQRNMAAGKQFSGWKGETSLFCIWFGINDLGAVNHNGGVTTAQVSERIATSMFNMIEGMYKEGGRNFMFIYVPPIEKCPAYNSGQNYMKTDVPIYNDIINKYAQNFQKSHPDTNIFVYDS

SEQ ID NO: 13282 - protein, 35 aa, Anaeromyces robustus
  SGNH hydrolase
NGQQQCDSNTYFWKDVIHPTPTVHKPLAEDMNDFL

SEQ ID NO: 13283 - protein, 269 aa, Anaeromyces robustus
  SGNH hydrolase
NFHIYLAFGQSNMLSGDIESQDKNVDSRFKMISTVNDCGNRRQGEWYTAVPPLASCNAGLGPVPYFGNTLVEKLPKEITVGVAVVGIAGCDIQLFEKDRYQSYEHADWMTGYINEYGGNPYGRLVESGKIAQKSGVIKGILVHQGETNNGNQDWPKRLKGVYENLLKDLSLKAEEVPLLVGELVQSNKGGICGDMNSIIQRVPEVIPTAHVVSSEGLEQQGDGFHFTSASHRILGKRYAEVMLSILDGTTPISQNGSEEPDKDGYYFHN

SEQ ID NO: 13284 - protein, 251 aa, Anaeromyces robustus
  SGNH hydrolase
NFHIYLAFGQSNMEGRGKIYQEDKTVDSRFQMIATVDGCKGRKFGEWNDAIPPLSNCNMGQLGPADYFGRTLVKKLPHEIKIGIAVVAIGDCDIQLFEKTKNRNYRIPNEIKNTYEAYGRNSYSRLIEMGKKAQEVGVIRGILLHHGENNIGQTDWPNRVKAIYDNILNDLDLNSDDVPLLAGEVVSSEKGGKYGEMNPIIHNLAKICSTCHIISSQNLDSEDDGFHFTTNAYRTLGERYAEEMLKIHNYN

SEQ ID NO: 13285 - protein, 149 aa, Piromyces finnis
  SGNH hydrolase
GGNPYGRLVDMGKIAQKSGVIKGILVHQGETNNGNQDWPKRLKGVYENLLTDLGLKAENVPLIVGELVQSDKGGICGGMNNIIQTVPEVIPTAHIVSSEGLEQQGDGFHFTSASHRILGKRYAEVMLSILDGTTPIKQGGGEPDKDGYY

SEQ ID NO: 13286 - protein, 188 aa, Piromyces finnis
  SGNH hydrolase
KDIVIYGDSYTTVSTNYNTMEYTGENLSKGKNWPQHLIDPIHPMKMWNFAANGAVVDARIVGQYTPMTEQYSYFLKHMGKGQKFNTWKGETTLFTIWFGINDLLSKRGTGTSVDEQIATSMFEMIEGMYNEGGRNFMIFFVPDVSKSPLYYGNETQKTYIPAYNQILNKYAMMYQASHPDTNFFVYNT

SEQ ID NO: 13287 - protein, 34 aa, Piromyces finnis
  SGNH hydrolase
GGQSNCDEKTYFWADNLHPSPKVHEALAYDIDKF

SEQ ID NO: 13288 - protein, 188 aa, Piromyces finnis; identical to SEQ ID NO: 13286
  SGNH hydrolase

SEQ ID NO: 13289 - protein, 34 aa, Piromyces finnis; identical to SEQ ID NO: 13287
  SGNH hydrolase

SEQ ID NO: 13290 - protein, 188 aa, Piromyces finnis; identical to SEQ ID NO: 13286
  SGNH hydrolase

SEQ ID NO: 13291 - protein, 34 aa, Piromyces finnis; identical to SEQ ID NO: 13287
  SGNH hydrolase

SEQ ID NO: 13292 - protein, 28 aa, Piromyces finnis
  SGNH hydrolase
GDGLHFTSAAYRTFGERYAETMLKLLDG

SEQ ID NO: 13293 - protein, 28 aa, Piromyces finnis
  SGNH hydrolase
GDGLHFTSAAYRTFGERYAETMLKLLDG

SEQ ID NO: 13294 - protein, 97 aa, Piromyces finnis
  SGNH hydrolase
SLNASEVPLLAGEVVTSAQGGQCGSMNNIIAQLPKTIPTAHVISAQGLGQQGDGLHFSSAAYRTFGERYATEMLKILGDVKVVDTNPTTTVKKTTTT

SEQ ID NO: 13295 - protein, 196 aa, Neocallimastix californiae
  SGNH_hydro-type_esterase_dom
IQIVGDSLTAGQYLPNEQADSWSFLFGKYMNAETDIIAKPGICLSDIPLYGMDHGMEVSYFLNSNPLARSWGYISDEAHDFSERKAPDLMIIFLGTNDAGNDAKVVAEDYYETLKKFLTRVREIYPETPLAITSLLYDPGNWNEIQSNIVNEFDNIYYIYINDPVINSSPNIYLTNYHLTQKGSCALMKTMVEKVS

SEQ ID NO: 13296 - protein, 201 aa, Neocallimastix californiae
  SGNH_hydro-type_esterase_dom
KAVVCFGDSITDGRGVTNDKNNRWTDILATRLQQNPATKNIGVLNQGIGATTVAGTYYNPTSPAGQARFEKDVLKQTNVKYLIILYGVNDILYNNSNAQTIINVYKDLIKKAHNNGIKVFGGTILPFGKNSGFNSNKESQRTTVNNWIMNTPASQGGFDGYIDFASAVADKSNKQWLNTNWNFENDGLHPNAVGYEAMGKA

SEQ ID NO: 13297 - protein, 217 aa, Neocallimastix californiae
  SGNH_hydro-type_esterase_dom
GDTVKIMPVGDSITFGEGERGGYRKYLYSALTQKGYKIDMVGPEGSNSASANGIQYDDNNAGYSGFQIKEIPGWGQQQGGEGSLYNKLKSKNAVKQSQPDIILLIIGTNDMTANRSMDACANDLRALLDYMLADMPANSIIFMGSIPEFTAYGGNAQRIANYNGTVKKVADEYANKGKNVRFADVHGCLNGMSDIGSDRLHPSGNGYKKIGNFWAGV

SEQ ID NO: 13298 - protein, 233 aa, Neocallimastix californiae
  SGNH_hydro-type_esterase_dom
FNGQSSNNEEESKNWPLFLVKKRIMNMWNFACSGAVVDNDIIHSNNALPMTEQYKAFILHMGKGGKHSNWRSDQSLIGIWFGINDIMNRADNDIDYDDDQSIIKSMFKIINKIYDLGARNFLILDVPSLEKLPHFIYSPVKGLDEEVLKFNKMIADSAMNFQKSKPETNVFVYNAYNELNYIMKNENKFGFTITVDDWYHNNERKLEDITKEYFWRDGYHLSKYVQEALSQEL

SEQ ID NO: 13299 - protein, 265 aa, Neocallimastix californiae
  SGNH_hydro-type_esterase_dom
SEFKDIIIFGDSYTTVGINFNTMKYTGDNLSGGKNWPQFLIDMHPMNMWNFAISGAVVDAKVVDGNPQYTPMTEQYNWFLKNMAPGKQFSNWKGESSLFAIWFGINDIGSKRRNEGLTSSQIDEKIATSMFNMIDGMYKQGARNFMFIFVPTIEKCPAYSNGNNPNIKSDIPNYNSNLNKYAKNFQASHPDTNVFVYDSYNEFDYIMENKSQYGITNIDSTCGGGFGFGWGWGNQNNCDSNTYFWKDVIHPTPTVHKPLAQDIED

SEQ ID NO: 13300 - protein, 194 aa, Neocallimastix californiae
  SGNH_hydro-type_esterase_dom
VIGDSLSAGQYCPNEALDAWAFLLGKAMNVEVDVIAKPGACLTDVPIYDNAHGLEYSYFMTNGPNAEQFGYDDDAEYDFSKRKAPELIIIYMGNNDSGKEDPIAPEDYFETLKKFITRIRGIYPNSKIIVTSAFDSRPHWDTVQEHIPEYFDDLYYIPTYEFGLIEAPYVYPQNYHYTQLGNCLFLKNIIEKIS

SEQ ID NO: 13301 - protein, 215 aa, Neocallimastix californiae
  SGNH_hydro-type_esterase_dom
AIKIMPVGDSITFGMGENGGYRKYLYSALTQKGYNIDMVGPEGSSRATANGISYDDNHAGYSGFQIKEIPDWGRQQGGDGSLYNKLKSKNAVKQAQPDIILLIIGTNDMTANRSMDACASDLRALLDYMLGDMPSGGIIFMGSIPEFTAYGGNAQRVANYNGTVKKVAEEYASKGKNVRFADVHGSLNGTGDLGGDGLHPNGNGYKKMGNFWADV

SEQ ID NO: 13302 - protein, 215 aa, Anaeromyces robustus; identical to SEQ ID NO: 13301
  SGNH_hydro-type_esterase_dom

SEQ ID NO: 13303 - protein, 259 aa, Anaeromyces robustus
  SGNH_hydro-type_esterase_dom
ELKDIVIFGDSYTTVSVDFETMTYTGLNLSGGKNWPQFLIDMHLMKMWNYAVGGACVDLSLINGDPENTPMTDQYAWFLKNMSKGKKFANWDGDTSLFVIWFGINDINGMSGIDDVLNSGINEKIATSIFNMVEGMYKEGAKNFLFIYVPSLVKFPAYANEDGTGVYNENLSYVIDEVPEYNNNLNQYAKNFQEIHPDTNVFVYNAYDEFDYIMENKSEYGIVNIRDKCSYTCNMKTYFWNDNYHPTAHVHKILAKDIN

SEQ ID NO: 13304 - protein, 275 aa, Anaeromyces robustus
  SGNH_hydro-type_esterase_dom
KYSEFKDLIIFGDSYTTVGIDFNTMKYTGSNMSGGKNWPQFLVDMHPMNMWNFAISGASVDAKIVGNAQFTPMTEQYSYFQRNMAAGKQFSGWKGETSLFCIWFGINDLGAVNHNGGVTTAQVSERIATSMFNMIEGMYKEGGRNFMFIYVPPIEKCPAYNSGQNYMKTDVPIYNDIINKYAQNFQKSHPDTNIFVYDSYNEFDYIMENRSKYGITNIDGTCGGFGFGGGFGGGFGGFGGFGGGNGQQQCDSNTYFWKDVIHPTPTVHKPLAEDM

SEQ ID NO: 13305 - protein, 263 aa, Piromyces finnis
  SGNH_hydro-type_esterase_dom
KYSEFKDIVIYGDSYTTVSTNYNTMEYTGENLSKGKNWPQHLIDPIHPMKMWNFAANGAVVDARIVGQYTPMTEQYSYFLKHMGKGQKFNTWKGETTLFTIWFGINDLLSKRGTGTSVDEQIATSMFEMIEGMYNEGGRNFMIFFVPDVSKSPLYYGNETQKTYIPAYNQILNKYAMMYQASHPDTNFFVYNTFSEFEYIMENKSEYGLTNITDVCQTGFGFGGFQWGGQSNCDEKTYFWADNLHPSPKVHEALAYDIDKFLS

SEQ ID NO: 13306 - protein, 263 aa, Piromyces finnis; identical to SEQ ID NO: 13305
  SGNH_hydro-type_esterase_dom

SEQ ID NO: 13307 - protein, 263 aa, Piromyces finnis; identical to SEQ ID NO: 13305
  SGNH_hydro-type_esterase_dom

SEQ ID NO: 13308 - protein, 33 aa, Neocallimastix californiae
  Six-hairpin glycosidases
VEDFLNGGNPPTFRYHRFWGQTEIMVANGLIAI

SEQ ID NO: 13309 - protein, 630 aa, Neocallimastix californiae
  Six-hairpin glycosidases
MKKRAADEYAQRAIEHYNVVTGNGSYSSEYFSPENVPYHSIETMMVEAPDHGHESVSETYSFWVWLEAVNGKLTGNYDGVETAWSYLEKHLIPDSKNQPGNSRYNASSPATYAPEDDDIENYPAQLVFQDGIVGQDPIAKELQQAYGTWDIYAMHWIIDGDNWYGYGQQGDGKSKPSFINTFQRGASESAWKTVPHPCWESMKWGGRNGFLDLFTGDNSYAKQWRYTAAPDADARAIQAAYFGYIWAEEDGQDLSSVASKAAKLGDYLRYSHYDKYFKKIGNCIDYQRCAAGSGKNSAHYLISWYFAWGGGLQGDWAWRISSSHTHSGYQNPLAAWILSTESAFKPKGSTAVKDWSTSLDRQLELFRWLQSAEGCIAGGATNSWQGHYAQPPSDITTFYGMYYDWQPVYHDPPSNNWTGMQGWGMERVCSLYYLSGNEKAGKVCQEWAKWIKANTRVNGGEVVHATNLEWTGNPDEWKSSNFNKNGLNASLHGTVSSEGTDLGSIASMIKALMWVSLKDGDTEGLQLVLDVMDAIENYKDDLGYAVEEAREDYIKFNEDVYIPSGWTGKNAQGANIRSGVKFIDIRPKYKEDPDWAQVEDFLNGGSAPRFTYHRFWGQTEIMVANGLISI

SEQ ID NO: 13310 - protein, 624 aa, Neocallimastix californiae
  Six-hairpin glycosidases
ADYAERAIEHYNKVTGNGSYQSEYFSPENVPYHSIETMMVEAPDQGHESVSETYSFWVWLEAVNGKLTGNYEGVETAWSFLEKHLIPDSKNQPGNSRYNASSPATYAPEDDDIENYPAQLVFQDGIVGQDPIAKELQQAYGTWDIYAMHWIIDGDNWYGYGQQGDGKTKPSFINTFQRGASESAWKTVPHPCWETMKWGGSNGFLDLFTGDNSYAKQWRYTAAPDADARAIQAAYFGYIWAEEDGQDLSSVASKAAKLGDYLRYSHYDKYFKKIGNCIDYQRCAAGSGKNSAHYLISWYFAWGGGLQGDWAWRISSSHTHSGYQNPLAAWILSTESAFKPKGSTAVKDWSTSLDRQLELFRWLQSAEGCIAGGATNSWQGHYAQPPSDITTFYGMYYDWQPVYHDPPSNNWTGMQGWGMERVCSLYYLSGNEKAGKVCQEWAKWIKQNTRVNGGEVVHATNLEWSGNPDEWNASNFDKSGLNASLHGTVSSEGTDLGSIASMIKALMWVSLKDGDTEGLQLVLDVMDAIENYKDDLGYAVEEAREDYIKFNEEVYIPSGWSGKNAQGAQLKSGIKFIDIRPKYKEDPDWAQVEDFLNGGSAPRFTYHRFWGQTEIMVANGLISI

SEQ ID NO: 13311 - protein, 221 aa, Neocallimastix californiae
  Six-hairpin glycosidases
HDPPSNNWTGMQGWGMERVCSLYYLSGNEKAGKVCQEWAKWIKKNTRVNGGEIVHATNLAWTGNPDEWKSSNFNKSGLNASLHGTVSSEGTDLGSIASMIKALMWVSLKDEDTEGLQLVLDVMDAMENYRDDLGYAVEEAREDYIKFNEDVYIPSGWTGKNAQGANIRSGVKFIDIRPKYKEDPDWAQVEDFLNGGSAPRFTYHRFWGQTEIMVANGLISI

SEQ ID NO: 13312 - protein, 361 aa, Neocallimastix californiae
  Six-hairpin glycosidases
YSHYDKYFKKIGNCIDYQRCAAGSGKNSAHYLISWYFAWGGGLQGDWAWRISSSHTHSGYQNPLAAWILSTESAFKPKGSTAVKDWSTSLDRQLELFRWLQSAEGCIAGGATNSWQGHYAQPPSDITSFYGMYYDWQPVYHDPPSNNWTGMQGWGMERVCSLYYLSGNEKAGKVCQEWAKWIKETTRVNGGEIVHATNLEWSGNPDEWKSSNFNKSGLNASLHGTVSSEGTDLGSIASIIKGLMWVSMKDGDEEGLRLVLDVMDAIENYKDDLGYAVEEAREDYIKFNEEVYIPSGWSGKNAQGANIKSGVKFIDIRPKYKEDKDWAQVEDFLNGGSAPRFTYHRFWGQTEIMVANGLISI

SEQ ID NO: 13313 - protein, 226 aa, Neocallimastix californiae
  Six-hairpin glycosidases
WQPVYHDPPSNNWTGMQGWGMERVCSLYYLSGNEKAGKVCQEWAKWIKKNTRVNGGEIVHATNLAWTGNPDEWKSSNFNKSGLNASLHGTVSSEGTDLGSIASMIKALMWVSLKDEDTEGLQLVLDVMDAMENYRDDLGYAVEEAREDYIKFNEDVYIPSGWTGKNAQGANIRSGVKFIDIRPKYKEDPDWAQVEDFLNGGSAPRFTYHRFWGQTEIMVANGLISI

SEQ ID NO: 13314 - protein, 33 aa, Neocallimastix californiae; identical to SEQ ID NO: 13308
  Six-hairpin glycosidases

SEQ ID NO: 13315 - protein, 445 aa, Neocallimastix californiae
  Six-hairpin glycosidases
SQDYARHIELSLLFYEAQRSGKLPEDNRIYWRHDSELEAGADHGVDLTGGYYDAGDNAKFNFPAASTMTLLAWSGIDYAEGYKNAGQWKYILDAVRWGADYFIKCHTGKTELYAQVGDGNTDHSFWYPPEYVQYDYPSFKVTAQEPGSEVAGETAAFLAAASILFKDEDPSYSATLLKHSKEIYDFADKYRGDYTVAVPAVSFYNTYSGYMDELAWGAAWLLRATGDESYLDKYNVIANKKYESYDPKKFTGATGPISWDDKRPGCYILMAMITGDEKRINEAYSYCDAVLTQPRTKGGLWYDDGLSIWGSNRYASNAASMLGMFANYLPKSDPKRAKYVEFVKQQTDYILGDNPAKINYVVGAEANSPKAVHHRGASGVFDSQDKAAKPDENIYTLWGALAGGPDKNDKFVDSRKDYQMSEVALDYNAAFQMNLAFLTKEGLSK

SEQ ID NO: 13316 - protein, 446 aa, Neocallimastix californiae
  Six-hairpin glycosidases
SQDYARHIELSLLFYEAQRSGKLPENNRIYWRHDSLLDAGADNKVDLTGGYYDAGDNVKFNFPAAAALTLLAWSGIDYADGYKKAGQWDYLLDAVKWGADYFLKCHTGKNELYVQVGKGATDHGFWYPPEYVQYEYPSYKITSSAPGSEVAGDTASFLAASSILFKDVDSSYSATLLKHAKEIYDFADTYRGEYIKAVPDAQGFYSNWSGCDDELAFGALWLYRATKDESYMNKFKKIADASYGEQDTKAYGTCSGPISWDDKRPGAYILAAMLTGDEKRKSKAYSYCDAILTQPKTPGGLWYDANLSKWGSNRYASNAAAMVAMFANSLPASDSKRSKYVDFVQKQTDYILGNNPAKVNYVVGAEANSPKAVHHRAASGTYDSQDKNAKPTDYNVFTLWGALAGGPGSKDEYTDTRKNYEMNEVALDYNAAFQMNLAFLTKEGLS

SEQ ID NO: 13317 - protein, 442 aa, Neocallimastix californiae
  Six-hairpin glycosidases
SQDYARHIELSLLFYEAQRSGKLPENNRIYWRHDSMLDAGADNGVDLTGGYYDAGDNVKFNFPAAAALTLLAWSGVDYADGYKKAGQWDYLLDAVRWGADYFIKCHTGKNELYAQVGRGTTDHGYWYPPEYIQYDHPSYKVTASSPGSEVAGDTASFLAATSILFKDEDPSYSKKCLQHATEIYDFADTYRGDYTGSIPDVSGFYSTWSGYNDELAFGALWLYRATGDESYYEKFKKIADAEYGAQDSKAYGTCTGPISWDDKRPGAYVLAAIITGDEDRLKQAYWYCDNVLTQPRTKGGLWYDSNLSKWASNRYASNAAAMLAMMANYLPKGDARRAKYVDFVKSQTDYILGDNPAGVNFVVGAEANSPKAVHHRGASGTYDSQDVHARPTDYNIFTLWGALAGGPSKDDTYSDTRKDYEMNEVALDYNAAFQTNLAFLVK

SEQ ID NO: 13318 - protein, 169 aa, Neocallimastix californiae
  Six-hairpin glycosidases
YALMYMVTGEDKYKEQAFNHSDLMVNYKTTPGGLWFDTNLSAWGSNRYASNAAYTVAMVASTMDASDAKRKQYVKFIQKQIDYIQGDNPAKVDYVVGADPSSPKSVHHRGSSGTMNAMAEPPFNVFPLYGALAGGPDGNDKYTDDRTNYNSNEVALDYNAAYTGLLAFL

SEQ ID NO: 13319 - protein, 358 aa, Neocallimastix californiae
  Six-hairpin glycosidases
TYLGKTDEEIQKKLDQLWNHYFKGNNNSKVFYDQGNEGYILDVNNNDVRSEGMSYGMMICVQTDHREEFDKIWNWAKNHMWHKSGSWDGYFAWKRGSNGYGGDDNCAPDGEMYFMMSLLFAANRWNNKQYMDDAQYILKRMWDNSQHSLFNPRYNVITFQPQGNENNFSDPSYDLPAFVDLFSRWSTTNQGKWKAAASATRDHLYKSSNTKSGLFSDYNNFDGTPHSVSYNSNAQKYMYDAMRCAMNFGMDYYLFGADAKRQTEMARRLIDFFEKDGYQHARFNWDGSNPSEQYTLGEVGANAVATYALMGVNGYEDIIKKNLKMAWDGEPMTGQYRYYDGLVHYLSMLHLTGSFKIW

SEQ ID NO: 13320 - protein, 627 aa, Neocallimastix californiae
  Six-hairpin glycosidases
RASDEYGNRVTELYNKVTGNGSYSSEYFSAEKVPYHSVETLMVEAPDHGHESVSETFSFWIWLEAVNGKITGNYDGVEEAWSYLEKHIIPDSKNQPGNSRYNPSSPATYAAEHDDIDGYPSQLVFQDGIVGEDPIAKELQQAYGNWDIYIMHWIIDGDNWYGYGQQGDGKTKPSFINTFQRGPSESTWKTVPHPCWESMKWGGSNGFLDLFTIDNSYAKQWRYTAAPDADARAIQAAYFAYIWAEEDGVNLSSVASKAAKLGDYLRYAQYDKYFKKVGNCVGYQQCQAGRGKNSAHYLISWYFAWGGGLQGDWAWRIGSSHTHTGYQNPLAAWVLSTQSAFKPKSSTGAKDWATSLDRQLELFRWLQSAEGCIAGGATNSWQGSYAQPSSDITSFYGMWYDWQPVYHDPPSNNWTGMQGWGMERVCSLYYLSGNEKAGKICQEWAKWVKNTTRVSGGEVVHATNLEWSGNPDEWNSSNFNKSNLNRSLHGTVSSDGIDIGTIASIIKGLMWVSMKDGDQEGINLSIDVMDAIENYKDDLGYGTTEARGDYDKFGGEVYIPRGWSGKNAQGANIRNGVTFIDIRPKYKQDPDWEQVEAYLNGGEPPVFTYHRFWAQTEIAVANGLISI

SEQ ID NO: 13321 - protein, 437 aa, Neocallimastix californiae
  Six-hairpin glycosidases
IHTRDYARILNLNLRFYECNWSGKAPEHKQVYWRYDSALEDGADVGLDLTGGYYDAGDHVKFNLPMSYAMTMLAWGGIDLYDNYVAAGQIDYLVQIVNHGADYFVKCHPEKEVIYAQVGLGDVDHCFWVPPELMTMERPAVCKLTPENGASDVTAQMAAALASASILNKMVGNTEKSELYLKHAIEIYDFADKYRDVYGNPCPEGASFYPSASYKDELVWGAAWVYRASGDEKYYEKADSYYDSLGLSGRVLIGPISWDDASSGIIFLMSKPGFGSNWKRYLGEAQTYVDQYLNDKSARTDAGMLWYSAVSGWGSARHAMAGVFLYCIFNTYHKPTDPKYFNFIQQQADYILGNNPFNRSLVVGSIPGHDPLNVHHRGSHGGYSPISLPEHNMYTLYGALAGGPLQDDSWDDDRNNYITNEVSCDYNAGVTGVMAYL

SEQ ID NO: 13322 - protein, 630 aa, Neocallimastix californiae
  Six-hairpin glycosidases
SRKRANDEYAQRAINTYNTVTGNGSYKSSYFSPEVVPYHSIETLMVEAPDQGHESVSETFSFWVWLEAVNGKLTGDYSGVEKAWSYLEKHMIPDSKNQPGMSRYNPSSPATYAPEDDDITNYPARLVFQDGIVGQDPIAQELQQAYGTWDIYAMHWIIDGDNWYGYGQQGDGTSKPSFINTFQRGASESAWKTVPHPCWETFKWGGSNGFLDLFTLDNNYSKQWRYTDAPDADARAIQGAYFAWLWAKEDGKNLSSLASKAAKLGDYLRYSHYDKYFKKIGNCVGYQQCQAGSGKNSAHYLISWYFSWGGGLQGDWSWRIGSSHTHSGYQSPLAAWILSTESAFKPKSASGAKDWATSLERQIELFRWLQTSEGCIAGGATNSWQGHYAQPDSSITSFYGMWYDWQPVYHDPPSNNWTGMQGWGMERTCCYYYLSGDEKAGLVCQNWAKWVKANTRVSGGQIVHATNLSWEGSPDEWNSSNFNKANLNASLHGTVSAEGIDLGSIASIIKGLMWVSMKDNDQEGINLVIDVMDAIENYKDDEGYCADEAREDYAKFSSEVYIPSGWSGKNAQGANIKNGVTFIDIRPKYKQDPDWAQVENFINGGEPPRFRYHRFWGQTEIMVANGLISI

SEQ ID NO: 13323 - protein, 628 aa, Neocallimastix californiae
  Six-hairpin glycosidases
NKYDEYSQRAIEHYNIVTGNGSYQSEYFSPENVPYHSIETMMVEAPDHGHESVSETYSFWVWLEAVHGKLTGNYDGVSTAWSYLEKHLIPDSKNQPGNSRYNASSPATYAPEDDDIENYPAQLVFQDGIVGQDPIAKELQQAYGTWDIYAMHWIIDGDNWYGYGQQGDGKSKPSFINTFQRGASESAWKTVPHPCWETMKWGGPNGFLDLFTGDNSYAKQWRYTAAPDADARAIQAAYFGYIWAKEDGVDLSSVASKAAKLGDYLRYSHYDKYFKKIGNCIDYQRCAAGSGKNSAHYLISWYFAWGGGIQGDWSWRIGSSHTHSGYQNPLAAWVLSTESAFKPKGSTAVKDWSTSLDRQLELFRWLQSAEGCIAGGATNSWQGHYAQPDSDITTFYGMFYDWQPVYHDPPSNNWTGMQGWGMERVCSLYYLSGNEKAGKICQEWAKWVKENTRVIGGEVVHATNLEWTGNPDEWKSSNFNKNGLNSQLHGTVSSEGTDLGSIASIIKALMWVSLKDEDSEGLRLVIDVMDAIENYRDDLGYAVEEAREDYNKFEENVYIPSGWTGKNAQGANIRSGVKFIDIRPKYKQDKDWAQVEDYLNGGNPPKFTYHRFWGQTEIMVANGLISIY

SEQ ID NO: 13324 - protein, 228 aa, Neocallimastix californiae
  Six-hairpin glycosidases
YDWQPVYHDPPSNNWTGMQGWGMERVCSLYYLSGNEKAGKVCQEWAKWVKKNTRVNGGEVVHATNLEWTGNPDEWKSSNFNKNGLNSQLHGTVSSEGTDLGSIASIIKALMWVSLKDEDSEGLRLVIDVMDAIENYRDDLGYAVEEAREDYIKFNEDVYIPSGWTGKNAQGANIRSGVKFIDIRPKYKQDKDWAQVEDFLNGGSAPRFTYHRFWGQTEIMVANGLISI

SEQ ID NO: 13325 - protein, 628 aa, Neocallimastix californiae
  Six-hairpin glycosidases
KRASDEYAQRVIDTYNAVTGNGSYNSDYFSPENVPYHSIETMMVEAPDYGHESVSETYSFWVWLEAINGKMTGDYKGVETAWSFLEKHLIPNSKNQPGMSRYNTSSPATYAPEDDDITNYPARLVFQDGIVGEDPIAKELQQAYGTWDIYAMHWIIDGDNWYGYGQNGDGTSKPSFINTFQRGASESAWKTVPHPCWEEMKWGGRNGFLDLFTGDNSYSKQWRYTAAPDADSRAIQAAYFAYIWAKEDGQNLSSLASKAAKLGDYLRYAQYDKYFKKIGNCIGYQQCQAGRGKNSAHYLISWYFSWGGGLQGDWSWRIGSSHTHTGYQNPLAAWILSTQSAFKPKGSTAVKDWTTSLDRQLELFRWLQAAEGCIAGGATNSWQGHYAQPPSEITSFYGMYYDWQPVYHDPPSNNWTGMQGWGMERVCSLYYLSGNEKAGKVCQEWAKWVKNNVRVNGSEIVHATNFEWSGNPDEWKASNFNKSGLNASLHGAVSSEGIDLGSIASIIKGLMWVSMKDNDQEGIDLSVQVMDAIEQYKDQYGYGVEEAREDYIKFNEEVYIPSGWTGKNAQGANIRNGVKFIDIRPKYKEDPDWAQVENFLNGGEAPRFTYHRFWAQTEIAVANGLISI

SEQ ID NO: 13326 - protein, 374 aa, Neocallimastix californiae
  Six-hairpin glycosidases
NKEMFKGTWNYIDGVFLNSVINLYKKTNNEKYKDFFIKYVNYYVSEDGTFVHYTADGVKTVDNEMGWVNGELDTVCESKILFDAYEMTGDKRYLTAIEFTYKKLMEMPYCYNSPNFWHKTFYINQIWLDGMYMYAPFLARYALLKNDLSILDDIKNQYAFIHDNMRDENGLYHHGFDTTKTIFWSKNNDGKSENFWLRSMGWFAVSLADILEYYPEGENKEYLKSILEELLNGILPYQDKTTKMFYQVIDRPEEIQLVDKFYFSNLKNSKYGNINTFVSNYVESSGSSMLAYSFLKYGKVYQNGGNFEEIGKEIFEAVYKHSYKNNTLSDICITAGLGPEVKTYRDGTLSYYLAEVVGDDDAKGVGPFIMAFIE

SEQ ID NO: 13327 - protein, 373 aa, Neocallimastix californiae
  Six-hairpin glycosidases
KESFKGKWNYIDGVFLNSVVNLYKKTNNEKYKEFFIKYINYYVAEDGTFVHYTEDGVKTVDNDLGWVTGELDTVCESKILFDAYEMTGDKRYLTAIEFTYQKLMEMPLCYNSPNFWHKTFYINQIWLDGMYMYAPFLARYAVLKNDLSILDNIKEQYAFIHDNMRDENGLYHHGFDTTKTIFWSKNNDGKSENFWLRSMGWFAVSLADILEYYPEGENKEYLKNVLEELLNGILPFQDKTTKMFYQVIDKPEEIQLVDKFYFSNLGNSKYGDINTFVSNYVESSGSSMFAYSFLKYGKVYQNGGKFEDIGKEIFEAVYQHSYQNHTLSDICITAGLGPEAKTYRDGTLSYYLAEKVGEDDAKGVGPFLMAFIE

SEQ ID NO: 13328 - protein, 486 aa, Neocallimastix californiae
  Six-hairpin glycosidases
DVSGDAAKKAEAALSKVKNVDYSTLKSKHIEAYKKQFDRVKISLPTSSASADQTVNRILNFNRSDDQDLVALMFQYGRYLLITSSQPGGQAANLQGIWNDSTDAPWDSKYTININAQMNYWPAEVTNLSECHEPMFDLIRDLSVTGKEAASKIYGAEGWMAHHNTDIWRVTGPIDGAFWGMWPNGGGWLSTHIWQHYLFTGDKDFLKNNYAILRDSAKFYVTSMQKDPNTGFLVTVPSTSPEHGYSSDGSSMTAGCTMDNQIAFDVLNQALLAAQTLGVDESFQSTLKSTMNNIAPMKVGQYNQLQEWFVDADNPRDDHRHVSHLYGLYPSGQISPFKQPLLFEAAKNTLNQRGDMATGWSIGWKINLWARLLDGNHAYKIIQNMINLVRDNDGGNGRVYTNLFDAHPPFQIDGNFGFCAGIAEMLLQSHDGAVHLLPALPNVWKEGSVSGLVARGGFEVSMDWKNGKISKATIKSKIGGSLRIRS

SEQ ID NO: 13329 - protein, 627 aa, Neocallimastix californiae
  Six-hairpin glycosidases
RASDKYAQRVIDTYNAVTGNGNYNSEYFSPENVPYHSVETMMVEAPDYGHESVSETYSFWVWLEAINGKMTGDYKGVETAWSYLEKHLIPDSRNQPGMSRYNSSSPATYAPEDDDIENYPARLIFQDGIVGEDPLARELQQAYGTWDIYAMHWIIDGDNWYGYGQQGDGRSKPSFINTFQRGASESAWKTVPHPCWETMKWGGRNGFLDLFTGDNSYSKQWRYTAAPDADARAIQAAYFAYIWAKEDGTNLSSLASKAAKLGDYLRYSHYDKYFKKIGNCIGYQQCQAGRGKNSAHYLISWYFSWGGGLQGDWSWRIGSSHTHTGYQNPLAAWVLSTESAFKPKSSTAVKDWATSMDRQLELFRWLQASEGCIAGGATNSWQGHYAEPPSDITTFYGMYYDWQPVYHDPPSNNWTGMQGWGMERVCSLYYLSGNEKAGKVCQEWAKWVKKNVRVNGNEITHATNFSWSGNPDEWNPSNFNKSGLNASLHGTVSSEGIDIGSLASIIKGLMWVSMKDKDQEGINLSIKVMDAIENYRDDLGYSVEEAREDYIKFNEEVYIPYGWTGKNAQGATLEHGVKFIDIRPKYKQDKDWAQVENFLNGGEAPRFTYHRFWAQTEIAVANGLISI

SEQ ID NO: 13330 - protein, 440 aa, Neocallimastix californiae
  Six-hairpin glycosidases
SQDYARHIELSLLFYEAQRSGKLPENNRIYWRHDSELEAGADNGVDLTGGYYDAGDNAKFNFPGAATMTLLAWSGVDYAEGYKNAGQWEYLLDAVRWGADYFMKCHTGKTELYAQVGDGNTDHSFWYPPEYVQYEYPSFKVTADAPGSEVAGETAAFLAAASILFKDEDPTYSATLLKHSKEIYDFADKYRGDYTVAVPAVSFYNTYSGYMDELAWGAAWLLRATGDESYLEKYNVIANKKYESYDPKKFTGSTGPISWDDKRPGCYILIAMITGDEKRINEAYNYCDAVLTQPRTAGGLWYDDGLSIWGSNRYASNAASMVAMFANYLPESDPKRAKYVEFVKQQTDYILGDNPAKINYVVGAEANSPKSVHHRGASGVFDSQDKAAKPDENIYTLWGALAGGPDKNDKFVDSRKDYQMSEVALDYNAAFQMNLAFLTK

SEQ ID NO: 13331 - protein, 435 aa, Neocallimastix californiae
  Six-hairpin glycosidases
SRDYARILNLNLRFYECQWSGKAPEHKQVYWRYDSALEDGADVGLDLTGGFYDAGDHVKFNLPMSYAMTMLAWGGIDLYDNYVAAGQIDYLLQMVNHGADYFVRCHPEKEVIYAQVGVGDVDHCFWVPPELMTMERPTVCKLTPENGASDVTGQMAAALASASILNKKYGNTEKAELYLKHAIEIFDFADKYRDVYNNPCPEGASFYPSASYKDELVWGAAWVYRASGDEKYYQKADEYYDSLALSGRNLIGPITWDDASSGIVFLMSKPGFGSNWERYLGEAQHYVDQYLNDKGARTDGGMLWYSSVSGWGSARHAMAGTFLYCIFNTYHKPTDPKYFNFIQEQADYILGNNPFNRSLVVGSIPGYEPLNVHHRGSHGGYSPLSPPEHNMYPLYGALAGGPLQNDFWDDDRNNYVTNEVACDYNAGITGVMAYL

SEQ ID NO: 13332 - protein, 434 aa, Neocallimastix californiae
  Six-hairpin glycosidases
QDYARHLELSILFYEAQRSGKLPDNNRIYWRGDSMLEAGSDNKVDLTGGYYDAGDNIKFNFPQASSLTLLSWSAVEWKDGYKQAGQWEYMKDLIKWGMDYFIKCHTDKYVLYGQVGNAKLDHNSWVSPENISYDYPSYKITDSSPGSDLAAETSAALVAASMVFRDEDPNYADLLLKHGKELYEFADKYRGSYDESIPEANDYYHSNSYNDELVWGAAWLFRATGEEYYKSKVDAIWDYPYDENDSNKFLDSKNPISWDDKKASSYTLMAMITGDQKYLKEATTHSDLMVNHTTTPGGLWYNENLSVWGSNRYASNAAFTVAMMTSIMNDDDSKRQEYIDFVKKQTDYILGDNPAKIDYVVGAAPNSPKAVHHRGASGTKDVYENPDENTYVLYGALAGGPGPKDEYKDIREDYQKNEVALDYNAAFQGLLAFL

SEQ ID NO: 13333 - protein, 627 aa, Neocallimastix californiae
  Six-hairpin glycosidases
RAADAYAQRAIDHYNKMTNGGQYNTDYFSPETVPYHSIETLMVEAPDHGHESVSETYSFWIWLEAVNGKLTGNYDGINTAWSYLEKHMIPDAKNQPGNSKYNPSSPATYAPEDDDITNYPAQLVFQDGLVGEDPIAKELQQAYNTWDIYAMHWIIDGDNWYGYGQQADGKTKPSFINTFQRGSSESTWKTVPHPCWEEFKWGGRNGFLDLFTGDNNYAKQWRYTAAPDADARAIQAAYFGYMWAEEDGVDLSDLASKAAKLGDYIRYAQYDKYFKKIGNCIGHDRCSAGRGKNSAHYLISWYFAWGGGLQGDWAWRIGSSHTHTGYQNPLAAWVLSTQSAFKPKSRTGADDWATSLDRQLELFRWLQASEGCIAGGATNSWQGHYAQPSSDITTFYGMYYDWQPVYHDPPSNNWTGMQGWGMERVCSLYYISGNEKAGTICRDWAKWVKNTVRVNGNEVIHSTNLEWSGNPDEWNSNNFNKSGRNRSLHGTSSSDGLDLGTLASIIKGLLWVSAKDNDAEGIQLVLDVMNAIEQYSDDLGYAAEEPRGDYSKFGEEVYIPSGWTGKNAQGANIRSGVTFIDIRPKYKQDPDWAQVENYLNGGSEPRFTYHRFWAQTEIMVANGLISI

SEQ ID NO: 13334 - protein, 636 aa, Neocallimastix californiae
  Six-hairpin glycosidases
KKRASDAYAQRAIEHYNKMTNGGQYNTEYFSPENVPYHSIETLMVEAPDHGHESVSETYSFWIWLEAVNGKLTGNYDGINTAWSYLEKHMIPDEKNQPGNSKYNPSSPATYAPEDDDITNYPAQLVFQDGLVGEDPIAKELQQAYRTWDIYAMHWIIDGDNWYGYGQQADGKSKPSFINTFQRGASESTWKTVPHPSWEEFKWGGRNGFLDLFTGDNNYAKQWRYTAAPDADARAIQAAYFGYIWAEEDGVDLSDLASKAAKLGDYLRYSHYDKYFKKIGNCVGYDKCSAGRGKNSAHYLISWYFAWGGGLQGDWAWRIGSSHTHTGYQNPLAAWILSTQSAFKPKGSTAVKDWQTSLDRQLELIRWLQATEGCIAGGATNSWQGHYAEPDSDITTFYGMYYDWQPVYHDPPSNNWTGMQGWGMERTCSLYYVSGNEKAGTICRDWAKWVKETVRVSGGQVIHATNLEWSGNPDEWNKNNFNKSGANRSLHGTVSAEGLDLGSIASIIKALLWVSAKDGDEEGIDLAIQVMDAIENYKDDLGYAAEEARADYSKFGDEVYIPSGWTGKNAQGANLKSGVTFIDIRPKYKQDPDWAQVENYLNGGSEPTFTYHRFWGQTEIMVANGLISILGYGDRT

SEQ ID NO: 13335 - protein, 500 aa, Neocallimastix californiae
  Six-hairpin glycosidases
GLVGEDPIAKELQQAYNTWDMYAMHWIIDGDNWYGYGQQADGKSKPSFINTFQRGSSESTWKTVPHPCWEEFKWGGRNGFLDLFTGDNNYAKQWRYTAAPDADARAIQAAYFGYIWAEEDGVNLSDLASKAAKLGDYMRYAQYDKYFKKIGNCIGHDKCSAGRGKNSAHYLISWYFAWGGGLQGDWAWRIGSSHTHSGYQNPLAAWVLSTQSAFKPKSKSGADDWATSLDRQLELFRWLQASEGCIAGGATNSWQGHYAKPGSDITTFYGMYYDWQPVYHDPPSNNWTGMQGWGMERVCSLYYVSGNEMAGTVCRDWAKWVKNTVRVSGGQVVHATNLEWSGNPDEWNKSNFNKSGLNRSLHGTVSAEGLDLGSIASIIKGLLWVSAKDGDEEGIDLSLQVMDAIENYKDDLGYAAEEARADYDKFGGEVYIPSGWTGKNAQGANLKSGVTFIDIRPKYKQDPDWAQVENYLNGGSAPTFKYHRFWGQTEIMVANGLISI

SEQ ID NO: 13336 - protein, 479 aa, Neocallimastix californiae; identical to SEQ ID NO: 11168
  Six-hairpin glycosidases

SEQ ID NO: 13337 - protein, 429 aa, Neocallimastix californiae
  Six-hairpin glycosidases
SQDYARHLELNFLFYEAQRSGPLPSTNRIPWRGDSGLDHGSDVGVDLTGGYYDAGDNVKFNFPQAFSMTAISWMGIEFAKGVEMANQTEYLKDTVKWGCDYLLKCHEKGTDVFYMQVGDGDIDHQYWKAYENIDYPTPTFFVDSKNPGTEVTGETAAAFAAASILFKDSDPEYSATLLDQAKEWYEFADKYQFDYSQSVPAAGSYYKSYNGYNDELAWAAIWLYRALGDEAYLEKAKSLVANYKLSEVGIDWDSKYQGVIVILAQLGVKEYVEKVEAWVKDICTNGKFSPGGLYINKDSEWGSNRRATAMAASLIYYTHNLPEGNELREMAKKFAKSQADYIQGANPLGIDYVVGADETSPRSVHHRTASGAACIECDPVQNVHIIYGALAGGPDVEDNYLDDRADYKKNEVALDYNVCYAAVLAYLVE

SEQ ID NO: 13338 - protein, 586 aa, Neocallimastix californiae
  Six-hairpin glycosidases
IYKNHYNKLNLHNSTSSFYNLDSIPYTTLETLYIDQTVDYGHITTIKEFSYKLWIEAIQGKISGKWKSFVNAWNIFEMNMIPKEENQRGSYIYYSNNHNSQNNQDTLYKSLNEYYQTWSIYLPHYKIDTDNWNMYFSKSNEKRFINTYKNNNKDSIWSSLTYPSLINSKDFVNPYVKADSPEMKQWEYISDSKYVSKIIETIYWAYCWSNEQKKRKFMDTILKKVLRMSDYMLYFINSNESLQEFNVESKDDDLNYLVSRYFSWKGDIHGKWLTKKVSSNIIGIGSQNPLVAYILSNIKEFKSDNEDIILKWKKTYKRQIEFIRWLQSSEGAIVGNAIYISSSIEINKVPTFYNLVFSNNSNEEENNLFSTQCFVFESIAELYYITKDKDIETILFKWLDWVLTVFHLTSDRSFRIPNRLSFEGQPEKWIPNTKIKDHKNKHLNVIIEDFNNDLGVAASLSKILLWVGKKINNEDYLTLGREILERQEILNKDEDGYATEEKFYQYRLFNKKLPIQKDFKGVYGRSTKINDKSSFLSIRPYYKRDKNWKKIQTFLDKGTPVPKFRYHRFWEQCEILSAQGLYSLLY

SEQ ID NO: 13339 - protein, 435 aa, Neocallimastix californiae
  Six-hairpin glycosidases
QDYARHLELSILFYEAQRSGKLPANNRIFWRHDSMVDAGKDNNVDLTGGYYDAGDNVKFNFPQASALTLLAWSAVDWKDGYKEAGQWGYMKDLLKWGMDYFIKCHTSKYELYGQVGNGSLDHGAWVPPEEIDYEYPSYKITASAPGSDLAAETSASMVAASMAFRDDDPEYADILLKHGKELYDFAEKYQGTYDKSITDAKGYYRSYSGFNDELVWGAAWLYRATGDKTYKDKVDKIWDTPYGDLDPDKFLGSGGPISWDDKKAAAYALMALTTGESKYVDESTKHSELMVNYKTTPGGLWYDTNLSMWGSNRYASNAAFTVAMLATSMDANDAKRKEYVKFIKKQIDYIIGDNPAKVDYVVGADPSSPKAVHHRGASGSKGADKGPSENVFVLYGALAGGPGANDNFKDARDNYEMNEVALDYNAAFQGLLAFL

SEQ ID NO: 13340 - protein, 435 aa, Neocallimastix californiae; identical to SEQ ID NO: 13339
  Six-hairpin glycosidases

SEQ ID NO: 13341 - protein, 628 aa, Neocallimastix californiae
  Six-hairpin glycosidases
KRASDEYAKRVTDTYNAVTGNGSYNSDYFSPENVPYHSIETMMVEAPDYGHESVSETYSFWVWLEAINGKMTGNYKGVETAWSYLEKHLIPNSKNQPGMSKYNTSSPATYAPEDDDITNYPAQLVFQDGIVGEDPIAKELQQAYGTWDIYAMHWIIDGDNWYGYGQNGDGTSKPSFINTFQRGASESAWKTVPHPCWEEMKWGGRNGFLDLFTGDNNYSKQWRYTAAPDADARAIQAAYFAYIWAEEDGQNLSSLASKAAKLGDYLRYSHYDKYFKKIGNCIGYQQCQGGRGKNSAHYLISWYFSWGGGLQGDWSWRIGSSHTHTGYQNPLAAWVLSTQAAFKPKGSSAVKDWSTSLDRQLELFRWLQAAEGCIAGGATNSWQGHYAQPPSDITSFYGMYYDWQPVYHDPPSNNWTGMQGWGMERVCSLYFISGNEKAGKVCQEWAKWVKNNVRVNGSEIVHATNFEWSGNPDEWKPSNFNKSGLNASLHGTVSSEGVDLGSLASIIKGLMWVSMKDNDQEGIDLSVQVMDAIEQYKDKYGYGVEEAREDYIKFNEEVYIPSGWTGKNAQGANIRSGVKFIDIRPKYKEDPDWAQVENFLNGGEAPRFTYHRFWAQTEIAVANGLISI

SEQ ID NO: 13342 - protein, 442 aa, Neocallimastix californiae
  Six-hairpin glycosidases
KSQDYARHIELSLLFYEAQRSGKLPENNRIYWRHDSMLDAGSDHGVDLTGGYYDAGDNVKFNFPGAASLTLLAWSAIDYADGYKKADQWKYILDAVRWGADYFVKCHTGKNELYVQVGDGQIDHGYWYPPEYIQYKHSSYKITASAPGSEVAGDTASFLAASSILFKEENPTYSATLLKHAIEIYDFADKYRGEYTKAVPDAQGFYANWSGFLDELAFGALWLYRATGDESYMQKFSTIADAKYGEQDSKAYGISTGPISWDDKRPGAYILAAMVTGEEKRLQQAYWYCDSILTQPKTRGGLWYDASLSQWGSNRYASNAAAMLAMFANYLPKSDPKRSKYVDFVKKQTDYILGDNPAKINYVVGAEASSPKAVHHRAASGTYDSQDTNAKPTDYNIFTLWGALAGGPGPKDEYTDSRKNYQMNEVALDYNAGFQMNLAFLT

SEQ ID NO: 13343 - protein, 76 aa, Neocallimastix californiae
  Six-hairpin glycosidases
NWDGSNPSEQYTLGETGANAVATFALMGLSGYENVIKKNLKMAWDAQLMTGRYRYYDGLVHYLAMLHLLGSFKIWK

SEQ ID NO: 13344 - protein, 357 aa, Neocallimastix californiae
  Six-hairpin glycosidases
TYLGKTDAEIQGKLDQLWNHYFKGDNNSKVFYDRGNEGYILDVNNNDVRSEGMSYGMMIAVQTNHKEEFDKLWNWAKNHMWHKGGGWDGYFAWQRNTSGNGGDDNCAPDGEMYFMMSLLFAANRWNNKQYMDDAQYIIKRMWDNPQHKLFNQQNNIITFQPQGTGNNFSDPSYDLPAFVDLISRWSTTNQNRWKSAAQATRDHLYKSSNTRSGLFSDYNNFDGTPHSESYNQNASKYMYDAMRCAMNFGMDYYLFGSDAKRETEMAKRIIDFFEKDGYKHARFNWDGSGASEQYTQGETGANAVACFALMGTQGYESIIKKNLQMAWDVKPMTGQYRYYDGLVHYLAMLHLLGSFKI

SEQ ID NO: 13345 - protein, 197 aa, Neocallimastix californiae
  Six-hairpin glycosidases
SRDYARILNLNLRFYECQWSGKAPEHKQVYWRYDSALDDGADVGLDLTGGFYDAGDHVKFNLPMSYAMTMLAWGGIDLYDNYVAAGQLDYLLQMVNHGADYFVRCHPEKEVIYAQVGLGAIDHCFWVPPELMTMERPAACKLTPDNGASDVTAQMAAALASASILNKMYGNKEKAELYLKHAIEIYDFADKYRDVYN

SEQ ID NO: 13346 - protein, 342 aa, Anaeromyces robustus
  Six-hairpin glycosidases
CSAGRGKNSAHYLISWYFAWGGGLQGDWAWRIGSSHTHTGYQNPLAAWVLSTQSAFKPKSRTGADDWATSLDRQLELFRWLQASEGCIAGGATNSWQGHYAQPSSDITTFYGMYYDWQPVYHDPPSNNWTGMQGWGMERVCSLYYISGNEKAGTICRDWAKWVKNTVRVNGNEVIHSTNLEWSGNPDEWNSNNFNKSGRNRSLHGTSSSDGLDLGTLASIIKGLLWVSAKDNDAEGIQLVLDVMNAIEQYSDDLGYAAEEPRGDYSKFGEEVYIPSGWTGKNAQGANIRSGVTFIDIRPKYKQDPDWAQVENYLNGGSEPRFTYHRFWAQTEIMVANGLISI

SEQ ID NO: 13347 - protein, 351 aa, Anaeromyces robustus
  Six-hairpin glycosidases
TKCSAGRGKNSAHYLISWYFAWGGGLQGDWAWRIGSSHTHTGYQNPLAAWILSTQSAFKPKGSTAVKDWQTSLDRQLELIRWLQATEGCIAGGATNSWQGHYAEPDSDITTFYGMYYDWQPVYHDPPSNNWTGMQGWGMERTCSLYYVSGNEKAGTICRDWAKWVKETVRVSGGQVIHATNLEWSGNPDEWNKNNFNKSGANRSLHGTVSAEGLDLGSIASIIKALLWVSAKDGDEEGIDLAIQVMDAIENYKDDLGYAAEEARADYSKFGDEVYIPSGWTGKNAQGANLKSGVTFIDIRPKYKQDPDWAQVENYLNGGSEPTFTYHRFWGQTEIMVANGLISILGYGDRT

SEQ ID NO: 13348 - protein, 104 aa, Anaeromyces robustus
  Six-hairpin glycosidases
SKYVDFVKKQTDYILGDNPAKINYVVGAEASSPKAVHHRAASGTYDSQDTNAKPTDYNIFTLWGALAGGPGPKDEYTDSRKNYQMNEVALDYNAGFQMNLAFLT

SEQ ID NO: 13349 - protein, 357 aa, Anaeromyces robustus; identical to SEQ ID NO: 13344
  Six-hairpin glycosidases

SEQ ID NO: 13350 - protein, 38 aa, Anaeromyces robustus
  Six-hairpin glycosidases
GGPGARDDYKDDRTNYNSNEVALDYNAAYTGLLAFLIQ

SEQ ID NO: 13351 - protein, 435 aa, Anaeromyces robustus
  Six-hairpin glycosidases
QDYARHLELSILFYEAQRSGKLPANNRIFWRHDSMVDAGKDNNVDLTGGYYDAGDNVKFNFPQASALTLLAWSAVEWKDGYKEAGQWEYMKDLLKWGMDYFVKCHTGKTELYGQVGNGSLDHGAWVPPEDIDYKYPSYKITASAPGSDLAGETAAALVASSLAFREDDPEYADLLLKHGKEIYDFADKYRGSYDKSIEDAKGYYRSYSGYMDELVWGAAWLYKATGDETYKKKVDAIWDYPYGDLDPDKFLGSTGPISWDDKKASSYALMAMITGEDKYVKESTTHSDLMVNYKTTPGGLWYDTNLSMWGSNRYASNAAFTVAMLASSMDPNDSKRKQYVKFVQKQIDYIIGNNPAKVDYVVGADPSSPKAVHHRGASGSKGADKGPDENVFVLYGALAGGPGARDDYKDTRNNYEMNEVALDYNAAFQGLLAFL

SEQ ID NO: 13352 - protein, 442 aa, Anaeromyces robustus
  Six-hairpin glycosidases
KSQDYARHIELSLLFYEAQRSGKLPENNRIYWRHDSLLDAGADNGVDLTGGYYDAGDNVKFNFPAAATLTLLAWSGIDYAQGYKEAGQWDYLLDAVRWGADYFMKCHTGKNELYVQVGSGRVDHAYWYPPEYVNYDHPSFKITASAPGSEVAGDTASFLAAASILFKDVDSSYSQKCLKHAKEIYDFADTYRGEYTKAVEDAQQFYANWSGFLDELAFGALWLYRATGDESYHNKFKKIADDSYGEQDTKAYGICTGPISWDDKRPGSYILAAMITGEEKRLQQAYWYCDEVLTQPKTPGGLWYNDNLSKWGSNRYASNAAAMLGMFANYLPKSDPKRSKYIDFVKSQTNYILGDNPAKVNYVVGAEANSPKAVHHRGSSGTYDSQDNNAKPTDYNIYTLWGALAGGPGKSDDYSDTRKNYEMNEVALDYNAAFQMNLALLV

SEQ ID NO: 13353 - protein, 317 aa, Anaeromyces robustus
  Six-hairpin glycosidases
SRDYARILNLNLRFYECQWSGKAPEHKQVYWRYDSALDDGADVGLDLTGGFYDAGDHVKFNLPMSYAMTMLAWGGIDLYDNYVAAGQLDYLLQMVNHGADYFVRCHPEKEVIYAQVGLGAIDHCFWVPPELMTMERPAACKLTPDNGASDVTAQMAAALASASILNKMYGNKEKAELYLKHAIEIYDFADKYRDVYNNPCPEGASFYPSASYKDELVWGAAWVYRASGDEKYYKKADEYYDSLALSGRNLIGPITWDDASSGIVFLMSKPGFGSNWERYLGEAQHYVDQYLNDMGARTDGGMLWYSSVSGWGSARHA

SEQ ID NO: 13354 - protein, 443 aa, Anaeromyces robustus
  Six-hairpin glycosidases
SQDYARHIELSLLFYEAQRSGKLPENNRIYWRFDSQLDAGADHGVDLTGGYYDAGDNVKFNFPAAAALTLLAWSGVDYADGYKKAGQWDYFLDAIRWGADYFMKCHTGKNELYFQVGDGKIDHTYWYPPEYTVYEHPSLKLTTSKPGSEVASDTASFLAATYMIFKDIDPTYAKKCLQHSKEIYEFADKYRGDYSKSFGNYVNDFYKNWGTINDELAFGALWLYRATGDESYLAKYKVIADASYDSRDESAYPNCSGPISWDDKRPGAYVLGAIVTGEDKYLDKAISYCDAVLTQPKTRGGLWYNNNLSKWGSNRYASNAASMLGMLANYLPKDHPKRSKYIDFVKSQTNYILGDNPAKVNFVVGAEKNSPKAVHHRGASGTYDSQDTNAKPTDHNVYTIWGALAGGPGKDDSYTDTRKNYEMNEVALDYNAAFQMNLALLVK

SEQ ID NO: 13355 - protein, 474 aa, Anaeromyces robustus
  Six-hairpin glycosidases
DVSGDAKKKVEATLQKVKNVAYETLKERHIEAYKKQFDRVKIALPVNSSAQNPTMDRLANFNRSGDQDLVALMFQYGRYLLISSSQPGGQPANLQGIWNDSTDAPWDSKYTININAQMNYWPAEVTNLSECHEPLFSLIRDLSVTGKEAASRIYKAEGWMAHHNTDIWRISGPVDGAFWGMWPNGGGWLSTHIWQHYLFTGDKDFLEEYYPILRDAAKFFVSSMVKDPNTGYLVTVPSTSPEHGYSSDGSSMTAGCTMDNQIAYDVLNQALLAAKTLGVDDSFQKTLQNTMNNIAPMQVGQYNQLQEWFVDADNPRDDHCHVSHLYGLYPSGQISPFKQPLLFEASKNTLTQRGDMATGWSIGWKINLWARLLDGNHAYKIIQNMLVLIRSGVDGRVYGNMFDAHPPFQIDGNFGFCAGIAEMLLQSHDGAVHLLPALPSVWSDGSISGLVARGGFEVSITWKSGKVTKASIKS

SEQ ID NO: 13356 - protein, 35 aa, Anaeromyces robustus; identical to SEQ ID NO: 260
  Six-hairpin glycosidases

SEQ ID NO: 13357 - protein, 435 aa, Anaeromyces robustus
  Six-hairpin glycosidases
TRDYARILNLNLRFYECNWSGKAPEHKQVYWRYDSALEDGADVGLDLTGGFYDAGDHVKFNLPMSYAMTMLAWGGIDLYENYVAAGQIDYLVQIVNHGADYFVKCHPEKEVIYAQVGLGDVDHCFWVPPELMEMERPAVCKLTPENGASDVTAQMAAALASASILNKKVGNTEKAELYLKHAIEIYDFADKYRDVYGNPCPEGASFYPSASYKDELVWGAAWVYRASGDEKYYDKADEYYDSLGLSGRVLIGPISWDDASSGIIFLMSKPGFGKNWERYLNEAQIYVDQYLNDKGSRTDAGMLWYSSVSGWGSARHAMAGVFLYCIFNTYHKPEDPKYFNFIQQQADYILGNNPFNRSLVVGSIPGHDPLNVHHRGSHGGYSPISPPEHNMYTLYGALAGGPLQDDSWDDDRNNYITNEVSCDYNAGITGVMAYL

SEQ ID NO: 13358 - protein, 628 aa, Anaeromyces robustus
  Six-hairpin glycosidases
KRADDQYAKRATEHYNIITGNGSYSSKYFSSEKVPYHSVETLMVEAPDHGHESVSETYSFWIWLEAVNGKLTGNYEGVDTAWSYLEKHLIPDSKNQPGNSKYNPSSPATYAPEDDDITNYPAQLVFQDGIVGQDPIAQELQQAYGNWDMYAMHWIIDGDNWYGYGQQGDGTSKPSFINTFQRGSSESTWKTIPHPCWEEFKWGGPNGFLDLFTGDNSYSKQWRYTAAPDADARAIQAAYFGYIWAKEDGQDLSAVAAKAAKLGDYMRYAQYDKYFKKIGNCIGYNKCAAGSGKNSAHYLISWYFAWGGGLQGDWAWRISSSHTHSGYQNPLAAWVLSSEPAFKPKSSTGAEDWATSLDRQLELFRWLQSSEGCIAGGATNSWQGHYAQPDSSITTFYGMFYDWQPVYHDPPSNNWSGMQGWGMERVCSLYYLSGDERAGKVCQEWAKWVKKNVRVSNGEITHCTNIKWEGNPDEWNSSNFNKANLNASLHGTSSSEGTDLGTVASIIKGLLWVSLKDNDQEGIDLVIDVMDAMENYKDSLGYAVKEAREDYAKFGGEVYVPSGWTGKNAQGANIKNGVTFIDIRPKYKQDPDWAQVENFLNGGDPPEFTYHRFWAQTEIMVANGILSI

SEQ ID NO: 13359 - protein, 474 aa, Anaeromyces robustus
  Six-hairpin glycosidases
DVSGDPKKKAEAALEKVINTSYETLKKRHIEAYKKQFDRVKLSLPMNAYALNPTMDRLANFNKSGDQDLVTLMFQYGRYLLISSSQPGGQPATLQGIWNDNIDAPWDSKYTININIQMNYWPAEVTNLSECHEPLFELIRDLSVSGRESASKLYNAEGWMAHHNTDVWRISGPIEGAYWGIWPNGGAWLSTHIWQHYLFTGDKEFLKDYYEVLKGAAQFFVTDLVRDPNTGFLVTVPSGSPEHGYSADGSAMTAGCTMDNQIAYDTMNQALQAAKILGLDQDFQKTLQQTMDGLAPMQVGQYNQLQEWYVDADNPRDDHRHVSHLYGLYPSAQISPFKQPLLFEASKNSLTQRGDMATGWSIGWKINLWARLFDGNHAYKIIKNLLNLIRSGVDGRVYANMFDAHPPFQIDGNFGFCAGIAEMLVQSHDGAVHLLPALPDVWGDGSVSGLMARGGFEVSITWKSGKVTKASIKS

SEQ ID NO: 13360 - protein, 642 aa, Anaeromyces robustus
  Six-hairpin glycosidases
RTNDEYAQRVIEQYEKLTNNGTYDTDYFSKDNYLPFYSIETLIVEEDNSFSRLDYGHLSTSETLSYWIWLEAVNGKITGNYEGVDWAWSVMEKFLIPYSEYQRGNNRYNSNEPSIYVPEYDGIQNYPIPLTFQTGIAGMDPIAKELQVTYGTWDMYSLHWLVDGDNWYGYGQQENGYTRPVLINTFRRGPSESVWQTIPHPSFDEFRWGGSNGFLDLFFIDNNFYYPKQYKYTTCPDADARAIQATYFAYLWAKEDGINLPYSIILRATRLGDYLRYSHYDKYFKKIGDCFNYKLCTPGSGKNSAHYLISWAYSWGGGIMGDWTWRRGSSYIHSGYQNPLVAWIFSTQSAFKLKSSTGNKDWSVSLDRQLEFMRWLQTPEGCIAGGATNSWEGQYNTPPQNITNFYGMYYDWQPVYHNPSSNNWIGMQARSIERVCSLYYLSGNQKAELICQTWVEWIKKNIQIHDYEIIHATKLTWEGNPDDWDSSSFYKSGINTSLHGTVFEMGFDLGSMASIVKSLLWVSMKDNDQEGLDLAIQIMDIIENYKDDLGYAVEEFHDNYSKFANPVYFPNDWKGRNPQGAYLKRGACFLDIRPKYKEDPDWYQVEYYLNGYENPPVFTYHRFWVQAEIMIANGLLSIYKVK

SEQ ID NO: 13361 - protein, 365 aa, Anaeromyces robustus
  Six-hairpin glycosidases
VLNKITKMSDYMLYFINNDASLQSFNSDSTDENKNYLLSRYFSWKGSIHGKWLTKKIISNIIGIGSQNPFVAYILSNVKEFNSENPNSVNKWKKSYKRQIEFIRWLQSSEGAIVGNAKYPSNIDDINHKSSFYDLIFTSSNEEENDLFSTQCFVFESIAELYYITKDKDIEIILFKWLDWVLSVFHLTSDRSFRIPNKLSFEGHPEKWKPNTSIEDHENDNLNVIVEDYNNNIGVAASLSKILLLVGKKNNNDDYLTLGRDILEKIELINKDEYGYATEEIFYNYRLFNKKLPIQKDFKGVYGQSAKINDKSTFISIRPYYKKDKNWKIIKSYLNDGTPVPSFKYHRFWEQCEILLAQGLYSQYY

SEQ ID NO: 13362 - protein, 427 aa, Anaeromyces robustus
  Six-hairpin glycosidases
QDYARHLELNFLFYEAQRSGHLPANNRIPWRSDSGLDHGADNGVDLTGGYYDAGDNVKFNFPQAFSMTAIAWYGLEFAKGVEMAGQTEYLKDTVKWGCDYLLKCHKKGTDVFYMQVGDGDIDHLYWKAVEDIDYPTPSFYVDSKNPGTEVTGETAAAFAAASLLFKESDPEYSATLLDQAVEWFNFANTYRFDYSVSVPKVASYYKSWGGYKDELAWAAIWLYKALGEEKYLELAKDLVKDYKLGELGFDWDSKYQSTIVILAQLGVKEYVEKVENWVREICTKGKLSPGGLYINKDSEWGSCRRATSMAASLIFYTHTLPEGNELREMAKKFAQSQADYVQGNNPLGIDFVVGADASSPRSVHHRTASGADCIECDPVENAHIIYGALAGGPDENDQYEDIRADYQKNEVALDYNVCYAAVCAYLI

SEQ ID NO: 13363 - protein, 586 aa, Piromyces finnis
  Six-hairpin glycosidases
YQNHYDKLNINNSSSIYYNADSIPYSTLETLYIDQNVDYGHLTTLKEISYKLWIEALQGKISGKWKPFVNAWNIFENNMIPKDESQKGNSKYYSTTNNSINTKDSLYKELYEQYQTWSLYLPHNIIDTDNWNKYFSSKNKKRFIKNHKNNDKDSIWCSLFYPSIINSNNYLNPYLDNEITEIKQWEYISDSRYISKIIESVYRAYCWSTEQKKNKFMKPILKKIIKMSDYMLYFINSDDSLQSFDSESNEDNKNYLLSRYFSWKGSMEGKWLEKEVTTDIIGIGSQNPLIAYVLSNDKNFNSENPEFVSKWKKSYQRQIEFIRWLQSSEGAIVGVAQYPSNHNLSSKKMPSFYNLIFSKNFEVEENNLFGTQCYVFESLAELYYITKDKDIEIIITKWLDWVLSVFHLTSDRLFKIPNKLTFEGQPKDWNQKDGIKNHKNDKLNVIVEDYNNSIGVAASLSKILLLIGKKNNNEDYLTLGRDILERIEISSKDSQGYSVTETFYQYRRFNKKLPIPEGFKGMYGRSSKINDKSTFISIRPYYKKDKDWKIINTFLNKGTTIPTFKYHRFWEQCEILLAQGLYSQYY

SEQ ID NO: 13364 - protein, 488 aa, Piromyces finnis
  Six-hairpin glycosidases
DVSGDAQKKAEAAIQSALKSTYSSLKDKHLAAYKKQFDRVKISLPVNSNAENQTVDRLANFNRSGDQDLIALMFQYGRYLLITSSQPGGQPANLQGIWNDSIDAPWDSKYTININTEMNYWPAEVTNLSECHDPLFSLIRDLSVTGREAASKIYNAEGWMAHHNTDIWRITGPVDGAYWGMWPNGGGWLSTHIWQHYLFTGDKDFLNQNYSILKEAAKFFVSSMVKDPNTGYLATVPSTSPEHGYSYDGSSMTSGCTMDNQIAFDVLNQALLAAKTLGVDESFQKTLQNTINSIAPMKVGQYNQLQEWFVDADNPKDDHRHVSHLYGLYPSGQISPFKQPLLFEAAKNTLTQRGDMATGWSIGWKINLWARLLDGNHAYKIIQNMLNLLPTGQDNSNGRVYANLFDAHPPFQIDGNFGFCAGIAEMLLQSHDGAVHLLPAIPDVWNEGSISGLIARGGFEVDMIWKSKKITKATIKSKIGGVLRIRSN

SEQ ID NO: 13365 - protein, 446 aa, Piromyces finnis
  Six-hairpin glycosidases
SQDYARHLELSLLFYEAQRSGKLPENNRIYWRHDSLVDAGADNGVDLSGGYYDAGDNAKFNFPGAATMTLLAWSGIDYAEGYKEAGQWKYLLDAVRWGADYFMKCHTGKNELYAQVGKGTTDHSYWYPPEYASYDHPSFKLTASAPGTEVSADTASFLAASYLLFKDEDPSYASKCLQHSKEIYDFADTYRGDYIGSIPDVSGFYSTWSGYNDELAFGALWLYRATGSESYMKKFEAIADAVYGAQDTKAYGTCTGPISWDDKRPGAYILAAIITGDEKRMKQASWYCDNVLTQPKTPGGLWYDANLSKWASNRYASNAAAMVAMYANYLPSSDSKRSKYVDFVKKQTDYILGDNPAKINYVVGAEANSPKAVHHRGASGTYDSQDTNAKPTDYNIFTLWGALAGGPGPDDEYTDSRKNYEMNEVALDYNAAFQMNLAFLTQEGLS

SEQ ID NO: 13366 - protein, 448 aa, Piromyces finnis
  Six-hairpin glycosidases
SQDYARHLELSLLFYEAQRSGKLPENNRIYWRHDSLVDAGADNGVDLSGGYYDAGDNAKFNFPGAATMTLLAWSGIDYAEGYKSAGQWEYILDAVRWGADYFMKCHTGKNELYAQVGDGNTDHAFWYPPEYVKYDYPSFKVTAEKPGSEVAGETAAFLAAASILFKDEDSSYSAKLLKHAKEIYEFADTYRGDYTGAIPGVVSFYSTYSGYNDELAWGAAWLLRATGDESYLNKYNVIANKKYESYDPKKFSGATGPISWDDKRPGCYILIAMVTGDENRIKEAYNYCDAVLTQPKTPGGLWYDDGLSMWGSNRYASNAASMLAMFANYLPKSDPKRAKYVEFVQQQTNYILGDNPAKINYVVGAEANSPKAVHHRGSSGVFDSQDKAAKPDENIYTLWGALAGGPDETDSYIDTRSNFRTNEVALDYNAAFQMNLAFLVKEGFNKPD

SEQ ID NO: 13367 - protein, 446 aa, Piromyces finnis
  Six-hairpin glycosidases
SQDYARHIELSLLFYEAQRSGKLPENNRVYWRHDSLLDAGADNGVDLTGGYYDAGDNVKFNFPGAAALTLLAWSGIDYADGYKEAGQWDYILDAVRWGADYFVKCHTGKNELYVQVGKGATDHGFWYPPEYVQYDHPSYKITAAAPGSEVAGDTASFLAAASILFKDIDSSYSSNLLKHAIEIYDFADSYRGEYIKAVPDAQGFYSNWSGYNDELAFGALWLYRATGESKYMDKFSKIADASYGEQDTKAYGTCTGPISWDDKRPGAYILAAIITGDEKRMKQASWYCDNVLTQPKTPGGLWYDANLSKWASNRYASNAAAMVAMYANYLPSSDSKRSKYVDFVKKQTDYILGDNPAKINYVVGAEANSPKAVHHRGASGTYDSQDTNAKPTDYNIFTLWGALAGGPGPDDEYTDSRKNYEMNEVALDYNAAFQMNLAFLTQEGLS

SEQ ID NO: 13368 - protein, 449 aa, Piromyces finnis
  Six-hairpin glycosidases
SQDYARHLELSLLFYEAQRSGKLPENNRIYWRHDSLVDAGADNGVDLSGGYYDAGDNAKFNFPGAATMTLLAWSGIDYAEGYKEAGQWKYLLDAVRWGADYFMKCHTGKNELYAQVGKGTTDHSYWYPPEYASYDHPSFKLTASAPGTEVSADTASFLAASYLLFKDEDPSYASKCLQHSKEIYDFADTYRGDYIGSIPDVSGFYSTWSGYNDELAFGALWLYRATGSESYMKKFEAIADAVYGAQDTKAYGTCTGPISWDDKRPGAYILAAIITGDEKRMKQASWYCDNVLTQPKTPGGLWYDANLSKWASNRYASNAAAMVAMYANYLPSSDSKRSKYVDFVKKQTDYILGDNPAKINYVVGAEANSPKAVHHRGASGTYDSQDTNAKPTDYNIFTLWGALAGGPGPDDEYTDSRKNYEMNEVALDYNAAFQMNLAFLVKEGFNKPD

SEQ ID NO: 13369 - protein, 445 aa, Piromyces finnis
  Six-hairpin glycosidases
SQDYARHLELSLLFYEAQRSGKLPENNRIYWRHDSLVDAGADNGVDLSGGYYDAGDNAKFNFPGAATMTLLAWSGIDYAEGYKSAGQWEYILDAVRWGADYFMKCHTGKNELYAQVGDGNTDHAFWYPPEYVKYDYPSFKVTAEKPGSEVAGETAAFLAAASILFKDEDSSYSAKLLKHAKEIYEFADTYRGDYTGAIPGVVSFYSTYSGYNDELAWGAAWLLRATGDESYLNKYNVIANKKYESYDPKKFSGATGPISWDDKRPGCYILIAMVTGDENRIKEAYNYCDAVLTQPKTPGGLWYDDGLSMWGSNRYASNAASMLAMFANYLPKSDPKRAKYVEFVQQQTNYILGDNPAKINYVVGAEANSPKAVHHRGSSGVFDSQDKAAKPDENIYTLWGALAGGPDETDSYIDTRSNFRTNEVALDYNAAFQMNLAFLTQEGLS

SEQ ID NO: 13370 - protein, 449 aa, Piromyces finnis
  Six-hairpin glycosidases
SQDYARHIELSLLFYEAQRSGKLPENNRVYWRHDSLLDAGADNGVDLTGGYYDAGDNVKFNFPGAAALTLLAWSGIDYADGYKEAGQWDYILDAVRWGADYFVKCHTGKNELYVQVGKGATDHGFWYPPEYVQYDHPSYKITAAAPGSEVAGDTASFLAAASILFKDIDSSYSSNLLKHAIEIYDFADSYRGEYIKAVPDAQGFYSNWSGYNDELAFGALWLYRATGESKYMDKFSKIADASYGEQDTKAYGTCTGPISWDDKRPGAYILAAIITGDEKRMKQASWYCDNVLTQPKTPGGLWYDANLSKWASNRYASNAAAMVAMYANYLPSSDSKRSKYVDFVKKQTDYILGDNPAKINYVVGAEANSPKAVHHRGASGTYDSQDTNAKPTDYNIFTLWGALAGGPGPDDEYTDSRKNYEMNEVALDYNAAFQMNLAFLVKEGFNKPD

SEQ ID NO: 13371 - protein, 435 aa, Piromyces finnis
  Six-hairpin glycosidases
QDYARHLELSILFYEAQRSGKLPANNRIFWRHDSMVDAGKDNKVDLTGGYYDAGDNVKFNFPQASALTLLAWGAYKWKDGYKEAGQWDYMKDLLKWGMDYFIRCHTDKYVLYGQVGNGSLDHGAWVAPEDIDYEYPSYKITASAPGSDLAAETSASMVAASLAFRDEDPTYADTLLKHGRELYEFAEKYQGTYDKSITDAKGYYRSYSGFNDELVWGAAMLYAATGEQTYKDKVDKIWNTPYGELDPDRFLGSTGPISWDDKKAAAYALMAITTGESKYIEESTRHSDLMVNYPTTPGGLWYDTNLSMWASNRYAANAAFTVAMLATSMDANDSKRKEYVAFVKKQIDYILGDNPAKVDYVVGADPSSPKAVHHRGASGSKGADKGPDENVFILYGALAGGPGAKDNYKDARNNYEMNEVALDYNAAFQGLLAFL

SEQ ID NO: 13372 - protein, 304 aa, Piromyces finnis
  Six-hairpin glycosidases
LKLTTGAPGSEVAGDTASFLAATYIIFKDIDPSYAKKCLQHSKEIYEFADTYRGDYSKSFGDYVNSFYKNWGTIYDELAFGALWLYRATNDESYLKKYKAIADASYDTRDENAYGNCKGPISWDDKRPGGYVLGAIVTGEEKYIEKALSYCDMVLTQPRTPGGLWYDSNLSKWGSNRYASNAASMVAMMADFLPKDDARRAKYVDFVKSQTDYILGDNPAGVNYVVGAEENSPKAVHHRAASGTYDSQDRNAKPNDHNVYTIWGALAGGPAKDDSYEDTRKNYEMNEVALDYNAAFQMNLAFLV

SEQ ID NO: 13373 - protein, 41 aa, Piromyces finnis; identical to SEQ ID NO: 284
  Six-hairpin glycosidases

SEQ ID NO: 13374 - protein, 42 aa, Piromyces finnis
  Six-hairpin glycosidases
GALAGGPDGNDKYTDDRTNYNSNEVALDYNAAYTGLLAFLIQ

SEQ ID NO: 13375 - protein, 399 aa, Piromyces finnis
  Six-hairpin glycosidases
TRDYARILNLNLRFYECQWSGKAPENKQVYWRYDSALEDGADVGLDLTGGFYDAGDHVKFNLPMSYAMTMLAWGGIDLYDNYVAAGQIDYLIQMVNHAADYFVRCHPEKEVIYAQVGLGDVDHCFWVPPELMEMERPAVCKLTPENGASDVTAQMAAALASASILNKKYGNEEKAELYLKHAIEIYDFADKYRDVYGNPCPEGASFYPSASYKDELVWGAAWVYRASGDEKYYEKADSYYDSLGLSGRVLIGPISWDDASSGIIFLMSKPGFGSNWKRYLGEAQTYVDQYLNDKSARTDAGMLWYSAVSGWGSARHAMAGTFLYCIFNTYHNPTDPKYFNFIQQQADYILGNNPFDRSLVVGSIPGHDPLNVHHRGSHGGYSPISPPEHNMYTLYGALA

SEQ ID NO: 13376 - protein, 401 aa, Piromyces finnis
  Six-hairpin glycosidases
IHTRDYARILNLNLRFYECNWSGKAPEHKQVYWRYDSALEDGADVGLDLTGGYYDAGDHVKFNLPMSYAMTMLAWGGIDLYDNYVAAGQIDYLVQIVNHGADYFVKCHPEKEVIYAQVGLGDVDHCFWVPPELMEMERPAVCKLTPENGASDVTAQMAAALASASILNKKYGNEEKAELYLKHAIEIYDFADKYRDVYGNPCPEGASFYPSASYKDELVWGAAWVYRASGDEKYYEKADSYYDSLGLSGRVLIGPISWDDASSGIIFLMSKPGFGSNWKRYLGEAQTYVDQYLNDKSARTDAGMLWYSAVSGWGSARHAMAGTFLYCIFNTYHNPTDPKYFNFIQQQADYILGNNPFDRSLVVGSIPGHDPLNVHHRGSHGGYSPISPPEHNMYTLYGALA

SEQ ID NO: 13377 - protein, 202 aa, Piromyces finnis
  Six-hairpin glycosidases
SMYYLSGNEKAGLVCKNWAQWVKDTTRVNGGEVIHATNLGWDGNPDEWKASNFNKSGLNKSLHGTVTSEGLDLGSIASIMKGLMWVSMKDGDEEGLSLAVSVMDAIENYKDDLGYATYEERLDYANFGQETYIPSGWSGKNAQGANIKSGATFIDIRPKYKEDPDWAQVEDFLNGGNPPAFTYHRFWGQTEIMVANGLIAIY

SEQ ID NO: 13378 - protein, 628 aa, Piromyces finnis
  Six-hairpin glycosidases
KRASDEYGRRVTDLYDVMTGNGSYSSEYFSAEKVPYHSVETLMVEAPDHGHESVSETFSFWIWLEAVNGKITGNYDGVEEAWNYLEKHIIPDSKNQPGNSKYNPSSPATYAAEHDDIDGYPSKLIFQDGIVGEDPIAKELSQAYGNWDIYIMHWIIDGDNWYGYGQQGDGTSKPSFINTFQRGASESTWKTVPHPCWEAMKWGGRNGFLDLFTVDNSYAKQWRYTAAPDADARAVQAAYFAYIWAEEDGVNLSSVAAKAAKLGDYLRYAQYDKYFKKIGNCVGSDKCSAGRGKNSAHYLISWYFAWGGGLQGDWAWRIGSSHTHSGYQNPLAAWILSTQAAFKPKSSTGAKDWATSMDRQLELFRWLQTPEGCIAGGATNSWQGSYAQPSSDITTFYGMWYDWQPVYHDPPSNNWTGMQGWGMERVCSLYYVSGDERAGKVCQEWAKWVKDTTRVSGGEIVHATNLDWSGNPDEWNSSNFNKSNLNRSLHGTVSSEGVDLGSIASIIKGLMWVSMRDGDQEGINLSIEVMDAIENYKDDLGYATYEERLDYANFGQETYIPSGWSGKNAQGANIKSGATFIDIRPKYKEDPDWAQVEDFLNGGNPPAFTYHRFWGQTEIMVANGLIAI

SEQ ID NO: 13379 - protein, 628 aa, Piromyces finnis
  Six-hairpin glycosidases
KRASDEYGRRVTDLYDVMTGNGSYSSEYFSAEKVPYHSVETLMVEAPDHGHESVSETFSFWIWLEAVNGKITGNYDGVEEAWNYLEKHIIPDSKNQPGNSKYNPSSPATYAAEHDDIDGYPSKLIFQDGIVGEDPIAKELSQAYGNWDIYIMHWIIDGDNWYGYGQQGDGTSKPSFINTFQRGASESTWKTVPHPCWEAMKWGGRNGFLDLFTVDNSYAKQWRYTAAPDADARAVQAAYFAYIWAEEDGVNLSSVAAKAAKLGDYLRYAQYDKYFKKIGNCVGSDKCSAGRGKNSAHYLISWYFAWGGGLQGDWAWRIGSSHTHSGYQNPLAAWILSTQAAFKPKSSTGAKDWATSMDRQLELFRWLQTPEGCIAGGATNSWQGSYAQPSSDITTFYGMWYDWQPVYHDPPSNNWTGMQGWGMERVCSLYYVSGDERAGKVCQEWAKWVKDTTRVSGGEIVHATNLDWSGNPDEWNSSNFNKSNLNRSLHGTVSSEGVDLGSIASIIKGLMWVSMRDGDQEGINLSIEVMDAIENYKDDLGYAAEEQRLDYEKFGGEVYIPSGWTGKNAQGANIKSGVTFIDIRPKYKQDPDWAQVEEYLNGGNPPEFNYHRFWAQTEIAVANGLISI

SEQ ID NO: 13380 - protein, 201 aa, Piromyces finnis
  Six-hairpin glycosidases
SMYYLSGNEKAGLVCKNWAQWVKDTTRVNGGEVIHATNLGWDGNPDEWKASNFNKSGLNKSLHGTVTSEGLDLGSIASIMKGLMWVSMKDGDEEGLSLAVSVMDAIENYKDDLGYAAEEQRLDYEKFGGEVYIPSGWTGKNAQGANIKSGVTFIDIRPKYKQDPDWAQVEEYLNGGNPPEFNYHRFWAQTEIAVANGLISI

SEQ ID NO: 13381 - protein, 357 aa, Piromyces finnis
  Six-hairpin glycosidases
TYLGKTDEEIQKKLDELWNHYFKGDNNSKVFYDQGNEGYILDVNNNDVRSEGMSYGMMIAVQTDHQKEFDKLWNWAKNHMWHKSGSWDGYFAWKRGSNGSGGDDNCAPDGEMYFMMSLLFAANRWNDKKYMDDAQYILKRMWDNSQHSLFNPAYNVITFQPQGNENNFSDPSYDLPAFVDLFSRWSTTNQNKWKAAASATRDHLYKSSNPQSGLFSDYNNFDGTPHSVSYNSNAQKYMYDAMRCAMNFGMDYYLFGTDAKRQTEMAKRIINHFEKDGYQHARFNWDGTGGSEQYTLGETGANAVATYALMGIAGYEDIIKKNLKMAWDGKPMTGQYRYYDGLVHYLSMLHLLGSFKI

SEQ ID NO: 13382 - protein, 202 aa, Piromyces finnis
  Six-hairpin glycosidases
SMYYLSGNEKAGLVCKNWAQWVKDTTRVNGGEVIHATNLGWDGNPDEWKASNFNKSGLNKSLHGTVTSEGLDLGSIASIMKGLMWVSMKDGDEEGLSLAVSVMDAIENYKDDLGYATYEERLDYANFGQETYIPSGWSGKNAQGANIKSGATFIDIRPKYKEDPDWAQVEDFLNGGNPPAFTYHRFWGQTEIMVANGLISIY

SEQ ID NO: 13383 - protein, 628 aa, Piromyces finnis
  Six-hairpin glycosidases
KRASDEYGRRVTDLYDVMTGNGSYSSEYFSAEKVPYHSVETLMVEAPDHGHESVSETFSFWIWLEAVNGKITGNYDGVEEAWNYLEKHIIPDSKNQPGNSKYNPSSPATYAAEHDDIDGYPSKLIFQDGIVGEDPIAKELSQAYGNWDIYIMHWIIDGDNWYGYGQQGDGTSKPSFINTFQRGASESTWKTVPHPCWEAMKWGGRNGFLDLFTVDNSYAKQWRYTAAPDADARAVQAAYFAYIWAEEDGVNLSSVAAKAAKLGDYLRYAQYDKYFKKIGNCVGSDKCSAGRGKNSAHYLISWYFAWGGGLQGDWAWRIGSSHTHSGYQNPLAAWILSTQAAFKPKSSTGAKDWATSMDRQLELFRWLQTPEGCIAGGATNSWQGSYAQPSSDITTFYGMWYDWQPVYHDPPSNNWTGMQGWGMERVCSLYYVSGDERAGKVCQEWAKWVKDTTRVSGGEIVHATNLDWSGNPDEWNSSNFNKSNLNRSLHGTVSSEGVDLGSIASIIKGLMWVSMRDGDQEGINLSIEVMDAIENYKDDLGYATYEERLDYANFGQETYIPSGWSGKNAQGANIKSGATFIDIRPKYKEDPDWAQVEDFLNGGNPPAFTYHRFWGQTEIMVANGLISI

SEQ ID NO: 13384 - protein, 201 aa, Piromyces finnis
  Six-hairpin glycosidases
SMYYLSGNEKAGLVCKNWAQWVKDTTRVNGGEVIHATNLGWDGNPDEWKASNFNKSGLNKSLHGTVTSEGLDLGSIASIMKGLMWVSMKDGDEEGLSLAVSVMDAIENYKDDLGYSSHEARGDYDKFGGEVYIPSGWTGKNAQGANIKSGVTFIDIRPKYKQDPDWAQVEEYLNGGNPPEFNYHRFWAQTEIAVANGLISI

SEQ ID NO: 13385 - protein, 628 aa, Piromyces finnis
  Six-hairpin glycosidases
KRASDEYGRRVTDLYDVMTGNGSYSSEYFSAEKVPYHSVETLMVEAPDHGHESVSETFSFWIWLEAVNGKITGNYDGVEEAWNYLEKHIIPDSKNQPGNSKYNPSSPATYAAEHDDIDGYPSKLIFQDGIVGEDPIAKELSQAYGNWDIYIMHWIIDGDNWYGYGQQGDGTSKPSFINTFQRGASESTWKTVPHPCWEAMKWGGRNGFLDLFTVDNSYAKQWRYTAAPDADARAVQAAYFAYIWAEEDGVNLSSVAAKAAKLGDYLRYAQYDKYFKKIGNCVGSDKCSAGRGKNSAHYLISWYFAWGGGLQGDWAWRIGSSHTHSGYQNPLAAWILSTQAAFKPKSSTGAKDWATSMDRQLELFRWLQTPEGCIAGGATNSWQGSYAQPSSDITTFYGMWYDWQPVYHDPPSNNWTGMQGWGMERVCSLYYVSGDERAGKVCQEWAKWVKDTTRVSGGEIVHATNLDWSGNPDEWNSSNFNKSNLNRSLHGTVSSEGVDLGSIASIIKGLMWVSMRDGDQEGINLSIEVMDAIENYKDDLGYSSHEARGDYDKFGGEVYIPSGWTGKNAQGANIKSGVTFIDIRPKYKQDPDWAQVEEYLNGGNPPEFNYHRFWAQTEIAVANGLISI

SEQ ID NO: 13386 - protein, 357 aa, Piromyces finnis; identical to SEQ ID NO: 13381
  Six-hairpin glycosidases

SEQ ID NO: 13387 - protein, 280 aa, Piromyces finnis
  Six-hairpin glycosidases
HHMWHKSGSWDGYFAWKRGSNGSGGDDNCAPDGEMYFMMSLLFAANRWNDKKYMDDAQYILKRMWDNSQHSLFNPAYNVITFQPQGNENNFSDPSYDLPAFVDLFSRWSTTNQNKWKAAASATRDHLYKSSNPQSGLFSDYNNFDGTPHSVSYNSNAQKYMYDAMRCAMNFGMDYYLFGTDAKRQTEMAKRIINHFEKDGYQHARFNWDGTGGSEQYTLGETGANAVATYALMGIAGYEDIIKKNLKMAWDGKPMTGQYRYYDGLVHYLSMLHLLGSFKI

SEQ ID NO: 13388 - protein, 558 aa, Piromyces finnis
  Six-hairpin glycosidases
LTGDYSGVETAWSYIEKHMIPDSKNQPGNSKYNPSSPATYAAEHDDIDGYPSKLIFQDGIVGEDPIAKELSQAYGNWDIYIMHWIIDGDNWYGYGQQGDGTSKPSFINTFQRGASESTWKTVPHPCWEAMKWGGRNGFLDLFTVDNSYAKQWRYTAAPDADARAVQAAYFAYIWAEEDGVNLSSVAAKAAKLGDYLRYAQYDKYFKKIGNCVGSDKCSAGRGKNSAHYLISWYFAWGGGLQGDWAWRIGSSHTHSGYQNPLAAWILSTQAAFKPKSSTGAKDWATSLDRQLELFRWLQTPEGCIAGGATNSWQGSYAQPSSDITTFYGMWYDWQPVYHDPPSNNWTGMQGWGMERVCSLYYVSGDERAGKVCQEWAKWVKDTTRVSGGEIVHATNLDWSGNPDEWNSSNFNKSNLNRSLHGTVSSEGVDLGSIASIIKGLMWVSMRDGDQEGINLSIEVMDAIENYKDDLGYSSHEARGDYDKFGGEVYIPSGWTGKNAQGANIKSGVTFIDIRPKYKQDPDWAQVEEYLNGGNPPEFNYHRFWAQTEIAVANGLISI

SEQ ID NO: 13389 - protein, 628 aa, Piromyces finnis
  Six-hairpin glycosidases
KRASDEYGRRVTDLYDVMTGNGSYSSEYFSAEKVPYHSVETLMVEAPDHGHESVSETFSFWIWLEAVNGKITGNYDGVEEAWNYLEKHIIPDSKNQPGNSKYNPSSPATYAAEHDDIDGYPSKLIFQDGIVGEDPIAKELSQAYGNWDIYIMHWIIDGDNWYGYGQQGDGTSKPSFINTFQRGASESTWKTVPHPCWEAMKWGGRNGFLDLFTVDNSYAKQWRYTAAPDADARAVQAAYFAYIWAEEDGVNLSSVAAKAAKLGDYLRYAQYDKYFKKIGNCVGSDKCSAGRGKNSAHYLISWYFAWGGGLQGDWAWRIGSSHTHSGYQNPLAAWILSTQAAFKPKSSTGAKDWATSLDRQLELFRWLQTPEGCIAGGATNSWQGSYAQPSSDITTFYGMWYDWQPVYHDPPSNNWTGMQGWGMERVCSLYYVSGDERAGKVCQEWAKWVKDTTRVSGGEIVHATNLDWSGNPDEWNSSNFNKSNLNRSLHGTVSSEGVDLGSIASIIKGLMWVSMRDGDQEGINLSIEVMDAIENYKDDLGYSSHEARGDYDKFGGEVYIPSGWTGKNAQGANIKSGVTFIDIRPKYKQDPDWAQVEEYLNGGNPPEFNYHRFWAQTEIAVANGLISI

SEQ ID NO: 13390 - protein, 68 aa, Neocallimastix californiae
  Starch-binding domain-like
NSESIPNQQWRHYSFWTHSISGVSPNFTINNVIPGTYQLRAWSKGVVGEFILNKTITVTAGQTTNLGE

SEQ ID NO: 13391 - protein, 101 aa, Anaeromyces robustus
  Starch-binding domain-like
YVPKAKRGSVSGKLVIKDPLYGSLKISDATVTLVQPESSTEPIHPQQWHKMSHWVTHVTGDFKIENVVPGTYQLRAWSKGIVGEFYTTNTITVTSGQETKL

SEQ ID NO: 13392 - protein, 100 aa, Piromyces finnis; identical to SEQ ID NO: 1336
  Starch-binding domain-like

SEQ ID NO: 13393 - protein, 65 aa, Piromyces finnis
  Starch-binding domain-like
TEPIPNQQWRHMSFWTHSLSGATPNFVIYNVIPGTYELHAWAKGVVGEFVLDKLVTVKAGEVVNL

SEQ ID NO: 13394 - protein, 11 aa, Neocallimastix californiae
  SUBTILASE_ASP
IYILDSGIYGD

SEQ ID NO: 13395 - protein, 11 aa, Neocallimastix californiae
  SUBTILASE_ASP
IYILDSGIDVH

SEQ ID NO: 13396 - protein, 10 aa, Neocallimastix californiae
  SUBTILASE_HIS
HGSMVASVAA

SEQ ID NO: 13397 - protein, 10 aa, Neocallimastix californiae
  SUBTILASE_HIS
HGSMVASIAA

SEQ ID NO: 13398 - protein, 10 aa, Neocallimastix californiae
  SUBTILASE_SER
GTSFSCPIVA

SEQ ID NO: 13399 - protein, 10 aa, Neocallimastix californiae
  SUBTILASE_SER
GTSFSCPIVA

SEQ ID NO: 13400 - protein, 16 aa, Neocallimastix californiae
  SUBTILISIN
GGTSFSCPIVAGVAAS

SEQ ID NO: 13401 - protein, 13 aa, Neocallimastix californiae
  SUBTILISIN
ELKFHGSMVASVA

SEQ ID NO: 13402 - protein, 19 aa, Neocallimastix californiae
  SUBTILISIN
GRGVDIYILDSGIYGDHID

SEQ ID NO: 13403 - protein, 19 aa, Neocallimastix californiae
  SUBTILISIN
GKGVDIYILDSGIDVHHAD

SEQ ID NO: 13404 - protein, 13 aa, Neocallimastix californiae
  SUBTILISIN
KIKYHGSMVASIA

SEQ ID NO: 13405 - protein, 16 aa, Neocallimastix californiae
  SUBTILISIN
GGSSFSAPLVAGVAAS

SEQ ID NO: 13406 - protein, 19 aa, Anaeromyces robustus
  SUBTILISIN
GKGIDIFLIDKGLYLDNDD

SEQ ID NO: 13407 - protein, 16 aa, Anaeromyces robustus
  SUBTILISIN
QGTSVSTAITAGVIAT

SEQ ID NO: 13408 - protein, 23 aa, Neocallimastix californiae
  Subtilisin-like
VLSAAVQENNNNNNKFYIISIKD

SEQ ID NO: 13409 - protein, 22 aa, Neocallimastix californiae
  Subtilisin-like
PKPKFVKKQMNKFAELILDHID

SEQ ID NO: 13410 - protein, 396 aa, Neocallimastix californiae
  Subtilisin-like
SVLDVTVIYAYLSEELYNIIKDLPDVVSCNEDVVIPFPNDTIISINDTNTFEIKSDKKFEKRASYYDLYDIKRDTNWSDVTVFENTYHHLSLISQSKYDRNLVGKYDRNFYYPISAGRGVDIYILDSGIYGDHIDFDTGHRTVSCDAMFGKTRVINQPGSSNYKNCYLENELKFHGSMVASVAAGKYFGVAKNANIHMIVHDRTALNILYAYDYVKKYAKNPHKTVINLSFGNYIRIPEEEKMINSLAEMGFIVIAAAGNDYTNACTNNPRQVKQEGQTVTVTSKMYPAAYSNVIAVGATNNDIQSLDVTNVSNLYNVASFSNYGNCLDIFGPGYVYGAYPGYDYRNNNSIQAYAGGTSFSCPIVAGVAASIISEHPEIEFNVTILRQWLLDNAVR

SEQ ID NO: 13411 - protein, 55 aa, Neocallimastix californiae
  Subtilisin-like
GYDYRNNNSIQAYAGGTSFSCPIVAGVAASIISEHPEIEFNVTILRQWLLDNAVR

SEQ ID NO: 13412 - protein, 313 aa, Neocallimastix californiae
  Subtilisin-like
NYYYPSSAGKGVDIYILDSGIDVHHADFELDTGNTGNGYRTVSCDAMFGDKEIINQPGSSSYKNCFLEEKIKYHGSMVASIAAGKIHGVAKNANIHMVVHNRQSTGILLAYNFVKNNLKDPHKTVINLSFGSYKKIPEEVSLINSLIEMGCIVVAAGGNDNISSCTTEPRYVVSDDDNKVKTLIQEKIYPASLENVIGVGSIRNKIKETDVSSVQNLYSLADFSNYGDCLDLFAPGYAYAAYPPPNNNDKSSSDLEGYGGGSSFSAPLVAGVAASIISEHPEMTFNHSLMKKMLLEISVEGILDQSGIHDSPN

SEQ ID NO: 13413 - protein, 33 aa, Neocallimastix californiae
  Subtilisin-like
FLFNLLVIYCVFSYAEKENLKKTNKYYIISIKD

SEQ ID NO: 13414 - protein, 60 aa, Neocallimastix californiae
  Subtilisin-like
NILDVSVIFAYLSEELYEIIKELPDVVSCNENVIIPFPNDKIFSITNMESIGSMESMEKD

SEQ ID NO: 13415 - protein, 53 aa, Anaeromyces robustus
  Subtilisin-like
PILNYYTILVYLSDELVDQVQALPNVISCEKSFKIQDQVYKEEEEILINNNNN

SEQ ID NO: 13416 - protein, 330 aa, Anaeromyces robustus
  Subtilisin-like
SENDDSHLSLLSQGRFYKEVTGRYDNNYYYPSSAGKGIDIFLIDKGLYLDNDDFDRYEGTEDERTLTCDALVVYGVAHPYEGEDKKKCKFAEDSYPGHGNMVSSLAGGKLYGAAKKANLHMIVSYYELYETIVALDYIKQNGKPYQSIISFSRGAYKKYSQFLQDKLDELNDAGFITVVAAGNETEDICHEKNKYFYSIAGYKNVIIVGSTESTYNNDIENGYKIASYSNYGECIDIFAPGQARYANYQLNRKAQGTSVSTAITAGVIATIMSEHPDIKFNVDTMKEKLFELSLKNIISGLNNVTPNRFLNNGKLSIISPIHYYNTTVTT

SEQ ID NO: 13417 - protein, 247 aa, Neocallimastix californiae
  Thioesterase
FLIPAAGSSINMYNSWSKYMNKSALFAISYPGHLARIDETPIDDFKVLVKSIGEEILNNIKNGKISKDKPIYFFGHSLGALVSYETVLYLQNERKKGNPNAPVVTALVVSASPSPVFPRPITIKHDENGNPVHFTDLAPEELPAFLTNLGGANKDSMSNNKQFQKLIPSIVADFKLTDEYRRFTDKDHQLECALYDIGGISDPIISVASRSRWDLENAEGYPIVRIEFEGDHWFIQENVEVVLERLK

SEQ ID NO: 13418 - protein, 242 aa, Anaeromyces robustus
  Thioesterase
ILFPAAGSSINMYSNWNKYLTNSTLLAVSLPGHLIRLEEKPIDNMEDLVDNIYKEIIKNVKNGNIPKDQPLYLFGHSLGALVGYEVAMTLQNERKKGNPDIPNITALISSGSPAPIFPRPVVIRYENDKPIHFTDLVPEQYPEELSRLGGANSESLQSKQFQKLIPSIAADFILTDNYKRFSEKDHQLEVPIYDIGANSDYVAPKDSRTNWDIEIANGYPLKRMNFEGGHWFIQDNLEVVMD

SEQ ID NO: 13419 - protein, 247 aa, Piromyces finnis
  Thioesterase
FLFPAAGSSISMYGNWNSYMKNSALFGVSYPGHLVRLDETPIDDLKTLVSAIAKEIMENIKNGNIPKDQPLYCFGHSLGALVSYEVVMLLQNERKNGNPNAPVFAGLIVSASPAPIYPRPIPLRKVNGKPIHFTDLSPEQFPEELAILGGANKESLQSKQFQKLIPSIAADFKITDNYKRITDKDHQLECPLYDIGGVSDPMVNPDSRKNWELEVTEETPLVRITFEGGHWFIQENMESVLERLKKE

SEQ ID NO: 13420 - protein, 119 aa, Neocallimastix californiae
  Thioesterase/thiol ester dehydrase-isomerase
TIPKRKPDAIVKERTSEDQAILYRLSGDKNPLHVDPAMASIAGYHSPVLQSLCVLAISTLHIIQTFCYGDVASIKSIQADFVSHVFPGETLQTNMWQDGTKILFNVKALERDVIVISNA

SEQ ID NO: 13421 - protein, 134 aa, Neocallimastix californiae
  Thioesterase/thiol ester dehydrase-isomerase
EFAKEHFNYNERDVILYSIGVGITKKELSYVYENSPDFKVLPTFSTVPAMDYFSKMNLANVLPIFSPEALIQTKHYMELNKTFEPKDNVVSKGKIVDIIKTKMGAVLITAISTYDKDGNEICYNEFQHLLRHVD

SEQ ID NO: 13422 - protein, 119 aa, Neocallimastix californiae
  Thioesterase/thiol ester dehydrase-isomerase
TIPKRKPDAIVKERTSEDQAILYRLSGEKNPLHVDPAMASIAGYHSPVLQSLCVLAIGTLHIIQTFCYGDVASVKSIQADFVSHVFPGETLQTNMWQDGTKILFNVKALERDVIVISNA

SEQ ID NO: 13423 - protein, 137 aa, Neocallimastix californiae
  Thioesterase/thiol ester dehydrase-isomerase
TEFAKERFNYNEKDVILYSLGVGITKKELSYVYENSPDFKVLPTFSTVPALDYFSKMNLSNILPIFSPEALIQTKHYMELNKTFEPKDNVVSKGRIIDIIKSKMGAILVTAISTYDEEGNEICYNEFQHLLRHVDNY

SEQ ID NO: 13424 - protein, 110 aa, Neocallimastix californiae
  Thioesterase/thiol ester dehydrase-isomerase
NTNEDYSLASGDVNPIHTNYYFANLADLDVPITHGMWTSAATRRYVETYAADNDAERVVSYKVNFIGMVSPKDELRTSLTHVGMHNGRKIIKVSVKDLRTNETVMEGEAE

SEQ ID NO: 13425 - protein, 116 aa, Neocallimastix californiae
  Thioesterase/thiol ester dehydrase-isomerase
RVTEEDVKFFSDVTRYTHPSNKVVPSMDFIIVTSWVSVFKTIFAKEFDADITRLVHMNNGYEVIDPRPLRIGEVVDTRSIISAVTNLDSGKLIEVTGHVFREGKEYVKVTSSFLCR

SEQ ID NO: 13426 - protein, 111 aa, Neocallimastix californiae
  Thioesterase/thiol ester dehydrase-isomerase
THSSNIGYSRVSGDVNPIHTNPYFAQLADLPGNITHGMWTSASTRKFVETFAAENHPHRVTSYEVKFLDMVFPGDRLETKLFHTGMANGKKIIQCKTINQDGKVVLEGTAE

SEQ ID NO: 13427 - protein, 112 aa, Neocallimastix californiae
  Thioesterase/thiol ester dehydrase-isomerase
NIIGNRAESYTDRGQKVLFAPMDFAIVVGWQSIIRAIFPKFINADLLKLVHLTNGFRMIDNESGLKEGDIVKTESRIISVINDETGKIVEVKGVLKRDEKPFMEVISKFFYR

SEQ ID NO: 13428 - protein, 111 aa, Neocallimastix californiae; identical to SEQ ID NO: 13426
  Thioesterase/thiol ester dehydrase-isomerase

SEQ ID NO: 13429 - protein, 112 aa, Neocallimastix californiae; identical to SEQ ID NO: 13427
  Thioesterase/thiol ester dehydrase-isomerase

SEQ ID NO: 13430 - protein, 112 aa, Neocallimastix californiae
  Thioesterase/thiol ester dehydrase-isomerase
NIIGNRAESYTDRGQKVLFAPMDFAIVVGWQSIIRAIFPKFINADLLKLVHLSNGFRMIDNELGLKEGDVVKTESRIISVVNDETGKIVEVKGVLKRDEKPFMEVISKFFYR

SEQ ID NO: 13431 - protein, 112 aa, Neocallimastix californiae
  Thioesterase/thiol ester dehydrase-isomerase
NTHSSNLGYSRVSGDVNPIHTNPYFAQLADLPGNITHGMWTSASTRKFVETFAAENHPHRVTSYEVKFLDMVFPGDRLETKLFHTGMANGKKIIQCKTINQDGKVILEGTAE

SEQ ID NO: 13432 - protein, 116 aa, Neocallimastix californiae
  Thioesterase/thiol ester dehydrase-isomerase
RVTEEDVKFFSDVTRYTHPSNKVVPSMDFIIVTSWVSVFKTIFAKEFDADITRLVHMNNGYEVIDPRPLKIGELVDTRSIISAVTNLDSGKLIEVTGHVFREGKEFVKVTSSFLCR

SEQ ID NO: 13433 - protein, 110 aa, Neocallimastix californiae
  Thioesterase/thiol ester dehydrase-isomerase
NTNEDYSLASGDVNPIHTNYYFANLADLDVPITHGMWTSAATRRYIETYAADNDAERVVSYKVNFIGMVSPKDELRTSLTHVGMHNGRKIIKVSVKDLRTNETVMEGEAE

SEQ ID NO: 13434 - protein, 119 aa, Anaeromyces robustus
  Thioesterase/thiol ester dehydrase-isomerase
TIPKRKPDAIVKERTSEDQAILYRLSGDKNPLHVDPAMASIAGYHSPVLQSLCVLAISTLHIIQTFCYSDVASIKSVQADFVSHVFPGETLQTNMWQDGTKILFTVKALERDVIVISNA

SEQ ID NO: 13435 - protein, 137 aa, Anaeromyces robustus
  Thioesterase/thiol ester dehydrase-isomerase
TEFPKERFQYSERDVILYSLGVGITKKELSYVYENSPDFKVLPTFSTVPAMDYFSKMNLANVLPVFSPESLIQTKHYMELNKIFEPKDCVVSTGKIVDIIKTKMGAVLITAITTYDQDGNEICYNEFQHLLRHVDNY

SEQ ID NO: 13436 - protein, 110 aa, Anaeromyces robustus
  Thioesterase/thiol ester dehydrase-isomerase
NTNEDYSLASGDVNPIHTNYYFANLADLDVPITHGMWTSAATRRYVETYAADNDAERVVSYRVNFIGMVSPKDELRTSLTHVGMHNGRKIIKVSVKDLRTNETVMEGEAE

SEQ ID NO: 13437 - protein, 117 aa, Anaeromyces robustus
  Thioesterase/thiol ester dehydrase-isomerase
KRVTEEDVKFFSDVTRYTHPSNKIVPSMDFIIVTSWVSVFKTIFAKEFDADITRLVHMNNGYEVIDPRPLQIGEIVDTRSIISAVTNLDSGKLIEVTGHVFREGKEFIKVTSSFLCR

SEQ ID NO: 13438 - protein, 112 aa, Anaeromyces robustus
  Thioesterase/thiol ester dehydrase-isomerase
NTHSSNLGYSRVSGDVNPIHTNPYFAQLADLPGNITHGMWTSASTRKFVETFAAENHPHRVTSYEVKFLDMVLPGDRLETKLFHTGMANGKKIIQCKTINQNGQVILEGTAE

SEQ ID NO: 13439 - protein, 112 aa, Anaeromyces robustus
  Thioesterase/thiol ester dehydrase-isomerase
NIIGNQAESYTDRGQKVLFAPMDFAIVVGWQSIIRAIFPKFIDADLLKLVHLSNGFRMIENETGLKEGDVVKTESRIISVVNDETGKIVEVKGVLKRDEKPFMEVISTFFYR

SEQ ID NO: 13440 - protein, 112 aa, Piromyces finnis
  Thioesterase/thiol ester dehydrase-isomerase
NIIGNQAESYTDRGQKVLYAPMDFAIVVGWQSIIRAIFPKFINADLLKLVHLSNGFRMIDNATGLKEGDIVKTESRIISVINDENGKIVEVKGVLKRDEKPFMEVISKFFYR

SEQ ID NO: 13441 - protein, 111 aa, Piromyces finnis
  Thioesterase/thiol ester dehydrase-isomerase
THSSNLGYSRVSGDVNPIHTNPYFAQLADLPGNITHGMWTSASTRKFVETFAAENHPQRVTSYEVNFLDMVFPGDRLETKLYHTGMANGKKIIKCKTINQNGQVILEGTAE

SEQ ID NO: 13442 - protein, 111 aa, Piromyces finnis; identical to SEQ ID NO: 13441
  Thioesterase/thiol ester dehydrase-isomerase

SEQ ID NO: 13443 - protein, 112 aa, Piromyces finnis; identical to SEQ ID NO: 13440
  Thioesterase/thiol ester dehydrase-isomerase

SEQ ID NO: 13444 - protein, 111 aa, Piromyces finnis; identical to SEQ ID NO: 13441
  Thioesterase/thiol ester dehydrase-isomerase

SEQ ID NO: 13445 - protein, 112 aa, Piromyces finnis; identical to SEQ ID NO: 13440
  Thioesterase/thiol ester dehydrase-isomerase

SEQ ID NO: 13446 - protein, 112 aa, Piromyces finnis; identical to SEQ ID NO: 13440
  Thioesterase/thiol ester dehydrase-isomerase

SEQ ID NO: 13447 - protein, 111 aa, Piromyces finnis; identical to SEQ ID NO: 13441
  Thioesterase/thiol ester dehydrase-isomerase

SEQ ID NO: 13448 - protein, 118 aa, Piromyces finnis
  Thioesterase/thiol ester dehydrase-isomerase
IPKRKPDAIVKERTSEDQAILYRLSGEKNPLHVDPAMASIAGYNSPVLQNLCVLAISTLHVIQTFCYSDVASVKSIQADFVSHVFPGETLQTNMWQEGTKILFTVKALERDIVVISNA

SEQ ID NO: 13449 - protein, 134 aa, Piromyces finnis
  Thioesterase/thiol ester dehydrase-isomerase
VFNKEKFSYSERDVILYSLGVGITKKELSYVYENSPDFKVLPTFSTVPALDYFSKMNLSNILPIFTPETFIQTKHFMELKKIFEPKDVVVSKGKIVDIIKTKLGAVLVTAISTYDQDDNVICYNEFHHLLRHVD

SEQ ID NO: 13450 - protein, 126 aa, Neocallimastix californiae
  Thiolase-like
QVAVVGIALRLPGGINTVDKYWKSLENGRFCVSPTGTNRHLHHNMTHNEELKPGEHYIFNYCRYDSTPDAAPITDFDPMFFNMNPNEATVLDPKFRWVLETTYEVLQDAGINPDSLSGTHTNIYTA

SEQ ID NO: 13451 - protein, 226 aa, Neocallimastix californiae
  Thiolase-like
CASASLPGRISFMYNLFGAAHTVDTACSSGLVAIHDAFKDLNIGETDLAIVNAAHCPFQSSSFSLLSIAKMVSRNCRCASYDEAADGYVPGEGCVSVILKRKDDAIRDHNKIYGLINATAVGQSGSRASMSTPTVLGQKYIHKKVLEKANLTPGDIDYMEGHGTGTKLGDRIEAEAINEVFKGTHSESRPLTLASVKTNIGHTEEVSGLASLVKVLLAMKHKTVPP

SEQ ID NO: 13452 - protein, 130 aa, Neocallimastix californiae
  Thiolase-like
MVPIAVVGMGLRLPGGINTPSKYWNALVNGKDCISPTPANRHLHQYLRPFCPPNELGPFDHYIHRAGYYDVTPDAAPISDFDPTFFNISPLEAKFTEPKFRWIYETVYEAFQDACINVSELNGTRTSVFT

SEQ ID NO: 13453 - protein, 225 aa, Neocallimastix californiae
  Thiolase-like
SAASSCAGRISFNYGFIGPSDTIDTACSSGLNDCHNACKSLSMGDSDVAVVSAVHQQFVSTQFHVISVAHMASQIGRCATFDAEADGYAPGEGCISIILKRLDDAVTDHDHIYGVITGITTSQSGIRPSISSPAVGPQVENIQKALQIANVSPADVDYVEAHGTGTQVGDAIETETLNIAFGGTHNAKKPLIVGSVKTNIGHTEEVSGLAGLCKVLLSMSHRTIP

SEQ ID NO: 13454 - protein, 374 aa, Neocallimastix californiae
  Thiolase-like
PKFAIIGIGCHFPEGIESKEAFWKMLEDARCITKDIPKDRWDKNEWYSKEPIQGTIQTKRGAFLKNPYLFDNKYFYISMPEAKEMSPEQRWLLELTVETLEDANIKPEAVRGSRTGVFIGSSGCDYLATQISHANDINSHSPTGFELSILANRLSYVFDLQGPSISCNTACSSAFSALNIGLNAMITDDCEMALVAGSNFMNCPGGFVAFSQLRVVSPDGSCKPFDEKANGYARLEGAGMVLIKPYEKAVRDGDKIYCAIVGCGSNEDGRSPSLTMPSYEAQYKLLSHVCEKSGILPSEIDYVEAHGTGTKVGDPIESHAIGDAYGRSKGVRGPNDPPVLVSSVKGNTGHGENSSGIVSIIKTSLMLHKRKLVP

SEQ ID NO: 13455 - protein, 383 aa, Neocallimastix californiae
  Thiolase-like
SSNKKIAIIGMAFRLPGAISNSKSLWMALAKSRDCILPPVKTRDLHHGYVNKPANQLGPKEHYLARVGCYDVRPNVAKPSEFDADFFNCSPEEATALDPRHRWILETSWEALENAGIVPSSLKNTITGVFVGMNNDHEHEDLLKKCGKVPPLAAHATAQSSIAGRLSYFYELFGPSYTIDTACSTGSSALHSACQSMQCGDCDLSIVSGVKYMYSSDEFHKTCAARMTSPNSRCATFDASADGFAQSEGCVTFVLKRLEDAIRDKDNILSVILGSSSGQSGLRQSISAPSSEGQRITIQRAMKVAGITPDQVSYVEAHGTGTPLGDAIEVHALNQVYAGSHTEENPLVVGSIKSNIGHTCEAAGLAGIAKVIVAMKHNTIPKN

SEQ ID NO: 13456 - protein, 319 aa, Neocallimastix californiae
  Thiolase-like
KYAVIGVGCRFPGNIKSKEDFWEMLTSGRCLTSEIPNDRWNTAEWYNKEPKRGTMQTTRGAFMEDAFYFDNKYFSISQNEAKEMSPEQRWLMELAVETFEDANINPKKLKGSRTGVFVGSSGMDFVSAQISHANDLTQHSATGLELSILANRISYFFDLNGPSICTNTACSASMTALNLAINSMITDDCDAALVAGTNLLFTPGSYVAYSQLRVVSTDGSCKPFDKNADGYSRIEGAGMILIKPYEKAVKDGDKIYCAILGSGTNEDGHTPSLTMPSYSSQCKLLTHVCEKFDIDPASIDYVEAHGTGTAVGDPIEARS

SEQ ID NO: 13457 - protein, 34 aa, Neocallimastix californiae
  Thiolase-like
FPLLIGSSKGNTGHGEYSSGIIGMIKAILMLYHR

SEQ ID NO: 13458 - protein, 19 aa, Neocallimastix californiae
  Thiolase-like
TLRIAVNSFGFGGSNGNAI

SEQ ID NO: 13459 - protein, 65 aa, Neocallimastix californiae
  Thiolase-like
VVVTGYGEVGPYGNTRTRWEMEADGKFSLEGCVELAWIMGFIKHVTYKQMPDGTLYSGWVDAKSG

SEQ ID NO: 13460 - protein, 212 aa, Neocallimastix californiae
  Thiolase-like
QLPTGWDPARYGIPKDIIEQVDIITCYCIVSAVEALVSAGITDPYEFYEYVHVSEVGNACGSGVGAELANRAIFKDRFLDKPLQSDILQETFVNTMSAWINLLLLSSSGPIRTPVGACASAVESVDIGIDTILSGKAKVVFVGGYDDFQEEGSYEFAQMKATSNSREEMAQGREPNEMSRPTASSRGGFMEAQGVGTQVLMPASLALKMGVP

SEQ ID NO: 13461 - protein, 381 aa, Neocallimastix californiae
  Thiolase-like
TSDKIAIIGMALRLPGTINNSKSLWMSLAKGRDCVLPPVKTRDLHHGYVNKSFNELGPDEHYLPRIGCYDTRSNAAKPSEFDASFFNCTAEEAISLDPRHRWILETSWEALENAGIAPNSLENTLTGVYVGINNEHEHEDLLKECGIVPPVASHTLNQSSIAGRLSYFYKLFGPSFTIDTACSTGSSALHTACRAMQYGECDLSIVTGVKYMYSSKEFHKTCSAHMTSPNGRCATFDESADGFAQSEGCVTFILKRLDDAIRDNDNILTVILSSVSGQSGFRQSISAPSYEGQAINIERAMKIAGIKPEQVSYVEAHGTGTPLGDAIEIHALNKVYGGSHTEENPLIVGSIKSNIGHTCEAAGLAGIAKVIVSMKHNLIPK

SEQ ID NO: 13462 - protein, 166 aa, Neocallimastix californiae
  Thiolase-like
NVGIIGLASYIPSTTVNMSKLEVHDNCQGKYTISLGQKYMSLTAPNEDVVSMALNAVKRLMKKMNLKPSDIGRIQIGTETPVDLSKSVKTFIVEQFFDQGITDIEGVDNVNACFGSTAALFDTVAWMQSEFWNGRYAIVVGTDISQGEDIYHFLTGSSAVAVLIGP

SEQ ID NO: 13463 - protein, 370 aa, Neocallimastix californiae
  Thiolase-like
KIAIIGVGCRLPGDILTKDDFWNMLVTKRVVTTEIPADRWDRDEWYSDEPIPGTIQTKHGGFLTNAYDFDNKYFSISQAEALEITPEQRWLCELAVETMEDANIRPEELKGSQTGVFVGSAGIDFGGNQLVNTLQMSAHTMTGLEPSIFSNRISYIFDLHGPSITSNTACSASMSSLSMACNAIAVGDCDKAFVAGSNFLPSPGGYVAFSQLRVVSKTGSCKPFDEKADGYARLEGACMLLIKDYEKAVRDNDKIYACIIGSGTNEDGRTLSITMPSSDAQCTLMKWVCEKSNIKADTIDYVEAHGTGTPTGDPIEARSIGNAFGKAVRAPGSKPLPVGTVKGNVGHGEFLSGAIGLLKTSLMLFNKQLV

SEQ ID NO: 13464 - protein, 20 aa, Neocallimastix californiae
  Thiolase-like
TPLRAAVNSFGFGGANANAI

SEQ ID NO: 13465 - protein, 235 aa, Neocallimastix californiae
  Thiolase-like
VEPNRGIFSNSTFDFYKPYGYKNHYPVVDGKYSIKCYLDSLKSCYEDLKKKTKSETEFLDHQFGVFHNSSVSLTRKGFNTLMEMEIPKVLPNAKAIEKRKFISKIYKERVEASTLMTANMGCMYNASVLNGIISLNESLTPDDIGKRALVYSFGSGSVGALWTLRIDGLAEKDDLVNRLSNRKEVSVDTYFEIRKLWLEEIKKFGRSYKKDQFELPIRDGDYYLASVSSNGVRKY

SEQ ID NO: 13466 - protein, 212 aa, Neocallimastix californiae
  Thiolase-like
QIPTGWKPETYGIPKSIIDQVDPITLYVIVATVEALVSSGITDPYEFYEYVHVSEVGNCSGGGVGGMVSNRKQYFERLFEKPVQNDILQECFINTMPAWINLLLLSSSGPIKTPVGACATAVESVEIGLETILSGKAKIVIVGGYDDFQEEGSYEFANMKATSNSLEELAHGRDPSEMSRPATTTRGGFMESQGAGHEILMTASLAIKMGVP

SEQ ID NO: 13467 - protein, 59 aa, Neocallimastix californiae
  Thiolase-like
TVVVTGYGEVGPYGNSRTRWEMEAYGKFSLEGCIEMAWIMGMIKYAKNKKTKNGKLYSG

SEQ ID NO: 13468 - protein, 68 aa, Neocallimastix californiae
  Thiolase-like
DPSEMSRPATTTRGGFMESQGAGHEILMTASLAIKMGVPIYGIIAHTSTATDKEGRSVPAPGQGILTT

SEQ ID NO: 13469 - protein, 136 aa, Neocallimastix californiae
  Thiolase-like
LRGALAVFGLTIDDIEALSFHGTGTKANDTNESEVINKQFKHLGRSKGNVCPAIMQKYLTGHPKGAAASWMLNGMLQVIETGIIPGNRNADNIEEKLRKFEYIYFPSRSIHTDGIKAGLLKSFGFGQVGGEVLVIS

SEQ ID NO: 13470 - protein, 383 aa, Neocallimastix californiae
  Thiolase-like
VSMDKRVAVIGMALRLPGAINNSKSFWMSLAKGRDCVLAPVKDRKLHLGYVDKPSNLLGENEHNIPKCGCYDSRSNAAKPSEFDAEFFNCLPEEVNSMDPRQRWVLETSWEAFENAGIAPNTLENTTTGVFVGVNDDHDYQDLLKENGIAQPISAHSTPSGIAGRLSYFYKLFGPSFTIDTACSTGASALHSACRSLQFGDCDLSVVSGVKYLYSASEFHRTSVARMTSPHGRCATFDKDADGFAPGEGCVTFILKRLEDAVRDGDNILSVILGTSSGQSGLRQSISAPSSDGQVLNLKRALKFAGVDPSEVSFVEAHGTGTPLGDAIEVDALNQVYGGSHTEENPLVIGSVKTNIGHTNEAAGLAGMAKVILAMQHKYIPKN

SEQ ID NO: 13471 - protein, 21 aa, Neocallimastix californiae
  Thiolase-like
GRHRAAVNSFGFGGANANVIL

SEQ ID NO: 13472 - protein, 370 aa, Neocallimastix californiae
  Thiolase-like
KFAIIGTGIRLPGEINNKDDFWKVMTDKKVITGLIPEDRWDREEWYSKVEKPGTIQTLHGGFIENAFDFDNKYFGISQNEALDATPEQRWLCELTVETVEDANMDMDDFKGSHTGVFVGTSGMDYGSYVFSVPEKITKYTYSGIEPSIHANRVSYLFNLHGPSLSTNTACSSSMTALSIACNSMAAGDCEMALVAGTNFFQAPANGVAYSQLRVVSKKGACRPFDIGADGYARLEGAAMVLLKPYEKAIKDNNRIYATILSTACNEDGKTSSLTTPSSEAQCQLMKRVYSKGHIDPCTIDFVEAHGTGTSVGDPIEARSIGEAYGKVNKANGHPLLPVGSVKGNVGHGEYLSGIVGLIKGALILHKNTIV

SEQ ID NO: 13473 - protein, 374 aa, Neocallimastix californiae
  Thiolase-like
KSNAIAIIGMGLRLPGAINNEKTLWSALVKGRDCVSNIPKDRKLHESYVNKPSNELNPGEHNVKKCGYYDSRTSGEKVSQFDAEFFNCLPEEAIGLDPKHRWILETSWEALENAGISPDSLEDSNTGVFVGIGDQQDHAQFMKECHRKKVVSYHNSNPSAIAGRLSYFYKLYGPSVTVDTACSTGATALHTACRSMIYGDCRLAMVTASKYLFYPEEFEMTSKARMTSPNGRCATFDKDADGYAPAEGCVTFILKCLEDAERDKDHILGVILGTSSGQSGFRQSISVPSFEGQARNIKRVMEIAGVNPSDISYVETHGTGTPYGDAIEIQGINQVYAGSHTPEHPLVIGSIKTNIGHTAETSGLAGIAKVLVAM

SEQ ID NO: 13474 - protein, 382 aa, Neocallimastix californiae
  Thiolase-like
QSNGKIAIIGMGLRLPGAINSAKSLWLALAKGKDCVLPPIKTRDLHRNYVNKPSDQLDPTEHNIPRLGLYDTRNSVAKPSQFDAKFFNCLPDEALALDPRHRWILETSWEALENAGIPPNSLENSSTGVFVGINDDHEYSDLLTECGVKSPIAAHGQSPSGIAGRLSYFYRLYGPSFTMDTACSTGASALHTACRSLQCGDCDLSIVSGVKFMYSSKDFYMTCSARMTSPHGRCATFDKDADGFVPGEGCVTFILKRLEDAVRDNDHILSVVLSTSSGQSGLRQSISAPSSEGQAINMRKAMKFAGIKPEDVSYVEAHGTGTPLGDALEVHALNEIYGGSHTEENPLVVGSIKTNIGHTCETAGLAGIAKVIVSMQHKHIPR

SEQ ID NO: 13475 - protein, 68 aa, Neocallimastix californiae
  Thiolase-like
DPSEMSRPGTTTRGGFMESQGAGHEILMTASLAIKMGVPIYGIIAHTSTATDKEGRSVPAPGQGILTT

SEQ ID NO: 13476 - protein, 136 aa, Neocallimastix californiae
  Thiolase-like
LRGALAVFGLTMDDIDALSFHGTGTKANDTNESEVINKQFKHLGRSKGNVCPAIMQKYLTGHPKGAAASWMLNGMLQVIETGIIPGNRNADNIEEKLRKFDYIYFPSRSIHTDGVKAGLLKSFGFGQVGGEVLVIS

SEQ ID NO: 13477 - protein, 217 aa, Neocallimastix californiae
  Thiolase-like
QFDRTVAGQIPTGWKPETYGIPKSIIDQVDPVTLYVIVATVEALINSGITDPYEFYEYVHVSEVGNCSGGGVGGMLSSRKEYFERAFEKPIQSDILQECFINTMPAWINLLLLSSSGPIKTPVGACATAVESVEIGLETILSGKAKIVIVGGYDDFQEEGSYEFANMKATSNALDELAHGRDPSEMSRPGTTTRGGFMESQGAGHEILMTASLAIKM

SEQ ID NO: 13478 - protein, 222 aa, Neocallimastix californiae
  Thiolase-like
CAAASLPGRISFMYNLYGAAHTVDTACSSGLVATHDAFKDLNIGETDLAIVNAAHCPFQSSGFSLLSVAKMVSRNCRCAAYDEAADGYVPGEGCVSIILKRKDDAIRDHNKIYGLINATAVGQSGSRASMSTPSAIGQKIIHEEVLKNANLTPKDIDYMEGHGTGTKLGDRIEGEAINEVFKGSHSESRPLTLASVKTNIGHTEEVSGLASLVKVLLAMKYK

SEQ ID NO: 13479 - protein, 126 aa, Neocallimastix californiae
  Thiolase-like
QVAVVGIALRLPGGINTVDKYWKSLESGRFCISPTGTNRLLHHNLTHNEHLNPGEHYIFNYCRYDSTSDVSPITDFDPLFFNMNPSEATVLDPKFRWVLETTYEAFQDAGINPDTLSGTRTNVYTA

SEQ ID NO: 13480 - protein, 135 aa, Neocallimastix californiae
  Thiolase-like
QNRIAIVGIGLRLPGGINSTKKFWFSLIKGKNCLSATPTDRELHLGMVDMSKKPPEYRLNKNEHYVCRYGIYDSHYASSGVKYTDFDANFFDCSTEEAISMDVKQRWMLETSWEALEDAGIDPSSIENSDTGVFI

SEQ ID NO: 13481 - protein, 219 aa, Neocallimastix californiae
  Thiolase-like
TDLSSVAGRISYFYKIYGPAISMDTACSTGATALHTAYRSMQYGECDLAIVSGARFLYYNDEFINTSHAKMASPNGRCATFDEDADGFAPAEGCVTLILKRLDRAEENNDNIYGILLGSSNGQSGGRQSISVPSSEAQVRNIKNALKDAHVSPKDISFVEAHGTGTPYGDAIEIHALNQIFKDSHSKKSPLYIGSVKTNIGHTCEAAGLAGIVKVLLSM

SEQ ID NO: 13482 - protein, 219 aa, Neocallimastix californiae; identical to SEQ ID NO: 13481
  Thiolase-like

SEQ ID NO: 13483 - protein, 135 aa, Neocallimastix californiae; identical to SEQ ID NO: 13480
  Thiolase-like

SEQ ID NO: 13484 - protein, 137 aa, Neocallimastix californiae
  Thiolase-like
SNHNRIAIVGIGLRLPGGINSTKKFWHSLLQGKNCLSTTPVDRQLHLGMIDMAKQQPGYKLNKNEHYIHKYGYYDSIHTASIAKPTKFDANFFECTNEEAIGMDVKQRWMLETSWEALEDAGIDPSTLENSNTGVFI

SEQ ID NO: 13485 - protein, 219 aa, Neocallimastix californiae
  Thiolase-like
TDLSSAAGRISYFYKLYGPAISIDTACSTGATALHTAYRSMQYGDCDLAIVSGARFLYYNDEFINISHAKMTSPKGRCATFDESADGFAPAEGCVTLILKRLDDAEESNDDIYGILLGSSNGQSGGRQSISVPSSEAQVRNIRNALMDAQISPKDISYIEAHGTGTPYGDALEIHALNQVFGESHTKNSPLYIGSVKTNIGHTCEAAGLAGIVKVLLSM

SEQ ID NO: 13486 - protein, 225 aa, Neocallimastix californiae
  Thiolase-like
WEALENAGIAPNSLENTLTGVYVGINNEHEHEDLLKKCGIVPPLGSHTLNQSSIAGRLSYFYKLFGPSFTIDTACSTGSSALHIACNAMKRGECDLSIVTGVKYMYSSKEFHKTCSAHMTSPKGRCATFDASADGFAQSEGCVTFVLKRLDDAIRDKDNILTVILGSVSGQSGLRQSISAPSYEGQALNIERAMKIAGISPDQVSYVEAHGTGTPLGDAIEIHAL

SEQ ID NO: 13487 - protein, 68 aa, Anaeromyces robustus
  Thiolase-like
EPDEMSRPTASSRGGFMESQGVGTQVLMPASLALKMGVPIYGIIAHSATATDKEGRSVPAPGQGILTT

SEQ ID NO: 13488 - protein, 135 aa, Anaeromyces robustus
  Thiolase-like
LRGALAAFGLTVDDIGVASFHGTGTKANDKNESDVFNKQFEHLGRTKGNACPVVCQKYLTGHGKGAAAAWMLNGVIQIIQTGIIPGNRNADNIDPLLEKFDHLWFNNKTFKTPGVKAGLLKSFGFGQVGGEILVI

SEQ ID NO: 13489 - protein, 65 aa, Anaeromyces robustus
  Thiolase-like
VVVTGYGEVGPFGNCRTRWEMEAEGKFSLEGCVELAWIMGFIQHVTYKQMPDGTLYSGWVDAKSG

SEQ ID NO: 13490 - protein, 212 aa, Anaeromyces robustus
  Thiolase-like
QLPTGWDPARYGIPKDIIEQVDPITCYCIVSAVEALVSAGITDPYEFYEYVHVSEVGNACGSGVGAEIANRAIFKDRFLDKPLQSDILQETFVNTMSAWINLLLLSSSGPIRTPVGACASAVESVDIGIDTILSGKAKVVFVGGYDDFQEEGSYEFAQMKATSNSREEMAQGREPDEMSRPTASSRGGFMESQGVGTQVLMPASLALKMGVP

SEQ ID NO: 13491 - protein, 374 aa, Anaeromyces robustus
  Thiolase-like
NSNKIAIIGMALRLPGAINNAKSFWMALAKGKDCISTPVKDRKLHLGYVNKPSHLLNENEHNIPRCGCYDSRSNVAKPSEFDAEFFNCLPEEAMALDPRHRWILETSWEALENSGIAPNSLENTITGVFLGINDSHDYHDLMKENGITPPIAAHSTPSGIVGRLSYFYKLFGPSFTIDTACSTGASALHSACRSLQFGDCDLSIVSGVKYLYTSNDFHRTSIARMTSPKGRCATFDKDADGFVPSEGCVTFILKRYEDAIRDHDNILSVILGTSSGQSGIRQSISAPSSDGQVINLKRALHFAGVDPSDISFVETHGTGTPLGDAIEVNALNQVYKGTHTSENPLIIGSVKTNIGHTTEVAGLAGVAKVILSMQ

SEQ ID NO: 13492 - protein, 374 aa, Anaeromyces robustus
  Thiolase-like
DSNKIAIIGMALRLPGAINNAKSFWMALAKGKDCVTTPVKDRKLHLGYVDKPSHLLGENEHNIPRCGCYDTRSNVAKPSEFDAEFFNCLPEEAMALDPRHRWILETSWEALENSGIAPNSLENTITGVFLGINDSHDYHDLMKENGITPPIAAHSTPSGIVGRLSYFYKLFGPSFTIDTACSTGASALHSACRSLQFGDCDLSIVSGVKYLYTSNDFHRTSIARMTSPKGRCATFDKDADGFAPGEGCVTFILKRYEDAIRDHDNILSVILGTSSGQSGIRQSISAPSSDGQVINLKRALHFAGVNPSDISFVETHGTGTPLGDAIEVNALNQVYKGTHTSENPLVIGSVKTNIGHTTEVAGLAGVAKVILSMQ

SEQ ID NO: 13493 - protein, 374 aa, Anaeromyces robustus
  Thiolase-like
PKFAIIGIGCHFPEGIESKEDFWQMLEDARCITKDIPKERWDKDEWYSEEPIQGTIQTKRGAFLKNPYLFDNKYFYISMPEAKEMSPEQRWLLELTVETLEDANIKPETLKGTRTGVFIGSSGCDYLATQISHANDINSHSPTGFELSILANRLSYVFDLQGPSISCNTACSSAFSALNIGLNAMITDDCEMALVAGSNFMNCPGGFVAFSQLRVVSPDGSCKPFDEKANGYARLEGAGMVLIKPYEKAVRDGDKIYCAIVGCGSNEDGRSPSLTMPSYEAQYKLLTHVCEKSGIHPTQIDYVEAHGTGTKVGDPIESRAIGDAYGKSKGIRGPNDPPILISSVKGNTGHGENSSGIVSIIKTSMMLHKRRLVP

SEQ ID NO: 13494 - protein, 382 aa, Anaeromyces robustus
  Thiolase-like
KEKIAIIGMSLRLPGSINSAKSFWMALAKGKNCVLPPVKNRDLHHGYVNKPSDQLNPGEHNIPYIGCYDTRSNVAKPSQFDAEFFNCLPDEALALDPRHRWVLETSWEALENAGIPPNSLEDSLTGVFVGMSQDHEYADLLAERNIIAPIAAHSNTQSGIAGRLSYFYRLYGPSLTMDTACSTGGSAIHTAVRSLQNRDCNLSIVSCVRYMYTSKTFYKTCAARMTSPHGRCATFDKDADGFASGEGCVCFVLKRLDDAIRDNDHILSVIIGTSSGQSGLRQSISAPSSEGQAINIKRAMEIADIKPEDVSYVEAHGTGTPLGDALEIHSLNQVYAGSHNEENPLVVGSVKTNIGHTGEVAGLASIAKVILAMQHKHIPKNL

SEQ ID NO: 13495 - protein, 128 aa, Anaeromyces robustus
  Thiolase-like
PIAVIGMGIRLPGGINTPGKYWSALVSGRDCTSPTPTNRHLHHYLKPGCPANELGPMEHYIHRGGFYDTTPDAAPLSDFDPTFFNISPLEAKATDPKFRWVYETVYEAFQDACINISELNGSRTSVYC

SEQ ID NO: 13496 - protein, 227 aa, Anaeromyces robustus
  Thiolase-like
GSNPSSCAGRIAFNYGFTGPSDTIDTACSSGLNDVNNACKALSCGDTDLAVVSAVHQQIIGTQFHVISVAQMASHLGRCATFDAEADGYAPGEGCISLILKRLDEAVTDHDRIYGVITGISTAQSGTRRSISTPAVGPQAENMRRVLSMANINASDVDYLEAHGTGTPVGDAIETETLNLVFGKTHTEKKPLIVGSVKTNLGHTEEVSGLAGLCKVLLSMSHRIIPP

SEQ ID NO: 13497 - protein, 222 aa, Anaeromyces robustus
  Thiolase-like
VACASLPGRISFMYNLYGAAHTVDTACSSGLVAAHDAFKDLNIGETDLAIVNAAHCPFIGSGFSLLSIAQMVSRNCRCAAYDEAADGYVPGEGCVTVILKRKDDAIRDHNKIYGLINAAAVGQSGSRSSMSTPTVEGQSRIHKEVLKLAHLEPKDIDYMEGHGTGTSLGDRIEGEAINLIFKGTHSETRPLTLASVKTNIGHTEEVSGLASLVKVLLAMKNK

SEQ ID NO: 13498 - protein, 126 aa, Anaeromyces robustus
  Thiolase-like
QVAVVGIALRLPGGINTVDKYWDVLVNGKFCATPTGTNRHLHHYMTTAEHLKPGEHYVTKYCRYDSTPDAAPITDFDPMFFNMNPSEAAALDPKFRWVLETTYEALQDACINPDSLSGTRTNIYTA

SEQ ID NO: 13499 - protein, 212 aa, Anaeromyces robustus
  Thiolase-like
QIPTGWKPETYGVPKNIIDQVDPITLYVIVATVEALVSSGITDPYEFYEYVHVSEVGNCSGGGVGGMVSTHKEYFDRAFEKPVQSDILQESFINTMPAWINLLLLSSSGPIKTPVGACATAVESVDIGVETILSGKAKIVIVGGYDDFQEEGSYEFAQMKATSNSLDELAHGRDPSEMSRPATTTRSGFMEAQGAGHEILMKASLAIKMGVP

SEQ ID NO: 13500 - protein, 71 aa, Anaeromyces robustus
  Thiolase-like
TIVVTGYGEVGPYGNSRTRWEMEAYGKFSLEGCIEMAWIMGMIKYAKNKKTKDNKMYSGWVDTQTGEPVQD

SEQ ID NO: 13501 - protein, 68 aa, Anaeromyces robustus
  Thiolase-like
DPSEMSRPATTTRSGFMEAQGAGHEILMKASLAIKMGVPIYGIIAHTSTATDKEGRSVPAPGQGILTT

SEQ ID NO: 13502 - protein, 134 aa, Anaeromyces robustus
  Thiolase-like
LRGALAVFGLTIDDIDALSFHGTGTKANDTNESEVINKQFKHLGRSKGNVCPAIMQKYLTGHPKGAAASWMLNGMLQVIETGIIPGNRNADNIEEKLRKYEYICYPSRSIHTDGVKAGLLKSFGFGQVGGEVLV

SEQ ID NO: 13503 - protein, 20 aa, Anaeromyces robustus
  Thiolase-like
TPLRAAVNSFGFGGANANAI

SEQ ID NO: 13504 - protein, 370 aa, Anaeromyces robustus
  Thiolase-like
KIAIIGVGCRLPGDITTKEDFWNMLVTKRVVTSEIPADRWDREEWYSKEPIPGTIQTKHGGFLSNAYDFDNKYFSISQAEALEITPEQRWLCELAVETMEDANIRPEELKGSQTGVFVGSAGIDFGGNQLVNTLQMSAHTMTGLEPSIFSNRISYIFDLHGPSITSNTACSASMSSLSMACNAIAVGDCDKAFVAGSNFLPTPGGYVAFSQLRVVSKTGSCKPFDEKADGYARLEGACMLLIKDYEKAIRDNDKIYATIIGSGTNEDGRTLSITLPSSDAQCALMKWVCEKSNIKADTIDYVEAHGTGTPTGDPIEARSIGNAFGKVVRTPGSKPLPVGTVKGNVGHGEFLSGAIGLLKTSLMLFNKQLV

SEQ ID NO: 13505 - protein, 166 aa, Anaeromyces robustus
  Thiolase-like
NIGIIGLATYIPATTVSMTKLEAHDKCQGKYTISLGQKYMSLTAPNEDVVSMALNAVKRLMKKMNLKPSDIGRIQIGTETPVDLSKSVKTFIVEQFFEQGITDIEGVDNVNACFGSTAALFDTVAWMQSDFWNGRYAIVVGTDISQGEDIYHFLTGSSAVAVLIGP

SEQ ID NO: 13506 - protein, 227 aa, Anaeromyces robustus
  Thiolase-like
VEPNRGIFSNSTFDFYKPYGYKNHYPVVDGKYSIDCYLNSLVSCYEDLKKKSKSETEFLDHQFGVFHNSSVSLTRKGFNTLIEKEISKVLPNAEPHEKRQFISKIYKERVEASTLMTANMGCMYNASVLNGIISLNESLKPEDIGKRILVYSFGSGSVGALWSLRIDGLAEKDDLNNRLNNRKEISVDSYFKVRQLWLEDIKKFGRSYKKDQFELPIRDGDYYLSSV

SEQ ID NO: 13507 - protein, 381 aa, Anaeromyces robustus
  Thiolase-like
HYEKIAIIGMALRLPGAINNAKSLWMTLLKGKNCVVAPVKNRDLHTNYVNKPSNQLLPNEHNIPYFGCYDTKSNVAKPSQFDAEFFNCLPDEALSLDPRHRWILETTWEALENAGIPINSLKNTTTGVFVGINDDHEYSDLLEENGISIPISSHSNHPSDIAGRLSYFYNLYGPSYTMDTACSTGASAIHVACRSLQNRDCNLCMVTGVKYMYSSKSLSKACSARMISPHGRCATFDIDADGFVPGEGCVTYILKRLNDAIEDNDNILSVIIGSSSGQSGLRQSISAPSSEGQALNIRKAMEFAQVKPEDISYVEAHGTGTPLGDAMEIHALNEVYAGTHSKENPLIVGSIKTNIGHTCEVAGLAGLAKVIVSLQHKHIPR

SEQ ID NO: 13508 - protein, 219 aa, Anaeromyces robustus
  Thiolase-like
TELCSVAGRLSYFYKLYGPAISIDTACSTGATAVHVACRSIQMGECDLAIVSGARYLYYNDEFINTSHAKMTSPNNRCATFDESADGFASSEGCVTLILKRLDEAEENNDNIYGVILGSSNGQSGGRQSISVPSSEAQERNIRNAMKNANVSPKDISYIEAHGTGTPYGDALEIHAINQIFGHTHTQDSPLYIGSVKTNIGHTCEASGLAGLVKVLLSM

SEQ ID NO: 13509 - protein, 132 aa, Anaeromyces robustus
  Thiolase-like
DNLIAIVGIGLRLPGGINSTQKFWLSLIKGRNCLSNTPTDRQLHQGFVDMQKNPNKNLDINEHYIGKYGYYESVRGTAKPTDFDADFFECSKDEAIGMDVKQRWILETSWEALEDAGIDPSIIENSNTGIFV

SEQ ID NO: 13510 - protein, 219 aa, Piromyces finnis
  Thiolase-like
CAAASLPGRISFMYNLLGAAHTVDTACSSGLVATHDAVKDLNLGETDLAIVNAAHCPFMSSGFSLLSVAKMVSRNCRCAAYDEAADGYVPGEGCVTIILKRKDDAIRDHNKIYGLINAAAVGQSGSRASMSSPTVIGQTNIHKQVLKKAGVNPSDIDYMEGHGTGTKLGDRIEAEAINNVFKGSHSKERPLVLASVKTNIGHTEEVSGLASLVKVLLAM

SEQ ID NO: 13511 - protein, 130 aa, Piromyces finnis
  Thiolase-like
QNQVQIAVVGIALRLPGGINTVDKYWNSLVDGRFCISPIGTNRHLHHYMSKEENLKPGEHYIYNYGRYDSTPDAAPISDFDPMFFNMNPNEASALDPKFRWVLETTYEAFQDAGIDPDVLSGTNTSVYTA

SEQ ID NO: 13512 - protein, 374 aa, Piromyces finnis
  Thiolase-like
SSNKIAIIGMALRLPGAINNSKSLWMALAKGKDCVLPPVKTRDLHTRYANKSADQLELDEHYLPRIGCYDTRNSVAKPSEFDASFFNCLPDEAVALDPRHRWILETSWEALENAGIAPNSLKKTTTGVFIGINNEHEHEDLLHDCGIIPPLASHATAQSSIAGRLSYFYQLFGPSYTIDTACSTGSSALHSACQSLQCNDCNLSIVTGVKYMYSSKEFHKTCSARMTSPNGRCATFDASADGFAQSEGCVTFILKRFDDAVRDNDNILAVVLGSASGQSGLRQSISAPSSEGQTVSIKRAMEKAGITPEQVSFVEAHGTGTPLGDALEVHALNQVYGGSHTEENPLIVGSIKSNIGHTCEAAGLASIAKVIVAM

SEQ ID NO: 13513 - protein, 278 aa, Piromyces finnis
  Thiolase-like
LETSWEALENANIAPNSLENSSTGVFVGINDDHEYSDLMTECGIETSIASHGSSPSGIAGRLSYFYRLYGPSFTIDTACSTGATALHTACRSLQHHDCNLSIVSGVKYMYSSKNFYKTCAARMTSPHGRCATFDKDADGFVPSEGCVTFILKRLDDAIRDNDNILSVILSTSSGQSGLRQSISAPSSEGQAINMRKAMEFAGIKPEDVSYIEAHGTGTPLGDALEVHALNEIYAGSHTEENPLVVGSIKTNIGHTCETAGLAGIAKVIVSMQHKYIPK

SEQ ID NO: 13514 - protein, 105 aa, Piromyces finnis; identical to SEQ ID NO: 11972
  Thiolase-like

SEQ ID NO: 13515 - protein, 166 aa, Piromyces finnis
  Thiolase-like
NVGIIGLATYIPSSTVNMTKLEAHDNCQGKYTISLGQKYMSLTAPNEDVVSMALNAVKRLMKKMNLKPSDIGRIQIGTETPVDLSKSVKTFIVEQFFEQGITDIEGVDNVNACFGSTAALFDTVAWMQSDFWNGRYAIVVGTDISQGEDIYHFLTGSSAVALLIGP

SEQ ID NO: 13516 - protein, 227 aa, Piromyces finnis
  Thiolase-like
VEPERGIFSNSTFDFYKPYGYKNHYPVVDGKYSIDCYLSSLKSCYEQLKKKTGSETEFLDHQFSVFHNSSVSLTRKGFNTLIEQEISKVLPNAKIIEKRKFISNVYKERVEASTLMTANMGCMYNASVLNGIISLNESLTPEDIGKRVLVYSFGSGSVGALWTLRIDGLAEKDDLVNRLNSRNEVSVDTYFEIRKLWLEEIKKFGRSYKKDQFELQIREGDYYLSSV

SEQ ID NO: 13517 - protein, 370 aa, Piromyces finnis
  Thiolase-like
KIAIIGVGCRLPGDISTKEDFWNMLVTKRVVTSEIPSDRWDREEWFSEDPVPGTIQTKCGGFITNAYDFDNKYFSISQAEAFEITPEQRWLCELAVETMEDANIRPEELKGSQTGVFVGSAGIDFGGTQLANTLQMSAHTMTGLEPSIFSNRISYIFDLHGPSITSNTACSASMSSLSMACNAIAVGDCDKAFVAGSNFLPTPGGFVAFSQLRVVSKTGSCKPFDEKADGYARLEGACMLLIKDYEKAVRDNDKIYATIISSGTNEDGRTLSITLPSSDAQCALMQWVCEKSNIKADTIDYVEAHGTGTPTGDPIEARSIGNAFGKKVRSPNSKPLPVGTVKGNVGHGEFLSGAIGLLKVSLMLFNRQLV

SEQ ID NO: 13518 - protein, 117 aa, Piromyces finnis
  Thiolase-like
TGTPLGDAIETETLNKAFGGSHTEKKPLVVGSVKTNIGHTEEVSGLAGLTKVILSMSHRIIPPHLHLNTLNPKIDLSVIPMSIPQKKSIWKCPRGKKRIGLVSSFGLQGSVANAVIE

SEQ ID NO: 13519 - protein, 117 aa, Piromyces finnis; identical to SEQ ID NO: 13518
  Thiolase-like

SEQ ID NO: 13520 - protein, 239 aa, Piromyces finnis
  Thiolase-like
MVPIAVIGMGIRLPGGINTPTKYWNALVNGKDCISPTPNNRHLHHFLRPNCPHNELGPYDHYVHRAGYYDVVPDAAPITDFDPTFFNISPLEAKFTEPKFRWVYETVYEAFQDACIDISELNGSRTGIYCTVGGTFDYIGLTKAFVSGQTMTSQTMHGSAASSCAGRIAFNYGFIGPSDTVDTACSSGLNDVNNACKSLSCGDTDIAVASAVHHQYVSTQFHVISVAHMASQTGRCATF

SEQ ID NO: 13521 - protein, 93 aa, Piromyces finnis; identical to SEQ ID NO: 12672
  Thiolase-like

SEQ ID NO: 13522 - protein, 82 aa, Piromyces finnis
  Thiolase-like
NVGHGEYLSGIIGLIKSTLILHKNMIVPQTAFDTLNPKIECEKLGIRIANKIEKFPGQGRHRVAVNSFGFGGANANAIIEEE

SEQ ID NO: 13523 - protein, 345 aa, Piromyces finnis
  Thiolase-like
FAIIGTGIRLPGDINNKDDFWKVMIEKKVITGLTPEDRWDRDEWYCKTEKPGTIQTLYGGFIENAFDFDNKFFSISQKEALDATPEQRWLCELTVETIEDANINIDKFKGSNTGVFVGTSGIDYGSYVFSVPEKITKYTYSGIEPSIHANRVSYLFDLHGPSLSTNTACSSSLTALSIACNSMAAGDCEMAIVAGTNFFQAPANGVAYSQLRVVSKKGACRPFDSGADGYARLEGAGMVLLKPYEKAIRDNNKIYATILSTACNEDGKTASLTTPSSKAQYKLMKRVYEKGHIDPCTIDFIEAHGTGTAVGDPIEASSIGEAYGKINKANGNPAIPVGSVKGNVG

SEQ ID NO: 13524 - protein, 59 aa, Piromyces finnis
  Thiolase-like
TVVVTGYGEVGPYGNSRTRWEMEAYGKFSLEGCIEMAWIMGMIKYAKNKKTKDGKLYSG

SEQ ID NO: 13525 - protein, 212 aa, Piromyces finnis
  Thiolase-like
QIPTGWKPETYGVPKSIIDQVDPITLYVIVATVEALISSGITDPYEFYEYVHVSEVGNCSGGGVGGMTSNHKQYFDRVFEKPVQSDILQECFINTMPAWINLLLLSSSGPIKTPVGACATAVESVEIGLETILSGKAKIVIVGGYDDFQEEGSYEFAQMKATSNSLEELAHGRDPSEMSRPATTTRAGFMEAQGAGHEILMTASLAIKMGVP

SEQ ID NO: 13526 - protein, 136 aa, Piromyces finnis
  Thiolase-like
LRGALAVFGLTIDDIQALSFHGTSTKANDSNESEVFNKQFKHLGRTKGNACPVITQKYLTGHPKGAAASWMLNGMLQVIETGIIPGNRNADNIDEKLRKFEYLFYPSRSIHTDGVKAGLLKSFGFGQVGGEVLVIS

SEQ ID NO: 13527 - protein, 68 aa, Piromyces finnis
  Thiolase-like
DPSEMSRPATTTRAGFMEAQGAGHEILMTASLAIKMGVPIYGIIAHTSTATDKEGRSVPAPGQGILTT

SEQ ID NO: 13528 - protein, 136 aa, Piromyces finnis
  Thiolase-like
LRGALAAFGLTVDDIGVASFHGTGTKANDKNESDVFNKQFEHLGRTKGNACPVVCQKYLTGHGKGAAAAWMLNGVIQILQTGIVPGNRNADNIDPLLEKYEHLWFNNKTFKTPGVKAGLLKSFGFGQVGGEILVVH

SEQ ID NO: 13529 - protein, 68 aa, Piromyces finnis; identical to SEQ ID NO: 13527
  Thiolase-like

SEQ ID NO: 13530 - protein, 59 aa, Piromyces finnis; identical to SEQ ID NO: 13524
  Thiolase-like

SEQ ID NO: 13531 - protein, 212 aa, Piromyces finnis; identical to SEQ ID NO: 13525
  Thiolase-like

SEQ ID NO: 13532 - protein, 59 aa, Piromyces finnis; identical to SEQ ID NO: 13524
  Thiolase-like

SEQ ID NO: 13533 - protein, 212 aa, Piromyces finnis; identical to SEQ ID NO: 13525
  Thiolase-like

SEQ ID NO: 13534 - protein, 136 aa, Piromyces finnis; identical to SEQ ID NO: 13526
  Thiolase-like

SEQ ID NO: 13535 - protein, 68 aa, Piromyces finnis; identical to SEQ ID NO: 13527
  Thiolase-like

SEQ ID NO: 13536 - protein, 136 aa, Piromyces finnis; identical to SEQ ID NO: 13528
  Thiolase-like

SEQ ID NO: 13537 - protein, 68 aa, Piromyces finnis; identical to SEQ ID NO: 13527
  Thiolase-like

SEQ ID NO: 13538 - protein, 59 aa, Piromyces finnis; identical to SEQ ID NO: 13524
  Thiolase-like

SEQ ID NO: 13539 - protein, 212 aa, Piromyces finnis; identical to SEQ ID NO: 13525
  Thiolase-like

SEQ ID NO: 13540 - protein, 373 aa, Piromyces finnis
  Thiolase-like
PKFAVIGIGCHFPEGIESKESFWKMLEDGKCITKDIPKERWDKDEWYSKEPVQGTIQTKRGAFLENPYLFDNKYFYISMPEAKEMSPEQRWLLELTVETLEDANIKPETLKGSRTGVFIGSSGIDYLVTQISHANDINSHSPTGFELSILANRLSYVFDFQGPSISCNTACSSAFSALNIGLNAMITDDCEMAIVAGSNFMSCPGSFVAYSQLRVVSKDGSCKPFDEKADGYAKLEGAGMILVKPYEKAVRDGDKIYCAIVGCGSNEDGRSPSLTMPSYEAQYKLLTHVCEKSGINPTQIDYVEAHGTGTKVGDPIESHAIGDAYGRGKGIRGPNDPPVLVSSVKGNTGHGENSSGIVSIIKTSMMLYKRKLV

SEQ ID NO: 13541 - protein, 319 aa, Piromyces finnis
  Thiolase-like
KYAVIGVGCRFPGNIKSKEDFWEMLTTGRCLTSETPKDRWDSAEWYNKEPKRGTVQTTRGAFMEDAFYFDNKYFSISQNEAKEMSPEQRWLLELAVETFEDANINPKKLKGSRTGVFVGSSGMDFVAAQISHANDLTQHSATGLELSILANRISYYFDLNGPSICTNTACSASMTALNLAINSMITDDCDAALIAGTNLLFTPGSCVAYSQLRVVSVDGSCKPFDKRADGYSRVEGAGMLLIKPYEKAVRDGDKIYCAILGSSTNEDGHTPSLTMPSYDSQCKLLTHVCEKFDIDPASIDYVEAHGTGTAVGDPIEARS

SEQ ID NO: 13542 - protein, 37 aa, Piromyces finnis
  Thiolase-like
YPLIIGSSKGNTGHGEYSSGIIGMIKAVLMLHHRTMV

SEQ ID NO: 13543 - protein, 19 aa, Piromyces finnis
  Thiolase-like
TLRIAVNSFGFGGSNGNAI

SEQ ID NO: 13544 - protein, 382 aa, Piromyces finnis
  Thiolase-like
NKSNSIAIIGMGLRLPGAINSDKSLWSTLVKGRDCITAIPKDRKLHENYVDKQSSELNMGEHNVKRCGYYDSRSSGKKISQFDAEFFNCLPDEAIGLDPKHRWILETSWEALENAGISPESLENTDTGVFVGIGDQQEHVKFMQECQKEKVVAHHNSNPSAIAGRLSYFYKLYGPSVTVDTACSTGATALHTACRSMIFGDCNLSIVTASKFLFYSEEFEMTSKARMTSPSGRCATFDKNADGYVPAEGCVTFILKRLEDAERDKDHILGVILGTSSGQSGFRQSISVPSSEGQARNIERAMAVAGVQPSDISYIEAHGTGTPYGDAIEIQGINQVYAGSHTSEHPLVIGSIKTNIGHTAETAGLASIAKVLLAMKNKTIPR

SEQ ID NO: 13545 - protein, 271 aa, Neocallimastix californiae
  Thiolase-like_subgr
QVAVVGIALRLPGGINTVDKYWKSLENGRFCVSPTGTNRHLHHNMTHNEELKPGEHYIFNYCRYDSTPDAAPITDFDPMFFNMNPNEATVLDPKFRWVLETTYEVLQDAGINPDSLSGTHTNIYTAPGQVDEMNAYATNASPTGYSVLNGMSMHSCASASLPGRISFMYNLFGAAHTVDTACSSGLVAIHDAFKDLNIGETDLAIVNAAHCPFQSSSFSLLSIAKMVSRNCRCASYDEAADGYVPGEGCVSVILKRKDDAIRDHNKIYGLI

SEQ ID NO: 13546 - protein, 164 aa, Neocallimastix californiae
  Thiolase-like_subgr
TAVGQSGSRASMSTPTVLGQKYIHKKVLEKANLTPGDIDYMEGHGTGTKLGDRIEAEAINEVFKGTHSESRPLTLASVKTNIGHTEEVSGLASLVKVLLAMKHKTVPPHLHFNKPSPLIDFDSVPLHIPTQKEEWKPAEGKKRVALVSSYGLSGSVCDAIVEEY

SEQ ID NO: 13547 - protein, 164 aa, Neocallimastix californiae
  Thiolase-like_subgr
ITTSQSGIRPSISSPAVGPQVENIQKALQIANVSPADVDYVEAHGTGTQVGDAIETETLNIAFGGTHNAKKPLIVGSVKTNIGHTEEVSGLAGLCKVLLSMSHRTIPPHLHLKNLNPRIDTSVIPMTIPQKKCIWKSPRGKKRVGVVSSFGLQGSVANAVIEEF

SEQ ID NO: 13548 - protein, 274 aa, Neocallimastix californiae
  Thiolase-like_subgr
VPIAVVGMGLRLPGGINTPSKYWNALVNGKDCISPTPANRHLHQYLRPFCPPNELGPFDHYIHRAGYYDVTPDAAPISDFDPTFFNISPLEAKFTEPKFRWIYETVYEAFQDACINVSELNGTRTSVFTTVGSTADYIALTKAFTKVESMTSQTMHGSAASSCAGRISFNYGFIGPSDTIDTACSSGLNDCHNACKSLSMGDSDVAVVSAVHQQFVSTQFHVISVAHMASQIGRCATFDAEADGYAPGEGCISIILKRLDDAVTDHDHIYGVIT

SEQ ID NO: 13549 - protein, 259 aa, Neocallimastix californiae
  Thiolase-like_subgr
FAIIGIGCHFPEGIESKEAFWKMLEDARCITKDIPKDRWDKNEWYSKEPIQGTIQTKRGAFLKNPYLFDNKYFYISMPEAKEMSPEQRWLLELTVETLEDANIKPEAVRGSRTGVFIGSSGCDYLATQISHANDINSHSPTGFELSILANRLSYVFDLQGPSISCNTACSSAFSALNIGLNAMITDDCEMALVAGSNFMNCPGGFVAFSQLRVVSPDGSCKPFDEKANGYARLEGAGMVLIKPYEKAVRDGDKIYCAIV

SEQ ID NO: 13550 - protein, 167 aa, Neocallimastix californiae
  Thiolase-like_subgr
CGSNEDGRSPSLTMPSYEAQYKLLSHVCEKSGILPSEIDYVEAHGTGTKVGDPIESHAIGDAYGRSKGVRGPNDPPVLVSSVKGNTGHGENSSGIVSIIKTSLMLHKRKLVPTVAYHHMNPAIDAEKLGIKVCETLEDWKTPHTLHAAVNSFGFGGANTNTILEEVK

SEQ ID NO: 13551 - protein, 263 aa, Neocallimastix californiae
  Thiolase-like_subgr
MAFRLPGAISNSKSLWMALAKSRDCILPPVKTRDLHHGYVNKPANQLGPKEHYLARVGCYDVRPNVAKPSEFDADFFNCSPEEATALDPRHRWILETSWEALENAGIVPSSLKNTITGVFVGMNNDHEHEDLLKKCGKVPPLAAHATAQSSIAGRLSYFYELFGPSYTIDTACSTGSSALHSACQSMQCGDCDLSIVSGVKYMYSSDEFHKTCAARMTSPNSRCATFDASADGFAQSEGCVTFVLKRLEDAIRDKDNILSVIL

SEQ ID NO: 13552 - protein, 165 aa, Neocallimastix californiae
  Thiolase-like_subgr
SSSGQSGLRQSISAPSSEGQRITIQRAMKVAGITPDQVSYVEAHGTGTPLGDAIEVHALNQVYAGSHTEENPLVVGSIKSNIGHTCEAAGLAGIAKVIVAMKHNTIPKNIHFNELNPEIDLSVIPMKIPTKNLPWNSSEEGKPLIAQVSSFGLQGSIIVTFLEQY

SEQ ID NO: 13553 - protein, 258 aa, Neocallimastix californiae
  Thiolase-like_subgr
AVIGVGCRFPGNIKSKEDFWEMLTSGRCLTSEIPNDRWNTAEWYNKEPKRGTMQTTRGAFMEDAFYFDNKYFSISQNEAKEMSPEQRWLMELAVETFEDANINPKKLKGSRTGVFVGSSGMDFVSAQISHANDLTQHSATGLELSILANRISYFFDLNGPSICTNTACSASMTALNLAINSMITDDCDAALVAGTNLLFTPGSYVAYSQLRVVSTDGSCKPFDKNADGYSRIEGAGMILIKPYEKAVKDGDKIYCAIL

SEQ ID NO: 13554 - protein, 182 aa, Neocallimastix californiae
  Thiolase-like_subgr
SGTNEDGHTPSLTMPSYSSQCKLLTHVCEKFDIDPASIDYVEAHGTGTAVGDPIEARSIGYAYGRRVREGKQIKTTRPGETEEILDQPTFPLLIGSSKGNTGHGEYSSGIIGMIKAILMLYHRTMVPTIAHKEMNPAIDAEGLGIKVATKLEPWTTPHTLRIAVNSFGFGGSNGNAIFEEVV

SEQ ID NO: 13555 - protein, 225 aa, Neocallimastix californiae
  Thiolase-like_subgr
QFDRLVSGQLPTGWDPARYGIPKDIIEQVDIITCYCIVSAVEALVSAGITDPYEFYEYVHVSEVGNACGSGVGAELANRAIFKDRFLDKPLQSDILQETFVNTMSAWINLLLLSSSGPIRTPVGACASAVESVDIGIDTILSGKAKVVFVGGYDDFQEEGSYEFAQMKATSNSREEMAQGREPNEMSRPTASSRGGFMEAQGVGTQVLMPASLALKMGVPIYGIV

SEQ ID NO: 13556 - protein, 163 aa, Neocallimastix californiae
  Thiolase-like_subgr
GQSGFRQSISAPSYEGQAINIERAMKIAGIKPEQVSYVEAHGTGTPLGDAIEIHALNKVYGGSHTEENPLIVGSIKSNIGHTCEAAGLAGIAKVIVSMKHNLIPKNIHFNKLNPEIDISAIPMKIPTKHIPWTSPNEDEPLIAQVSSFGLQGSIIVTFLQQYI

SEQ ID NO: 13557 - protein, 264 aa, Neocallimastix californiae
  Thiolase-like_subgr
IGMALRLPGTINNSKSLWMSLAKGRDCVLPPVKTRDLHHGYVNKSFNELGPDEHYLPRIGCYDTRSNAAKPSEFDASFFNCTAEEAISLDPRHRWILETSWEALENAGIAPNSLENTLTGVYVGINNEHEHEDLLKECGIVPPVASHTLNQSSIAGRLSYFYKLFGPSFTIDTACSTGSSALHTACRAMQYGECDLSIVTGVKYMYSSKEFHKTCSAHMTSPNGRCATFDESADGFAQSEGCVTFILKRLDDAIRDNDNILTVI

SEQ ID NO: 13558 - protein, 260 aa, Neocallimastix californiae
  Thiolase-like_subgr
KIAIIGVGCRLPGDILTKDDFWNMLVTKRVVTTEIPADRWDRDEWYSDEPIPGTIQTKHGGFLTNAYDFDNKYFSISQAEALEITPEQRWLCELAVETMEDANIRPEELKGSQTGVFVGSAGIDFGGNQLVNTLQMSAHTMTGLEPSIFSNRISYIFDLHGPSITSNTACSASMSSLSMACNAIAVGDCDKAFVAGSNFLPSPGGYVAFSQLRVVSKTGSCKPFDEKADGYARLEGACMLLIKDYEKAVRDNDKIYACII

SEQ ID NO: 13559 - protein, 169 aa, Neocallimastix californiae
  Thiolase-like_subgr
SGTNEDGRTLSITMPSSDAQCTLMKWVCEKSNIKADTIDYVEAHGTGTPTGDPIEARSIGNAFGKAVRAPGSKPLPVGTVKGNVGHGEFLSGAIGLLKTSLMLFNKQLVPTAAFEKLNPKIDVSGLGIRVADKNEPMVKLNGKENTPLRAAVNSFGFGGANANAILESV

SEQ ID NO: 13560 - protein, 252 aa, Neocallimastix californiae
  Thiolase-like_subgr
NVGIIGLASYIPSTTVNMSKLEVHDNCQGKYTISLGQKYMSLTAPNEDVVSMALNAVKRLMKKMNLKPSDIGRIQIGTETPVDLSKSVKTFIVEQFFDQGITDIEGVDNVNACFGSTAALFDTVAWMQSEFWNGRYAIVVGTDISQGEDIYHFLTGSSAVAVLIGPNANLVVEPNRGIFSNSTFDFYKPYGYKNHYPVVDGKYSIKCYLDSLKSCYEDLKKKTKSETEFLDHQFGVFHNSSVSLTRKGFNTL

SEQ ID NO: 13561 - protein, 265 aa, Neocallimastix californiae
  Thiolase-like_subgr
EAEQFKKKHGDRVDIFENGESGQWIVKIKKGSTIYIPKALQFDRTVAGQIPTGWKPETYGIPKSIIDQVDPITLYVIVATVEALVSSGITDPYEFYEYVHVSEVGNCSGGGVGGMVSNRKQYFERLFEKPVQNDILQECFINTMPAWINLLLLSSSGPIKTPVGACATAVESVEIGLETILSGKAKIVIVGGYDDFQEEGSYEFANMKATSNSLEELAHGRDPSEMSRPATTTRGGFMESQGAGHEILMTASLAIKMGVPIYGII

SEQ ID NO: 13562 - protein, 130 aa, Neocallimastix californiae
  Thiolase-like_subgr
LRGALAVFGLTIDDIEALSFHGTGTKANDTNESEVINKQFKHLGRSKGNVCPAIMQKYLTGHPKGAAASWMLNGMLQVIETGIIPGNRNADNIEEKLRKFEYIYFPSRSIHTDGIKAGLLKSFGFGQVGG

SEQ ID NO: 13563 - protein, 164 aa, Neocallimastix californiae
  Thiolase-like_subgr
TSSGQSGLRQSISAPSSDGQVLNLKRALKFAGVDPSEVSFVEAHGTGTPLGDAIEVDALNQVYGGSHTEENPLVIGSVKTNIGHTNEAAGLAGMAKVILAMQHKYIPKNLHFNTLNPEIDIHSIPIQIATKTMPWETQDNKPRIAQVSSFGLQGSIVHIILQEY

SEQ ID NO: 13564 - protein, 263 aa, Neocallimastix californiae
  Thiolase-like_subgr
GMALRLPGAINNSKSFWMSLAKGRDCVLAPVKDRKLHLGYVDKPSNLLGENEHNIPKCGCYDSRSNAAKPSEFDAEFFNCLPEEVNSMDPRQRWVLETSWEAFENAGIAPNTLENTTTGVFVGVNDDHDYQDLLKENGIAQPISAHSTPSGIAGRLSYFYKLFGPSFTIDTACSTGASALHSACRSLQFGDCDLSVVSGVKYLYSASEFHRTSVARMTSPHGRCATFDKDADGFAPGEGCVTFILKRLEDAVRDGDNILSVIL

SEQ ID NO: 13565 - protein, 258 aa, Neocallimastix californiae
  Thiolase-like_subgr
FAIIGTGIRLPGEINNKDDFWKVMTDKKVITGLIPEDRWDREEWYSKVEKPGTIQTLHGGFIENAFDFDNKYFGISQNEALDATPEQRWLCELTVETVEDANMDMDDFKGSHTGVFVGTSGMDYGSYVFSVPEKITKYTYSGIEPSIHANRVSYLFNLHGPSLSTNTACSSSMTALSIACNSMAAGDCEMALVAGTNFFQAPANGVAYSQLRVVSKKGACRPFDIGADGYARLEGAAMVLLKPYEKAIKDNNRIYATI

SEQ ID NO: 13566 - protein, 165 aa, Neocallimastix californiae
  Thiolase-like_subgr
TACNEDGKTSSLTTPSSEAQCQLMKRVYSKGHIDPCTIDFVEAHGTGTSVGDPIEARSIGEAYGKVNKANGHPLLPVGSVKGNVGHGEYLSGIVGLIKGALILHKNTIVPQTAFETLNPKIHCDELGIRIADKVEPLPGKGRHRAAVNSFGFGGANANVILEEEP

SEQ ID NO: 13567 - protein, 264 aa, Neocallimastix californiae
  Thiolase-like_subgr
GMGLRLPGAINNEKTLWSALVKGRDCVSNIPKDRKLHESYVNKPSNELNPGEHNVKKCGYYDSRTSGEKVSQFDAEFFNCLPEEAIGLDPKHRWILETSWEALENAGISPDSLEDSNTGVFVGIGDQQDHAQFMKECHRKKVVSYHNSNPSAIAGRLSYFYKLYGPSVTVDTACSTGATALHTACRSMIYGDCRLAMVTASKYLFYPEEFEMTSKARMTSPNGRCATFDKDADGYAPAEGCVTFILKCLEDAERDKDHILGVIL

SEQ ID NO: 13568 - protein, 164 aa, Neocallimastix californiae
  Thiolase-like_subgr
TSSGQSGFRQSISVPSFEGQARNIKRVMEIAGVNPSDISYVETHGTGTPYGDAIEIQGINQVYAGSHTPEHPLVIGSIKTNIGHTAETSGLAGIAKVLVAMKNKTIPRHLHFKTLNPEIDLKSVPLAIPTHNMKWETEEGKPRTALVSSYGLQGSAVNIILQEY

SEQ ID NO: 13569 - protein, 164 aa, Neocallimastix californiae
  Thiolase-like_subgr
GQSGLRQSISAPSSEGQAINMRKAMKFAGIKPEDVSYVEAHGTGTPLGDALEVHALNEIYGGSHTEENPLVVGSIKTNIGHTCETAGLAGIAKVIVSMQHKHIPRNLHFNTLNPEIDIKSIPIQIPTKTLPWNSTEPNKPLIAQVSSYGLQGSIVHVFLQEYIP

SEQ ID NO: 13570 - protein, 264 aa, Neocallimastix californiae
  Thiolase-like_subgr
IGMGLRLPGAINSAKSLWLALAKGKDCVLPPIKTRDLHRNYVNKPSDQLDPTEHNIPRLGLYDTRNSVAKPSQFDAKFFNCLPDEALALDPRHRWILETSWEALENAGIPPNSLENSSTGVFVGINDDHEYSDLLTECGVKSPIAAHGQSPSGIAGRLSYFYRLYGPSFTMDTACSTGASALHTACRSLQCGDCDLSIVSGVKFMYSSKDFYMTCSARMTSPHGRCATFDKDADGFVPGEGCVTFILKRLEDAVRDNDHILSVV

SEQ ID NO: 13571 - protein, 130 aa, Neocallimastix californiae
  Thiolase-like_subgr
LRGALAVFGLTMDDIDALSFHGTGTKANDTNESEVINKQFKHLGRSKGNVCPAIMQKYLTGHPKGAAASWMLNGMLQVIETGIIPGNRNADNIEEKLRKFDYIYFPSRSIHTDGVKAGLLKSFGFGQVGG

SEQ ID NO: 13572 - protein, 274 aa, Neocallimastix californiae
  Thiolase-like_subgr
LPGFECSKEEAEQFKRKHGDRVDIFENGESGQWNVKFKKGSTIYIPKALQFDRTVAGQIPTGWKPETYGIPKSIIDQVDPVTLYVIVATVEALINSGITDPYEFYEYVHVSEVGNCSGGGVGGMLSSRKEYFERAFEKPIQSDILQECFINTMPAWINLLLLSSSGPIKTPVGACATAVESVEIGLETILSGKAKIVIVGGYDDFQEEGSYEFANMKATSNALDELAHGRDPSEMSRPGTTTRGGFMESQGAGHEILMTASLAIKMGVPIYGII

SEQ ID NO: 13573 - protein, 271 aa, Neocallimastix californiae
  Thiolase-like_subgr
QVAVVGIALRLPGGINTVDKYWKSLESGRFCISPTGTNRLLHHNLTHNEHLNPGEHYIFNYCRYDSTSDVSPITDFDPLFFNMNPSEATVLDPKFRWVLETTYEAFQDAGINPDTLSGTRTNVYTAPGQVDEMNTYTIDASPTGYSILNGMSMHSCAAASLPGRISFMYNLYGAAHTVDTACSSGLVATHDAFKDLNIGETDLAIVNAAHCPFQSSGFSLLSVAKMVSRNCRCAAYDEAADGYVPGEGCVSIILKRKDDAIRDHNKIYGLI

SEQ ID NO: 13574 - protein, 164 aa, Neocallimastix californiae
  Thiolase-like_subgr
TAVGQSGSRASMSTPSAIGQKIIHEEVLKNANLTPKDIDYMEGHGTGTKLGDRIEGEAINEVFKGSHSESRPLTLASVKTNIGHTEEVSGLASLVKVLLAMKYKTIPPHLHFHKPSSSIDFDSVPLHIPTQKEEWKAHDGKNRIALVSSYGLSGSVCDAVVEEY

SEQ ID NO: 13575 - protein, 165 aa, Neocallimastix californiae
  Thiolase-like_subgr
SSNGQSGGRQSISVPSSEAQVRNIKNALKDAHVSPKDISFVEAHGTGTPYGDAIEIHALNQIFKDSHSKKSPLYIGSVKTNIGHTCEAAGLAGIVKVLLSMKHNVIPKHINFKKLNPEIDLSMVPFCIPSQKNIRWTSPDPSKPLIAEVSSYGLQGSITNVILQQ

SEQ ID NO: 13576 - protein, 286 aa, Neocallimastix californiae
  Thiolase-like_subgr
NDCQNRIAIVGIGLRLPGGINSTKKFWFSLIKGKNCLSATPTDRELHLGMVDMSKKPPEYRLNKNEHYVCRYGIYDSHYASSGVKYTDFDANFFDCSTEEAISMDVKQRWMLETSWEALEDAGIDPSSIENSDTGVFIGMNNCYHQTKLLSSKKATNISSSFNPTTLHCTDLSSVAGRISYFYKIYGPAISMDTACSTGATALHTAYRSMQYGECDLAIVSGARFLYYNDEFINTSHAKMASPNGRCATFDEDADGFAPAEGCVTLILKRLDRAEENNDNIYGILL

SEQ ID NO: 13577 - protein, 165 aa, Neocallimastix californiae; identical to SEQ ID NO: 13575
  Thiolase-like_subgr

SEQ ID NO: 13578 - protein, 286 aa, Neocallimastix californiae; identical to SEQ ID NO: 13576
  Thiolase-like_subgr

SEQ ID NO: 13579 - protein, 165 aa, Neocallimastix californiae
  Thiolase-like_subgr
SSNGQSGGRQSISVPSSEAQVRNIRNALMDAQISPKDISYIEAHGTGTPYGDALEIHALNQVFGESHTKNSPLYIGSVKTNIGHTCEAAGLAGIVKVLLSMKHQIIPKHINFKKLNPEIDLETIPLCIPSQKNIHWTSSDPSKPLIAQISSYGLQGSVTNIILQQ

SEQ ID NO: 13580 - protein, 285 aa, Neocallimastix californiae
  Thiolase-like_subgr
SNHNRIAIVGIGLRLPGGINSTKKFWHSLLQGKNCLSTTPVDRQLHLGMIDMAKQQPGYKLNKNEHYIHKYGYYDSIHTASIAKPTKFDANFFECTNEEAIGMDVKQRWMLETSWEALEDAGIDPSTLENSNTGVFIGMNNSNHHIKLLSSEKATNVGPNFSSVTLHGTDLSSAAGRISYFYKLYGPAISIDTACSTGATALHTAYRSMQYGDCDLAIVSGARFLYYNDEFINISHAKMTSPKGRCATFDESADGFAPAEGCVTLILKRLDDAEESNDDIYGILL

SEQ ID NO: 13581 - protein, 165 aa, Neocallimastix californiae
  Thiolase-like_subgr
WEALENAGIAPNSLENTLTGVYVGINNEHEHEDLLKKCGIVPPLGSHTLNQSSIAGRLSYFYKLFGPSFTIDTACSTGSSALHIACNAMKRGECDLSIVTGVKYMYSSKEFHKTCSAHMTSPKGRCATFDASADGFAQSEGCVTFVLKRLDDAIRDKDNILTVIL

SEQ ID NO: 13582 - protein, 64 aa, Neocallimastix californiae
  Thiolase-like_subgr
SVSGQSGLRQSISAPSYEGQALNIERAMKIAGISPDQVSYVEAHGTGTPLGDAIEIHALNEVYA

SEQ ID NO: 13583 - protein, 225 aa, Anaeromyces robustus
  Thiolase-like_subgr
QFDRLVSGQLPTGWDPARYGIPKDIIEQVDPITCYCIVSAVEALVSAGITDPYEFYEYVHVSEVGNACGSGVGAEIANRAIFKDRFLDKPLQSDILQETFVNTMSAWINLLLLSSSGPIRTPVGACASAVESVDIGIDTILSGKAKVVFVGGYDDFQEEGSYEFAQMKATSNSREEMAQGREPDEMSRPTASSRGGFMESQGVGTQVLMPASLALKMGVPIYGII

SEQ ID NO: 13584 - protein, 126 aa, Anaeromyces robustus
  Thiolase-like_subgr
LRGALAAFGLTVDDIGVASFHGTGTKANDKNESDVFNKQFEHLGRTKGNACPVVCQKYLTGHGKGAAAAWMLNGVIQIIQTGIIPGNRNADNIDPLLEKFDHLWFNNKTFKTPGVKAGLLKSFGFG

SEQ ID NO: 13585 - protein, 166 aa, Anaeromyces robustus
  Thiolase-like_subgr
TSSGQSGIRQSISAPSSDGQVINLKRALHFAGVDPSDISFVETHGTGTPLGDAIEVNALNQVYKGTHTSENPLIIGSVKTNIGHTTEVAGLAGVAKVILSMQHKYIPKNLHFNTLNPEIDIESIPIQIATKTIPWENKNNKPRIAQVSSFGLQGSIVHIILQEYLP

SEQ ID NO: 13586 - protein, 264 aa, Anaeromyces robustus
  Thiolase-like_subgr
IGMALRLPGAINNAKSFWMALAKGKDCISTPVKDRKLHLGYVNKPSHLLNENEHNIPRCGCYDSRSNVAKPSEFDAEFFNCLPEEAMALDPRHRWILETSWEALENSGIAPNSLENTITGVFLGINDSHDYHDLMKENGITPPIAAHSTPSGIVGRLSYFYKLFGPSFTIDTACSTGASALHSACRSLQFGDCDLSIVSGVKYLYTSNDFHRTSIARMTSPKGRCATFDKDADGFVPSEGCVTFILKRYEDAIRDHDNILSVIL

SEQ ID NO: 13587 - protein, 167 aa, Anaeromyces robustus
  Thiolase-like_subgr
TSSGQSGIRQSISAPSSDGQVINLKRALHFAGVNPSDISFVETHGTGTPLGDAIEVNALNQVYKGTHTSENPLVIGSVKTNIGHTTEVAGLAGVAKVILSMQHKYIPKNLHFNTLNPEIDIESIPIQIATKTIPWENKNNKPRIAQVSSFGLQGSIVHIILQEYIPE

SEQ ID NO: 13588 - protein, 264 aa, Anaeromyces robustus
  Thiolase-like_subgr
IGMALRLPGAINNAKSFWMALAKGKDCVTTPVKDRKLHLGYVDKPSHLLGENEHNIPRCGCYDTRSNVAKPSEFDAEFFNCLPEEAMALDPRHRWILETSWEALENSGIAPNSLENTITGVFLGINDSHDYHDLMKENGITPPIAAHSTPSGIVGRLSYFYKLFGPSFTIDTACSTGASALHSACRSLQFGDCDLSIVSGVKYLYTSNDFHRTSIARMTSPKGRCATFDKDADGFAPGEGCVTFILKRYEDAIRDHDNILSVIL

SEQ ID NO: 13589 - protein, 259 aa, Anaeromyces robustus
  Thiolase-like_subgr
FAIIGIGCHFPEGIESKEDFWQMLEDARCITKDIPKERWDKDEWYSEEPIQGTIQTKRGAFLKNPYLFDNKYFYISMPEAKEMSPEQRWLLELTVETLEDANIKPETLKGTRTGVFIGSSGCDYLATQISHANDINSHSPTGFELSILANRLSYVFDLQGPSISCNTACSSAFSALNIGLNAMITDDCEMALVAGSNFMNCPGGFVAFSQLRVVSPDGSCKPFDEKANGYARLEGAGMVLIKPYEKAVRDGDKIYCAIV

SEQ ID NO: 13590 - protein, 167 aa, Anaeromyces robustus
  Thiolase-like_subgr
CGSNEDGRSPSLTMPSYEAQYKLLTHVCEKSGIHPTQIDYVEAHGTGTKVGDPIESRAIGDAYGKSKGIRGPNDPPILISSVKGNTGHGENSSGIVSIIKTSMMLHKRRLVPTVAYHHMNPAINAEKLGIKVCETLEDWKTPHLLHAAVNSFGFGGANTNTILEEVP

SEQ ID NO: 13591 - protein, 167 aa, Anaeromyces robustus
  Thiolase-like_subgr
TSSGQSGLRQSISAPSSEGQAINIKRAMEIADIKPEDVSYVEAHGTGTPLGDALEIHSLNQVYAGSHNEENPLVVGSVKTNIGHTGEVAGLASIAKVILAMQHKHIPKNLHFNTLNPEIDIESIPIKIPTKTIPWTSPVPNKPLIAQVSSFGLQGSIVHLFLEEYIP

SEQ ID NO: 13592 - protein, 263 aa, Anaeromyces robustus
  Thiolase-like_subgr
MSLRLPGSINSAKSFWMALAKGKNCVLPPVKNRDLHHGYVNKPSDQLNPGEHNIPYIGCYDTRSNVAKPSQFDAEFFNCLPDEALALDPRHRWVLETSWEALENAGIPPNSLEDSLTGVFVGMSQDHEYADLLAERNIIAPIAAHSNTQSGIAGRLSYFYRLYGPSLTMDTACSTGGSAIHTAVRSLQNRDCNLSIVSCVRYMYTSKTFYKTCAARMTSPHGRCATFDKDADGFASGEGCVCFVLKRLDDAIRDNDHILSVII

SEQ ID NO: 13593 - protein, 164 aa, Anaeromyces robustus
  Thiolase-like_subgr
ISTAQSGTRRSISTPAVGPQAENMRRVLSMANINASDVDYLEAHGTGTPVGDAIETETLNLVFGKTHTEKKPLIVGSVKTNLGHTEEVSGLAGLCKVLLSMSHRIIPPHLHLKNLNPRIDLSVIPMTIPQKKCIWKSPRGKKRIGVVSSFGLQGSIANAVVEEF

SEQ ID NO: 13594 - protein, 273 aa, Anaeromyces robustus
  Thiolase-like_subgr
PIAVIGMGIRLPGGINTPGKYWSALVSGRDCTSPTPTNRHLHHYLKPGCPANELGPMEHYIHRGGFYDTTPDAAPLSDFDPTFFNISPLEAKATDPKFRWVYETVYEAFQDACINISELNGSRTSVYCTVGQILDYVSVARAFNKSENMTSQTMHGSNPSSCAGRIAFNYGFTGPSDTIDTACSSGLNDVNNACKALSCGDTDLAVVSAVHQQIIGTQFHVISVAQMASHLGRCATFDAEADGYAPGEGCISLILKRLDEAVTDHDRIYGVIT

SEQ ID NO: 13595 - protein, 163 aa, Anaeromyces robustus
  Thiolase-like_subgr
AVGQSGSRSSMSTPTVEGQSRIHKEVLKLAHLEPKDIDYMEGHGTGTSLGDRIEGEAINLIFKGTHSETRPLTLASVKTNIGHTEEVSGLASLVKVLLAMKNKTVPPHLHFHNPNPSIDFKSVPLHIPTQVEEWKPVEGKKRVALVSSYGLSGSVCDAVVEEY

SEQ ID NO: 13596 - protein, 271 aa, Anaeromyces robustus
  Thiolase-like_subgr
QVAVVGIALRLPGGINTVDKYWDVLVNGKFCATPTGTNRHLHHYMTTAEHLKPGEHYVTKYCRYDSTPDAAPITDFDPMFFNMNPSEAAALDPKFRWVLETTYEALQDACINPDSLSGTRTNIYTAPGQVHEMNNYTTSASPTGFSVLNGQSMHGVACASLPGRISFMYNLYGAAHTVDTACSSGLVAAHDAFKDLNIGETDLAIVNAAHCPFIGSGFSLLSIAQMVSRNCRCAAYDEAADGYVPGEGCVTVILKRKDDAIRDHNKIYGLI

SEQ ID NO: 13597 - protein, 265 aa, Anaeromyces robustus
  Thiolase-like_subgr
EAEQFKKKHGDHIDIFENTESGQWIVKVKKGSTIFIPKALQFDRTVAAQIPTGWKPETYGVPKNIIDQVDPITLYVIVATVEALVSSGITDPYEFYEYVHVSEVGNCSGGGVGGMVSTHKEYFDRAFEKPVQSDILQESFINTMPAWINLLLLSSSGPIKTPVGACATAVESVDIGVETILSGKAKIVIVGGYDDFQEEGSYEFAQMKATSNSLDELAHGRDPSEMSRPATTTRSGFMEAQGAGHEILMKASLAIKMGVPIYGII

SEQ ID NO: 13598 - protein, 130 aa, Anaeromyces robustus
  Thiolase-like_subgr
LRGALAVFGLTIDDIDALSFHGTGTKANDTNESEVINKQFKHLGRSKGNVCPAIMQKYLTGHPKGAAASWMLNGMLQVIETGIIPGNRNADNIEEKLRKYEYICYPSRSIHTDGVKAGLLKSFGFGQVGG

SEQ ID NO: 13599 - protein, 259 aa, Anaeromyces robustus
  Thiolase-like_subgr
IAIIGVGCRLPGDITTKEDFWNMLVTKRVVTSEIPADRWDREEWYSKEPIPGTIQTKHGGFLSNAYDFDNKYFSISQAEALEITPEQRWLCELAVETMEDANIRPEELKGSQTGVFVGSAGIDFGGNQLVNTLQMSAHTMTGLEPSIFSNRISYIFDLHGPSITSNTACSASMSSLSMACNAIAVGDCDKAFVAGSNFLPTPGGYVAFSQLRVVSKTGSCKPFDEKADGYARLEGACMLLIKDYEKAIRDNDKIYATII

SEQ ID NO: 13600 - protein, 169 aa, Anaeromyces robustus
  Thiolase-like_subgr
SGTNEDGRTLSITLPSSDAQCALMKWVCEKSNIKADTIDYVEAHGTGTPTGDPIEARSIGNAFGKVVRTPGSKPLPVGTVKGNVGHGEFLSGAIGLLKTSLMLFNKQLVPTAAYEKLNPKIDVNGLGIRVADKNEPMIKINGKVNTPLRAAVNSFGFGGANANAILEAV

SEQ ID NO: 13601 - protein, 254 aa, Anaeromyces robustus
  Thiolase-like_subgr
NIGIIGLATYIPATTVSMTKLEAHDKCQGKYTISLGQKYMSLTAPNEDVVSMALNAVKRLMKKMNLKPSDIGRIQIGTETPVDLSKSVKTFIVEQFFEQGITDIEGVDNVNACFGSTAALFDTVAWMQSDFWNGRYAIVVGTDISQGEDIYHFLTGSSAVAVLIGPNANLVVEPNRGIFSNSTFDFYKPYGYKNHYPVVDGKYSIDCYLNSLVSCYEDLKKKSKSETEFLDHQFGVFHNSSVSLTRKGFNTLIE

SEQ ID NO: 13602 - protein, 272 aa, Anaeromyces robustus
  Thiolase-like_subgr
HYEKIAIIGMALRLPGAINNAKSLWMTLLKGKNCVVAPVKNRDLHTNYVNKPSNQLLPNEHNIPYFGCYDTKSNVAKPSQFDAEFFNCLPDEALSLDPRHRWILETTWEALENAGIPINSLKNTTTGVFVGINDDHEYSDLLEENGISIPISSHSNHPSDIAGRLSYFYNLYGPSYTMDTACSTGASAIHVACRSLQNRDCNLCMVTGVKYMYSSKSLSKACSARMISPHGRCATFDIDADGFVPGEGCVTYILKRLNDAIEDNDNILSVII

SEQ ID NO: 13603 - protein, 165 aa, Anaeromyces robustus
  Thiolase-like_subgr
SSSGQSGLRQSISAPSSEGQALNIRKAMEFAQVKPEDISYVEAHGTGTPLGDAMEIHALNEVYAGTHSKENPLIVGSIKTNIGHTCEVAGLAGLAKVIVSLQHKHIPRNLHFNKPNPDFDLNSIPIKIPTKTLPWNSLKPGKPLIAQVSSFGLQGSIIHLIIEEY

SEQ ID NO: 13604 - protein, 282 aa, Anaeromyces robustus
  Thiolase-like_subgr
LTDNLIAIVGIGLRLPGGINSTQKFWLSLIKGRNCLSNTPTDRQLHQGFVDMQKNPNKNLDINEHYIGKYGYYESVRGTAKPTDFDADFFECSKDEAIGMDVKQRWILETSWEALEDAGIDPSIIENSNTGIFVGMNNCNHHVKLMASKEATNINSNYNSITTHGTELCSVAGRLSYFYKLYGPAISIDTACSTGATAVHVACRSIQMGECDLAIVSGARYLYYNDEFINTSHAKMTSPNNRCATFDESADGFASSEGCVTLILKRLDEAEENNDNIYGVIL

SEQ ID NO: 13605 - protein, 165 aa, Anaeromyces robustus
  Thiolase-like_subgr
SSNGQSGGRQSISVPSSEAQERNIRNAMKNANVSPKDISYIEAHGTGTPYGDALEIHAINQIFGHTHTQDSPLYIGSVKTNIGHTCEASGLAGLVKVLLSMKHQLIPKHINFRKINPEINLDLVPLNIPYQKCIPWKSSDPTKPLIAEVSSYGLQGSVTNIILQQ

SEQ ID NO: 13606 - protein, 274 aa, Piromyces finnis
  Thiolase-like_subgr
NQVQIAVVGIALRLPGGINTVDKYWNSLVDGRFCISPIGTNRHLHHYMSKEENLKPGEHYIYNYGRYDSTPDAAPISDFDPMFFNMNPNEASALDPKFRWVLETTYEAFQDAGIDPDVLSGTNTSVYTAPGQVDEMNRYAILASDTGFSVLNGMSMHSCAAASLPGRISFMYNLLGAAHTVDTACSSGLVATHDAVKDLNLGETDLAIVNAAHCPFMSSGFSLLSVAKMVSRNCRCAAYDEAADGYVPGEGCVTIILKRKDDAIRDHNKIYGLI

SEQ ID NO: 13607 - protein, 164 aa, Piromyces finnis
  Thiolase-like_subgr
AVGQSGSRASMSSPTVIGQTNIHKQVLKKAGVNPSDIDYMEGHGTGTKLGDRIEAEAINNVFKGSHSKERPLVLASVKTNIGHTEEVSGLASLVKVLLAMKNKTVAPHLHFKNPSPLIDFDSVPLHIPTQKEEWKPAEGKKRTALISSYGLSGSVSDVIVEEYI

SEQ ID NO: 13608 - protein, 168 aa, Piromyces finnis
  Thiolase-like_subgr
SASGQSGLRQSISAPSSEGQTVSIKRAMEKAGITPEQVSFVEAHGTGTPLGDALEVHALNQVYGGSHTEENPLIVGSIKSNIGHTCEAAGLASIAKVIVAMKYNLIPRNIHFNELNPEIDLSTIPMKIPTKTLPWNPPNDDTPLIAQVSSFGLQGSIIVTFLEQYVPE

SEQ ID NO: 13609 - protein, 264 aa, Piromyces finnis
  Thiolase-like_subgr
GMALRLPGAINNSKSLWMALAKGKDCVLPPVKTRDLHTRYANKSADQLELDEHYLPRIGCYDTRNSVAKPSEFDASFFNCLPDEAVALDPRHRWILETSWEALENAGIAPNSLKKTTTGVFIGINNEHEHEDLLHDCGIIPPLASHATAQSSIAGRLSYFYQLFGPSYTIDTACSTGSSALHSACQSLQCNDCNLSIVTGVKYMYSSKEFHKTCSARMTSPNGRCATFDASADGFAQSEGCVTFILKRFDDAVRDNDNILAVVL

SEQ ID NO: 13610 - protein, 164 aa, Piromyces finnis
  Thiolase-like_subgr
GQSGLRQSISAPSSEGQAINMRKAMEFAGIKPEDVSYIEAHGTGTPLGDALEVHALNEIYAGSHTEENPLVVGSIKTNIGHTCETAGLAGIAKVIVSMQHKYIPKNLHFNTLNPEIDVKLIPMKIPTKNLPWNSSDPNKPLIAQVSSYGLQGSIIHVFLEEYIP

SEQ ID NO: 13611 - protein, 168 aa, Piromyces finnis
  Thiolase-like_subgr
LETSWEALENANIAPNSLENSSTGVFVGINDDHEYSDLMTECGIETSIASHGSSPSGIAGRLSYFYRLYGPSFTIDTACSTGATALHTACRSLQHHDCNLSIVSGVKYMYSSKNFYKTCAARMTSPHGRCATFDKDADGFVPSEGCVTFILKRLDDAIRDNDNILSVI

SEQ ID NO: 13612 - protein, 100 aa, Piromyces finnis
  Thiolase-like_subgr
IGMGLRLPGAINNAKSLWMSLAKGKDCVLPPLKNRDLHRNYVNKPSELLDPSEHNIPRLGLYDTRSNVAKPSQFDAAFFNCLPDEALSLDPRHRWILETS

SEQ ID NO: 13613 - protein, 253 aa, Piromyces finnis
  Thiolase-like_subgr
NVGIIGLATYIPSSTVNMTKLEAHDNCQGKYTISLGQKYMSLTAPNEDVVSMALNAVKRLMKKMNLKPSDIGRIQIGTETPVDLSKSVKTFIVEQFFEQGITDIEGVDNVNACFGSTAALFDTVAWMQSDFWNGRYAIVVGTDISQGEDIYHFLTGSSAVALLIGPNANLVVEPERGIFSNSTFDFYKPYGYKNHYPVVDGKYSIDCYLSSLKSCYEQLKKKTGSETEFLDHQFSVFHNSSVSLTRKGFNTLI

SEQ ID NO: 13614 - protein, 156 aa, Piromyces finnis
  Thiolase-like_subgr
SGTNEDGRTLSITLPSSDAQCALMQWVCEKSNIKADTIDYVEAHGTGTPTGDPIEARSIGNAFGKKVRSPNSKPLPVGTVKGNVGHGEFLSGAIGLLKVSLMLFNRQLVPTAAFEKLNPKIDVDGLGIRVADKNEPLVKINGKINTPFRAAVNSFG

SEQ ID NO: 13615 - protein, 258 aa, Piromyces finnis
  Thiolase-like_subgr
IAIIGVGCRLPGDISTKEDFWNMLVTKRVVTSEIPSDRWDREEWFSEDPVPGTIQTKCGGFITNAYDFDNKYFSISQAEAFEITPEQRWLCELAVETMEDANIRPEELKGSQTGVFVGSAGIDFGGTQLANTLQMSAHTMTGLEPSIFSNRISYIFDLHGPSITSNTACSASMSSLSMACNAIAVGDCDKAFVAGSNFLPTPGGFVAFSQLRVVSKTGSCKPFDEKADGYARLEGACMLLIKDYEKAVRDNDKIYATI

SEQ ID NO: 13616 - protein, 120 aa, Piromyces finnis
  Thiolase-like_subgr
TGTPLGDAIETETLNKAFGGSHTEKKPLVVGSVKTNIGHTEEVSGLAGLTKVILSMSHRIIPPHLHLNTLNPKIDLSVIPMSIPQKKSIWKCPRGKKRIGLVSSFGLQGSVANAVIEEFK

SEQ ID NO: 13617 - protein, 120 aa, Piromyces finnis; identical to SEQ ID NO: 13616
  Thiolase-like_subgr

SEQ ID NO: 13618 - protein, 239 aa, Piromyces finnis; identical to SEQ ID NO: 13520
  Thiolase-like_subgr

SEQ ID NO: 13619 - protein, 50 aa, Piromyces finnis
  Thiolase-like_subgr
ISTSQSGSRPSISSPAIIPQVMNIKNALQIANVTPEEVDYVEAHGTGTPL

SEQ ID NO: 13620 - protein, 42 aa, Piromyces finnis
  Thiolase-like_subgr
GRCATFDASADGYAPGEGCISLVLKRLDDALTNHDRIYGVIT

SEQ ID NO: 13621 - protein, 83 aa, Piromyces finnis
  Thiolase-like_subgr
NVGHGEYLSGIIGLIKSTLILHKNMIVPQTAFDTLNPKIECEKLGIRIANKIEKFPGQGRHRVAVNSFGFGGANANAIIEEEP

SEQ ID NO: 13622 - protein, 258 aa, Piromyces finnis
  Thiolase-like_subgr
FAIIGTGIRLPGDINNKDDFWKVMIEKKVITGLTPEDRWDRDEWYCKTEKPGTIQTLYGGFIENAFDFDNKFFSISQKEALDATPEQRWLCELTVETIEDANINIDKFKGSNTGVFVGTSGIDYGSYVFSVPEKITKYTYSGIEPSIHANRVSYLFDLHGPSLSTNTACSSSLTALSIACNSMAAGDCEMAIVAGTNFFQAPANGVAYSQLRVVSKKGACRPFDSGADGYARLEGAGMVLLKPYEKAIRDNNKIYATI

SEQ ID NO: 13623 - protein, 85 aa, Piromyces finnis
  Thiolase-like_subgr
TACNEDGKTASLTTPSSKAQYKLMKRVYEKGHIDPCTIDFIEAHGTGTAVGDPIEASSIGEAYGKINKANGNPAIPVGSVKGNVG

SEQ ID NO: 13624 - protein, 266 aa, Piromyces finnis
  Thiolase-like_subgr
EEAEQFKKKHGDRVDIYENAESGQWTVKIKKGSSIYIPKALQFDRTVAAQIPTGWKPETYGVPKSIIDQVDPITLYVIVATVEALISSGITDPYEFYEYVHVSEVGNCSGGGVGGMTSNHKQYFDRVFEKPVQSDILQECFINTMPAWINLLLLSSSGPIKTPVGACATAVESVEIGLETILSGKAKIVIVGGYDDFQEEGSYEFAQMKATSNSLEELAHGRDPSEMSRPATTTRAGFMEAQGAGHEILMTASLAIKMGVPIYGII

SEQ ID NO: 13625 - protein, 129 aa, Piromyces finnis
  Thiolase-like_subgr
LRGALAVFGLTIDDIQALSFHGTSTKANDSNESEVFNKQFKHLGRTKGNACPVITQKYLTGHPKGAAASWMLNGMLQVIETGIIPGNRNADNIDEKLRKFEYLFYPSRSIHTDGVKAGLLKSFGFGQVG

SEQ ID NO: 13626 - protein, 126 aa, Piromyces finnis
  Thiolase-like_subgr
LRGALAAFGLTVDDIGVASFHGTGTKANDKNESDVFNKQFEHLGRTKGNACPVVCQKYLTGHGKGAAAAWMLNGVIQILQTGIVPGNRNADNIDPLLEKYEHLWFNNKTFKTPGVKAGLLKSFGFG

SEQ ID NO: 13627 - protein, 266 aa, Piromyces finnis; identical to SEQ ID NO: 13624
  Thiolase-like_subgr

SEQ ID NO: 13628 - protein, 129 aa, Piromyces finnis; identical to SEQ ID NO: 13625
  Thiolase-like_subgr

SEQ ID NO: 13629 - protein, 266 aa, Piromyces finnis; identical to SEQ ID NO: 13624
  Thiolase-like_subgr

SEQ ID NO: 13630 - protein, 266 aa, Piromyces finnis; identical to SEQ ID NO: 13624
  Thiolase-like_subgr

SEQ ID NO: 13631 - protein, 126 aa, Piromyces finnis; identical to SEQ ID NO: 13626
  Thiolase-like_subgr

SEQ ID NO: 13632 - protein, 167 aa, Piromyces finnis
  Thiolase-like_subgr
CGSNEDGRSPSLTMPSYEAQYKLLTHVCEKSGINPTQIDYVEAHGTGTKVGDPIESHAIGDAYGRGKGIRGPNDPPVLVSSVKGNTGHGENSSGIVSIIKTSMMLYKRKLVPTAAYHRLNQAIDAEKLGIKVCEKLEDWNTPHILHAAVNSFGFGGANTNALLEEVK

SEQ ID NO: 13633 - protein, 259 aa, Piromyces finnis
  Thiolase-like_subgr
FAVIGIGCHFPEGIESKESFWKMLEDGKCITKDIPKERWDKDEWYSKEPVQGTIQTKRGAFLENPYLFDNKYFYISMPEAKEMSPEQRWLLELTVETLEDANIKPETLKGSRTGVFIGSSGIDYLVTQISHANDINSHSPTGFELSILANRLSYVFDFQGPSISCNTACSSAFSALNIGLNAMITDDCEMAIVAGSNFMSCPGSFVAYSQLRVVSKDGSCKPFDEKADGYAKLEGAGMILVKPYEKAVRDGDKIYCAIV

SEQ ID NO: 13634 - protein, 258 aa, Piromyces finnis
  Thiolase-like_subgr
AVIGVGCRFPGNIKSKEDFWEMLTTGRCLTSETPKDRWDSAEWYNKEPKRGTVQTTRGAFMEDAFYFDNKYFSISQNEAKEMSPEQRWLLELAVETFEDANINPKKLKGSRTGVFVGSSGMDFVAAQISHANDLTQHSATGLELSILANRISYYFDLNGPSICTNTACSASMTALNLAINSMITDDCDAALIAGTNLLFTPGSCVAYSQLRVVSVDGSCKPFDKRADGYSRVEGAGMLLIKPYEKAVRDGDKIYCAIL

SEQ ID NO: 13635 - protein, 182 aa, Piromyces finnis
  Thiolase-like_subgr
SSTNEDGHTPSLTMPSYDSQCKLLTHVCEKFDIDPASIDYVEAHGTGTAVGDPIEARSIGYAYGRRVREGKQIKTTRPGETEEILDQPTYPLIIGSSKGNTGHGEYSSGIIGMIKAVLMLHHRTMVPTIAHEEMNPAIDAEGLGIKVATKLEPWTTPHTLRIAVNSFGFGGSNGNAIFEEVV

SEQ ID NO: 13636 - protein, 164 aa, Piromyces finnis
  Thiolase-like_subgr
TSSGQSGFRQSISVPSSEGQARNIERAMAVAGVQPSDISYIEAHGTGTPYGDAIEIQGINQVYAGSHTSEHPLVIGSIKTNIGHTAETAGLASIAKVLLAMKNKTIPRNLHFKNLNPEIDLGVVPLSVPTHNVKWETVDGKPRTALVSSYGLQGSAVNIILQEY

SEQ ID NO: 13637 - protein, 264 aa, Piromyces finnis
  Thiolase-like_subgr
GMGLRLPGAINSDKSLWSTLVKGRDCITAIPKDRKLHENYVDKQSSELNMGEHNVKRCGYYDSRSSGKKISQFDAEFFNCLPDEAIGLDPKHRWILETSWEALENAGISPESLENTDTGVFVGIGDQQEHVKFMQECQKEKVVAHHNSNPSAIAGRLSYFYKLYGPSVTVDTACSTGATALHTACRSMIFGDCNLSIVTASKFLFYSEEFEMTSKARMTSPSGRCATFDKNADGYVPAEGCVTFILKRLEDAERDKDHILGVIL

SEQ ID NO: 13638 - protein, 114 aa, Piromyces finnis
  Thioredoxin-like
PTRDSLVVYYKIDCPFSQELLKTLEKLGKKYANYRTKFSIVKYEAEDQKIPKMSLWRNLEGYPTIVLYKANPFSREKKYYYVYPENAGRSSVSLDRWIQTHSFYKPKIIFNEED

SEQ ID NO: 13639 - protein, 102 aa, Piromyces finnis
  Thioredoxin-like_fold
NPTRDSLVVYYKIDCPFSQELLKTLEKLGKKYANYRTKFSIVKYEAEDQKIPKMSLWRNLEGYPTIVLYKANPFSREKKYYYVYPENAGRSSVSLDRWIQTH

SEQ ID NO: 13640 - protein, 123 aa, Neocallimastix californiae
  TIGR00556
NNGIGVDIELVTEVPITNENFLERNFTKEEIKYCMSRPDPQSSFAGRWSAKEAVIKAVSSRATSKVWTKGEAAPLIDIEILPGESGAPVVKFYNDAEKAVKDAGINNVKVTISHSGGFSCAMA

SEQ ID NO: 13641 - protein, 119 aa, Neocallimastix californiae
  TIGR00556
GIGVDIELVTEIPINNENFIERNFTKEEIKYCMSRPDPQSSFAGRWSAKEAVVKAVSSHSSSKVWTKGEAAPLIDIEILPGESGAPVVQFHNDAEKAVKEAGVKSVNVTISHSGGFSCA

SEQ ID NO: 13642 - protein, 121 aa, Anaeromyces robustus
  TIGR00556
NGVGIDIALISELNVDNEGFIERNFTNNEIQYCEAKPDRRSSFAGKWAAKEAVIKAISSYSLEAQKIWEGAGAPLKDIEVVIAESGAPKVLLSPTLNEKVKSVGVNDVKVTISHSGQFAVA

SEQ ID NO: 13643 - protein, 122 aa, Anaeromyces robustus
  TIGR00556
NGIGVDVELVSEIPITNETFLERNFTKDEITYCMSRPDPQSSFAGRWSAKEAVIKAVSSRATSKVWTKGEAAPLVDIEILPGESGAPVVKFHNDAEKAVKDAGIKDVKVTISHSGGFSCAMA

SEQ ID NO: 13644 - protein, 123 aa, Piromyces finnis
  TIGR00556
SNGIGVDVELVTEIPISNQNFLERNFTPKEIEYCMSRPDPQSSFAGRWSAKEAVIKAVSSRSTSKVWTKGEAAPLVDIEILPGESGAPVVEFHGDAEKAVKEAGINSVKVTISHSGGFSCAMA

SEQ ID NO: 13645 - protein, 120 aa, Piromyces finnis; identical to SEQ ID NO: 720
  TIGR00556

SEQ ID NO: 13646 - protein, 123 aa, Piromyces finnis; identical to SEQ ID NO: 13644
  TIGR00556

SEQ ID NO: 13647 - protein, 120 aa, Piromyces finnis; identical to SEQ ID NO: 720
  TIGR00556

SEQ ID NO: 13648 - protein, 412 aa, Anaeromyces robustus
  TIGR01733
TFKKLDEMSNSLAHYLRKENIGRGDIVPIISERSHYFVIATLAIMKSGAAFLPIDPDFPKERIEYMINEVNAKFILKYITNIETERKIKFDNVIEYELQKHNYKDNVFEITNINNSDDLCYVLFTSGTTGKPKGTMMTHNNLINYSLYSQTYNGKEIYTNDFNNALSAAKFTFDMSLCEILYPLIKGKCVFICDDNEYNNPQLIGEKILKYNIDYIFSTPSRIENYMKNKTYMKALKNLKCILIGGEGCNIKTVENIIKNTNANIYNLYGPTETTIMCTVSELSNLYKQNKLNVITIGKPLCNCKLYILDEYLKPVPIGVEGEIYIGGYGVGKGYLNREQLTREKFVDCPFNIKNGLPNQMYSTGDLGKWTEKGEIICSGRADFQVKIRGQRIELTEIENTIKKIKGIKYSI

SEQ ID NO: 13649 - protein, 408 aa, Anaeromyces robustus
  TIGR01833
AENIGIIGLATYIPATTVSMTKLEAHDKCQGKYTISLGQKYMSLTAPNEDVVSMALNAVKRLMKKMNLKPSDIGRIQIGTETPVDLSKSVKTFIVEQFFEQGITDIEGVDNVNACFGSTAALFDTVAWMQSDFWNGRYAIVVGTDISQGEDIYHFLTGSSAVAVLIGPNANLVVEPNRGIFSNSTFDFYKPYGYKNHYPVVDGKYSIDCYLNSLVSCYEDLKKKSKSETEFLDHQFGVFHNSSVSLTRKGFNTLIEKEISKVLPNAEPHEKRQFISKIYKERVEASTLMTANMGCMYNASVLNGIISLNESLKPEDIGKRILVYSFGSGSVGALWSLRIDGLAEKDDLNNRLNNRKEISVDSYFKVRQLWLEDIKKFGRSYKKDQFELPIRDGDYYLSSVSVNGVRKY

SEQ ID NO: 13650 - protein, 408 aa, Piromyces finnis
  TIGR01833
AENVGIIGLATYIPSSTVNMTKLEAHDNCQGKYTISLGQKYMSLTAPNEDVVSMALNAVKRLMKKMNLKPSDIGRIQIGTETPVDLSKSVKTFIVEQFFEQGITDIEGVDNVNACFGSTAALFDTVAWMQSDFWNGRYAIVVGTDISQGEDIYHFLTGSSAVALLIGPNANLVVEPERGIFSNSTFDFYKPYGYKNHYPVVDGKYSIDCYLSSLKSCYEQLKKKTGSETEFLDHQFSVFHNSSVSLTRKGFNTLIEQEISKVLPNAKIIEKRKFISNVYKERVEASTLMTANMGCMYNASVLNGIISLNESLTPEDIGKRVLVYSFGSGSVGALWTLRIDGLAEKDDLVNRLNSRNEVSVDTYFEIRKLWLEEIKKFGRSYKKDQFELQIREGDYYLSSVSLDGVRKY

SEQ ID NO: 13651 - protein, 346 aa, Neocallimastix californiae; identical to SEQ ID NO: 855
  TRANS-2-ENOYL-COA REDUCTASE, MITOCHONDRIAL

SEQ ID NO: 13652 - protein, 346 aa, Anaeromyces robustus; identical to SEQ ID NO: 858
  TRANS-2-ENOYL-COA REDUCTASE, MITOCHONDRIAL

SEQ ID NO: 13653 - protein, 346 aa, Anaeromyces robustus; identical to SEQ ID NO: 859
  TRANS-2-ENOYL-COA REDUCTASE, MITOCHONDRIAL

SEQ ID NO: 13654 - protein, 345 aa, Piromyces finnis; identical to SEQ ID NO: 862
  TRANS-2-ENOYL-COA REDUCTASE, MITOCHONDRIAL

SEQ ID NO: 13655 - protein, 184 aa, Piromyces finnis; identical to SEQ ID NO: 156
  UNCHARACTERIZED

SEQ ID NO: 13656 - protein, 193 aa, Piromyces finnis; identical to SEQ ID NO: 157
  UNCHARACTERIZED

SEQ ID NO: 13657 - protein, 68 aa, Neocallimastix californiae
  VCBS
DLDGDGTYDFVVKRMSDNRDPILLEAYKLDGTFLWRINLGPNIETYTSSLTSPVLVYDFDGDGKAEVM

SEQ ID NO: 13658 - protein, 234 aa, Neocallimastix californiae
  ZINC FINGER FYVE DOMAIN CONTAINING PROTEIN
MNMWNFAISGAVVDAKVVDGNPQYTPMTEQYNWFLKNMAPGKQFSNWKGESSLFAIWFGINDIGSKRRNEGLTSSQIDEKIATSMFNMIDGMYKQGARNFMFIFVPTIEKCPAYSNGNNPNIKSDIPNYNSNLNKYAKNFQASHPDTNVFVYDSYNEFDYIMENKSQYGITNIDSTCGGGFGFGWGWGNQNNCDSNTYFWKDVIHPTPTVHKPLAQDIEDFLIENEKASQQIFS

SEQ ID NO: 13659 - protein, 234 aa, Neocallimastix californiae; identical to SEQ ID NO: 13658
  ZINC FINGER FYVE DOMAIN-CONTAINING PROTEIN 26

SEQ ID NO: 13660 - protein, 108 aa, Neocallimastix californiae; identical to SEQ ID NO: 1059
  ZINC FINGER-CONTAINING PROTEIN

SEQ ID NO: 13661 - protein, 1177 aa, Neocallimastix californiae; identical to SEQ ID NO: 334
  ZINC FINGER-CONTAINING PROTEIN

SEQ ID NO: 13662 - protein, 870 aa, Neocallimastix californiae; identical to SEQ ID NO: 1060
  ZINC FINGER-CONTAINING PROTEIN

SEQ ID NO: 13663 - DNA, 666 bp, Neocallimastix californiae
  (Trans)glycosidases
aaaaattttagttgctatttggaaacaaattgctgctgaatttgctgactatgatgaacatttaattttcgaaggtatgaatgaaccaagaaaggttggtgatccagccgaatggaatggtggtgattatgaaggatggaatttcgttaatgaaatgaatgatcttttcgttaaaactattcgttctactggtggtaacaatgctttacgtcatcttatgattccaacctacgctgcttgtattaatgatggtgctattaataacttcaaatttccaagaggtgatgataaagttattgtttctcttcactcatacagtccatataactttgccttaaataatggagctggtgcagttagtaatttctacgatggtagtgaaattgattgggctatgaatactattaattctaatttcattagcaagggtattcctgttattattggtgaatttggtgccatgaatcgaaacaatgaaaatgaccgtgaaagatgggcagaatattatattaagaaggctacatctatcggtgttccatgtgttatatgggataatggttactttgaaggagaaggtgaacgttttggtcttattaatcgttctactttacaagttgttttcccaaaacttattaatggtttaattaaaggtttaggtaattctat

SEQ ID NO: 13664 - DNA, 909 bp, Neocallimastix californiae
  (Trans)glycosidases
gaaccaatatactggggttaatgaatctggtgctgaatttggtcaaggtgaatacccaggtacttacaataagcattacatttacccagatgttaaagctattcaagcttccattgatcaaggtatgaatattttccgtgttggctttgcatgggaacgtttacaaagaagcttaaatgctgaatttgatgccactgaatttggtcgtttagatgaagttattaactatatcactagtaatggtgctgtagccattattaatccacataactttgctagatataagaacgctgttattggtacaagtcaagtcccaaattctgctttctctaacttatggaagagattagctcaaaaatacaagaacaatcaaaaagtttggtttggtttagtaaatgaaccacatgatatgccaacagctcaatggttcgctgctgcacgtgatgctgttgataccattcgtgctacaggtgctaacaataatgttcttgttcctggtaatgcatacactggtgcatggaactggaaagaaactttttatggtgaatctaatgcttccgttgctcttagatacttcagctcagctgataagaatataattttcgaaactcaccaatatttcgattctgattattctggtactcatgaacaatgtgttcaacgtccatgtaacaaactcttcgttaatttcgttgaatggttaaaagctaacaatttaaagggtttcattggtgaatttggtgctgccattaacagggactgcaaagcttgtgttgaagaagctattaactacttagaacaaaactctgctaatattgttggctgggcctggtgggctgctggtccatggtggggtaattatatgtactcccttgaaccaaaaggtaacaagttcccagaacaaatgac

SEQ ID NO: 13665 - DNA, 972 bp, Neocallimastix californiae
  (Trans)glycosidases
tttatggtcagaatctgaagacttagctaaagctttagttgaagaaatgactttagatgaaaagattggaatggttactggttctcaaaatagttttggtccatgtgttggatatattgaaccaattgaaagattaggtttcaagggtatgtgtttccaagatggtccagctggtgttcgtagtgctaaacatactacaactttaccatctggtttaaatattgcttctacttttgatccagaaattatgaagaaaattggtgttgtattaggtgaagaatcaagagctaagggtgttaatgccattttaggtccagctatgaatatgtaccgttctccagctgctggtagaaattgggaaggttatggtgaagatacctatcttgcttcagttgcttcaaagaatgttgtagctggtattgctagtcaaggtgtccttgctactattaagcactttgctggtaatgagcaagaaactaaccgtgaaacatctaattctgagattgatgaacgtgttttacaagaagtttacttcccaccattcaaggctggaattgtttctggtgctggtggtgttatggctgcttacaacgaccttaatggtattccatctgctaataatacctggcttttaaacaaagttttaaagaaacaaatgttattccatggtttcgttaccagtgactggtggggtactaaggataagtacgaaattatgaatggtttagatattaatatgccaggtggtaaacaatggggtccaaccgtaactgaaagttactggggtgaagaacttaaggaagctgttgaatctggtgaaattgatgtctcttatgttgatgaagcttgtactcgtatcttaactatgttatacaagtacagacaatttgatgactatccagaaattaatcttgatgctgatgctacagaaggtcatgcagaagttgttcgtgaagctgctgctgctagtgt

SEQ ID NO: 13666 - DNA, 363 bp, Neocallimastix californiae
  (Trans)glycosidases
aagatacttctcttctgaagatgaaaatattctctttgaagttcaccaatatttcgatactgattactctggttctcatgatacctgtgtccaacgtccatgtcaaaacaacctcaaagaatttgttgaatggcttaagactaacaacttaaagggatgggttggtgaaattggtggacttgctaatgatgaatgtaaggaatgtattgaagaagttcttgaatatctccaagaaaacagagatgttattaagggagtccaatggtgggccgctggtccatggtggggacataatgctttatctattgaaccaaatgccgaaaaggccttcccaggacaaatggcatggttaaaaccatattt

SEQ ID NO: 13667 - DNA, 624 bp, Neocallimastix californiae
  (Trans)glycosidases
ttacctttctactaagggtcacaatattgttgattcaaagggtcgtaaggttcaattatctggtctttcatggttcggtggtgaaactactaacctttccccacacggtttatggaccaattctttagctaactttattaagattgtcaaggataatggttacaaccatcttcgttacccatggactaatgaaatgttctttgaaggtgctaagactcaatctattgatcaaatgaacaatccagatcttgttgatctttctccattagaagttatggatgccgttattaatgaatgtggtaaggccggtcttaaggtttatcttgatcgtcacagaccactttctggtggacaaagtgaattatggtatgttgatgaagttgatgaagctaaatggattgaagattggcaattccttgctaagcgttacaagggtaatccaaccgttattggagctgatcttcacaatgaaccacacggtaaggcttgctggggttgtggtgaagaagaacgtgattggagacttgcagctgaaagatgtggtaatgctattcatgaagttaatccagactggcttattattgttgaaggtaatgatcactatggtgaagaaggatggcaaaa

SEQ ID NO: 13668 - DNA, 1035 bp, Neocallimastix californiae
  (Trans)glycosidases
tttcctctctactaagggacacaacattgttgattctaagggacgtaaggttcaattatctggtctttcttggttcggtggtgaaaccactaacctttccccacacggtttatgggctaactctttagctaacttcattaagattgttaaggataatggttacaatcatcttcgttacccatggaccaatgaaatgttctttgaaggtgctaagactcaatcagttgatcaagttaacaacccagatcttgctgatctctctcctttagaaattatggatgccgttattaatgaatgtggtaaggctggtcttaaggtttatcttgatcgtcacagaccactttctggtggacaaagtgaattatggtatgttgatgaagttgatgaagctaaatggattgaagactggcaattccttgctaagcgttacaagggtaatccaaccgttattggtgctgatcttcacaatgaaccacacggtaaggcctgctggggttgtggtgaagaagaacgtgattggagacttgcagctgaaagatgtggtaatgctattcatgaagttaatccagactggcttattattgttgaaggtaatgatcactatggtgaagaaggatggcaaaagggagaatcctactggtggggaggtatgttaaagggagttaaagaattcccagttagattaaatactccaaacaagcttgtctattctgctcacgattatgataagaatgtccatatgcaagattggttcaaagaagccgatttcccagataacatgccaccaatttgggatgataaatggggatacattgttaaggaagatattgcaccagttcttattggtgaattcggttcactcttaagagatgccacagatgttaaatggttaagtaacttaattgactatatgaaagaaaatgaagttcactggactttctggtgtttaaatccaaactctggtgataccgaaggtattcttggatatgattggaagacagttaatactaagaaggatggtattttaactccagg

SEQ ID NO: 13669 - DNA, 951 bp, Neocallimastix californiae
  (Trans)glycosidases
aactttagttaatccaaaggctattcctgctgctaaaaaactttatgatttcttaaaatcaaattatggtaaaagaattctttctggtcaagtcggtgctgccggtcaagctggtgatgaaggtgaagaatttaaacgtattatgaatgctactggtaaaaagccagcagtttggaatatggatttcatttttgaatctaatgattgtacttggagaccaactaatcctgatattactgaaatggcaattaattggtggaagaaatatcaaggtaaaggaattatgtctgctcaatggcattggaatattgctggtagaactggtaactttgctttctacaaaaaagataccactttcgatcttgaaaaagcagtcaccgaaggtacttgggaatatgaaaaaattattaaagatattgatcgtgtttctggtttaattaagaaattacaagctattaatatgccattaatctggcgtcctcttcatgaaaataatggtgactggttctggtggggtaataatccaaaagcttgtgctaaattatggaaaatcttatatgaacgtatggttaactatcatggattaaataatttaatttggctttggaatggtaataatgatgaatatactccaattgaatacattgatattattggtgttgatatctatgctaatgatcatggaccacaaactacagcatacaatactcactttgatttttatggaggtaaaaagatggttgttttatcagaaaatggacgtattccagatattcaacaatgtgttgaccaaggtgcttggtggggttatttccaaacctggaacaatgaatttattttacaaaatcattatcatactgatgctcaacttaaagaatatttcaatcataaaattgttatgaatatggatgaattaccatcattcaatgtaaatagttatgattaccaatc

SEQ ID NO: 13670 - DNA, 735 bp, Neocallimastix californiae
  (Trans)glycosidases
aatggcaattaattggtggaagaaatatcaaggtaaaggaattatgtctgctcaatggcattggaatattgctggtaaaactggtaattttgctttttacaaaaaagataccactttcgatcttgaaaaagcagtcaccgaaggtacttgggaatataaaaaaattattaaagatattgatcgtgtttctggttttattaagaaattacaagctattaatatgccattaatctggcgtcctcttcatgaaaataatggagattggttctggtggggtaataatccaaaagcttgtgctaaattatggaaaatcttatatgaacgtatggttaactatcatggattaaataatttaatttggctttggaatggtaataatgatgaatatactccaattgaatacattgatattattggtgttgatatctatgctaatgatcatggaccacaaactacagcatacaatactcactttgatttttatggaggtaaaaagatggttgttttatcagaaaatggacgtattccagatattcaacaatgtgttgaccaaggtgcttggtggggttatttccaaacttggaatagtgaattcattttacaaaattcatatcatactgatgctcaacttaaagaatactttaatcataaaattgttatgaatatggatgaattaccatcattcaatgtcaatagctatgattatcaatctagtggaagtaatgaaaataataa

SEQ ID NO: 13671 - DNA, 984 bp, Neocallimastix californiae
  (Trans)glycosidases
ttttgctactacttgggaagaagcagaccaaaaggcaaagacctttatgagcgatttaactgaaagtgaaaaaattgatattgtcactggttatatgaataatcaaggttcatgtgttggtaatgttaaaccactcagcagaaagaatttcaaaggtatatgtttacaggatggtccagcaggtgttcgttttaatgatggaacttcaactacatggcaagttggtattaataatgctgccacttttaataaggaattattatacaaaattggtaaggaccaaggtgctgaattcaaggctaagggtattaatattgctcttgctccatctatgaatattcttcgtgctccagcttctggaagagtttgggaaaactttggtgaagatccatatttatctggtgtttgtggtactgaaatgactaagggttaccaagattctggttgtattgtttccgcaaagcattatgttgctaatgatgttgaacacaatcgtgaagcttcaacttctaatatggatgaacaaactttaatggaaattcatgttgaaccattctatagaactgttactgaaggtcaagctggttctgtcatggcctcctacaacgctgttaatgatgtatatgttgttcaaaataagaaggtgcttactgaaattttaaaggaaaaaatgaatttccaaggttttgttatgtctgattggtgggctattcatgatttagaaggtagtttcaatgctggtgttgatttgaatatgccaggtggtaaagcttggggtccagattatattaatgattctttctggggtaacaatatttctactgctatcagaaatggaaaggtatcttcagctcgtttggatgatgctgttagacgtattattcgtacattatacagattcgatcaaatgagtggttatccaaatgttaacatcagagcacaaagtatgcatgctgaaactaatagacaagctgctattgaaag

SEQ ID NO: 13672 - DNA, 1089 bp, Neocallimastix californiae
  (Trans)glycosidases
gaaaattttaaatactctcagtttacttagtttagccgttattggctcaaaggctatgaaaaacatttcatctaaggaattagttaaggatttgactattggttggagtttaggtaatactttagatgccacttgttttgaaactttagattataataaaaatccaattgcttcagaaacttgttggggtaatgttaaaactactcaagaactttactataaattaagtgatcttggttttaatactttccgtattccaactacttggagtggtcattttggagatgctccagactacaaaattaatgatcaatggatgaaaagagttcgtgaaattgttgattatgctcttaatactggtggttatgccattttaaatattcatcatgaaacttggaatcatgctttccaaaaaaatttagacagtgctaagaaaattttagttgctatttggaaacaaattgcagctgaatttgcagactatgatgaacatttaattttcgaaggtatgaacgaaccaagaaaggttggtgatgcaaatgaatggaatggtggtgattatgaaggatggagcttcgttaatgaaatgaatgatcttttcgttaaaactattcgtgctactggtggtaacaatgctttacgtcatcttatgattccaacttacgctgcttgtgttatggataatgctgtgaataacttcaaatttccaagtggtgatgataaagttattgtttctcttcactcatacagtccatataactttgccttaaataatggagctggtgcaattagtaatttcaacgatggcagtgaaattgattgggttatgaatattatcaactctaacttcattagcaaaggtattcctgttattattggtgaatttggtgccatgaatcgaaacaatgaagatgaccgtgaaagatgggctgaatattatattaagaaggctacatctcttggtattccatgtgttatatgggataatggttactttgaaggagaaggtgaacgttttggtcttattaatcgttctactttacaagttgtttacccaaaattagttaatggtttaattaaaggtttagg

SEQ ID NO: 13673 - DNA, 1029 bp, Neocallimastix californiae
  (Trans)glycosidases
ttatctttcaactaaaggtagacacattgttgacgaaaagggtcgtaaggttagattagctggtatctcatggtttggaggtgaaactactaatctttctccccatggattatgggctaagccattagaccatttcattaaagtaataaaggatcatggttacaaccatattcgttatccatggactaatgagatgctcttcccaggtgctaaaactgaatctattaatgctatggaaaatcctgatcttgttgatcttaccccattagaagttatggacgctgttattgatgcctgtggtaaggctggtttaaaagtttatcttgatcgtcacagaccactttctggtggtcaaagtgaattatggtatatttctaaggttgatgaaaagaaatggattgaagactggcaattcctagccaaacgttacaagggtaatccaactgttattggtgctgatcttcacaatgaaccacatggtactgcctgttggggttgtggtgaaactcaacgtgattggagacttgctgctgaaagatgtggtaatgctattcatgaagttaaccctgattggcttattattgtagaaggtaatgatcattatggtgaagaaggttggcaaaaaggtgaaggctactggtggggtggtatgttgaagggtgttaaagaaaatcctgtcagattaaagaaaccaaacaagcttgtttattctgctcacgattatgataagaatgttcacatgcaagattggttcaaagtttcttctttcccagataacatgcctgaaatttgggatgataaatggggttacattgtgaaagaagatatagctcctgttcttattggtgaatttggttcacttttaagagataaaactgatgttaaatggttacaaaatttaatttcttacatgaataaaaataccgttcactggactttctggtgcttaaatccaaattctggtgatactgaaggtattcttggttatgattgggaaactgttaacactcaaaaggatggaattcttga

SEQ ID NO: 13674 - DNA, 399 bp, Neocallimastix californiae
  (Trans)glycosidases
caacaactttatcttcccagaagatgatgataaggttattgcttctgttcatgcctatgctccatacaactttgccttaaataatggtgaaggagctgttgataagtttgatgcagctggtaagagagatcttgaatggaacattaatttaatgaagaagagatttgttgatcaaggtattccaatgattcttggtgaatatggtgctatgaaccgtgacaatgaagaagatcgtgctacttgggctgaattctacatggaaaaggttactgctatgggagttccacaaatctggtgggataatggtgtcttcgaaggtactggtgaacgttttggtcttcttgatcgtaagaacttaaagattgtttatccaactattgttgctgctttacaaaaggg

SEQ ID NO: 13675 - DNA, 927 bp, Neocallimastix californiae
  (Trans)glycosidases
aaattactctaagggtttcagaattggtgctgctactaacaccattcattacaacaacgctaactatgttaatgctatgaaagcattcaactatatggttgctgaaaatgcttgtaagttcgttagtattcaaggtactaagggtagattcaatttcaatgattgtgatgcccactacaacaaagcaaaggaattaggtatggactttagaggtcacgctttaatttggcacagtatggctccaaagtggcttgaatacgaagattctaatactatgagaaattccatagttaatcacattacaactgtcttaaagcactacgaaggtaaaattgatacttgggatgttgttaatgaagctattgatgatgattccaatggtaatggttggaagtatcgtaattcattcctttaccaaaagaacagagatttcattgatcttgctttcaagactgctcgtcaagtagctccaaaggttaaacttttctacaacgattataatactgaaggtatttggggtaagagtgaatctgtttaccaatttgttgctgatttaaagaaacgtaatattccaattgatggtgttggtcttcaataccatgtcagtgttcaaaatcaaccacaattcaacaaaattaacgatttaattggtcgttactgtaagttaggccttgaagttcacattactgaattagatgtcagttgtgttaattcttgtaatgctggagatgttgaaagcagacaatcccaagttttcactaatgctttaaaggcttgtcttaacaactcctgttgtactgctttccttgtctggggtattggtgatccagacagttggttaggtaatgataagaagggtttacttttcaatggtaattaccaaccaaaatctcaatacaatgctctcttaaacgtcttaaagactac

SEQ ID NO: 13676 - DNA, 981 bp, Neocallimastix californiae
  (Trans)glycosidases
gattaaaatgtccgatgtaattcaacaagttagacctgatttctactttggtgtttctacagcctctcatttctttgctaacccaaagtacaatgatattatttctacttacaacttacaagttgctggtaatgaatgtaaattctatacttttaacggttctcaaactttcaacacaaagccatgtgatgacactgttgctttcgctaagaagtatggagctaagttccgtggtcacaatcttttctggccagcttactctccacaatggttccaagatgctcatgatggtagtgacccagaagctgtaaaagaatacattcttgactatgttgctaaggttttagatcattacaaggatgaagaagatattatttactgggatgttattaatgaatctgttactgacgattctactgctaagaacatcaagttacgtactggttctgataacagtaatgaattcgaaggttgggatacttacacagaagatattttcaaggttgctcgtgaacacaccaacgaaaatgtaaagttattctataacgattacaatgccgaagcaaacaatggaaactttgatggaaaaactggtgctgttttcgaatacatcagatctatgagagaaaagggtgtcccaattgatggtgtcggcttacaaatgcacgtttcctgtaattggactccaaattatgaacaacttacaaagttaatttctcaatatgaagaaattggcgttgaagttcatattactgaaattgatgttaaaagaactcaatgtaaatctgctgaagctcaaaaagaagttttcatgaacgtcttcaaagcttgtttcgatcatgaaaactgtaaggtcttcactgtttggggttcctacgatgaagaatcctgggttggtgttgaaaatgaaccagttctttttgatgttgatatgtatccaaaggacatttactttgatatgttggactacgttttagaaaa

SEQ ID NO: 13677 - DNA, 163 bp, Neocallimastix californiae
  (Trans)glycosidases
ccgtgatatttcatcaaaggaattaattaaggaaatgaatttcggttggaatttaggtaatactatggatgctcaatgtattgaatacttaaattatgaaaaggatcaaactgcttcagaaacttgctggggtaatccaaagactactgaagatatgttcaag

SEQ ID NO: 13678 - DNA, 936 bp, Neocallimastix californiae
  (Trans)glycosidases
ccttttaaaggattattctaatggttttagaattggtgctgccaccaacactagattctacaacaatggtaactacgttaatgccatgaaggctttcaactatatggttgctgaaaatgcttgtaagtttgttagtattcaaggtacaaagggtaaattcaacttcaatgactgtgataatcacctcaagaaagctaaggaattaggtatggacttcagaggtcacgcccttgtttggcactctatggctccagattggcttaaaaatgaagattcaaaaactatgagacaatccatcgttaaccacattactaaggtcttacaacactatgacggtaagattgatacctgggatgttgttaatgaagctattgatgatgattccaatggtaatggctggaaataccgtaactccttcctttaccaaaagaacagagatttcattgatcttgctttcaagaccgctcgtcaagttgctccaaaggttaaacttttctacaacgactacaacaccgaaggtatttggggcaagagtgaatctgtctaccaatttattgctgacttaaagaagcgtaacattccaattgatggggtcggtattcaataccacgtcagtgtcaagaaccaaccccaattaaacaaaattactgacttaattggccgttactgtaagttaggccttgaggttcacattaccgaaattgatgtcagttgtgaaggtgcctgtaacaacggtgatgttcaaaaccgtcaagctcaagtcttcacaaatgccttaaaggcttgtcttgccaactcctgctgtaccgcttatcttgtttggggtattggggataatgacagttggttaggtgctgataagaagggtttacttttcgatggtagttacaagccaaaagctcaatacactgccctcttaaacaccttaaagacaac

SEQ ID NO: 13679 - DNA, 1044 bp, Neocallimastix californiae
  (Trans)glycosidases
aaaagctgcaccattccgtatgggtgttggtttaaatggttcagataaaagtacttctactgttttatctaagaaaatgcgtgaaatcattgcttatcaattcaattcagtcacttattcaaatcttatgaaggctgaaaatattttagataaagccgcttcccaagctaatgcaaaaaaaggtgatgatatgccagttttaaaatttgatacaattgttgatggtttagaattctgtaaagaaaataacattaaaatgagaggtcacactttagtatggcatgttcaaactccagaatggttcttccgtactgactttagtgatagtggttcatatgtcaatgcagccaagatggaaaagcgtatggaaagttatattaaacaaatgttagaattcgttcaatattattatccaggtattgttgatgtttgggatgttgttaatgaagctgttgaaattgaaggtggtagttatgatgcctcaactggttggaatactcgtactagatataatggtagtccaaatccatggtatactactatgggcgctgactatgttattaaggctttccgtattgctcgtaaatatgctgacaaaaatgttaaacttatttacaatgattacaacacttttatgtcacaaaagactactgctatttgtaatcttattaaaaaattaaaggctgaaaacttagttgatggcgttggtcttcaatcttacttaaatgccgactggccaaatcgtaatgactataagactgctattcaaaagtttgctgctcttggtgttgaagttcaagctacagaattaactattagaactgatggtactgcaaataaatataatactcaagctaaacattatgaagaagttttcaagatttacaaagatttgaagaagagtggtgtcaatattactagtgttacagtctttggcttacaagatggttatttattttataataatgattcaactgatacacgtttatgggaccataatcttaagaaaaaaccagtttacaattctattatgaaagtattatc

SEQ ID NO: 13680 - DNA, 1038 bp, Neocallimastix californiae
  (Trans)glycosidases
attccgtatgggtgttggtttatatggtaccaataagagttcttctccagtcttctctaagaaaatgcgtgaaattattaaatatcaatttaattctgtaactttcactaatcttatgaaagctgaatttatgttagataaaagtgcttctcaagccaacgctagaaatggtaatgatatgccagttttaaagtttgatacaattgttgatggtttagaattctgtaaggaaaataatattaagatgagaggtcacactttagtttggcacactcaagctccagaatggttcttccgtactggatttaatgataacggtagttatgttgataagaacaaaatggaaaaacgtatggaaagttacattaaacaaatgttagaatttattcaatattactatccaggtgtcattgatgtatgggatgttgttaatgaagctgttgaaattgctaacggtagttatgatgcttcatccggatggaatactcgtactaagtttgataacaacaagactaatccatggtatgcaactatgggtcctgactatgtatttaaggctttccgttttgctcgtaaatatgctgataagaatgtcaagcttatttacaacgattttaatacattccaatatccaaaaactgataatatctgtaaccttgttaagaaattaaaggctgaaaacttaattgatggtgttggtctccaatcttacttaggtccaagttggccaaatcgtaacgattacaagaacgctattcaaaagttcggtgctcttggtgttgaagttcaaattactgaattaactattagtgttgaaaatggtaataacaaattcactacccaagctaatcaatatagagatgttttcaagatctataaggacttaaagaaaagtggtgttaacatcactagtgttactgtcttcggtttacaagatcattacttattctatgataatgataatactgaaactcgtttatgggatggtaatcttaagaagaagccagtatacaatgctattatgaatgtattaaaaaa

SEQ ID NO: 13681 - DNA, 1014 bp, Neocallimastix californiae
  (Trans)glycosidases
ttttgttcaaacggatggaactaattttgtagtggatggttgtaaacgttatttctctggttctaatacctactatttgatggtatcaagtcatgaaagagtggatttagctcttgaagcttatgctagacataatctcaatgttgttagagcttgggctttctgtgatgaatgtgaagacgccacaagattagtcgatttctctggtccagaagttaagcttaactccttaaatatggaaaaggttgattattatcttgcagctgctgctcaaagaaatattcgtgtggttttaactcttactaacaattggactgattatggtggtatggatgtttgggtcaaaaagttcggtggaaaatatcatgatgaattttataccaacagaaaaattattgaaggttataaacaatatattaaagctatgattaaccgtgttaacacatacaccggtcaattatataaggatgatccaactattttctcatggcaacttgctaatgaagctcgttgtaacaatggtccacatggtcttccagttaaaaattgtaatacggatactattacaaagtggatggatgaaatcgctacttttatccataaagaagatccaaatcatttagtttcttctggtattgaaggtattggtcttactccaccagctggtgttgatccatatacttatgtatacacttatactgaaggtactgattatgaagctatcagtgctcttgattctattgattataatactgttcatatgtatccagttggttggggattaaaagattatgccaaagatggtgttacttggattcaagctcatgctgatgtcgataaaaaatttaacaaaccaacagttgttgaagaatggggtctcagtacttcagttgataatgttccaattaaagagcgtgatccaatttatactcaatggatgaatgcagttttagctaatgataatattggaatgaatatgttctggtatgtctgtggtgaagattattatggaac

SEQ ID NO: 13682 - DNA, 927 bp, Neocallimastix californiae
  (Trans)glycosidases
tgccgccaagggtttcagaattggtgctgctacaaacactattcactataataatccaaattatattaatgctatgaaggctttcaattatatggttgctgaaaatgcttgtaaatttgtaagtattcaatacactaaaggtaaatttaactttgacgattgtgataatcacttaaagaaagctaaggaattaggtatggctttcagaggtcatgctttaatatggcatgctatggctccaggttggcttgaacgtgaagatggaaatactatgaaacaatctattattaatcatattaccactgtattaaagcattatgaaggtaaaattgatacttgggatgtcgttaatgaagctcttgatgatagttctaatggtaatggttggaaacttcgtaattctttcctttatcaaaaggttcctgactttattgatattgctttccaaactgctcgtaaggtttctccaaacactaaacttttctataacgattataacactgaaggtatatggggtaagagtgaatcttgctaccaatttattgctgatatgaaaaaacgtaatattccaattgatggtgttggtattcaatatcatgttggtattaatgttcaaccaaaattcgaaaaaattaacaatttaattagtcgttactgtaaattaggtgttgaagttcacatcactgaattagatgtcagttgcgatgacaactgtcgtgacgcagacggtggtgagagcaagcaaggacaagtttacactaatgccctaaaggcttgtcttaataattcttgttgtactggtttccttgtttggggtattggtgataaggatagttggagaggtgttgaaagtaaaccattacttttcgatgctaactaccaaccaaagggtcaatacactgctatattaaacactttaaagtccac

SEQ ID NO: 13683 - DNA, 696 bp, Neocallimastix californiae
  (Trans)glycosidases
tatggctccaggttggcttgaacgtgaagatggaaatactatgaaacaatctattattaatcatattaccactgtattaaagcattatgaaggtaaaattgatacttgggatgtcgttaatgaagctattgatgatggttctaatggtaatggttggaaacttcgtaattctttcctttatcaaaaagttcctgactttattgatattgctttccaaactgctcgtaaggtttctccaaacactaaacttttctataacgattataacactgaaggtatatggggtaagagtgaatcttgctaccaatttattgctgatatgaaaaaacgtaatattccaattgatggtgttggtattcaatatcatgttggtattaatgttcaaccaaagttcgaaaaaattaatgatttaattagtcgttactgtaaactaggtgttgaagttcatatcactgaattagatgtcagttgtgatgacaactgtcgtgatgcagacggtggtgacagtaagcaaggacaagtttacactaatgccctaaaggcttgtcttaataattcttgttgtactggtttccttgtttggggtattggtgataatgatagttggagaggtgccgaaaacaagccattacttttcaatactaattatcaaccaaagggtcaatataccgctgtcttaaacacattgaaatctac

SEQ ID NO: 13684 - DNA, 927 bp, Neocallimastix californiae
  (Trans)glycosidases
tgccgctaatggtttcagaattggtgccgctaccaatactattcattacaacaatccaaattatattaatgctatgaaggcttttaactatatggttgctgaaaatgcttgtaaattcgttagtattcaatataataaaggtagatacaactttgatgattgtgataatcatttaaagaaagctcaagaattaggtatggctttcagaggtcacgctttaatttggcatgctatggctccaggatggcttgaacgtgaagatggtaacactatgaagcaatctattattgatcacattactactgtattaaaacattatgaaggtaaaattgatacttgggatgttgttaatgaagctatcgatgatggttctaatggtaatggttggaaattacgtaattctttcctttaccaaaaggttccaaactttattgatattgctttccaaactgctcgtaaggtctcaccaaaaactaaacttttctacaatgattacaacactgaaggtatttgggccaagagtgaatctgtttatcaatttgttgctgatatgaaaagacgtaatattccaattgatggtgttggtattcaatatcacgttggtatcaatgttcaaccacaattccaaaagattaatgatttaattggtcgttactgtaagttaggagttgaagttcatatcactgaattagatgtcagttgtgatgataattgtcgtgattgggatggtggtgaaagtaaacaaggacaagtttacactaatgctttaaaggcttgtcttggtaattcttgttgtaccggtttccttgtttggggtattggtgataaggatagttggagaggtgaagaaaacaagccattacttttcaattctaactatcaaccaaagggtcaatacacagctatcttaaatactttaaaatcaac

SEQ ID NO: 13685 - DNA, 882 bp, Neocallimastix californiae
  (Trans)glycosidases
taccatcaatggtaagagacttcttatcaagggtgtcaatcgtcatgattcagatccattcaatggaagggctgttccacaacaaacattacgtgaagatattgctctcatgaaaaagcataatattaatgccataagaacttctcattacagtaatgactcctacctctactggctctgcaataaatatggtatgtatgtcatgggtgaaaccaatttggaatctcatgctttacagaataaccatgacgcaaaagccaaattctatgaacttggaatggacagaacagaaactgcctataagcgtttgaaaaataatccatcaatctttgcatggtctattggaaatgaaatggcctacaccaataatccaaatgatgcaggaggtcttttccgtgatatgatctggtatttcaaaaagaacgattccagtcgtccagtacatagtgaaggacaaggtagtagtatgggtgttgatatgtctagtaatatgtatcctggttctgatggactcggtgttcatgctggtcgaggaaagatgccttacatcatgtgtgaatatgatattgcttcaggtaatgctataggtgctttaaaagaatattgggatgtgataagaagtgctgataatatgttagggggttttatttgggattgggttgatcaatccagagcaaaaactctcaacggcggatgggattactactctcaatcttatgccataactaatctttattctgaagaaattaaaggtaaattctatgcttatggtggtgattggggtgattggccaaatgataatagtttctgtgtcaatggtcttatcaatccagatagaactcctcaaccagaacttgccgaagtcaaattccaatatcaaag

SEQ ID NO: 13686 - DNA, 636 bp, Neocallimastix californiae
  (Trans)glycosidases
tttaccagatatgttaccatactggccatacaaatggccaggtatgcaaagttggttaaatcaagttaaatctttcattgatgataagaagaaatctggtttaaccaactggtatggtttagaaatctggaatgaaccagatggtacttgggataatgccaatggaagtttcaacgatatgtggaaaaagacttatgaccttattcgtcaagctgatccaggagaaaaaattattggtccatgtttcagttggtatgaagaaaacaaaatgaagaacttcttacaatactgtaaacaaaacaactgtattccagatattattagttggcatgaattaagtggtattgaaggtgtttcaagccacttaagaggttaccgtaacttagaacgttctcttggtatcaaggaacttccaattagtattaacgaatactgtgatgccgaacatgaattagaaggtcaaccaggttccagtgctcgtttcattggtaagttcgaacgttacaaggttgatagtgctatgattacttggtggttcgttccacacccaggtcgtttaggtagtttaatggctactgacactcaaaagggtgctggttggtacttctacaaatggtatggtgatatgactggtga

SEQ ID NO: 13687 - DNA, 933 bp, Neocallimastix californiae
  (Trans)glycosidases
tagagatcatgcaaacggcttcagaattggtgctgctgctaacacaatgtactttaacaaccaaagttatatcaatgccttaaagtctttcaactatatggttgctgaaaatggttgtaagctttcaggtattcaacaacaaaaaggtgtttacaatttcaatgattgcgataatcacttaaagaaggctcaagaattaggtatggatttccgtggtcactgtcttatctggcacgcttaccaaccatcttggttcgaaaatgctgatgctaatactttaaagaacgctattgttgatcatattactaagactttacaacattatgaaggaaagattgatacttgggatgttgttaatgaagctattgatgatagttctaatggtaatggttggaaaatgcgtaactccttcctttatcaaaaggttccaaactttattgatttagctttccaaactgcacgtaaggtttctccaaacactaaacttttctacaatgattacaatactgaaggtatttatggaaaatctgaatctgtttaccaattcgttaaagatttagtttcacgtaatattccaattgatggtgttggtattcaatatcacgtttctgtccaaagtcaaccacaatataacaagattaacgatttaatttctcgttactgtaaacttggacttgaagttcacattactgaacttgatgttaaatgtgataatcaatgttatagtggtaatgttgaacaacaacaagctacagtctttactaatgccttaaaggcttgtcttagtaactcttgttgtactggttaccttgtttggggtgttggtgacaacaattcatggttaggtagtgataagaagggtttacttttcgacggtaactacagaccaaaatctcaatacactgctgtccttaacatgttaaaggaattagc

SEQ ID NO: 13688 - DNA, 165 bp, Neocallimastix californiae
  (Trans)glycosidases
ccgtgatatttcatctaaggaattaattaaggaaatgaatttcggttggaatttaggtaatactatggatgctcaatgtattgaatacttaaattatgaaaaggatcaaactgcttccgaaacttgttggggtaatccaaagactactgaagatatgttcaaggt

SEQ ID NO: 13689 - DNA, 534 bp, Neocallimastix californiae
  (Trans)glycosidases
tattttaccatattggccataccaatggccaggtttggataaatggcttgatgctgttagatcatttattcgtgacaaaaaagcttctggtttaaaaaattggtatggttatgaaatttggaatgaagctgaaaatacttggagagattctaacggtttatcgttctttgaaatgtggaaggaaacctatagagttattcgtgaaatggatccagatgaaaaaattattggtccatgtgatggtttatacagtgaacaaagaatgcgtccattcttagaatactgtttaaagaatgatgttatgccagatattatgtgttggcacgaattgatgggtattgaattaattccaggaagatataaggcttatcgtaaattagaaaaatctcttggaattaaggaacttccaattaccattaatgaatattgtgatattaaacatgaattagaaggacaaccaggttcaaatgcccgtttcattggtaaatttgaacgttataagattgatagtgccttaatatcttggtggtttgt

SEQ ID NO: 13690 - DNA, 333 bp, Neocallimastix californiae
  (Trans)glycosidases
tatttttgaagttcatcaatatttcgatagtgattactctggtactcatgatacctgtgttcaacgtccatgtcaaaaccttcttaaagaatttgttgaatggctcaagaccaacaacttaaagggttggttaggagaaactagtagtactcttagtgaaggatgtaaggaatgtgttcaagaagttcttgaataccttgaagaaaacagagaacatgttttaggagttacatggtgggccgcaggaccatggtggggacacactgcctgtgccattgaaccaaatgaagaaaaggccttcccagaacagatggcatggttaaaaccatactt

SEQ ID NO: 13691 - DNA, 933 bp, Neocallimastix californiae
  (Trans)glycosidases
actccaatatttaggtaccaatgaagctggtggtgaatttggtgatgctgttttaccaggtgtctacaatgaacattatatttatccaaatattaatgctattgaagcttctattgaacaaggtatgaatgttttccgtatgggactcagatgggaacgtttccaacatgaattatttggtgatttaactgaatttgatttaactgaatataaaaagattgttgatgctactactgctaagggagcagttcttattattgatccacataactatgctcgttataacaataatgttattggatctgaagaagttccaattgaagctttcgcagacttctgggctaaattagccgaagttttcaaagacaatgaaaaagtatggtttgatttagttaatgaaccccatgatatggaaacagatgattggtttaaagctgcacgtgctgcagttgatgctattcgtactacaggagctaagaacaatattttaatttcaggtaatggttgggatggagcctggagttggggtaaggaagcatggtatggagaatctaatgcagatgttgctttaagatacttctcttctgaagatgaaaatattatttttgaagttcatcaatatttcgatagtgattactctggtactcatgatacctgtgttcaacgtccatgtcaaaaccttcttaaagaatttgttgaatggctcaagaccaacaacttaaagggttggttaggagaaactagtagtactcttagtgaaggatgcaaggaatgtgttcaagaagttcttgaataccttgaagaaaacagagaacatgttttaggagttacatggtgggccgcaggaccatggtggggacacactgcctgtgccattgaaccaaatgaagaaaaggccttcccagaacagatggcatggttaaagccatactt

SEQ ID NO: 13692 - DNA, 972 bp, Neocallimastix californiae
  (Trans)glycosidases
tttatggtcagaatctgaagatttagctaaggcttttgttgaaaaaatgactttagatgaaaagattggaatgataactggttctaaaaacagttttggtccatgtgttggttatattgaaccaattgaaagattagacttcaaaggtatgtgcttacaagatggtccagctggtgttcgtaatgctaatcatagtactactttcccctcaggtttaaatattgcttcaacatttgatccagaaattatgaagaaacttggtgttgctttaggtgaagaatgtagagccaagggtgttaatgcacttttaggtccagctatgaacatgtaccgttctccagctgctggtagaaattgggaaggttatggtgaagatacttaccttgcttcagttacttctaaaaatgttgttgctggtgttgttagtcaaggtgtacttgctacagttaaacactttgccggtaatgaacaagaaacaagacgtgaacattctaactcagttgttgatgaacgtgtcttacaagaagtatatttcccaccattcaaagctgctattgtttctggtgctggtggtgttatggcagcttacaatgacctcaatggaattccagctgccaacaatacttggcttttaaataaagtcttaaagaagcaaatgatgttccacggttttgtcaccagtgattggtggggtactaaggataagtatgaaattatgaatggtttagatattaatatgccaggcggtactgactggggtgaatcagttactgaaagttactggggtgaagaacttaaggcctctgttgagtctggtgaaatagatgtttcatatgttgatgatgcttgcgtacgtataatgaccatgttatacaagtacagacaatttgatgactatccagaaattaatcttgacgctgatgctactgaaggtcatgctgagattgctcgtgaagctgctgctgccagtgt

SEQ ID NO: 13693 - DNA, 1056 bp, Neocallimastix californiae
  (Trans)glycosidases
acttacattatctgctgctagttcagctttagctttaactacccaacaagttataaaagaaatgggtcttggttggaatttaggtaatactttagaagctacaggtgattggattaatggtaataatgttaatgcttatgaaactgcttggggaaatccagctgctactaaggaattaattaatgcaattaaaaataatggtttcaatagtattcgtataccagtttcatggagtaatcttatgtcttctgattacactattagtgaagaattattaaagagagttaatgaagtagttagttgggttatcgaaaatgatatgtatgctattattaacattcactgggatggtggatggattgaaaaattcggaactaacgaatccacaatggctaatcaaaagttcgtcaaaatttggaatcaagtttcagattacttcaaaaattatggagaacatttaatttttgaatctttaaatgaagaaggttgttggaatgatgtctggaatcgttacagtaatgctggtgataagaacaaggcttatagtactttaaataacattaatcaacaatttgttgatattgttcgtaaatctggtggtaacaacaaaagtagacatttacttattgctggttattgtactgatattgatcttactgtcgattctgcattcaagatgccaactgattctgaaaaccgtatgatggtttctgttcattactacactccatctactttcactattcttgaaaaggatgaagattggggtaaattccaaggtacttggggtactgatgccgatgttaatgaacttattactaatttcgacaaacttaagaaacgttttgttgataatggtgttcctgttattattggtgaatatgctactgttttaactaacaaggacaaggcaagtgttcacaaatatttattcacttgtgctcaatacgctactagtttaggtatttgcccaatgctttgggataatggtgaatatttcgatcgtaagggtcttcaattcaaggactctgaaattggtgaattctacaaacatca

SEQ ID NO: 13694 - DNA, 99 bp, Neocallimastix californiae
  (Trans)glycosidases
tgatccagaaactattcaatataaagctaaatatattattgataacaactttggtggtatgatgatttgggaattagaaaatgatactgatgatttcga

SEQ ID NO: 13695 - DNA, 705 bp, Neocallimastix californiae
  (Trans)glycosidases
tgactccaaaataattgttggttatttcagtgaatggaaaaatgcgaactatcctattagtcgtgtagatttatcaaaaattacacatcttaattatgcatttggtgtaattgatccaaattcatatgctgtaactggatatgatagtaatattttaagtcaagttgtcactgctgcacacagtcaaggagtaaaagttcttatgtctgtaggtggatggtatggaagtcgttactttactcagatgacttcttcaaaaagtaacatagaaaagtttgttgacagttgtcaaagtcttatcagtaattatggtgttgatggtattgatattgattgggaatacccaggaagagaaggcgcatgtaatagcccagatatggcaaatgatgcagaaaattatttaactcttttaaagatcttacgtgaaaagatcggaaatgctctaatttctgctgctgtcagtgttataccgtttgaaaagaatggtcaaccaatttcagacctttctgaatatgaaaaatactttgattatattaatgttatggcatatgattttgctggtagttggacacctactgtttctcatcactctgctttatatgacccagaagctggtgaaaagttgtctctatcttcaggtgtaaagaattggttaagtcgtggttttccagctaataaaattgttgttggtgtaccagcttatgg

SEQ ID NO: 13696 - DNA, 201 bp, Neocallimastix californiae
  (Trans)glycosidases
agaattcagtggtcatatctctgatagtcaatgtaaggaatgtgtccaagaattccttgaataccttcaattaaacaatgaatatgttttaggagccacctggtgggcagcaggtccatggtggggacaaaacaattacaccattgaaccaaatgctaagaaagaattcccaggacaaatggcttggttaaagccttattt

SEQ ID NO: 13697 - DNA, 942 bp, Neocallimastix californiae
  (Trans)glycosidases
tggaaaattaaagtaccttggtgttaatgaagctggtggtgatttcggtgaaggtcatttaccaggagtttacaatactcattacacctatccaaacattgatgctattagtacttctatcgaacaaggtatgaatgctttccgtatgggtcttagatgggaacgtttccaacatgaattatttggtgaattaactgaatttgatcttaccgaatataagaagatcgtggatgctgttactgctatgggagctgttattattgttgatccacacaactatgctcgttacaaagataaacttattggttcagaggaagttccaactgaagcttttgttgatttctggaagaagatggctaatgttttcaaggataatgacaaagtatggtttggtttagttaatgaaccacatgatatgaaaacagatgactggtttaagattgctcgtgctgctgttgatggtattcgttccactggagctaataataccattttaattccaggtaatggatgggatggtgcatggagttggggttctcaagcttggtatggtgaatccaatgctgaagttgccttaagatacttctcttctgaagatgaaaatattgcttttgaagttcaccaatactttgattctgattactccggaggtcatggaacatgtgaaaaacgtccatgccaaaacaatgttaaagaatttgttcaatggcttaaggataataacttaaagggttggtttggagaattcagtggtcatatctctgatagtcaatgtaaggaatgtgtccaagaattccttgaataccttcaattaaacaatgaatatgttttaggagccacctggtgggcagcaggtccatggtggggacaaaacagttacaccattgaaccaaatgctaagaaagaattcccaggacaaatggcttggttaaagccttattt

SEQ ID NO: 13698 - DNA, 1056 bp, Neocallimastix californiae
  (Trans)glycosidases
acttactttagctactgctagttcagctttagcattaaccacccagcaagttgttaaagaaatgggtcttggttggaatttaggtaatactttggaatccacaggtgattggattaatggtagaaatgtaaatgcttatgaaactgcatggggtaatccagctgctactaaagatttaatcaaagcaattaaaaataatggtttcaatagtattcgtattcctgtttcttggagtaatcttatgtcatctgattacactattagtcaagaattattaaaaagagttaatgaagtagtcagttgggttattgatacaggtatgtatgctattattaacattcattgggatggtggatggattgaaaaattcggaaccaacgaatccacaatggctaatcaaaaattcaataaaatctggactcaagtatccgactatttcaaaaactatggagaacatttaatttttgaatcactgaatgaggaaggttgttggaatgatgtctggaaccgttacagtaactcaggtaataaaaacaaggcttatagtactttaaataatattaatcaacaattcgttgatattgttcgtaaatcaggcggtaacaacaaaaatagacatttacttattgctggttattgtactgatattgatttaactgttgattctgctttcaagatgccatctgattcagctaaccgtatgatggtttcagttcactactacactccatctacctttactattcttgaaaaggatgaagattggggtaaattccaaggaacatggggtactgatgctgaaattaaaactcttatggctgattttgacaaacttaagaagcgcttcgttgacaacggcgtaccagttattattggtgaatatgccacagttttgactaacaaggataaagctagtgtccataaatatttattcacttgtgctcaatacgctactagtttaggtatttgtccaatgctttgggataatggtgattactttgaccgtaaagctcttaaattcaaggattccgaaattggtgacttctacaaatacca

SEQ ID NO: 13699 - DNA, 627 bp, Neocallimastix californiae
  (Trans)glycosidases
tttcttaccatactggccatatcaatggcctggtatgcaaaaatggttagaactagttagacagttcattcgtgataaaaaggctgctggtattaaaaatttctatggttatgaaatttggaatgaagctgaaaacacctggagagattctaatggttatactttctttgaaatgtggaaagaaacctacaaggtcatccgtgaaatggatcccgatgaaaaaattattggtccatgtgatggtttgtacagtgaagaaagaatgcgtccatttttacaatattgtttagataatgatgtcatgccagatattatgtgttggcacgaattgatgggtgttgaattaattccacgaagatacaaagcttaccgtgaattagaagcttctcttggtattaaggaactcccaattactattaatgaatattgtgatattaaacatgaattagaaggtcaaccaggttctagtgctcgttttattggtaaatttgaacgttataagattgaaagtgctttaatttcatggtggttcaataatttaccaggtcatttaggtagtttattagctactgattctgaaaagggtgctggttggtatttctataaatggtatggtgacatgacagg

SEQ ID NO: 13700 - DNA, 222 bp, Neocallimastix californiae
  (Trans)glycosidases
tattccaatgattcttagtgaatattgtgcaatgaaccgtgataatgaagaagatcgtgctacttgggccgaattctacatggaaaaggttacagctatgggagttccacaaatctggtgggataatggtatcttcgaaggtactggtgaacgttttggtcttcttgatcgtaagaacttaaagattgtttatccaactattattgctgctttacaaaaagg

SEQ ID NO: 13701 - DNA, 813 bp, Neocallimastix californiae
  (Trans)glycosidases
ttacggtcttattgaaaatgttccaaaggattataaaaatttagtagctcctcttaatgttaatgttatgcgtgccccagctagaagtggtaatggtcgccaacaaccaattggagatgtaattaaggtcgctcaacgtttaaaggaatcccctggtgctagagtcactattgaattagccgatattttaccaggttggccatacaaatggccaggtattcaaacttggtttaatgaaattagatcctttattaatgataaaaagaagtcaggtttaactaacttttatggtaatgaaatttggaatgaaccagatgttacttggaaggattctaatggtttaagtttcaatcaaatgtggaaacaaacctacgatttacttcgtcaaattgatccaaatgaaaaaattattggtccaagtttcagttggtacgaagaaaataaaatgaaaaacttcttacaattcagtaaacaaaataattgtcttccagatattatcgcttggcatgaattaagtggtattgatggtgtctccagtcacttcagaagttatcgtaacttagaaaaatctatgggaatatctgaacgtccaatcactattaatgaatattgtgatgaaaatcatgatttagaaggtcaaccaggttctagtgctcgtttcattggtagattcgaacgttacaaggtcgatagtggtatgattacttggtggtttgttcctcacccaggtcgtttaggtagtttattagcatctgatactcaaaagggtgccggttggtacttctataaatggtatggtgatatgactggaga

SEQ ID NO: 13702 - DNA, 1110 bp, Neocallimastix californiae
  (Trans)glycosidases
tagtttttataaaggtgttgatatctctagtattatttctttagaaaatagtggtgttcaattctacgatactaatggtcaacctcaagatatctttaaaacccttgcaagtgttggagtcaattgtattcgtgttagaatttggaattctccaagaagtactgatggaaaaacttatggaggaggaaataatgatcttgaagtagccagagaaataggtagtagagctgcgaaggctggacttccattatttgttgattttcattattcagatttctgggcagacccagccaaacaatctattccaaaagaatggaagggttttgatttaaataaaagaatttttgaaatttatagatttacaaaaggttgtttagaatggcttttagaaaatggatcatatatatctatggttcaaattggtaatgaaactacttgttttatgtgtggtgaaaatgaaatggtcaatgttatgaaaatgatgagtaatggtatccaagctgtacgtgatattaataaaaatatattaattgcacttcatttcaccaatcccaataaaacagataatatgttatggtatgcttctcaacttgctgaagcaaaagtagattatgatgttttctgtacttcctattatccattttggcatggaactactgaaaatttacaatggatattaggagaaattgctaataaatatggtaagaaagttatggttgctgaattttcatatccatatactgaagtagcaaagacatcagataattgtgaatacagtcatgttaatcataagttagaaggtaccgagtttaattatccattaacattagatggacaaattcaatgtataaaagatgtttatagtcacataaaaaatacaaagaatggtattggggccttctattgggaaccagcatggattgcacccaaagctagtaatgatttagaaagaagacaactttgggaaaaatatggttctagttgggctacaaaaactgcagctgagtatgatattaatgccgatagtagtcttaccggtgaatcagcatgggataatcaagcagtttttgatcaagaaggaaaacctttaaaatccatttgggcactagg

SEQ ID NO: 13703 - DNA, 915 bp, Neocallimastix californiae
  (Trans)glycosidases
ttacctttctactaagggtcacaatattgttgattcaaagggtcgtaaggttcaattatctggtctatcatggttcggtggtgaaactactaacctttccccacacggtttatgggctaactctttagctaactttattaagattgtcaaggataatggttacaaccatcttcgttacccatggactaatgaaatgttctttgaaggtgctaagactcaatctgttgatcaagtgaacaatccagatcttgctgatctttctccattagaaattatggatgccgttattaatgaatgtggtaaggccggtcttaaggtttatcttgatcgtcacagaccactttctggtggacaaagtgaattatggtatgttgatgaagttgatgaagctaaatggattgaagattggcaattccttgctaagcgttacaagggtaatccaaccgttattggtgctgatcttcacaatgaaccacatggtactgcttgttggggatgtggtgaaactaaacgtgattggagacttgctgctgaaagatgtggtaatgccatccataaagttaacccagattggcttattattgttgaaggtaatgatcactatggtgaagaaggttggcaaaagggagaaggatactggtggggtggtatgttaaagggtgttaaggaaaacccagtaagattaaataccccaaacaaacttgtttactctgctcatgattatgataagaatgtattcatgcaagattggtttaaagaatccgatttcccagataacatgccaccaatttgggatgataaatggggatacattgttaaggaagatattgcaccagttcttattggtgaattcggttcactcttaagagatgccacagatgttaaatggttaagtaacttaatttattacatgaa

SEQ ID NO: 13704 - DNA, 771 bp, Neocallimastix californiae
  (Trans)glycosidases
agctattgattattttattgctgctgcatctcaaagaaatataagattggtgctaggttttacaaataactggactgattatggtggtatggatgaatgggtaaaaggttttggaggaaaatatcacgacgatttttatactaataaagaaattcgtaatgcatttaaaaggtatattaaaactgtaataactcgtattaatcgtcatactaatattcgttatagagatgatccaacaattttttcatggcagttggcaaatgaaccaagatgtggtaatggtccatctggacttcctcaatcagggaagtgtactccggaagttattactgaatgggctgatgatattagttcgtatattaaagaattagatccaaatcatcttgtctcagttggtgttgaaggttttggtcttgaagcacctaaaggatctaaaggattatatgcatataaatatgatgaaggaactgattttgaagcattaaccgcattaccaaatgtagattataatacatatcattattacccaattccatggggaatgacagacttaatttctcatactaaagattggattgaatcacatcaagctgttggaaaaaaattaaataaacctgtagtttttgaagagtggggtcttgaagtaccgaccgattgttcaaaagaagaacgaattcaatattataaaacttggacaaaacaaattcttgatgctgatgtaccaatgaatatgttttggtacacagttggagctgattattatggaactga

SEQ ID NO: 13705 - DNA, 927 bp, Neocallimastix californiae
  (Trans)glycosidases
agactatgctaatggtttcagaattggtgttgctgctaacactatgaaatttaataatcaagcctataatgaagccttaaaagcctttaattatatggttgctgaaaatggttgtaaattgtctggtattcaacagcaaaaaggtgtttacaacttcagtgattgtgataaccacttaaagaaagctaaagaattaggcatggacttccgtggtcactgtcttatctggcactcataccaaccatcttggttcgaaaatgctgatgcaaacaccttaaagaatgctatcgttgatcacattactaagactttacaacactatgaaggaaagattgatacttgggatgttgttaacgaagctattgatgacagttctaatggaaatggttggaaaatgcgtaactccttcctttaccaaaaagttccaaactttgttgatttagctttccaaactgctcgtaaagtttctccaaatactaaacttttctataacgattataatactgaaggtatttatggtaaatctgaatcggtataccaatttgtaaaagatatgatttctcgtaacattcctattgatggtgtaggtattcaatatcatgtttctgtttcaagtcagccaaaatacgaaaaaattaatgatttaatttcccgttactgtaaacttggtattgaagttcatattactgaactcgatgttaaatgtgataatcaatgcaacagcaataatgttgaacaacaacaagctacagtcttcactaatgctttaaaggcttgtttcagtaattcatgctgtaccggttatcttgtttggggtgtaggtgataatgatagttggttaggttctgacaagaaaggtttacttttcaatagtaactacaagccaaagtctcaatacaccgctattcttaatttcttaaaagaaaa

SEQ ID NO: 13706 - DNA, 1044 bp, Neocallimastix californiae
  (Trans)glycosidases
attccgttttggtgttggtttaaacggtgctagtattgaaaattctactgtttcatctaaaactatgagagaagttatcaaacatcaattcaattctgttacttactcaaaccttatgaaatcattatttattcttaatcaagaaggtagtattaagaatcttaaagaaggtaaacaagatccagctttagatttcagtggtattgttgatggtttagatttctgtcaaaagaatggtattcacatgagaggtcatgttttagtttggcacaaccaagtcccaagatggttcttcaccaaagattattctgaagatggtgaatttgttgatccagaaactatggaataccgtttagatagtttcattagacaatatcttggttttgttcaatactactacccaggtgttgttgatgtttgggatgttgttaatgaagctgttgaagttgttggtgaacaatatgataattctactggttggtacactcgtactttatatgatgaagttaaaccaaacatgtggtatgatatgtttggtccagattacgttgttaaaactttccgtattgctcgtaagtatgcccttccaaatgttaaattagtttacaacgattactgtacttatgtcactaaaccaattagtaagagagatgctattgttaaacttcttggtattttacaaaaggaagatttagttgatgctattggtatgcaatcctacatcaacccagaagaagatgttaatgaccatttagcagctattgaagtataccaacaaaccggattagaaattcaaattactgaattaactattcgtgttaagaatactgatgactgggaagaatacaatattcaacaatacagtcaactctttgaaggtattatgaaatatgttagaaagggttacaatattggtagtgttactgttttcggtttacaagatggatacagattctatgaaaacgattccaccaagactcgtctcttcgatcacgatcttcaaaagaagaaggtttaccgtgctattatggatatcattaaggc

SEQ ID NO: 13707 - DNA, 1050 bp, Neocallimastix californiae
  (Trans)glycosidases
agccccattccgtttcggtgttggtttaaatggtggagccatttctacttctactactacttcaaaaaaaatgagagaagtcattaaatatcaatttaactctatgacttatactaatcttatgaaaccagaatttgttcttgataaggaaggttgtctcaaaaacgctgaaaatggatctgaagaagtcgtattaaaatttgatgatattgttgacggtttagattttgctttaaagaataatattcacgttagaggtcatgtattagtatggcacacccaaactccagattggttcttcagaaaaggattcaattctgaaaatgaatttgctgatgttgaaactatctatcaacgtttagaaagttatattcgtcaatatcttggatttgttcaacacaattatccaggtgtcattgatgtttgggatgttgttaatgaagctattgaaattaatgatggatatttcgataactctactggatggtataccagagtctctactcaaactgaagaaagtttatggtataagattgttggaccagattatgttaagaaaacatttgaaattgctcgtaaatacgctcttccaaatgttaaattagtttacaatgattacaatactttccaaacctatccacatgataaaactcaagccatcattgatcttatgaatattttaagaaaagataatttagttgatgctcttggtatgcaatcttatattggtgaaacttggccaaagattgaagaatatgttagagccattgaacgtttcactgaagctggtttagaacttcaaattaccgaattaaccattaccccaccaagtggagaaggttggttagaaaaacaagctcaacaatatcgtgaattctttgaaaaagttatggaacaaattaataagggagctaatattaccagtgttactgtatttggtattcaagatggatatagattctacacctctgacagtactaagactcgtcttttagatcatgatcttcaaaagaaaccaaattacgaagccattatggaagttttaaaagc

SEQ ID NO: 13708 - DNA, 1035 bp, Neocallimastix californiae
  (Trans)glycosidases
ccgtatgggggttggtttatacggtaccagtaaaactaattctccaattttctcaaagaaaatgcgtgacgtaatcgcctatcaatttaattctgttaccttcactaatcttatgaaagctgatcaaatgttggataaggccgcctctcaagctaacgccagaagtggtaatgatatgccagttttaaaatttgattccatcgtggatggtttagaatactgtaaagcgaataacatcaagatgagaggacataccttggtttggcatgttcaagctccagaatggttcttccgtactggatttaacgataatggtaactatgtggataaaaataaaatggaaaaacgtatggaaagttacattaaacaaatgtttgaatttgttcagcactactatcctggtgtagttgatgtctgggatgtcgttaatgaagcggtcgaaattactaatggtagttttgatgcttcctccggttggaatactcgtactaaatatgataataataaaacaaatccatggtatgctaccatgggtcctgattatgtcttcaaagctttccgttttgctcgtaaatacgccaataaagatgttaaactcgtctataacgacttcaatacttttatgtctcaaaagacaaatgccatctgtaatcttgtaaagaaattaaaggctgaaaacttaattgatggtgttggtcttcaatcctacttaggtccaagctggccaaatcgtaatgactataagaatgccattcaaaagtttagtgctctcggtgttgaaattcaaattaccgaattaaccattagtgtcgaagaatccaataataaattcaatgctcaagctaatcactacagagatgtcttcaagatttataaggatttaaagaaaagtggtgttaacattaccagtgtcactgttttcggtttacaagatcactacttattctatgataatgataagacagaaactcgtttatgggaccgcaatcttaagaagaaacaagcttacaattctgtcatgagtgtcttaaaagc

SEQ ID NO: 13709 - DNA, 504 bp, Neocallimastix californiae
  (Trans)glycosidases
aggtgtttcctcatggtcatgggttgctcactgggggtacggtgaaagtgatcaatcgaatcctaatacgcataaaaaatggattgatctggcttcaaccatgggatggagattctacattttagatgaaggatggcaaccagatagttatgacaatgatggtagttattactcgggttggtttgattggtggccagaagttagagattatgctaaaaggaagggggtacaacttattgcctgggttcacaagaatgatgtggatacaccggaaaagagaagaaaaaggtttaaggaatggtcagaggaaggaattgttggtattaaagttgatttcttcttcaatgaggctcaaagtaccttacaacttcatcaagatatttataaagaggcggccaggtaccatttactcgttaatgttcatggttctaatccaccatcaggagaaattagaacttatcctaatgttcttgctcgagaaggtattagaggacaagaggctgg

SEQ ID NO: 13710 - DNA, 978 bp, Neocallimastix californiae
  (Trans)glycosidases
gattaaaatgtctgacgttattcaacaagtcagaccagatttctattttggtgttgcaactcaaaaaactttctttgctaacccaaaatacaaagatatcatgtcaacttttaatttagaagttggtggtaacgaatgtaaattctatactataaatggatctgaaactttcaacactaaggcttgtgatgaatctattgcttttgctaagaaacaaggtgctaagtaccgtggtcacaatcttttctggccagctaattctccaagttggtttaagagtgcttacgatggtaaagacccagaagaagttaaggaatacattcttgactacattacaaaggttttagatcattacaaggatgaagaagatatcatttactgggatgttattaatgaatcagttaccgatgattctaccccagaaaatattaaattacgtaccggatccgatactagtaatgaatttaagggttgggatacctatactgaagatatcttcaaacttgctcgtgaacacactaatgaaaatgttaaattaatttacaatgattataatgctgaagctaatggtggaaacttcggtggtaagactggtgctgtattccaatacattaaatccatgaaagaaaacggtgttccaatcgatggtgttggtttacaaatgcacatttcttgtaattggactccaaattacgaagaacttactaaattaatttctcagtatgaagaaattggtgttgaagttcatgttactgaaattgatgttaaaatggagaactgtaaaactcatgatgatcaaaggaaggtatacatgaacatcttcaaagcttgtttcgatcatgaaaactgtaaagtcttcactgtttggggtgcttacgattctgaatcatgggttggtgctgaaaacgaaccacttattttcgatgaagatatgtatccaaaggacatttactttgacatgttagattacgttatcga

SEQ ID NO: 13711 - DNA, 1029 bp, Neocallimastix californiae
  (Trans)glycosidases
ttacttatctactaaaggtaaatacattgttgatgaaaagggtcgtaaagttaaattagctggtctttcatggtttggaggtgaaactccaaatctttcacctcatggtttatgggctaaaccattagctcatttcattaaagtaattaaagatcatggttacaaccacattcgttatccatggactaatgaaatgtttgtagaaggtgcaaagactgaatctattaatgctatggaaaatccagatcttgttgatcttactccattagaagttatggatgcagtaattgatgcttgtggtaaggctggtttaaaggtttaccttgaccgtcacagaccaactgccgctggacaaagtgaattatggtatatttcaaaggttgatgaaaagaaatggattgaagactggaaattccttgctaagcgttataagggaaatccaaccgtaattggtgctgatcttcacaatgaaccacatggtactgcttgctggggatgtggtgaaactgaacgcgattggagacttgctgctgaaagatgtggtaatgctattcatgaagttaacccagactggcttattattgttgaaggtaatgatcactttggtgaagaaggttggcaaaagggtgaatcctactggtggggaggtatgttaaagggtgttaaagaaaacccagtcagattaaataaaccaaataagcttgtttactctgctcatgactacgataagaacgtccatatgcaagaatggttcaagctttctactttcccagataatatgccagaaatttgggatgatgtttggggatatatttctaaggaagatattgctccagtccttattagtgaattcggttcacttttaagagataagactgatgttaagtggttagaaaaccttgtttcctacatgaatgataatgctgttcactggactttctggtgtttaaatccaaattctggtgatacagaaggtattcttggatatgattgggaaaccgttaatacccaaaaagatggtattcttga

SEQ ID NO: 13712 - DNA, 1113 bp, Neocallimastix californiae
  (Trans)glycosidases
cgaaggttttggtaccagtttttgttggtgggcgaacagacttggttactctgatattttatctgaaaaggctgctaccctcttctacgataaaaaggaaggtttaggtcttactattattcgttataatattggtggtggtgataatccatctcataatcatattactagaacggattctaacatgccaggttatgccattaatccacgttataacggtaatggttcctacacctgggattacaattggaatagtgatttcaatcaaagaaatgctctacttaaagctatcgctaagaacaaggaagaaatcatcgttgaaggtttctctaattctccaccatactttatgactaattctggttgttcaaccggtaatactgatcctaataaggataacctaaagagtgacgcctatcctgcttttgctaaatatcttgcggatgttgcggagcacttcagcaaaagttggggagttaccttccaaagtatgaccccagtcaatgaaccatttactaattactggggagcaaatagtaaaaaacaggaaggatgtcactttgatcaaggaaattctgaatcaaaaattattgtagaacttcgtaaagccattgatcaaaagggcttaaagagtattcaaattagtggtacggatgaaactagtatcgatactcaaattacttcatatgaaaaacttagcaatgaagctaagaatattattactagaattgatacgcatacctatagtggtagtaaacgttatgaattaagagttcttgctgaaaatagtaagaagaatctttggatgtctgaagtcgatggtggaggtgttgcaggaacaaatgctggagaaatgggtgccggtttatggcttgctaaccgtattattgaagatttgaatggtcttagatcctctgcttgggtcttatggcaagtgattgataatcatattagtaagaatggatacaatggtaaaaaggatagtggtatggttaatttgaatggtggttactggggtattgctgttgccgatcatgataagaatgatattattcttacgcaaaagtactatgcttttggtcaattctctagatacattcgtccaggttacac

SEQ ID NO: 13713 - DNA, 1068 bp, Neocallimastix californiae
  (Trans)glycosidases
gaaatttgaaaactttttattcatctttggttgtgttggttcatctttagcattaaccacgaaggaagtgattaaagatatgggacttggttggaatttaggtaatactttagaagcatgtggagattggattaatggtagtaccactaaacaatatgaaactgcatggggaaaccctgaaaccactgaagctatgattaaaggtgttaaaagctatggtttcaagtcagttcgtattccagttgcatggagtaatctcatgtcttctgattatacgattagtccattattacttaaaagagtggaagaagtagtcaattatgttgtcaaaaatgatatgtatgctataatgaatatccactgggatggtggttggtttgaaaaattttctacctcggaacaagaagcatttactaaatacaaaaaagtttgggaacaattaacggattatttcaaaagttttgatgaacatttaattttcgaatcattaaatgaagaaggttgttgggattccatttggaatcgctattctaaatctggtgacaaggccaaagcctacggtttattaaatacaattaatcaaaactttgttgatattgttcgtaattctggtggaaacaataccaatagacatttacttttagctggttattgtacagatattgacttaacggttgatgaagcctatgtggttccaaaggatgatagagttatggtctccgttcactactacactccatccactttcactcttcttgaagaagatgccgattggggtaaggctgcccctacctggggtacggatgatgaagttaactaccttattaatgatttcaataaattaaagacacgttttgttgataaaggtattccagtcattattggtgaatatggtacaactgctaaaaataaagataccgaaagtattcataaatatttaatgacatgtgcagaatatgccctaaacttagatatgtgtccagttgtttgggatgcaggacaatactttgatcgtaattcattaaccttcaaggactccgaaattggagaattatataagagtctttc

SEQ ID NO: 13714 - DNA, 1014 bp, Neocallimastix californiae
  (Trans)glycosidases
ttttgttcaaactgatggcaccaacttcgtggttgatggttgcaaacgttatttctctggttctaatacatactatttaatggtatcaaatcacgaaagagttgatttagctcttgaagcttatgctagacataatcttaatgttgttagagcttgggctttctgtgatgaatgtgaagatgctacaagattagttgatttttctggtccagaagttacccttaatagtgaaaacatggaaaaggttgattattatcttgctgcggctgctcaaagaaatattcgtgttgttttaactcttacaaataattggactgattatggtggtatggatgtttgggttaaacaatttggtggaaaatatcatgatgaattctatacaaatagaaaaattgttgaaggttataagcaatatattaaagctatgattaatcgagttaacacttacactggtcaattatataaggatgatccaacaattttctcatggcaacttgctaatgaagcccgttgtaacaatggaccacatggtcttccagttaaaaattgtaatactgatactattacaaattggatggacgaaattgcttcatttatacatcaagaagatccaaatcatttagtttcttctggtattgaaggtattggtcttactccaccatcgggtgttgatccaaatacttatgtttatagatatgatgaaggaactgattatgaagctattagtgctcttgattctattgactataatactgttcatatgtatccagttggatggggactaaaggattatagcaaagatggtgttacatggattaaagcccacgctgatgttgataagaaatttaataaaccaactgttgttgaagaatggggtcttagtacttcagcagataatgttccacttgaagaacgtgatccaatttatacaaaatggatggatgctgtattggctaatgataatattggtatgaatatgttctggtatgtttgtggtgaagattattatggaac

SEQ ID NO: 13715 - DNA, 636 bp, Neocallimastix californiae
  (Trans)glycosidases
tttacccgatatgttaccaggatggccatacaattggccaggtatgcaaagttggttaaaccaagtcaaatctttcattaatgataaaaagaagtcaggattaaccaattggtatggtttagaaatttggaatgaaccagatggtacttggaaagattctaatggaagtttcaatcaaatgtggaaacaaacatatgatgttattcgtcaagctgatccaggagaaaaaattattggaccatgttacagttggtatcaagaaaataagatgaaagactttttacaattttgtaaacaaaataactgtttaccagatattattagttggcatgaattgagtggtattgaaggagtttctagtcacttaaaggcataccgtaacttagaacgttctcttggtattaaggaacttccaattagtattaatgaatactgtgatgcggaacatgaattagaaggacaaccaggatctagtgcacgtttcattggtaagtttgaacgttacaaggttgatactgctatgattacttggtggtttgttccacacccaggtcgtttaggtagtttaatggctacagacaatcaaaagggagcaggttggtacttctataaatggtatggtgatatgacaggaga

SEQ ID NO: 13716 - DNA, 636 bp, Neocallimastix californiae
  (Trans)glycosidases
  modified_base (88)..(88): a, c, t, g, unknown or other
tttacccgatatgttaccaggatggccatacaattggccaggtatgcaaagttggttaaaccaagtcaaatctttcattaatgataanaagaagtcaggattaaccaattggtatggtttagaaatttggaatgaaccagatggtacatggagagattctaatggaagttttaatcaaatgtggaaacaaacatatgatcttattcgtcaagctgatccaggagaaaaaattattggaccatgttacagttggtatcaagaaaataagatgaaagactttttacaattttgtaaacaaaacaactgtataccagatattattagttggcatgaattgagtggtattgaaggagtttctagtcacttaaaggcataccgtaacttagaacgttctcttggtattaaggaacttccaattagtattaatgaatactgtgatgcggaacatgaattagaaggacaaccaggatctagtgcacgtttcattggtaagtttgaacgttacaaggttgatactgctatgattacttggtggtttgttccacacccaggtcgtttaggtagtttaatggctacagacaatcaaaagggagcaggttggtacttctataaatggtatggtgatatgacaggaga

SEQ ID NO: 13717 - DNA, 1062 bp, Neocallimastix californiae
  (Trans)glycosidases
gaaactaagcattttattttctatcataggatgggcaagtaccacattagcagccctaactactgaagatattattaaaggtttaactgttggtgttaatttaggtaaaacatttgaaattaatagagattggaaatcggttgaaaatattaatcaaccatgggctgaaaaaaattttacagcaaaagaaattgttgagagttataaacaattaggtttcaatgccattcgtattccggtaaaatgggcaaaaactatcaattctaaaacagttatcgaacctaatttattaaaaagtgtagaagaagtggttcgtcaaaccctaaataataatatgtttgctattattaatttagaaacttcaaatactttcatgacaggttttatttctgaagatgataatatacgttccgaaacctatgatggttataaaggaatatggaaacaaatttcaaattattttaaggattatgatgaacatttattatttgaatctatgaatgattctggttattgggaagatatatggaatactagaacttctgatggggatagacaatatgctcttgatatattacgtcaagtcaatcaagaattcattaatatggttcgttcaacaggtggttcaaatgaagaaagatatttattagtcagtggttatgctaatgatcctatcctaactcaagataacttctataaaattccaagtgatccttcccataaacttatggtttctctttattattatgttccaaatcattttactatcatcgataattattatacttggggttcacaagatgacattaaacagcttcaaactattatgaaaaatcttagtgttcgctttgttattcaaggtgttcctgtagttatcactagatacggtactattgtaaaaaatagaagttcagctaatattcatagttatttaacttccattgctaataatgcatcttctaaaaatataccatcctttttaagtgattctggtgaatttattagtcgtgatcatcttccactttctttcatagaagaagaattaggtaaattttataaaga

SEQ ID NO: 13718 - DNA, 1110 bp, Neocallimastix californiae
  (Trans)glycosidases
taatttttataaaggtgtcgacatttccagtattatttctctagaaaatagtggtattcgtttctacgacactaatggtcaacaaatagacatttttaaaatgtttgctagtgttggggttaattgtatccgtgttagaatttggaataacccaaagagtgctaatggaaaaacttatggtggtggtaataatgatcttgaagtagctagagaaataggtagtagagcagcaagtgcaggcctaccattatttgttgattttcattattctgatttctgggctgatccaggaaaacaaactattccaaaagattggaaaaactttaatcttgataaaagagtctctgaaatttatagatttactaaaggttgtttagaatggcttttacaaaatggttctcttatttcaatggttcaaattggtaatgaaactacatgctttatgtgtggtgataaaaatatgacaaatgttatgaaaatgatgagcaatggtgcaaaagctgtacgtgaaattaatagagatatattaattgctcttcattttacaaatccaaataaatcagacaatatgttatggtatgcttctcaactcgcttctgctagagttgattatgatgtttatagtacttcttactatccatattggcatggtactactgataatttaaaatgggtattaggagaaattgctaataaatatggtaagaaagttatgattgctgaatattcttacccatatactgaagttgcatatacatcagataattgtcattatggtgttgtagactctaaagcaagcggtactgtattccgttatccaattagtgttgatggtcaaattcaatgcattagagatatgtattctgttatgagaaatacaaagaatggtattggtgctttctattgggaaccagcatggattgctccaaaagcaagaaatgatatggaaagaagacaaatttgggagcaatatggttccagttgggctaccaaaactgcagctgaatatgattcaaatgctgatagaaaccttacaggaggtacatcatgggataatcaagctattttcgatcaaaatggaaaagttttaaaatctatttgggctttggg

SEQ ID NO: 13719 - DNA, 876 bp, Neocallimastix californiae
  (Trans)glycosidases
aatgcatgttcaaggaagtaaacttttagatggaaatggtaatgaatttattttccgtggtattaatattgcacatgcttggtatactgataagacggaattctccattaatgaaattaatgctttaggtgctaacagtgcacgcattgttttagcttgtggtgctaaatacacaaaaacttcatatactgaagttgaaaagatcatcggatggtgtgaaaaggctggtttagtatgtgttcttgaacttcatgactttacaggatctgataatccatccgatattactactactgctttaaattactggaaagaaatgaaggatttagttaatactcataaagattatattattataaatatagctaatgaatggcaaggtagttggaataagggatccctctggggtaatacttattcttctgctgttaaatctatgcgtaatattggaatccaaaatgcaattatgattgatgcttctggctatggtcaagaaacaggaccaatgataaattatgctcaaagtgttctttcagctgatcctaataaaaatgttattttttcctatcatgtttattcagttctcggtaaagacaatactagtttatactctggtttcgatggaataaaagctaaaggagtatgctggattgttggagaatttggttggtggcaaaatggaggagatgttgtatataaatcattaatgagttactgtaattctaatcgtattggatggattgcttggtcttggtcaggtaatggaggtattgacacctgtcttgatttaacaagttcaaaaaccttttctagaaatagtttgagtgattggggaaaatatgtattttattcaaatgatggaattaaatattcatc

SEQ ID NO: 13720 - DNA, 1065 bp, Neocallimastix californiae
  (Trans)glycosidases
taaagcagctccattccgttttggtgttggtttaaatggtggtgctattgaaaactccacaacttcttccaaaacgatgagagaggttattaagcatcaattcaactccgttacctattctaacctcatgaaagcagtatttgtacttaatcaagaaggtagtattaagaatcttaagaaaggtaaacaagatccagttttagatttcagtacttttgtggatggtttagatttctgtcaaaagaatggtattcacatgagaggtcatgtcttagtttggcacaaccaagctccaagatggttcttcacgaagaactatgaagaagatggtgaatatgtagatgctaaaacgatggaataccgtttagagagttacattaagcaatatcttagctttgttcaattcaattacccaggggttgttgatgtttgggatgttgttaacgaagccattgaagttgttgataatcaatatgataaatctactggttggtacactcgtaccttatacggtaataactcaccaaacatgtggtatgatatatttggtccagattacgttgtgaagaccttccgtattgctcgtaagtacgctcttccaaatgtcaaattagtttacaacgattattccaccttcgtcaccaagccagtgagtaagagagatgctatcattaaacttcttggtattttaaagaaggaagatttagttgatgccattggtatgcaatcctatattaatcccgatgaagatattaatgaatatttagctgctgtggatgaataccaaaaaactgggttagaaattcaaattactgaattaaccattcgtgtgaagagtacggatgattgggaagaatacaatattcaacaatactctcagctctttgaaggtcttatgaaacgtgttaagaaaggttacaatattggaagtgttactgttttcggtttacaagatggttacagattctatgaaaacgatactcaaaaattccgtcttttcgatcacgatcttaaaaagaagaaggtctaccatgccatcatgaaaatacttaaaggagagagtgc

SEQ ID NO: 13721 - DNA, 978 bp, Neocallimastix californiae
  (Trans)glycosidases
gaaattgtttaatatttttttttttataattgaatgtgccagtacagctttgagtatagcacttaaagatgttctaaatggtatgagtgttggtgttaatttaggtaaaacatttgaaattaaaaaagattggaaaactgtggaaaatataaatcagccatgggataaaaaatcatttacagcaaaagaaatagttgaaagctataagcaattaggtttcaatgccattcgtattcctgttaattgggctacaaaaattaattcaaaaactattattgaaccaaatttattaaaaagtgttgaggagatcgttcataatactatagataataatatgtttgctattatcaatttagaaacttcaaattcctttatgacaggatttatttcagaagatgaagaattacgttctgaaacatatgacggttataaaaatatatggaaacaagtttcaaatcattttaaggattatgatgaacatttattatttgaatcaatgaatgattccggatactgggaagatatttggaatacaagaactactgatggtgatagacaagctgctcttgatgtattacgtcaagtaaatcaagaatttataaatgcagtacgttcaacaggtgacaataatgaaaaaagatatttattggtaagcggttatgctaatgatcctattttaactcaagataacttttataaaattccaagtgatccatcccataaacttttagtttctctttattattatgttccaaatcatttcactactattgataattattatacttggggttcacaagaagatgttaaacaacttcaaacaataatgaaaaatcttagtattcgttttgttattcaaggtgttccagtgattataactagatatggtacaattgttaaaaatagaagttcagcaaatattaatagttatttaacatctatagttaataatgcatcttctcaaaatatgccttcctt

SEQ ID NO: 13722 - DNA, 1047 bp, Neocallimastix californiae
  (Trans)glycosidases
ttatttccatgttaaaggatctgaaattgttgatgaaaatgatgaacccgttagaattgctggtgttaactggttcggaacagaaactgctcaattatccccacatggtttatggagtaaaaatttaactgaaattttatatttaattgtagaccatggttataatactattagatatccatattgtaatgatatctttaaaccaggagcaagtacagtttctattgaatattatagaaatccttgggctaaaggtttatctccacttgaagttatggatgttgttattagagaagcaacagatttaggtttaaaaattatcttagatcgtcatagaccagattttcaagctcaaagtgctttatggtatactagtgccgtttctgaagaacaatggatttcagactggcaaaaattagctaaacgttacaaggataatagtggtgttattggtgctgatttacataatgaacctcatgatgaggcttgttggggttgtgatgacatttccattgattggcgtttagctgcagaaagatgtggtaatgctattcatgaaattaatcctaactggttaattattgttgaaggaattcatcatattggtgaaacttgttggcaatgtggtgataactactggtggggaggatatttaaagaaaggtgtggttgatattattaataaacctgtcaatttaaagattccaaatcgtgttgtttattctactcatgattatccaagagaagttttcccacaaacttggtttgatgatccaactttcccagataatatgccagacaaatggtacaattattggtcttggattaagaaggataatattgctccaatattagtcggtgaattcggaaccaaattggaagatgattgggatagagtttggttaaagactcttgttaactacatgaaggaaaatagacttcattggaccttctggtgtcttaatgagaatagttctgatacaggtggtttaattactggtggtgcatgggatggatggcacgacgaaaaagatagtatgttagaacc

SEQ ID NO: 13723 - DNA, 708 bp, Neocallimastix californiae
  (Trans)glycosidases
atcaattattatttattatccagaatggaagtactataactatccaccaaggaatcttccatttaacaaacttactcatataaattatgcctttggtgaaattgatccaactaattattcattaaaatatgactctactaagtttttagaattgattgaaactgctcgtagtagaaataaaaatgttaaaattataatgtctgttggtggttggactggaagtagatatttctcagttatgtcatcaaatcctgcaaacagatccaaatttataagtagtgttaaatcgatgttagaaagtactggtgctgatggtattgatattgattgggaacacccaggagtacctggtgctttttatgatagttttgatgcccaaaatgatacctataatttattaaaattgatgcaagaattacgtgaagctattggtaaatcaaaaattatttcaactgctgtaacgttcaatttatttgttgtgaactatcaaccattacaagacttatctaaatttgccgaaatattagattatattaatcttatgtgttatgattttaatggaagttggtcaaatattatatcacatcaatcttcactatacccaactggaggaaatgatagtggattttctgtagaaggtgctgttaaaaattggatgaatgctaaatttccatctaacaaaattgttattggtattccttcttatgg

SEQ ID NO: 13724 - DNA, 108 bp, Neocallimastix californiae
  (Trans)glycosidases
tgatccagaatcagtgaaaattaaagctgattatgtaatcgaaagaaatttaggaggtatgatgatgtgggaaattgaagaagatacaaaggatggtgaattaatttc

SEQ ID NO: 13725 - DNA, 1074 bp, Neocallimastix californiae
  (Trans)glycosidases
ggaagctccattccgttttggtgttggtttaaatggtgttgatataaataattacactccaagttcaaagaaaatgatggaacttatcaagtatcaatttaactctatgacttattctaatggtatgaaaagtattaaaattatggatgaagaaggatctcgtaagaatatagccgaaggtagagaagaagttgctgttgacttttctggaattattgatggtcttgaatttgccaagaaaaatggtattcacattagaggtcacgtcttagtttggcacaaacaaactccagactggttcttcagaaaagattttgatactgaaaaggaatatgctgatgttgaaactatctttgttcgtttagaaagctacatgaaagctttctttgacttccttaacttcaattacccaggtgttgttgatgtctttgatgttgttaatgaagccattgaagtcagagaaggaaaattcgataactcaactggttggtacactcgtactgaatctcttgaaggtgatgacaatatttggaatactcttgttggtccaagttacgttgttagagctttccgtattgctcgtaaatacgctcttccaactaccaaattagtttacaatgatgttgataccttcatgactaagccacatgacaagacccaagctgttattgatctcatgaacatattaagagctgaagatttagttgatgcccttggtatggaatcttacattgatcaagacttagttaatgtagatgccccagaagactacgctcgtgccattgaacgtttcaccgaagctggtttagaaattcaaattacagaatttactatctacaatgatgatagagaagattggttagaaactcaaactaagagatacagagacttcttccaagttgttatagatcatgttaagaagggatatgataatatttctagtttcactgttttcggtttacaagatggatacagattctacgataatgatactcaaaaaactcgtctcttcgatcatgatcttcaaaagaagccaaactactatgccatcatggaaattttaaagcaatacaa

SEQ ID NO: 13726 - DNA, 912 bp, Neocallimastix californiae
  (Trans)glycosidases
gattcaatacactggtgtcaatgaatctggtgcagaatttggagaaggaaaataccctggggtatataataccgattatatttatccagatgtcaaagctattcaagcctctattgatcaaggtatgaatattttccgtgttggtttttcatgggaacgtatgcaaagaacattaaattcagcctttgatactacagaatttaagcgtttggatgaagtgattagttacattactaaaaatggagcagtcgctattcttaatccacataacttcgctagatatagaaatagtgttgttggttccagtcaagttccaaattccgcctttgctgatttctggaaaagaatggctgataaatataagagtaataataaagtttggtttggattagtgaatgaaccccatgacatgccaaccgaacaatggttctctgctgcacgtgatgctgtcaatgctattcgtaaagcaggagcgaataataatgtattagttccgggtaattcctacacaggagcatggtgctggacgaaaacacattatggatcaccaaattcaaaagtagcacttgaatattttaatgcttccgataaaaatattatttatgaagttcatcaatattttgatagtgattattctggtacgcatgagcaatgtgtacaacgtccatgtaataaacttttcactgattttgttgattggttaaaagaaaataatttgaaaggtttcgttggtgaacttggagcagctatcaataatgactgtaaagcctgtgtagaagaagccttaaactatttagaaaagaattctgactatgttgttggttggacttggtgggcagctggtccatggtggggtaattatatgtattccattgaaccaaaaggtaatgcattcccagaacaaatgacctg

SEQ ID NO: 13727 - DNA, 975 bp, Neocallimastix californiae
  (Trans)glycosidases
ggtgaagatgtcagatgtaattcaacaagttcgtccagatttttattttggtgtagcaacatcgattgcttattcctctaatccaaaatataaggatattgtttcttcttttaatttacatgttggaggaaatgaatgtaaattctataccattcaagcttctaaaacccgaaatttctatcaatgtgatcagtcattgtcctacgcaaaaaaatttggagccaagtatcgtggtcataatctcttctggccagcaaattcaccaaattggtttaagacctacagtgatgatattgaagttactaaaagctatattattgactacattaaaagtgttttaaatcattatcgtgatgatgatagtattatctattgggatgttattaatgaatcagttatggatgaatccacctccaatgatattcaattacgtacaggttcaaaaactagtgatgaatttttgggatgggatacgtataccgaggatatctttaaattagcaagagataatatcaatgaaaatgtcaaattgatttacaatgattattattgtgaagccaataatggtaattttgatggaaaaacaggtgcagttttcaattacattaaaaatatgaaggaaaaggaggttcctattgatggtgttggtcttcaaatgcatgtttcttgtaatgacgcaccatcatatgatgatctttacctgttgatttcacgatatgaagaaattggagttgaagttcacgttactgaaattgacgtaaccatggctcgttgtaacagtctcaaagatcaaaaggatgtctatatgaatattttcaaggcttgttttaatcataacaactgtaaagttttcactgtctggggagcctatgatacagaatcatggattggagctgagaatactccattaatatttgattcagatatgtatcccaaagatatctattttgaaatgttagattatgttttaggtaa

SEQ ID NO: 13728 - DNA, 1035 bp, Neocallimastix californiae
  (Trans)glycosidases
tttcttatctactaagggtagaaatattgtagaccagaaaggtcgtaatgttaaattagctggtatttcatggttcggaggagaaactgataatctttctccacatggtttatggtcaaaatcgttagctcacttcattaaggttattaaggataatggctataatcatattcgttacccatggactaatgaaatgcttctctcaggtgccagaactaaatctattaatgctatggaaaatccggatcttgctaatcttacaccattagaagttatggatgccgttattaatgctgctggtaaggcaggtttaaaggtttaccttgatcgtcatagaccaactgcagctggtcaaagtgaactttggtatatttctaaagtggatgaaaagaaatggattgaagattggaaattccttgctaagcgttacaagggtaatccaacagttatcggtgctgatattcataatgaaccccatggtactgcttgttggggttgtggagaaactaagcgtgattggagacttgctgctgaaagatgtggtaatgccattcatgaagtaaatcccgattggcttattattgttgaaggtaatgatcattatggtgaagaaggttggcaaaagggtgaatcctactggtggggaggtatgttaaagggtgttaagcaataccctgttagattaaataagaagaacaagcttgtttattctgcacatgattatgataagaatgttcatttacaagattggtttaaggtatctaacttcccagacaatatgccatctatttgggatgataaatggggttacattgcaaaacaaaatattgcaccagtacttattagtgaatttggttctctcttaaaggataaaactgatgtaaaatggttacaaaaccttatttcttatatgaataagaatggtgttcattggactttctggtgtctaaatccaaattcaggtgataccgaaggtattctcggttatgattgggaaacagtgaataaacaaaaggatggaattcttacacctgg

SEQ ID NO: 13729 - DNA, 1056 bp, Neocallimastix californiae
  (Trans)glycosidases
ctttttttccctcttaggttgtgctggctcaactttagctttaacttcaaaggaaattactaaagaattaggacttggttggaatttaggtaacaccttagaagcttgtggagattggattaacggaaaaactaccaagcaatatgaaacggcttggggtaatcctgtaaccaccgaagaaatgattaagggtgtaaagagttatggtttcagtacagttcgtattccagttgcatggagtaatcttatgtcttctaattatactattagtcctttgttacttaatagagttgaagaagttgtcaattacgtcgtcaaaaatgatatgtatgctattgtaaacattcattgggataatggctggttcacaaaatttgctactgatgaagaagaagcttttattaaatataaaaggatctggggacaaatatctgaacattttaaggattatgatgaacatttgatttttgaatctttaaatgaagaaggttgctgggaatcaatttggaataattattcaaatgaaggtgataaacctaaagcttttggtcttttaaatactattaatcaaaactttgttgatattttccgtaactctggtggatataatgctgaaagattcttacttttagctggttattgtactggtattgatcacactatcgataaaaattatattcttccaaaagatgataaagttatggtttctgttcattattatggcccttccacttttactattcttgaagaagatgccgattggggaaaagctgcttattattggggtactgaagaagaaatcaataatattactaatgatcttatcaaagtaaaaactcattttgttgataataatattcctgttattattggtgaatacggtactgctactacaaataaggatccagaaagtgttcgtaagtggttaagaactgttgcaggaaaggcaacagaattgggtatatgtccaattgtttgggatgctggccaatattttgatcgtaaagccttaactttcaaagatccacaaattggagaattatacaaggaattatc

SEQ ID NO: 13730 - DNA, 1047 bp, Neocallimastix californiae
  (Trans)glycosidases
taaggctgctccattccgtatgggtgttggtttaaacggttctgataaaagtacttctacagttctttcaaagaaaatgcgtcaactcattgcttatcaattcaattcagttacctattctaatcttatgaaggctgaacatattttagataaatctgcttcccaagctaatgctaataaaggtaatgatatgccagtcttaaaatttgacactattattgatggtttagaattctgtaaggaaaacaatattaaaatgagaggtcacaccttagtttggcacgttcaaacaccagaatggttcttccgtacaaactttagcgatagtggttcatatgttaatgcccaaaaaatggaaaagcgtatggaaagttatattaaacaaatgctagagtttgttcaatactactacccaggtgttgttgatgtttgggatgtcgttaatgaagctgttgaaattgaaggtggtagttacgatagttctactggttggaacacacgtactaagtacaatggaagtgcaaatccatggtatgctactatgggtcctgattatgtcttcaaggcattccgatttgctcgtaaatacgctgacaaaaatgttaaacttatttacaatgattacaatactttcatgtcacaaaagactaatgctatttataatcttgtaaaaaaattaaagtctgaaaatttaattgatggtgttggtcttcaatcttacttaaacgctgactggccaaatcgtaacgattacaagaatgctatgcaaaggtttgcatctcttggtgtagaaattcaagctactgaattaactattaaaactgatggatctagtaataagttcaataatcaagctaaacactaccaagaagtcttcaagatttacaaagatttgaagaagagcggtgttaacattactagtgttacagtcttcggcttacaagatggctacttattctatagtaatgattcaaccgatactcgtttatgggaccataatcttaagaaaaagccagtttactattctattatgaatgctttaaaggc

SEQ ID NO: 13731 - DNA, 1062 bp, Neocallimastix californiae
  (Trans)glycosidases
ggaagcgcctttccgttttggtgttggattaactggaaccaatttacaagtttccacaaccgtttcggaaaagatgagagatatcattaagcatcaatttaattcgatgacctacaccaatttaatgaagcctctctacattttagataaggaaggaagtatccaaaatattaagaatggcattcaagatccaaagttaaactttactagtatcgtcgatggattagaatttgcttataaaaatggtatccacattagaggacatgtcttgatttggcacactcaaactccagattggttctttaatgaaggctatactgacgatggaaaaaaagtcagtccagaggttatggaatctcgtttagatagttatataaaacaatatcttagttttgtacaatttaattatccaggagtagtagatgtatgggatgttgtcaatgaagccatagaaattactgatggacaatatgatgccaatacaggatggtatacccgtaccatgttaaacaatacccctaatccatattacgatatgtttggaccagattacgtcattaaagccttccgtatagctcgtaaatatgctcttccaaatgtgaaattagtgtataacgatttcaatacattccaagtatggccccacaataagacacaagccattatggatttagccggaattttacagaaagaagatttaattgatggtattggattacaatcgtatttaggagtcacctggccatcccttgatgaatactttagaggtgtcgaaagattagccaccacaggacttgagcttcaaattaccgaattaactattaccgccccagatggagataattggttagaagcacaagcagaacaatacagagatttctttgaaagattaatgaagcatgttgaagaaggatacaatattggcagtgtcaccgtatttggacttcaagatggctatctcttctacgctagtgattcgacaaaaacaagacttcttgatcatgatcttcaaaagaagccaaactttgaggcgattatgagcattttaaaatcttataagaa

SEQ ID NO: 13732 - DNA, 786 bp, Neocallimastix californiae
  (Trans)glycosidases
ccaaaaaaatattgctgctttcgaaagtttacaagatagacacttggatgttgttcatcttttcattcattgggataataaagatgaaccatgggaatgggctcgcaattttgtagatatcgctaaagctaatggttccattatgatgatttcatggatgccacagccatatactgctcaagatattcttgatggaaagggtgatgaatacattgatactttcgttaaaggtgtcaaagattttggtgaggaaatttggcttcgtcctcttcatgaagccaatggtgattggtacacttggggtactggtgctgatagaattaataattcggaagataagcttgcagccgcttatcgtcatattgttgatagattccgtgatgcaaacgttaccaatgttaaatggatatggactactaactgtagtaattctggagtagctactttaactggttcttacccaggtgatgattacattgattacacttctattgatggttacaactggggtaccgctcaaagttggtctcgttggaatactttcgaagaagtttttgataatgcttacaaagctcttattaaaattccaaaacctatcttccttgctgaattttcttcctctcgatttggtggtgataaagctggttggtttaccgatatgttcaatttacttccagaaaaatacccaagaattgttggtcttgttatcttcagtcgtagtaaaaatgaaacagaagctgattgggctcttgattcacaagaagaagcagtagaagcttggagaaa

SEQ ID NO: 13733 - DNA, 930 bp, Neocallimastix californiae
  (Trans)glycosidases
agattattctaagggtttcagaattggtgctgctactaacactattcactacagtaattctaactataacaatgctatgaaagctttcaattatatggttgctgaaaatgcttgtaaatttgttagtattcaaggtaccaagggaaaattcaactttaatgattgtgataatcatttaaagaaagctcaagaattaggtatggatttcagaggtcatgctttagtttggcatagtatggccccaaaatggcttgaaaacgaagatgcaaatactatgaaaaactctataattaatcatattactactgtattaaagcattatgaaggaaaaattgatacttgggatgtagttaatgaagctattgatgatagttctaatggtaatggatggaatatgcgtaaatccttcctttacaataaagttccaaactttattgatattgctttccaaactgctcgtcaagtatctccaaaaactaaacttttctataatgattataatactgaaggtatttggggaaagagtgaatctgtttaccaatttgttgctgatttaaagaaacgtaatattccaattgatggtgttggtattcaatatcacgttagtcttgaaaataatccacgtttcgacaaaattaatgatttaattagtcgttattgtaaattaggtgttgaagttcacattactgaaatggatgtcagttgtgacaaaaactgttgggccagtgatgttgaacaacaacaaggtaaagtttttactaatgctttacaagcttgtcttaacaattcttgttgtaccggtttccttgtttggggtattggtgataacgatagttggattggtggtgataagaaaggtttacttttcaattccaattaccaaccaaagtctcaatacactgctgtcttaaatctcttaaaatctactac

SEQ ID NO: 13734 - DNA, 1053 bp, Neocallimastix californiae
  (Trans)glycosidases
aaaagaagctcctttccgtttcggtgttggtttaaatggtggtgctctttctacttctactactacttctaaaacaatgagagaagtcattaaatatcaatttaattcaatgacttatactaatatcatgaaacctgaatatatttttgataaagaaggatgtctcaaaaatgcagaaaatggttcagaagaaatggctttaaaatttgatgatattgtggatggtttagattttgctttaaagaataatattcatattagaggtcatgtattagtatggcataaacaaactccagattggttcttcagaaaaggatttaattctgaaaatgaatttgccgatgtcgatacgatctattatcgtttagaaagtttcattaaacaatatcttggatttattcaatttaattatccaggagtcattgatgtttgggatgttgttaatgaagcagttgaaattaatgatggcagctttgataattctacaggatggtacactagaactatgacaggagatgaagaaagtttatggtataaagtagtaggaccagattatgttaagaaaacatttgaaattgctcgtaaatatgcacttccaaatgtcaagttagtatataatgattataatactttccaaacttatccacatgataaaactcaagccatcattgatctcatagatattttaagaaaagataatttaatcgatgccattggtatgcaatcatacattggagtgaattggccaagtgttgatgaatatataagagccattgaacgtttcactgaagccggattagaaattcaaattaccgaattaaccattacagcaccaagtggcgatgattggttagaaaaacaagctcaacaatatggagaattatttgaaagaatcatggaacaaattaaaaagggagctaatatttctagtgtaacagtttttggattacaagatggatatagattctattcctctgatagtactaaaactcgtcttttagatcatgatcttcaaaagaaaccaaattacgaagctattatgaaagttttaaa

SEQ ID NO: 13735 - DNA, 99 bp, Neocallimastix californiae
  (Trans)glycosidases
tgatccggaatcagtatctcttaaagccgattacgttataaataaaaatttaggtggaatgatgatgtgggaaattgaagaagatacacaagatagtga

SEQ ID NO: 13736 - DNA, 711 bp, Neocallimastix californiae
  (Trans)glycosidases
aaaatcaatcattgtttactatccagaatggaagtattacgatttcccaccaaagaatattccatttaataagcttactcatataaattatgcgtttgccgaaattgattcaaatgattattcattagattatgattcaagtagatttttagaattagttgaaactgctcatgaaaaaaataaaaatattaaagttttaatgtccattggtggctggacaggtagtaagtattactcaaaaatggcatcttcttcttctcgacgatcaaaatttgttaagagtgtgaaaagaatgttggaagcaagtgatgcagatggtattgatattgattgggaatatccaggtacaagtggtgcttatgatgataattttgatgctgaaaatgatacaaataatttattgaaattgttaaaggaattacgtgaagctattggttcttcaaaaattatttctgctgctgttccatttaatacatttgaagtggactctcgtccattaaaagatatgtctgaatttgctgaattgtttgactatgttaatattatggcttacgattttgctggaagttggtcaaccgttacatctcatcaatcttcactgtattcaatttcagaagatgataatggctattctttatctggtgcggtaagtaactggataaatgctaatttcccttcaagtaaaattgttgttggtattcctgcttatgg

SEQ ID NO: 13737 - DNA, 96 bp, Neocallimastix californiae
  (Trans)glycosidases
tgatccagaatcagtatcaattaaagctgattatgttataaaatataacttaggtggaatgatgatgtgggaaatcgaagaggatacaaaagatag

SEQ ID NO: 13738 - DNA, 708 bp, Neocallimastix californiae
  (Trans)glycosidases
atcaataattgtgtattatccagaatggaagtattataattttccaccaaagaatattccatttaataaacttactcatataaattatgcatttgctgaaattaattcaagtgattattccttagaatatgattcaagtaaatttttagaattagttgaaactgcacatgaatataataaaaatattaaggtattaatgtcaattggtggttggacaggtagtagatattattcaaaaatggcatcctcttcttctaatagatcaaaatttgttaaaagtgtaaaaagaatgctagaagctagtggtgctgatggtatagatattgattgggaatatccaggaacaagtggtgcttatgatgataacttcgatgctaaaaatgatacaaataatttattaaaattattgcaagaattacgtgcctcaattggttattcaaaaattatttctgctgctgtaccatacaacacatttgaagttaattataaaccattagaagatatgtctgaatttgctgaattatttgactatattaatattatggcttatgatttcgctggtagttggtcatctgttacatcacatcattcttcactttattcaactgttgaagatgacagtggatattcattagcaggtgctgttaaaaattggatgaacgcaagattcccagctactaaaattgttgttggtattcctgcttatgg

SEQ ID NO: 13739 - DNA, 906 bp, Neocallimastix californiae
  (Trans)glycosidases
aacaaatccaaattcaacttcttcaaccaaattattatataattatcttgtgaataattttgggaaaaaaataatatcaggacaagttggttctgcaggatatttagaaactgaagaattcgattatataaaaaaaattactggaaaaactccagcaatgttcaatgttgactttatttttgaatctctagatcatgactggaaaccagatgatagtattgctgatatggttttagcttggtggaagaaatatgaaggaaaaggaatattacatgctcagtggcattggaataaaaaaggaagtgatggtcaagttagtttctatactaaaaatgttgatttcgatataactaaagctctaattgaaggtaccaatgaatataaaagtattatggcagatatggattatattgcttcacaaataaaaatactacaagacaaagatattccaattatttggagaccattacatgaagcttctggaggttggttttggtggggtgctaaaggtcccgaaccatgtgtagcgctgtataaaatgatgtatgaaagatttaccaaagttcataaattgaataatttaatatggtgttggaatggaggaattggtaattggtacccaggagatgaatatgtcgacataatctcagaagatgtttatgataaacatagttcatttgcctcaaaatataattctttacttaatcaagtaggaaataaaaaaattattgcattatctgaaaatggtagtttacctgatattgaatcttgtatgaaagagagaattacctggagtttcttttgtacctggaataatgaatatattttaaataatagtgataatatctataatactcctgaatatattaaaagtgtttataacagtaactatgttattactcaatc

SEQ ID NO: 13740 - DNA, 594 bp, Neocallimastix californiae
  (Trans)glycosidases
ggaaaaatggttagaattagttagacaattcattcgtgataaaaaggcttctggtttaacaaattggtatggttatgaaatttggaatgaagctgaaaatacttggagagattctaatggctatactttcttagaattttggaaagaaacttataaggtcattcgtgaaatggatccagatgaaaaaattattggtccatgtgatggtttatacgttgaaagtagaatgcgtccatttttggaattttgtaaagaaaatgatgttatgccagatatcatgtgttggcatgaattaatgggtgttgaattaattccaagaagatataaggcttatcgtgaattagaacgttctcttggtattaaagaacttccaattactattaatgaatattgtgatattaaacatgaattagaaggtcaaccaggttcaagtgctcgtttcattggtaaatttgaacgttacaagattgaaagtgctttaatttcttggtggttcaataatttaccaggacatttaggtagtttattagctactgattctaaaaagggtgctggttggtatttctacaaatggtatagtgaaatgactggtga

SEQ ID NO: 13741 - DNA, 678 bp, Neocallimastix californiae
  (Trans)glycosidases
gttaccttctcaaggtatgacttggaattatgtattaggaaatgatatagatgtaaattcagaaacagcaaatgttgttgatattgatatcagaaagactgaagcaatcaataaacttcataaaaaaggaataaaagtaatttgctatttttcggttggtactcttgaaagttttcgtgatgattatccacaatttcttgcagttaaaggcttagttaaaaatagatatgatgattggcctgatgaaagatggttagattttcgtgttgaaggtatcaagccattacttaaaaatcgtatgaaatcagccgtcagtaaaaattgtgatgcgattgaagtagataatttagatggttatcaaatggatgaagttaaaagttggtcaaaaccattaactaaaaaagataccatagtttttgctaaatggttatcaactacggcgcatggcttgggtctttctattggtttaaaaaatgttgctggattaattgatgaattaacaagttattatgattttgctattaatgaagaatgtataaaatataatgaatgctctttatataaaaatttccttcgtactggtaaagctgtttttggtgttacctataatggattatcagcaaataaaagtaaattatgtaaaaatttaaatggtctcggtataagtatgattgttaa

SEQ ID NO: 13742 - DNA, 282 bp, Neocallimastix californiae
  (Trans)glycosidases
tggtcgttactgtaaacttggtcttgaagttcatattactgaacttgatgttaaatgtgataatgtttgtaattctggtaatgttgaacaacaacaagctactgtatttactaatgctcttaaagcttgtcttaataatagttgttgtactggttatcttgtttggggtattggtgataatgatagttggttaggtggtgataagaagggattactcttcaattcccaatacaaaccaaaatctcaatacactgctgttcttaatgttcttaaagaatacag

SEQ ID NO: 13743 - DNA, 918 bp, Neocallimastix californiae
  (Trans)glycosidases
agatgaaaaaattaatatggtcactggttcccaaaatagtttcggaccttgtgttggttatcttgaaccaattgaaagattaggtttcaagggtctctgtttacaagatggtccagctggtgtacgttctgctaaacacagtactactttcccatctggtttaaatattgcctctacatttgacccagaactcatgaaaagtcttggtgttgctttaggtgaagaagtcagagctaagggtgtcaatgctatcttaggtccagctatgaacatgtaccgttctccagttggtggtagaaattgggaaggttatggtgaagatacttatcttgcttcagtagctgcaaagaatgttgttgctggtattactagtcaaggtgttattgctaccattaaacactttgttggtaatgaacaagaaactaaacgtgaatcatcaaattctattattgatgaacgtgttttacaagaagtttacttcccaccatttaaggctgctattgtttctggtgctggtggtgctatggctgcatacaatgatcttaatggtattccatgtgccaacaatacctggcttttaaacaaagttttaaagaagcaaatgttattccacggtttcgttacaagtgactggtggggtgttaaggataaatacggaattatgaatggtttagatcttaacatgccaggtggtaaggaatggggaccaaccgttaaagatagttactggggtgaagaacttaaggaagctgttgaatctggtgaaattgatgaaatgtaccttgatgaagcttgtattcgtgttatgactatgttatacaagtacagacaattcgatgattacccagaaattaatcttgatgctgatgctactgaaggtcatgctgaaattgttcgtaaagctgctgctaatagtgt

SEQ ID NO: 13744 - DNA, 1050 bp, Neocallimastix californiae
  (Trans)glycosidases
tagaatgggtgttggaattaatggcagtttaagaaaaacatcaactattctttctaagaaaatggttgatataataaatcatcaatttaatagtgtaacattaacaaacttaatgaaaccttcgtatttactagatcaaaatggaagtcaaaaaaatattatgaaaggaatacaagatccatcagtaaatttccaatcggcaatagatactttagaatattgtaaaaagaataatataaaaatgagaggacatactttagtatggcacactcaaacaccatcatggttctttaaaaaagattatgatgataaaaatgattatgttgattctgaagtaatggaattgcgtatagaaagttatataaaacaggttatgcaattcgttcaatattattatccaggcgttgtagatgtatgggatgttgttaatgaagcggttgaaattgatgaaggatactatgatgaaaaagtatcatggaaaactcgaacaaaatgtaatgaatcatccaatccttggtatgaaacaatgggtcctgattatgtaattaaagcatttagatttgctagaaaatatgcagctcctggtgttaaattaatatataatgattataatacttttatgagtgaaaagacaacagcaattattaatctcttaaaaattttaaaagaagaaaatttaattgatggaattggaatgcaatcatatcttaccccaacttttccagaacgaagtacatatgctaatgctattaagaaattcggtgaattaggaatagaagtacaaattactgaattaactataagcattgatgataaattatcagaagaagagatgtatgaaaaacaagctgaacaatataaggaggtttttgaaatatatcttaaagcgtatcataatggtattaatattggaagtgttactgtatttggtttacaagatggctacctattttataccaatgattcaacgaaaactcgtttatgggataaagatttacaaaaaaagaagaattattattcaattttggaagttttaaaagagtattacaa

SEQ ID NO: 13745 - DNA, 942 bp, Neocallimastix californiae
  (Trans)glycosidases
atatgaactcttaaaagactactcaaagggtttcagaattggtgcagctactaacacaattcactacaacaatgctaactacgttaatgctatgaaggcattcaactatatggttgctgaaaatgcttgtaaatttgttagtattcaaggtactaaaggtaaattcaactttaatgattgtgatgctcacttaaataaggctaaacaattaggtatggatttcagaggtcacgctttaatttggcacagtatggctccaaaatggcttgaaaatgaagattccaatagtatgaaaaattctattgttaaccatattacaaatgtcttaaaacactacgaaggaaaaattgatacatgggatgtagttaatgaagctattgatgatagttctaatggtaatggctggaaaatgcgtaattccttcctttaccaaaaggttccaaatttcattgatctttctttccaaaccgctcgtaaagtttctccaaaaactaaacttttctataacgattataatactgaaggtatttggggaaagagtgaatcggtttaccaatttattgctgatttaaagaagcgtaatattcctattgatggtgttggtcttcaataccacgttagtgtccaacatcaaccacaattcaataagattaatgatttaattggacgttactgtaaattaggtgttgaagttcatattactgaattagatgtcagttgtgttgaatcctgttatgctggtgatgttgaaaagaaacaatctgatgtctttactaatgccttaaaggcttgtcttggtaattcatgttgtactggatttcttgtttggggtattggtgatccagatagttggttaggtagtgataagaagggcttacttttcaatagtaattaccaaccaaaatcacaatacacggctgtattaaatgtcttaaagactac

SEQ ID NO: 13746 - DNA, 684 bp, Neocallimastix californiae
  (Trans)glycosidases
tattgaagaagttaaggaatactaccttgactatgttgctaaagttttagatcactacaaagatgaagaagatattatttactgggatgttatcaatgaatctgttactgatgattctactgttgataacattaagttacgttatggttctgatgacagtaatgaattcaagggatgggatacttatactgaagatatcttcaaggttgcccgtgaacacactaataaaaatgtaaaattattctataatgattataatgctgaaaacaacaacggtaattacaatggtaagactggtgccgttttcaattacatcaaatctatgagagaaaaagatgttccaattgatggtgttggtttacaaatgcacatttcttgtaattattatccaaactatgatcaactttatgaattaatttctcaatatgaagaaattggtgttgaagttcacattactgaaattgatgtcagtatgaagagttgtagtactcttgaagatcaaaagaaattatatatggatgtctttaaggcttgtttcgatcactctaactgtaaggtctttactgtttggggtgcttacgattctgaatcttgggttggtgctgaaaatgttccattaattttcgatgaagatatgtatccaaaggatatctatttcgatatgttagattatgttatgaaaca

SEQ ID NO: 13747 - DNA, 681 bp, Neocallimastix californiae
  (Trans)glycosidases
gttaccttctcaagatatgacatggaattatgtattaggaaatgatattgatgtaaattcagaaaaggccaatgttgttgatattgatattagaaagagtgaaacaaaaataaaaaatcttcaaaaaaaaggaataaaggtaatttgttatttctcggttggtacacttgaaagttttcgtgatgattatccacaatttattgctgttaaaggcttagtacagaatacatatgatgcatggccagatgaaagatggttagattttcgtgttgaaggtattaaaccattacttaaaaatcgaatgaaattagctgtcagtaaaaattgtgatgctattgaagtagataatttagatggttatcaaatgaaagaagttaaaagttggccaaatccattaactaaaaaagatacaatagtatttgcgaaatggttatctgcaactgctcattcattgggtctttctattggtttaaaaaatgtacctagcttaattgatgaattatcaagttattatgattttgctattaatgaggaatgtattaaatataatgaatgttatttatataaaaatttccttaaaactggtaaagcagttttcggcgttacctattatggattaactgaaaataagaatcagttatgtaaaaatttggatggtctcggtataagtatgattgttaa

SEQ ID NO: 13748 - DNA, 900 bp, Neocallimastix californiae
  (Trans)glycosidases
aagtaattggcaaccaattactattaatggtaaacgtcttcttcttaaaggtgttaaccgtcacgatactgatccattcaatggtaaagctattccacaagccactatggaaatggatattactcttatgaaaactaacaacattaatgctattagaacttctcactacagtaatgattcttacttatactggctttgtaacaaatatggtatgtatgtcatgggtgaaactaatatggaatctcatgctttaatggataataatgatgctaaagctttattctatgaagttggtcttgacagaactgaaactgcttataaacgtttaaagaatcatccatctattgttgcttggtctattggtaatgaaatggcttatactagtaatccaagtgatgctggaggtcttttccgtgatatgatttggtatttcaagaagaatgataacagtcgtccagttcatagtgaaggtcaaggtggtagtatgggtgttgatatgtctagtaatatgtacccaagttcagatggtattcgtggtaacgctggtaaaggtaaaatgccatacgttatgtgtgaatatgaccacgctatgggtaattctgttggtgctttaaaagaatactgggatggtattagaagtgctgataatatgcttggtggtttcatttgggattgggttgatcaatctagagctactccattaaaaggtggttgggattattattctgaatcctatgctaaaacaaatctttacgctgaagaaattaaaggtaaattctatggttatggtggtgattggggagattggccaaatgataacagtttctgtgttaatggtcttattagtcctgatagaactccacaaccagaacttgctgaagttaaataccaataccaaag

SEQ ID NO: 13749 - DNA, 636 bp, Neocallimastix californiae
  (Trans)glycosidases
tttagctgatattttaccatactggccatatcaatttaaaggtattcaaagttggttaaatgatattggttcatttattgatgataaaaaagcttcaggtttaactaattggtatggttatgaaatttggaacgaaccagatggtacatggaaagattccaatggtatgaactttaatgaattttggaaacaaacttatcaatttattcgtcaaaaagatccaaatgaaaaaattattggtccatgtattagttggtataatgaaaataatattcgttctttcttacaattcgctaaagctaacaattgtcttccagatattattagttggcatgaattaagtggtattgatggtatgtcttcacatttcagatcttatcgtaatttagaaaaatctcttggtattaaggaacttccaattagtatcaatgaatactgtgatgctgaacatgaattagaaggtcaaccaggttcaagtgctcgttttattggtaaatttgaacgttataagattgatacagctatgattacttggtggtttgttccacaaccaggtcgtttaggtagtttaatggctactgatactcaaaagggtgctggttggtatttctataaatggtatggtgatatgactgg

SEQ ID NO: 13750 - DNA, 396 bp, Neocallimastix californiae
  (Trans)glycosidases
caacttcattttcccagaagatgatgataaggttattgcagccgtacatgcttactctccatataactttgccttaaacaatggtgatggagctgttgatacttttgattcagctggtaagaacgaacttgattggaacattaacttaatgaaaaagagattcgttgatcaaggtattccaatgattcttggtgaatatggtgctatgaaccgtgataatgaagaagaacgtgccaaatgggccgaatattacatggaaaaggttacagctttaggtattccacaagtttggtgggataatggtatctttgaaggagaaggtgaacgttttggtattattgaccgtacttccttaaagattatgtatccagatattgttgcttcattacaaaaggg

SEQ ID NO: 13751 - DNA, 930 bp, Anaeromyces robustus; identical to SEQ ID NO: 13733
  (Trans)glycosidases

SEQ ID NO: 13752 - DNA, 777 bp, Anaeromyces robustus
  (Trans)glycosidases
gactttagttgatgatcttcatccatatgttatgcgtaatccacctagaggtaaaatgggtgaccaacatccatttggtaatgctattgaagttgctagacgtttatcacgtactccaggtgctttagtatctgttattttaaccgatttcttaccatattggccttatcaatggccaggtatggaaaaatggttagaattagttagacaattcattcgtgataaaaaggcttctggtttaacaaattggtatggttatgaaatttggaatgaagctgaaaatacttggagagattctaatggctatactttcttagaattttggaaagaaacttataaggtcattcgtgaaatggatccagatgaaaaaattattggtccatgtgatggtttatacgttgaaagtagaatgcgtccatttttggaattttgtaaagaaaatgatgttatgccagatatcatgtgttggcatgaattaatgggtgttgaattaattccaagaagatataaggcttatcgtgaattagaacgttctcttggtattaaagaacttccaattactattaatgaatattgtgatattaaacatgaattagaaggtcaaccaggttcaagtgctcgtttcattggtaaatttgaacgttacaagattgaaagtgctttaatttcttggtggttcaataatttaccaggacatttaggtagtttattagctactgattctaaaaagggtgctggttggtatttctacaaatggtatagtgaaatgactggtga

SEQ ID NO: 13753 - DNA, 960 bp, Anaeromyces robustus
  (Trans)glycosidases
tgttattcaacaagtcagaccagatttttactttggtgttgccactactaaatctttcttcgctaatccaaaatacaaagatattatgagtacttataatttacaagttggtggtaatgaatgtaagttttacactttccaaggtactgaaactttcaacacaaaaccttgtgatgacagtattgcttttgctaagaaattaggtgccaaattccgtggtcacaatcttttctggccagcttactctccatcatggttcaaaacttacagtagtgatattgaagaagttaaggaatactaccttgactatgttgctaaagttttagatcactacaaagatgaagaagatattatttactgggatgttatcaatgaatctgttactgatgattctactgttgataacattaagttacgttatggttctgatgacagtaatgaattcaagggatgggatacttatactgaagatatcttcaaggttgcccgtgaacacactaataaaaatgtaaaattattctataatgattataatgctgaaaacaacaacggtaattacaatggtaagactggtgccgttttcaattacatcaaatctatgagagaaaaagatgttccaattgatggtgttggtttacaaatgcacatttcttgtaattattatccaaactatgatcaactttatgaattaatttctcaatatgaagaaattggtgttgaagttcacattactgaaattgatgtcagtatgaagagttgtagtactcttgaagatcaaaagaaattatatatggatgtctttaaggcttgtttcgatcactctaactgtaaggtctttactgtttggggtgcttacgattctgaatcttgggttggtgctgaaaatgttccattaattttcgatgaagatatgtatccaaaggatatctatttcgatatgttagattatgttatgaaaca

SEQ ID NO: 13754 - DNA, 933 bp, Anaeromyces robustus
  (Trans)glycosidases
tagagactatgctaacggtttcagaattggtgctgctactaatactatgcattataataatcaaaactatgttaatgctatgaaatctttcaattatatggtagctgaaaatgcttgtaaactttctggtattcaacaacaaaaaggtgtttacaatttcaatgattgtgataatcattataagaaggctaaagaattaggtatggacttccgtggtcactgtcttatttggcatgcctatcaaccatcatggttccaaaatgctgatgctaacacattaaagaacgctattgttgatcacattactaaggtacttcaacattatgatggtaaaattgatgcctgggatgttgttaatgaagctattgatgatagttctaatggtaatggatggaagatgcgtaattccttcctttaccaaaaggttccaaactttattgatttagctttccaaactgctcgtaaagttgctccaaatgttaaacttttctataatgattataatactgaaggtgtttacgctaaaactgaatctgtttatcaatttattcaagatatgattaaacgtaatattccaattgatggtgttggtattcaatatcacgttgctgttaatcaacaaccatcttaccaaaagattaatgatttaattggtcgttactgtaaacttggtcttgaagttcatattactgaacttgatgttaaatgtgataatgtttgtaattctggtaatgttgaacaacaacaagctactgtatttactaatgctcttaaagcttgtcttaataatagttgttgtactggttatcttgtttggggtattggtgataatgatagttggttaggtggtgataagaagggattactcttcaattcccaatacaaaccaaaatctcaatacactgctgttcttaatgttcttaaagaatacag

SEQ ID NO: 13755 - DNA, 972 bp, Anaeromyces robustus
  (Trans)glycosidases
tttatggtcagaatctgaagatttagctaaagcttttgttgaagaaatgactttagatgaaaaaattaatatggtcactggttcccaaaatagtttcggaccttgtgttggttatcttgaaccaattgaaagattaggtttcaagggtctctgtttacaagatggtccagctggtgtacgttctgctaaacacagtactactttcccatctggtttaaatattgcctctacatttgacccagaactcatgaaaagtcttggtgttgctttaggtgaagaagtcagagctaagggtgtcaatgctatcttaggtccagctatgaacatgtaccgttctccagttggtggtagaaattgggaaggttatggtgaagatacttatcttgcttcagtagctgcaaagaatgttgttgctggtattactagtcaaggtgttattgctaccattaaacactttgttggtaatgaacaagaaactaaacgtgaatcatcaaattctattattgatgaacgtgttttacaagaagtttacttcccaccatttaaggctgctattgtttctggtgctggtggtgctatggctgcatacaatgatcttaatggtattccatgtgccaacaatacctggcttttaaacaaagttttaaagaagcaaatgttattccacggtttcgttacaagtgactggtggggtgttaaggataaatacggaattatgaatggtttagatcttaacatgccaggtggtaaggaatggggaccaaccgttaaagatagttactggggtgaagaacttaaggaagctgttgaatctggtgaaattgatgaaatgtaccttgatgaagcttgtattcgtgttatgactatgttatacaagtacagacaattcgatgattacccagaaattaatcttgatgctgatgctactgaaggtcatgctgaaattgttcgtaaagctgctgctaatagtgt

SEQ ID NO: 13756 - DNA, 969 bp, Anaeromyces robustus
  (Trans)glycosidases
ggaagaagccgataaaaaggcttcatcctttgttagtgatttaagtgaagctgaaaaaattgacattgtaactggttacatgaatatgcaaggtacctgtgttggtaatattaaaccaaatagtagaaaaaattttaagggtttatgtcttcaagatggtccagccggtgttcgttttaatgaaggaacttcaacaacttggcaaactggtattaacagtgcagccacttttaataaggatttattatataaaattggtaaagatcaaggtgccgaattttatgctaaaggtataaacgttgctcttgctccttcaatgaacattcttcgtgccccagcttctggtagagtttgggaaaactttggtgaagatccatatttatcaggtgtatgtggtacacaaattacaaagggtatgcaagattctggtgttattgtttcagctaaacactatgttgctaatgatattgaacataatcgtgaagcttctacatctaacatggatgaacaaaccttaatggaaattcatgtagaaccattctatagaactgtcactgaaggtgaagctggttctgttatggcttcatataatgctgttaatggtgtatatgtggttcaaaataaaaaggtacttactgaaatcttaaaggaaggaatgaacttccaaggtttcattgtttctgattggtgggctattcatgatttagaaggtagtttcaatgctggtgttgatatgaacatgccaggtggtaaggcttggggtccaaattatattaatgattcattctggggttctaacatttctaacgctataagaagtggtaaagttagctccgctcgtttagatgatgctgttaaacgtattattcgttctatgtataagatgaaccaaatgggtaatttcccaaatgtcaatcttagagctcaaagtatgcatactgaaacacacagacaagctgccactgaaag

SEQ ID NO: 13757 - DNA, 1035 bp, Anaeromyces robustus
  (Trans)glycosidases
ttacctttcaactaaaggtagatatattgttgacgaaaaaggtcgtaaagttaaattagctggtatatcttggtttggtggtgaaactactaacctttcaccacacggtttatgggctaagccattatctcacttcattaaaattattaaggatcttggttataaccatattcgttacccatggactaatgaaatgctcttcccaggtgccaaaactcaatctgttgatcaattacaaaatccagatcttgctgatcttactccattagaagttatggatgctgttattgatgcttgtggtaaagctggtattaaggtttatctcgatcgtcacagacctctttctggtggacaaagtgaattatggtatgttgctaaagtagatgaagataaatggattgaagactggcaattccttgctaagcgttacaagggtaatccaactgttattggtgctgatcttcacaatgaaccacatggtactgcttgttggggatgtggtgaaactaaacgtgattggagacttgctgctgaaagatgtggtaatgccatccataaagttaacccagattggcttattattgttgaaggtaatgatcactatggtgaagaaggttggcaaaagggagaaggatactggtggggtggtatgttaaagggtgttaaggaaaacccagtaagattaaataccccaaacaaacttgtttactctgctcatgattatgataagaatgtattcatgcaagattggtttaaagtttctaacttcccagacaacatgccagaaatttgggatgataaatggggttacattgctaaagaagacattgcaccagtacttattggtgaattcggttctcttttaatggataataaagatgttaaatggttacaaaatttaatttcttacatgaacaagaatgatgttcactggactttctggtgtttaaatccaaattccggtgatactgaaggtattcttggttatgattggacaactgttaatactaagaaagataatattcttactccagg

SEQ ID NO: 13758 - DNA, 636 bp, Anaeromyces robustus; identical to SEQ ID NO: 13749
  (Trans)glycosidases

SEQ ID NO: 13759 - DNA, 924 bp, Anaeromyces robustus
  (Trans)glycosidases
tgctaatggttttagaattggtgccgctacaaatacaattcattacagtaatcgtaattatattgaagctatgaagtctttcaattatatggttgctgaaaatgcttgtaaatttgttagtattcaaggtactaaaggtagatataattttgatgattgtgataatcatcttaaaaaagctcaagaattaaaaatggatttcagaggtcatgctttaatttggcattctatggctccacaatggcttgaacgtgaagattctaatactatgaaacaatctattattgatcatattactactgttttaaaacattatgaaggtaaaattgatacttgggatgttgttaatgaagctattgatgatggttctaatggtaatggttggaaattacgtaattctttcctttatcaaaaagttccaaatttcattgatattgctttccaaactgctcgtaaagtttctccaaatactaaacttttctataatgattataatacagaaggtatttgggcaaaaagtgaatctgtttatcaatttgttgctgatatgaaaaaacgtaatattccaattgatggtgttggtatacaatatcatgttggtgttaatgttcaacctcaatttgataaaattaataatttaattagtcgttattgtaaattaggtgttgaagttcatattacagaattagatgttagttgtgatgataattgtaatgatagagatggtggtgaaggtaaacaatctcaagtttatattaatgctttaaaagcttgtcttaataattcttgttgtactggtttccttgtttggggtattggtgatagtgatagttggagaggtgctgaaaataaaccattacttttcaattctaattatcaaccaaaaggacaatataatgctattttagaaactttaaaatcaac

SEQ ID NO: 13760 - DNA, 672 bp, Anaeromyces robustus
  (Trans)glycosidases
atcacgtactccaggtgctttagtatctgttgatttagctgatattttaccatactggccttataaatggccaggtatgcaaaaatggttagatgaagttagatcatttattcgtgataaaaaggcttctggtttaacaaattggtatggttatgaaatttggaatgaagctgaaaatacttggagagattctaatggttataactttttagaattctggaaagaaacttataaggtcattcgtgaaatggatccagatgaaaaaattattggtccatgtgatggtttatatagtgaagaaagaatgcgtccatttttacaattttgtaaagaaaataatgtattaccagatattatgtgctggcacgaattaatgggtgttgaattaattccaagaagacaaaaagcttatcgtgaattagaacgttctcttggtattaaagaacttccaattactattaatgaatactgtgatgttgaacatgaattagaaggtcaaccaggttcaagtgctcgttttattggtaaatttgaacgttataatgttgaaagtgctttaatttcttggtggttcgttccacaaccaggtcgtttaggtagtttattagctactgattctaaaaagggtgctggttggtatttctacaaatggtatagtgatatgactggtga

SEQ ID NO: 13761 - DNA, 1047 bp, Anaeromyces robustus
  (Trans)glycosidases
taaagctgctccattccgtatgggtgttggtttaaatggatctgataaaagtagttctactgttctttctaaaaaaatgtgtcaattaattgcttatcaatttaattctgtgacttattctaatcttatgaaagctgaacatatgttagataaaacagctagtcaaaataatgctaaaaatggtaatgatatgccagttttaaaatttgataccattattgatggtttagaattttgtcaaaaaaataatgtaaaaatgagaggtcatactttagtttggcatactcaaactccttcttggtttttccgtactaatttccaagataatggttcatttgttaatgcttctaaaatggaaaaacgtatggaaagttatattaaacaaatgttagaatttattcaatattattatccaggtgtagttgatgtttgggatgttgttaatgaagctgttgaaattactaatggttcctacgatagttctacaggatggaatactcgtacaaaatttgatggaggtgataatctttggtataaaactatgggtgctgattacgtttttaaggctttccgttttgctcgtaaatatgctgataaaaatgttaaacttatttataatgattataatacttttatgtctcaaaaaactaatgctattagtaaccttattaaaaagttaaaagctgaaaatttagtggatggagttggtcttcaatcttacttaaatgctgattggccaaatcgtaatgattataaatctgctattcaaaaattcagttctcttggagttgaaatccaaattactgaattaactattaaaacagatggttctggtaataaatttaataatcaagctactcattatcaacaagttttccaaatttataaagatttaaagaaaagtggtgttaatattactagtgttactgttttcggtttacaagatggttacttattctacagtaatgatagtactgatactcgtttatgggatcataaccttaaaaagaaaccagtatacaacgccattatgaaggttttaaaatc

SEQ ID NO: 13762 - DNA, 1041 bp, Anaeromyces robustus
  (Trans)glycosidases
aataggtttcctttctactaagggtcaccttattgttgatgaaaagggtcgtgctgttaaattagctggtatttcatggttcggtggtgaaactactaacctttctccacacggtttatgggctaaaccattaagtcatttcattaaaactattaaggatcttggttataaccatattcgttacccatggactaatgaaatgtttaaagaaggagctaaaactgaatctgttgattccgtcaataacccagatcttgctgatttaactccattagaagttatggatgctgttattgaagctgctggtgctgctggtattaaggtttaccttgatcgtcacagaccacttgctggtggacaaagtgaattatggtacattgatgaagttccagaatctcaatggattgaagactggcaattccttgctaaacgttacaagggtaacccaactgttattggtgctgatcttcataatgaaccacacggtaccgcttgttggggttgtggtgaagaagttcgtgattggagacttgctgctgaaagatgtggtaatgctattcatgaagttaacccagactggcttattattgttgaaggtaatgatcactatggtgaagaaggatggcaaaagggtgaaagttactggtggggaggtatgttaaagggtgttaaggaaaacccagttagattgaaggttccaaacaagcttgtttactctgcccacgattacgataagaatgttcacttacaagattggttcactacttctgatttcccagacaacatgccagaaatttgggatgataaatggggttacattgttaaggaagatattgctccagttcttattggtgaatttggttcagtcttaagagatgctgttgatgttaaatggttaactaatttagttacctatatgcatgaaaatggtgtccactggactttctggtgtttaaatccaaactctggtgatactgaaggtattcttggatacgattgggaaactgttaatactaaaaaggatggtatccttactccaga

SEQ ID NO: 13763 - DNA, 909 bp, Anaeromyces robustus
  (Trans)glycosidases
aactttagttaatccaaaagctattcctgctgctaaaaaactttatgatttcttaaaaacaaattatggtaaaagaattttatctggtcaagttggtgctgctggtcaagccggtgatgaaggtgaagaatttaaacgtattattaatgctactggtaaaaaaccagctgtttggaatatggatttcatttttgaatctaatgattgtacttggagaccaactaaccctgatattactgaaatggcacttgattggtggaaaaaatatcaaggtaagggtattatgtctgctcaatggcattggaatattgctggtcaaactggtaattttgctttttataaaaaagatactacttttgatttagaaaaagctgttaccgaaggtacttgggaatataataaaattataaaagatattgatcgtgtttctggtcttattaaaaaattacaagctgttaatatgccattactttggcgtccacttcatgaaaataatggtgattggttctggtggggaaataatccaaaagcttgtgctaaattatggaaaattttatatgaacgtatggttaattatcacggattaaataatttaatttggctttggaatggtaataatgatgaatacactccaattgaatatatcgatttaattggtgttgatatttatgctgatgaccatggaccacaaactactgcttttaatactcattttgatttctatgatggaaagaaaatggttgttttatctgaaaatggtcgtattccagatattcaaaaatgtgttgcacaaggagcatggtggggttacttccaaacttggaatagtgaatttatattacaagattcctaccatactacagctcaacttaaagaatactttagcaataaagtcgttatgaatatgga

SEQ ID NO: 13764 - DNA, 1056 bp, Anaeromyces robustus
  (Trans)glycosidases
acttactttagcagctgctagttcagctttagctttaacttctcaagaagttgttaatgaaatgggtctcggttggaatttaggtaatactttagaagcttttggtgattggataaatggtagtacagttaatcaatttgaaactgcttggggtaatccagcagcaacaaaacaattaattactgcaattaaaaattctggtttcaatagtattcgtattccagttgcctggagtaatcttatgagttctgattacactattagttcagaattattaaaaagagttaatgaagttgttagttgggttattgatagtaacatgtatgctattattaacattcactacgatggaggttggattgaaaaattcggtactagtgaatctactatggctaataataaattcaataaaatttggactcaagttgccgactatttcaaaaactatggtgaacatttaattttcgaatcattaaatgaagaaggttgttggaacgatgtttggaatcgttatagtaactctggtgataaaaacaaggcttactctactttaaataacattaaccaacaatttgttgatattgtacgtaaatctggtggtaacaacaaatccagacatttacttatagctggttattgtaccgatattgacttaactgtcgattcagctttcaaaatgccaactgattctgccaatagaatgatggtttctgttcactattacactccatctactttcactattcttgaaaaggatgaaagttggggtaaatttgctggtacttggggtactgatgctgaagttaatgcccttcttgctgatttcgataaacttaagaaacgttttgttgataatggtgttccagttattattggtgaatatggtaccgttttaactaacaaagataaggacagtgttcacaaatacttattcacttgtgctcaatatgctacaagtttaggtatgtgtccaatgctttgggataatggtgatcactttgaccgtaaaggacttaaattcaaggattctgaagttggtgatttctacaaatatca

SEQ ID NO: 13765 - DNA, 903 bp, Anaeromyces robustus
  (Trans)glycosidases
aaatcaatatactggtgttaacgaatccggtgctgaattcggtcaaggtaaatatccaggtgaatacaataaagattatatttacccagatgttaaagcaattcaagcttcaattgatcaaggtatgaatgttttccgtattggtttttcatgggaacgtttacaaagaagtttaaatgctgaacttgattcaactgaatttgatcgtttagatgaagttgttagttatgttactaaaaatggtgctgtagctattcttaatccacacaattttgctagatataacggtcaaattgttggtacaagtcaagtaccaaattctgctttcgctgatttatggaaaagaattgctcaaaaatataagagtaataataaagtttggtttggtttagttaatgaaccacatgatatgccaactgctcaatggttctcagctgctcgtgatgctgttgatagtattcgtgctcttggtgctaataataatgttcttgtaccaggtaatgcttatactggtgcttggaattggaaagaaactttttatggagattctaatgcttctacagctcttatatatttcagttcttctgataaaaatattatttttgaaactcatcaatatttcgattctgattattcaggtactcataaagaatgtgttcaacgtccatgtaataaccttttcaaaaacttcgtagaatggttaaaagctaataatttaaaaggttttattggtgaattaggtgctgctattaatgatgattgtaaagcatgtgttgaagaagctattacttatttagaacaaaattctgattatattgttggttgggcctggtgggctgctggtccatggtggcaagattatatgtattctattgaaccaaaaggtgaaagattcccagaaca

SEQ ID NO: 13766 - DNA, 1113 bp, Anaeromyces robustus
  (Trans)glycosidases
aagtttttataaaggtgttgatatatctagtattatttcattagaaaatagtggtgtaaaattttataatcctttaggtcaagaacaagatctcttccaaattcttgccaatgttggtgtaaattgtattcgtgttagaatttggaattcaccaaagaatgccaatggaaaaacatatggtggtggtggtaatgatcttgaagttgcaagagccattggtagtagagctgctcgttatggtctttcattatttgttaatttccattattctgatttctgggctgatccatcaaaacaaactattccaaaagaatggaaaaattttgaccttgataaacgtatttttgaaatttacagatttactaaaggatgtttagaatggcttttagaaaatggttcaattatttctatggttcaaattggtaatgaaactactagttttatgtgtggtgaaaagaatatgactaatgtaatgaaaatgatgagtaatggtgttaaagctgttcgtgatattagcaagaatatagtagttgctcttcattttactaatccaaataaagctgatactatgttatggtatgcttctcaacttgcctctgctagagttgattatgatgtatttgccacttcatattatccatactggcatggtacccttgataatttaaagggagtattaaataaaatagctaaccaatatggtaagaaagttctcattgctgaatattcttatccatacacaaacgctgctttaactgatgatagatgtcattatgaattaatttcatctagtacaagtaatatccaactccgttatccagttagtattgacggtcaaattcaaagtattagagatatttacaaaactattaaagaaattaaaaatggtattggtgctttctattgggaaccagcttggattgctccaaaggcaagaaatgatgccgaaagaaaacaaatttgggaaaagtatggttctggttgggcaagtactcctgctgctgaatatgatagtgatgttgatagatatcaaactggtggaactacatgggataatcaagctgtttttacacaaaatggtaaaccattagattcactttatgcattaggaga

SEQ ID NO: 13767 - DNA, 1110 bp, Anaeromyces robustus
  (Trans)glycosidases
tgaaggtttcggtacaagtttctgttggtgggctaatcgacttggttattctgattctttatctgaaaaagcagctactctattttatgataaagaaaaaggtttaggtcttactgttattcgttataatatcggtggtggtgatgatccaactcataatcatattactagaacagattctaacatgccaggttatgctattaatccaaaatacgatggtagatcttacacttgggattataattggaatagtgatagtaatcaaagaaatgttttattaaaatctgtagctaagaataaagatgaaattattgtggaagcattctctaattctcctccatattttatgacatattctggttgttctactggtaattttgatccaggtaaagataatcttagaagtgatgcttatccagctttcgctaaatatcttgctgatgttgctgaacatttcaaaactcattggggtgtttatttccaaagtattactcctactaatgaaccatacactaatttctggggagcaaatagttataaacaagaaggttgtcattttgatcaaggagaatctgaatcaaaaattattgttgaacttcgtaaagctattgatcaaaaaggattaaaagaaatgcaaattagtggtacagatgaaactagtattgatactcaaattacttcttttgaaaaacttagtaatgaagctaaaaatattattacaagaattgatactcatacatatggtggatggaaacgtgatgaattaagacttcttgctgaaaataatcataaaaacctttggatgtctgaagttgatggtaaaggtactgaaggtactaatgccggtgaaatgggtgcagctatttggttagctaatcgtattataggtgatttaaatggtcttagagcctctgcttgggttctttggcaagttattgataatcatattagtaaaaatggttataatggcagaaaagattctggtatgataaatattaatgaaggttactggggagttgccgttgctgatcatgataatgataatattattcttactcaaaaatattatggttttggtcaattcagtagatatattcgtccaggttatac

SEQ ID NO: 13768 - DNA, 1050 bp, Anaeromyces robustus
  (Trans)glycosidases
ccgtatgggtgtaggattaaacggtggtaatattagcaattatactccaagttctaagaaaatgatggaacttattaattatcaatttaattctatgacttactctaatggtatgaaatcactttttattatggatcaagaaaagtcacttaagaacttagcagaaggtaaagaagaagttggtataaatttctcaggagttatagatggtttagaattttcagctaaaaataatcttaatattagaggacatgttttagtttggcataagcaaactccagaatggttttggagaaaagattttgatgaaactaaagaatatgtcgatcgtgaaactattttcaagcgtttagatagtttcatgaaaaattattttgatttcttaaatttcaactacccaggtgttgtagatgttgttgatgttgttaatgaagctgttgaagttcttgaaggaaaatatgataattctactggttggtacactcgtacagaatcatatgaaggtgatgaaaacatttggtataacttagttggaccagattatgttaaggaagctttccgtattgctcgtaaatatgcacttccaaccactaaattagtttataatgattatgatacttggagaactactcctcatgataaaactgaagctattattaatcttatgaaaatattaaaagctgaagatttagttgatgttattggtatggaatcttatattactccaggtgaaccaactccagaagaatatggtaaagctattgaacgttatgctgctgaaggattagaaattcaaattactgaatttactatttatgttactgatggtgatgattggttagaacaacaaaccattcattatcgtgatatgttcaaagctattatggaagcttataaaaagggagctaatattactagtttcactgttttcggtttacaagatggttatagattctatgatagtgatagtactagaactcgtttatatgaccacgatcttcaaaagaaaccaaacttccaagctattatggatatcttaaaggaatataa

SEQ ID NO: 13769 - DNA, 972 bp, Anaeromyces robustus
  (Trans)glycosidases
tttatggtctgaatctgaagatttagctaaagaatttgtttcacaaatgactttagatgaaaagattggcatggttacaggttctcaaaacagttttggaccatgtattggttaccttgaaccaattgaaagattaggtttcaagggtttatgtttacaagatggtccagctggtgtacgtagtgctaaacatagtactactttcccatctggtttaaatattgcatctacttttgatgttgaattaatgcatgatcttggtgttgctcttggtgaagaatgtagagcaaagggtgttaatgttattttaggtccagctatgaatatgtatcgttcacctgctgctggtagaaactgggaaggttacggtgaagatacttatcttgcttctgttgcttcaaagaatgttgttgcaggtattcaaagtcaaggtgtacttgctactgctaaacattttgttggtaatgaacaagaatataaacgtgattcttcaaattctattattgatgaacgtgttttacaagaagtttatcttccaccatttaaagcagctgtagtttctggtgctggtgcttttatggcttcttataattctattaatggtattcctgctactaatcatactcaacttttaaataaagttttgaaaaaacaattcttattccatggttttgttactagtgattggtggggtactaaagataaaattgaaattactaatggtttagatatgaatatgccaggtggtaaagtttggggtccaacggtaaaagaaagttattggggtgaagaattaaaagatgctattgaaaatgaagaaattgatatttcttaccttgatgaatcttgtgaacgtattatgactatgttatacaagtataaacaaatggatgatttcccagatcttaatttagatgctgatgctactgaaggtcatactgaactcgtacgtaaagctgctgctgctagtgt

SEQ ID NO: 13770 - DNA, 618 bp, Anaeromyces robustus
  (Trans)glycosidases
accaggttggccatatcaatttaaaagtatgcaacattggaaagatgaaattaaatcttttgttaatgataaaaaagcttctggtttaactaattggtatggttatgaaatttggaatgaaccagatggtacatggaaagatcctaatggattaaactttaatgaattttggaaacaaacttatcaataccttcgtcaaattgatccaaatgaaaaaattattggtccagctttaagttggtataatgaagatagaattcgttctttcttacaatatgctaaagctaataattgtcttccagatattatttgttggcatgaattaagtggtattgataatatgtctgcacattttagatcttatcgtaatttagaaaaatctcttggtattaaggaacttccaattagtattaatgaatattgtgatgctgaacattcattagaaggtcaaccaggttcaagtgctcgttttattggtaaatttgaacgttacaagattgatagtgctatgattacttggtggtttgtaccattaccaggtcgtttaggtagtttaatggcttctgatactcaaaagggagctggttggtatttatataaatggtatggtgatatgtc

SEQ ID NO: 13771 - DNA, 936 bp, Anaeromyces robustus
  (Trans)glycosidases
gcatttcaaattaaatcatttattattagtattaggttttgtgaatatatctttagctttaacaactaaagagttcatgaaatctattggtatgggtgttaatataggacatacttttgatacaataagagattggtctaatattgacatttcagaaattaatagtgattttaaactttggactgattctgaagtaaaaattaaggaagctgtagaaggttataaaaatttaggttttcattccattcgtatacctgtaaaatggtcaactcgtccaacaactaaaacaccaattgaaccaaaattattaaaagcagtagaagaagttgttcgagtagctattgaaaatgatatgtatgttattattaatttagaaacagataatttttatatgaatggatttatttcagaagataaagctattcttactgaaacttatgatagttataaaggaacttggaaacaaatcgctaattattttaaagattatgatgaacatttaatgtttgaagcattaaatgaatcaggttattgggaaactatatggaatactcgtacagctgatggtgatagacctgaagctctcgctgttttacttaaagtcaatcaagaatttataaataccgttcgttctattgaaggatataatcaagaaagatatttattaattgaaggttatgcttgtgatccaattttaactcaagatcacttttataaaacacctagtgatccaaaaagttcaggaaaacttattgtttcactttattatttcattccttacacatttactgttatagaaaagtatggtatatggggatcttcatatgatgttcatcaacttcaagaagttgttgatgatctcagatatcgttttgttattcaaggagttccagtcatttttacaagatatggtacaaatattagaaatagaaaaag

SEQ ID NO: 13772 - DNA, 924 bp, Anaeromyces robustus
  (Trans)glycosidases
tcatgaaagagttgatttagcccttgaagcttatgctaaacataatcttaatgttgtaagagcttgggctttctgtgatgaatgtgaagatgcaacaagattagttgatttttctggtccagaggttaaacttaatagtgaaaatatggaaaaggttgattattatcttgctgcagctgctcaaagaaatattcgtgttgtattaactcttactaataactggactgattacggtggtatggatgtttgggtcaaacaattcggtggaaaatatcatgatgaattctatactaatagaaaacttattgaaggttacaaacaatacattaaagctatgattaaccgtgttaatacttataccggtcaaagatacaaggatgatccaaccattttttcatggcaacttgctaatgaagctcgttgtaataatggacctcatggtcttccagttaaagattgtaatactgatactattactaaatggatggatgaaatagctacatttattcatgaagaagatccaaatcatttggtctcttctggtattgaaggtattggtcttacaccaccggctggtgttgatccaaatacatatgtctatacttacgttgaaggtactgattatgaagccattagtgctcttgattctattgattataacactgttcatatgtacccagttggttggggtttaaaagattatgctaaggatggtgtaaaatggattcaagctcacgctgatgttgataaaaaattcaataaaccaactgttgttgaagaatggggtcttagtacatcagctgataatgtacctttagaagaacgtgatccaatttatactcaatggatggatgctgttttagctaatgataatattggtatgaatatgttctggtatgtttgtggtgaagattattatggaac

SEQ ID NO: 13773 - DNA, 624 bp, Anaeromyces robustus
  (Trans)glycosidases
tttaccaaattggccttatagatggccaggtttacaaaaatggttagatgaagttaaatcttttattaatgataaaaaaaaatcaggtttaacaaattggtatggttatgaaatttggaatgaacctgatggtacttggaaagatgcggatggtattaattttaatgaattatggagacaaacctatcaagtaatgcgtcaaaatgatcctaatgaaaaaattattggtccttgtgatagttggtataatgaaaatagaatgcgttctttccttcaatatgctaaaactaataattgtttaccagatattatgtgttggcatgaattaagtggtatagaaaatgtttccaatcatttaaaagcttatcgtaatttagaaaaatctcttggtattaaggaacttcctattactattaatgaatattgtgatgctaaacatgaatgggaaggtcaacctggttcaagtgctcgttttattggtaaatttgaacgttataaggttgatagtgctttaatttcttggtggtttgtaccacatccaggtcgtttaggtagtttattagctaccgatacacaaaaaggtgcaggttggtatttttataaatggtatggggatatgaccgg

SEQ ID NO: 13774 - DNA, 933 bp, Anaeromyces robustus
  (Trans)glycosidases
gcttcaatatgttggtgttaatgaagctggtggtgaatttggtgaaaataatttaccaggtatttataataaacattatatttatccaaatattgaatccattcgtgcttctgttgaacaaggtatgaatgttttccgtatgggtcttagatgggaacgtttccaacatgaattatttggtgaatttagtgaatttgatgttactgaatataaaaaggttgttgatgctactacttctatgggagctgtacttatcattgatccacataattatgctcgttacaatgataatattgttggttctaaagaagttccaattgaagcctttgctgatttctgggctaaattagcaaatattttcaaagataatgaaaaagtatggtttggtttagttaatgaaccccatgatatggaaactgatgattggttcaaggcggctcgtgctgcagttgatgctattcgtgccactggtgctactaataatattttaattccaggtaatggatgggatggtgcatggagttggggtaaggaagcttggtatggtgaagctaatgctgatgttgctttaagatatttctcatctgaagataaaaatattatttttgaagttcaccaatactttgatgaagattactctggaactcatgacacttgtattcaacgtccatgtcaaaatcttcttaaagaatttgttgaatggcttaaaactaacaatttaaaaggttgggttggtgaaattggtggtactcttaatgatgaatgtaaagaatgtgttcatgaacttattgaatatcttcaagaaaatagagattatgttttaggtcttcaatggtgggcagctggtccatggtggggacacaattcttactctattgaaccaaattcagaaaaggcttttccaggacaaatggcttggttaaaaccatactt

SEQ ID NO: 13775 - DNA, 762 bp, Anaeromyces robustus
  (Trans)glycosidases
tgaaggttttggtacaagtttctgttggtgggctaatcgtcttggttattcagattctttagctgaaaaagctgctactctcttttatgataaagtcaatggtttaggtcttaccgttattcgttataatattggtggtggtgatgatccaactcatcatcatattactagaacagattcaaatatgccaggttatgctattaatccaagatatgatggtagatcatatacttgggattataattggaatagtgatgctaatcaaagaaatgttttattaaaatctgttgctaaaaatagagatgaaattattgtagaagctttctctaattctccaccatactttatgacgaattctggttgttccacaggtaattttgatgctaataaggataatcttaaaagtgatgcttaccctgcttttgctaaatatcttgctgatgttgctgaacatttcaaaacaagttggggtgttggtttccaaagtattacccctgttaatgaacccttcactaattattggggagctaatagtaaaaaacaagaaggttgtcactttgatcaaggtaattctgaatccaaaattattgttgaacttaaaaaagctattgatcaaagaggtttaagagatatgcaaattagtggtacagatgaaactagtattgatactcaaattacttcattccaaaaacttagtaatgaagctaaaaatattattactagaattgatacccatacttatggtggaagtaaacgtgatga

SEQ ID NO: 13776 - DNA, 1035 bp, Anaeromyces robustus
  (Trans)glycosidases
tttcctttctactaaaggtagatcaatcgttgatcaaaatggtcgtaaaataaagttagctggtatttcatggtttggaggtgaaactaataatctttctccacatggtttatgggctaagccattagatcattttattaaaactattaaggatcttggttataatcatattcgttatccatggacaaatgaaatgcttacaccaggagctaaaacaaattcaattgattctacaagtaatccagatcttgttaatcttactccattagaagttatggatgctgttattaatgcctgtggtaaagttggtcttaaagtttatcttgatcgtcatagacctcaatctggtggacaaagtgaattatggtatattccagaagtagatgaaagtaaatggattgaagattggcaatttcttgctaaacgttacaagggaaatccaactgttattggtgctgatattcataatgaacctcatggtgaagcatgttggggatgtggagaaagtaaacgtgattggaaagctgctgctgaaagatgtggtaatgccattcatcaagttaacccagattggcttattattgttgaaggtaatgatcattatggtgaagaaggttggcaaaagggtgaatcatactggtggggtggtatgttaaagggtgttaaagaaaacccaattaaattaaataaaccaaataaacttgtatattctgctcatgattatgataagaatgttcatatgcaagattggtttaaggaatccaatttcccagataatatgccaaccatttgggatgataaatggggtttcattgctaaacaaaatattgcaccagttcttattggtgaatttggttcccttttaaaagatgcaaccgatagtaaatggttacaaaatttagttacttatatgactaagaatgaaattcattggactttctggtgtttaaatccaaattctggtgatactgaaggtattcttggatatgattgggaaactgttgatactaaaaaagatggtcttcttacaccagg

SEQ ID NO: 13777 - DNA, 729 bp, Anaeromyces robustus
  (Trans)glycosidases
ctctaaaaaaattgttggttatttcagtgaatggagaaattccaattatccaattagtcgtgtagatttatcaaaaattactcaccttaattatgcatttggtcttattgatccaagtacatatgctgtaaccggttatgaaagttggattttaactcaagttgttgaagctgctcataaacaaggtgttaaagttcttatgtcaattggtggttggtatggaagtcgttacttcactaaaatgacctcttctaagagtaatatggaaagatttgctgatagttgtaaaaatcttattgatacatataaaatcgatggtattgatattgattgggaatatcctggaagagaaggtgcttgtaacacccctgaccttgccaatgatacagataattatttaacacttttagaaattttacgtaagaagattggtaatgattcattaattactgctgctgttagtgcaattccatttgaaaagaatggtcaaccagtttcaaatctttcagcttatgctaaatactttgattttattaaccttatggcatatgattttgctggtagttggtcatcagttacttcacatcattcaggtttatatgatccagaagctggtgataaattatctgtttccactggtgttaaaaattggttaaatgctcaattcccagctagtaagattgttgttggtgttccagcttacggaaagagttggattgctgcttcatc

SEQ ID NO: 13778 - DNA, 165 bp, Anaeromyces robustus
  (Trans)glycosidases
agctaaatatgttcttagtaataattttgctggtatgatggtttgggaattagaaaatgatacggaagattttgaaatcttaagtgccattaataagcatttaggttgtgatggttcttttaatggtgattcaaacaaacctactactactactactaaaaaaac

SEQ ID NO: 13779 - DNA, 711 bp, Anaeromyces robustus
  (Trans)glycosidases
aaaatcaattattgtttattacccagaatggaaatattatgatttcccaccaaaagatatcccattttcaaagttaactcatattaattatgcttttgctgaaattaatcctgatgatttctcattagaatatgattcaaataaatttttagaattaatagatactgctcataaaaaaaataaaagtattaaagttttaatgtcaataggtggttggactggtagtagatatttctcaaaaatggcttcatcttcttcaaatcgtacaaaatttgttaaaagtgtaaaaagaatgattgatgctagtaatgctgatggtattgatattgattgggaatatccaggttcaagtggtgcttatgatgacaattatgattcagaaaatgataccaataatttattaaaattattaaaagaattacgtgaaactataggaacttcaaaacttattactgctgctgtaccatttaacacttttgaagttgatcataaacctttaagtgatatgacagaatttgctaaactttttgattttattaatattatggcttatgatttctctggaagttggtcttccgttactgcacatcaatccgctctttattcaactcatgaagatgatagtggttattccctttcaggtgcagttaaaaattggatgaatgctaatttccctgctaaaaaaattgttgtaggtattccagcttatgg

SEQ ID NO: 13780 - DNA, 99 bp, Anaeromyces robustus
  (Trans)glycosidases
tgatccaaaatcagtaggtcttaaagctgattatgttattgaaaataatttaggtggtatgatgatgtgggaaattgaagaagattcaaaagatagtga

SEQ ID NO: 13781 - DNA, 186 bp, Anaeromyces robustus
  (Trans)glycosidases
tgttggtgaaattggtgctgctattaatgataaatgtaaagcttgtgttgaagaaactttaaattatttagaagaaaattcggataatattgttggttgggcttggtgggctgcaggtccttggtggggtaattatatgtattctcttgaaccaaaaggtaaagctttccctgaacaaatgacttg

SEQ ID NO: 13782 - DNA, 639 bp, Piromyces finnis
  (Trans)glycosidases
gacacaagtttcaagttatttcaaagattttgatgaacatttaatttttgaatcattaaatgaagaaggttgttggaatgatgtttggaaccgttggagtaatgctggtgataagaataaggcatatggaactttaaacaatctcaatcaacaatttgttgatattgttcgtaactccggtggtaataataaaaatagacatttacttttagctggttattgtactgatattgatttaacagttgattctgcctttaagatcccatctgattcttctaatagattaatggtttctgtacactattacactccatctacttttactatccttgaaaaagatgaagattggggtaagtttgctggttcatggggtactgacgctgaagttaaagcccttattgctgatttcgataaacttaaaaaacgttttgttgacaatggaattccagttattattggtgaatacggtacagttttaactaacaaaaataaagacagtgttcacaaatatttattcacttgtgctcaatacgccactagtttaggaatgtgtccaatgctttgggataatggtgatcactttgaccgtaagggtcttaaatttaaggattctgaaataggtgacttctacaaacacca

SEQ ID NO: 13783 - DNA, 675 bp, Piromyces finnis
  (Trans)glycosidases
aggaattaaatggaattatgtattgggtagcgacattaatgaaaataccgaaacagccaatgttgttgatatagatattagaaaagatcaatcaaaaattgataatcttcacaaaaggggtataaaggttatatgttatttttcaggtggtacattggaatattttcgtgaggattataaagattttttaaatgttcctaatttagttcaaaatagatatgaggcttggcctgatgaagattggcttgatattcgtgttgaaggtttaaagcctttacttaaaaagcgtattaaattagcagtgagtaaaaaatgtgatgccattgaagttgataatttagatggctatcaaatggccgaagttaaaagttggcgtaatccattaactaagagtgatactataaagtttgcaaaatggttagccaatactgctcataactatgacatttcaattggattaaaaaatgttcccggacttattgatgaattatcaagttattttgattttgctattaatgaagattgtgtagtatacaatgaatgccgtctttacaagaatttccttgctaaaggaaaggctgtatttggtgttacttataatggtatagaagccaatcgcagtgccttatgtagaaatttaaatggtcttaatattagtatgattgttaaaaataa

SEQ ID NO: 13784 - DNA, 1047 bp, Piromyces finnis
  (Trans)glycosidases
tcgatttggtgttggtctctatggtaatgatcttgccatgtccaccatcacatctgaaaaaatgagaaaagttattaaatatcaatttaattcaatgacctatactaatcttatgaatccaagtgctattttagatcaacaagcttctattgataatattatgaatggtaatgaagatcctattctaaattttagtaatattgttgatggtttagattttgcctataaaaatggacttaatattcgtggtcatgctctagtatggcatactcaagttccagaatggttctttagagatggatattatagcaatacagaatttgttagtagagatgttatggagtatcgtttagatagttatattcgtaagttccttggatttgttcaatttaattatccaggaacagtagatgtttgggatgtagttaatgaagcaattgaaattacagatggtcaatatgatgaaacaactggatggtatacccgtactgctaataataaaacaccaaatccttggtatgaaatatttggacctgattatgttgcaatagcattccgtattgctcgtaaatatgcccttcctaatgtaaagttaatttataatgatcataatactttccaaatccaaccacatgataaaactcaagccattattgatcttgccaatattttacaacaagaaaacttaattgatggtattggtatgcaatcttatataggagttacttggccaaatttagatgattactttaacggtttagaaaggttaattacttctactggattagaaattcaaattactgaattaacaattactccaccaataggtgataattggttaggtgctcaagcagaacaatattatgagtacttcaatagacttttatcttacattaaaaatggttataacatttctagtgtcactgtttatggtttacaagatggctatagattctacactaaagattctaccaaaactcgtcttttagatcatgatcttaaaaagaaaccaaatttcaatgctattataaatgtattaaaaaatta

SEQ ID NO: 13785 - DNA, 909 bp, Piromyces finnis
  (Trans)glycosidases
aactacaaaaaattggcaacctatcactataaatggtaaacgtcttcttcttaagggtgtaaatcgccacgacactgatccattcaatggaaaagctatacctcaagaaactatgcgtgaagatattactttaatgaaaaagaataatattaatgccattagaacttcccactatagtaatgattcctatttatattggctttgtaataaatatggtatgtatgttatgggtgaaacaaatatggaatcacatgctttaatggataataatgatggaaaagctttattctatgaacttggtcttgacagaacagaaacagcatacaaacgtttaaagaataatccttccattgtagcatggtccattggaaatgaaatggcatacacaggtaatccaagtgatgctggaggtcttttccgtgatatgatatggtactacaagaaaaacgataatactcgtccagttcacagtgaaggacaaggtggtggaatgggtgtcgatatgagtagtaatatgtaccctagctcagacggtattcgcggtaatgcaggaaaaggtaaaatgccatatgttatgtgtgaatatgatcacgctatgggtaactcagttggtgctttaaaagaatattgggatgctattagaagtgcggataatatgttaggtggtttcatttgggattgggttgatcaatcaagagcagttccaatcaaaagcggtggatgggattattactctgaatcctatgccaagacaaatctctattctagtgaaattaaaggaaaattctacggttacggtggtgactggggagatagaccaaatgataacagtttctgtgtaaatggacttatcaatcctgatagaactcctcaacctgaacttgctgaagtcaaattccaataccaaag

SEQ ID NO: 13786 - DNA, 906 bp, Piromyces finnis
  (Trans)glycosidases
attagtaaatccaaaagctattccagctgctagaaagctttatgactttttaaaatctaattatggtaagagaatactttctggtcaagttggtgctgctggtaaagctggtgatgaaggtcaagaattccaacgtattaagaatgcttctggaaaattacctgctgtttggaatatggatttcatttttgaatcaaatgattgtacttggagaccagaaaatccagatattactgaaatggcaattaattggtggaaaaagtatgaaggaaaaggtattatggcagctcaatggcactggaatattgctggtaaaactggtaattttgctttttacagtaaggatacaacatttagtcttgagaatgcagtaactaaaggtacttgggaatatgaaaagattattaaagatattgatcgtgtttcaggtcatataaaaaagttacaagctgttaatatgcctttaatatggagacctctccatgaaaacaatggtgattggttctggtggggtaataatccaaaggcttgtgctaaattatggaaaatcttatatgaacgtatggttaactatcacggtttaaacaatttaatttggctttggaatggtaataatgatgaatatactccagttgactatattgatattattggtgttgatatttatgctaatgaccacggaccacaaactacagcattcaatacccactttgatttctatggaggaaagaaaatggttgttttatcagaaaatggacgtattccagatattcaacaatgcgttgatcaagatgcttggtggggttacttccaaacttggaatagtgaatttattttacaagaatcataccatactaatgcacaacttaaagaatactttaatcatgaaattgttatgaatatgga

SEQ ID NO: 13787 - DNA, 582 bp, Piromyces finnis
  (Trans)glycosidases
aaatgaaccaagaaaagtcggggaccctgttgaatggacaggagatcaagaaggatataactttgttaatgaaatgaatgaagttttcattaaaacaattcgttccactggtggtaataatgctcttcgtcatcttatgattccaccatatgctgctggtgttatggatgcaagtcttaacactttcagagttccaagagatgatgataaaattattgtttcacttcattcctacagtccttataattttgctttaaataatggatctggcgccatttctaatttctatgatggtagtgaaattgattatgtcatgaatactattcatcaaagatatatcagccaaaatattcctgttattattggtgaattcggagccatgaatcgtgataatgaagtcgatagagctagatgggctgaatattatattaagaaggctacttctattggtgttccatgcgttttatgggataatgcttactatgaaggaaaaggtgaacgttttggagctattaaccgtaccactttagaagtcgtatttccagattatattaatggattaatgaaaggattaggcaacaa

SEQ ID NO: 13788 - DNA, 556 bp, Piromyces finnis
  (Trans)glycosidases
tggtgctgctgtttccacctcaactacttcttccaaggttatgagagaacttgttaaataccaatttaattcattctcatacagtaaccttatgaaaccacttttcgttcttgaccaagctggttgtcaaaagaacttcaagaatggtagtaatgaaattgctcttaattttactccatttgttgatggtttagattatgctcaaaagaatggtcttcatattagaggtcacgttttagtctggcacaagcaattcccagactggttctttagagaagaatttgacgatgctaaggaatacgtttctgaagaagttatttacgaacgtttagaaaactatattaaacaatatctcggtttcgttaactacaactacccaggtgttgttgatgtttgggatgttgttaatgaagctgttgaagttttagaaggaaaattcgataacagtactggatggtacactcgtactattacttatgaaggtgatagaaacatctggtatgactttgttggtccagattatgttgttaaaactttccgtattgctcgtaaatac

SEQ ID NO: 13789 - DNA, 1011 bp, Piromyces finnis
  (Trans)glycosidases
ttatgtatacactgaagggacaaacttttatattgatggctacaaaatatatttttctggaacaaatacatactatttacatagttctcaaaatgaaagggtggatcttgcattagaagtatcagcaaaacataatattcaagtagttcgtgcatgggcattttgtgatcttaaggtgtgtggtgacaaacaatttgtgaaatttgaaaatggaaaggctgtatttcttgaagataatatggaagctatcgattactttatagcagcagcatcacaaagaaatatcagattagttttaggttttactaataattggactgattatggtggtatggatgaatgggttaaaggttatggtggtaaatatcatgatgatttctatactaatacagatatccgtaaggcattcaaaagctatattaaattgttaattactcgtattaatcgtcataccaatattcgttatagtgatgatcctacaatattttcttggcaattagctaatgagccaagatgcggaaatggtccttctggacttcctcaatcaggtaaatgcactcctgaggttataactgaatgggctaatgatattagttcatatattaaagaactagaccccaaccacttagtatcagtcgggtgtgaaggttttggtcttgaagctccagagggatctaaaggattatatgcatacaaatatgatgaaggtactgattttgaggctttaacagcacttccaaatattgattataatacttatcattattatcctattccatggggaatgaaagatttagtttctcatactaaagattggattgaatcacatcaagctgtaggaaaaaaattaaataaaccagtagtatttgaagaatggggtcttgaaattccaactgactgttcaaaagaagaacgtattcaatattacaaaacatggacaaagcaaatcctcgatgctgatgttccaatgaatatgttttggtatactgtcggtgaagattattatggaac

SEQ ID NO: 13790 - DNA, 1014 bp, Piromyces finnis
  (Trans)glycosidases
ttttgttcaaactgatggtacaaattttgttgtcgatggttgtaaacgttacttttctggttcaaatacttattatttaatggtatcaaatcatgaaagagttgatttggctctcgaaacatatgctagacataaccttaatgttgttagagcatgggctttctgtgatgaatgtgaagatgcaacaagattagttgatttttctggtccagaagttacacttaacagtgaaaatatggaaaaggttgattattatcttgctgctgctgctcaaagaaacattcgtgttgttttaacccttactaataattggactgattatggtggtatggatgtttgggttaaacaattcggtggaaaatatcatgatgaattttacactaacagagatattgttaatggttacaaacaatatattaaggctatgattaatcgtgttaatacctatactggtcaatattataaggatgacccaactattttctcatggcaacttgccaatgaagcccgttgtaataatggtccacatggtcttccagtcaaaaattgtaatactgacactatcactaaatggatggatgaaattgcttctttcattcatgaagaagatccaaatcacttagtttcttctggtattgaaggtattggtcttactccaccagctggtgttgatccaaatacttatgtctactcatacattgaaggtactgattatgaagctattagtgctctcgactcaattgattacaatactgttcatatgtacccagttggttggggattaaaagattataccaaagatggtatgaaatggattcaagctcatgctgatgttgataagaaatttaataaaccaactgttgtagaagaatggggtcttagtacttctgctgataatgtaccacttgaagaacgtgatccaatttatactaaatggatggaaactgttttggaaaatgacaacattggtatgaatatgttttggtatgtttgtggagaagattattatggtac

SEQ ID NO: 13791 - DNA, 1029 bp, Piromyces finnis
  (Trans)glycosidases
ttatctctcaaccaagggtaagtacatcgttgatgaaaagggccgtaaagttattttaggtggtctctcatggttcggtggtgaaactactaacctttctccacacggtttatgggctaactctttagaaaacttcattaagatcgttaaggatcacggttacaatcaccttcgttacccatggactaacgaaatgttattcccaggtgccgaaactcaatctgttgaccaagttaacaacccagatcttgctaacctcagtccattagaagttatggatgccgttattgatgcttgtggtaaggccggtttaaaggtttaccttgatcgtcacagaccactttctggtggacaaagtgaattatggtacattccagaagttccagaagaacaatggattgaagactggcaattccttgctaagcgttacaagggtaacccaaccgttattggtgctgatcttcacaacgaaccacacagttctgcctgctggggttgtggtgaaatcgaacgtgattggagacttgctgctgaaagatgtggtaacgctattcacgaagttaacccagactggcttattattgttgaaggtaatgatcactatggcgaagaaggttggcaaaaaggtgaatcctactggtggggtggtatgttaaagggagctaaggaattcccagttagattaaacgttccaaataagcttgtttactccgctcacgattatgataagaatgtccacatgcaagattggttcaaggaaccagacttcccagacaacatggaaccaatttgggatgacaaatggggataccttgttaaggaaaacactgctccagttcttattagtgaatttggttccctcttaagagatgctactgatattaaatggttaggtaacttagttagctacatgaaggaaaatgatgttcactggactttctggtgcttaaatccaaactctggtgatactgaaggtattcttggttacgattggaagactgttaacgcccaaaaggatggtcttctcga

SEQ ID NO: 13792 - DNA, 972 bp, Piromyces finnis
  (Trans)glycosidases
tttatggtctgaatcagaagatttagctaaagcttttgttgaagaaatgactttagatgaaaagattaacatggttactggttctgaaaatagttttggtccatgtgttggttacattcctccaattgaaagattaggtttcaaaggtttatgtttacaagatggtccagctggtgttcgttctgctaaacattcaaccactttcccatctggtttaaatattgcttctacttttgatcaaaatcttatgaagaaacttggtgttgctcttggtgaagaatgcagagctaagggtgttaacgttattttaggtccagctatgaacatgtaccgttctccagctgctggtagaaactgggaaggttatggtgaagatactttcctcgctactgttgcttcaaagaatgttgttgctggtattcaaagtcaaggtgtttttgctactgctaagcactttgctggtaatgaacaagaatacaagcgtgaatcttctaactctattattgatgaacgtgttttacaagaagtttacttcccaccatttaaggctgctgttgtttctggtgctggtgcttttatgtcagcttataatgatcttaatggtattccatctgctaacaacacttatcttttaaaccaagttttaaagaagcaatttaaattccacggttttgtcactagtgactggtggggtactaaggataagtatgaaattactaatggtttagatgttaatatgccaggtggtaagcaatggggtccaactgaaaaagaaagttactggggagaagaactcaaggctgctattgaaagcgaagaaattgatatttcttatcttgatgaagcttgtgaacgtattttaactatgatgtacaaatacaagcaaatggatgatttcccagaacttaatcttgatgctgatggtactgaaggtcacactgaacttgttcgtgaagctgctgctgcttctgt

SEQ ID NO: 13793 - DNA, 972 bp, Piromyces finnis; identical to SEQ ID NO: 13792
  (Trans)glycosidases

SEQ ID NO: 13794 - DNA, 1056 bp, Piromyces finnis
  (Trans)glycosidases
acttactttagctgctgcaagttcagctttagctttaacttcacaacaagttattggtgaaatgggtcttggttggaatttaggtaatactttagaagcatttggggattggatcaatggaagtacagttaatcaatttgaaactgcttggggaaatccagctgcaactgagcaattaattggagctattaaagataatggttttaacagtattcgtattccagttgcttggagtaatcttatgagttccgattacactattaattctaatttattaaaaagagtaaaagaagttgttagttgggttactaataaaaacatgtatgctatcataaatatccactatgacggtggttggttcgaacaattcggtacttctcaatctactcaagcaaatcaaaaatttaacaagatatggacacaagtttcaagttatttcaaagattttgatgaacatttaatttttgaatcattaaatgaagaaggttgttggaatgatgtttggaaccgttggagtaatgctggtgataagaataaggcatatggaactttaaacaatctcaatcaacaatttgttgatattgttcgtaactccggtggtaataataaaaatagacatttacttttagctggttattgtactgatattgatttaacagttgattctgcctttaagatcccatctgattcttctaatagattaatggtttctgtacactattacactccatctacttttactatccttgaaaaagatgaagattggggtaagtttgctggttcatggggtactgacgctgaagttaaagcccttattgctgatttcgataaacttaaaaaacgttttgttgacaatggaattccagttattattggtgaatacggtacagttttaactaacaaaaataaagacagtgttcacaaatatttattcacttgtgctcaatacgccactagtttaggaatgtgtccaatgctttgggataatggtgatcactttgaccgtaagggtcttaaatttaaggattctgaaataggtgacttctacaaacacca

SEQ ID NO: 13795 - DNA, 1020 bp, Piromyces finnis
  (Trans)glycosidases
ttcatctcttgaattaattaaggaaatgagattcggttggaatttaggtaatactttagaagcatttggggattggatcaatggaagtacagttaatcaatttgaaactgcttggggaaatccagctgcaactgagcaattaattggagctattaaagataatggttttaacagtattcgtattccagttgcttggagtaatcttatgagttccgattacactattaattctaatttattaaaaagagtaaaagaagttgttagttgggttactaataaaaacatgtatgctatcataaatatccactatgacggtggttggttcgaacaattcggtacttctcaatctactcaagcaaatcaaaaatttaacaagatatggacacaagtttcaagttatttcaaagattttgatgaacatttaatttttgaatcattaaatgaagaaggttgttggaatgatgtttggaaccgttggagtaatgctggtgataagaataaggcatatggaactttaaacaatctcaatcaacaatttgttgatattgttcgtaactccggtggtaataataaaaatagacatttacttttagctggttattgtactgatattgatttaacagttgattctgcctttaagatcccatctgattcttctaatagattaatggtttctgtacactattacactccatctacttttactatccttgaaaaagatgaagattggggtaagtttgctggttcatggggtactgacgctgaagttaaagcccttattgctgatttcgataaacttaaaaaacgttttgttgacaatggaattccagttattattggtgaatacggtacagttttaactaacaaaaataaagacagtgttcacaaatatttattcacttgtgctcaatacgccactagtttaggaatgtgtccaatgctttgggataatggtgatcactttgaccgtaagggtcttaaatttaaggattctgaaataggtgacttctacaaacacca

SEQ ID NO: 13796 - DNA, 1023 bp, Piromyces finnis
  (Trans)glycosidases
ttcatctcttgaattaattaaggaaatgagattcggttggaacttaggtaatactttagatgccgaatgtacctcatggatggattatgaaaagaacccaattggttctgaaacctgctggggtaacgtcaagactaatgaagatatcttcaagactttaatggacaaccaattcaatgttttccgtattccaactacttggactggtcacattggtgaagctccagaatacaagattaacgaacaatggatgaagagagttcacgaaattgttgattacccatacaagaacggtgcttttgttatcttaaacattcaccacgaaacatggaaccatgctttcgctgaaaccgttgatgaagctaaggttgaattagctcaagtttggaagcaaattgctgaagaattcaagggttacggtgaacgtttaatcttcgaaggtcaaaacgaaccaagaaagaacggtactccagttgaatggaacggtggtgataaggaaggttgggatgttgttaatgcaatgaacgctgtcttcttagaaaccgttcgtagttctggtggtaacaatgctaagcgtcatcttatgattccaccatacgctgctgcttgtaatgaaaactctttcaagaactttgacttcccagaagatgatgacaaggttattgcttctgttcacgcttactctccatacaactttgccttaaataatggtgaaggagctgttgataagtttgatgcttctggtaagaatgaactcgactggaatattaacttaatgaagaagagattcgttgaccaaggtattccaatgattttaggtgaatatggtgccatgaaccgtgataatgaagaagaacgtgctgcttgggccgaatactacatggaaaagattactgctttaggtgttccacaagtctggtgggataatggtgtattcgaaggtgaaggtgaacgtttcggtcttattgatcgtaaaaacttaaagattgtttacccaagtattgttgctgctttacaaaaggg

SEQ ID NO: 13797 - DNA, 1023 bp, Piromyces finnis
  (Trans)glycosidases
ttcttctattgaattaattaaggaaatgagattcggttggaacttaggtaatactttagatgccgaatgtacctcatggatggattatgaaaagaacccaattggttctgaaacctgctggggtaacgtcaagactaatgaagatatcttcaagactttaatggacaaccaattcaatgttttccgtattccaactacttggactggtcacattggtgaagctccagaatacaagattaacgaacaatggatgaagagagttcacgaaattgttgattacccatacaagaacggtgcttttgttatcttaaacattcaccacgaaacatggaaccatgctttcgctgaaaccgttgatgaagctaaggttgaattagctcaagtttggaagcaaattgctgaagaattcaagggttacggtgaacgtttaatcttcgaaggtcaaaacgaaccaagaaagaacggtactccagttgaatggaacggtggtgataaggaaggttgggatgttgttaatgcaatgaacgctgtcttcttagaaaccgttcgtagttctggtggtaacaatgctaagcgtcatcttatgattccaccatacgctgctgcttgtaatgaaaactctttcaagaactttgacttcccagaagatgatgacaaggttattgcttctgttcacgcttactctccatacaactttgccttaaataatggtgaaggagctgttgataagtttgatgcttctggtaagaatgaactcgactggaatattaacttaatgaagaagagattcgttgaccaaggtattccaatgattttaggtgaatatggtgccatgaaccgtgataatgaagaagaacgtgctgcttgggccgaatactacatggaaaagattactgctttaggtgttccacaagtctggtgggataatggtgtattcgaaggtgaaggtgaacgtttcggtcttattgatcgtaaaaacttaaagattgtttacccaagtattgttgctgctttacaaaaggg

SEQ ID NO: 13798 - DNA, 1020 bp, Piromyces finnis
  (Trans)glycosidases
ttcttctattgaattaattaaggaaatgagattcggttggaatttaggtaatactttagaagcatttggggattggatcaatggaagtacagttaatcaatttgaaactgcttggggaaatccagctgcaactgagcaattaattggagctattaaagataatggttttaacagtattcgtattccagttgcttggagtaatcttatgagttccgattacactattaattctaatttattaaaaagagtaaaagaagttgttagttgggttactaataaaaacatgtatgctatcataaatatccactatgacggtggttggttcgaacaattcggtacttctcaatctactcaagcaaatcaaaaatttaacaagatatggacacaagtttcaagttatttcaaagattttgatgaacatttaatttttgaatcattaaatgaagaaggttgttggaatgatgtttggaaccgttggagtaatgctggtgataagaataaggcatatggaactttaaacaatctcaatcaacaatttgttgatattgttcgtaactccggtggtaataataaaaatagacatttacttttagctggttattgtactgatattgatttaacagttgattctgcctttaagatcccatctgattcttctaatagattaatggtttctgtacactattacactccatctacttttactatccttgaaaaagatgaagattggggtaagtttgctggttcatggggtactgacgctgaagttaaagcccttattgctgatttcgataaacttaaaaaacgttttgttgacaatggaattccagttattattggtgaatacggtacagttttaactaacaaaaataaagacagtgttcacaaatatttattcacttgtgctcaatacgccactagtttaggaatgtgtccaatgctttgggataatggtgatcactttgaccgtaagggtcttaaatttaaggattctgaaataggtgacttctacaaacacca

SEQ ID NO: 13799 - DNA, 636 bp, Piromyces finnis
  (Trans)glycosidases
tttagctgatattttaccatattggccatataaatggccaggtatgcaaagctgggcaaacgaagttaaatcatttattgctgataaaaaaaagtctggtttaaccaattggtacggtttagaaatttggaatgaaccagatggtacatggaaagattctaatggtttaaactttaacgaattttggaaacaaacttaccaagtaattcgtcaaaatgatccaaatgaaaagattattggtccatgtgatagttggtacaatgaaagtagaatgcgttcattcttacaattctgtaaaactaataatgttattccagatattatgtgttggcatgaattaagtggtattgaaaatgtttcaaaccacattaaggcttaccgtgaattagaaaaatctcttggtatcaaggaacttccaattagtattaatgaatattgtgatgctgaacacgaattagaaggtcaaccaggttctagtgcacgtttcattggtaaatttgaacgttataagattgacagtgctatgatttcatggtggtttgtaccaaaaccaggtcgtttaggtagtttattagctactgatactcaaaagggtgctggttggtatttctacaaatggtacggtgatatgactgg

SEQ ID NO: 13800 - DNA, 624 bp, Piromyces finnis
  (Trans)glycosidases
accaggttggccttataaattcccaggtcttcaaacttggttaaatgaagttaagtcctttgttaatgataagaaagcttctggtttaaaaaattggtatggtctagaaatttggaatgaaccagatggtacatggaaagattctactaacggtttaagttttaatgacctttggaaagaaacttacaagcttcttcgtcaactcgatccaaatgaaaaaattattggtccatgtaatagtttttaccatgaagatagaatacgttctttcttacaatttgcaaaacaaaataattgtttacccgatataatgtgttggcatgaattaagtggtattgattacgtatctagccatttcagagcttatcgtaatatggaaaaatctcttggaattaaggaacttcctattactatcaatgaatattgtgatgctgaacacgaattagaaggtcaaccaggttcaagtgctcgttttattggtaaatttgaacgttacaagattgatagtggtttaatcacttggtggtttactgctcatcctggtcgtttaggtagtttattagctactgatactcaaaagggtgctggttggtatttctacaaatggtacggtgatatgactgg

SEQ ID NO: 13801 - DNA, 624 bp, Piromyces finnis
  (Trans)glycosidases
accaggttggccttataaattcccaggtcttcaaacttggttaaatgaagttaagtcctttgttaatgataagaaagcttctggtttaaaaaattggtatggtctagaaatttggaatgaaccagatggtacatggaaagattctactaacggtttaagttttaatgacctttggaaagaaacttacaagcttcttcgtcaactcgatccaaatgaaaaaattattggtccatgtaatagtttttaccatgaagatagaatacgttctttcttacaatttgcaaaacaaaataattgtttacccgatataatgtgttggcatgaattaagtggtattgattacgtatctagccatttcagagcttatcgtaatatggaaaaatctcttggaattaaggaacttcctattactatcaatgaatattgtgatgctgaacacgaattagaaggtcaaccaggttcaagtgctcgttttattggtaaatttgaacgttacaagattgatagtggtttaatcacttggtggtttactgctcatcctggtcgtttaggtagtttattagctactgatactcaaaaaggtgctggttggttcttttataaatggtacggtgatatgacagg

SEQ ID NO: 13802 - DNA, 402 bp, Piromyces finnis
  (Trans)glycosidases
ttattgtactgatattgatctaactattgatgaagcttatgttgttccaaaagatgatcgtgttatggtttctgttcattattataccccttctaccttcactattcttgaagaagatgctgattggggtaaagcccaaccaacttggggatcagaaagtgaagttgaatatcttcttaacgatttcaaaaaaataaaaacacgttttgtcgataatggtattccagtagttattggtgaatatggtactgttaccaaaaataaggatattaatagtgttcataaattcttaaaaactgttgctgaaacttcacttaattctggtatgtgtccattcttatgggataatggtgaacattttaaccgcaaaacattagtctttagagatgaagctatcggtga

SEQ ID NO: 13803 - DNA, 816 bp, Piromyces finnis
  (Trans)glycosidases
ttggagtaatcttatgttggataattatattatcaatccattattactttctagggttaaagaagttgttgattatattgttaataatgatatgtacgctattgttaacattcattgggatatgggatggtttacaaaattcgctactaatgaaaaagaagctttcaaaaaatatacaagtatttggggtcaaatatctcaatattttaaagattatgatgaacatttggttttcgaatctttaaatgaagaaggttgttgggatgaaatatggaatcaatggagtaatcaaggggataagaaaaaggcttttaaccttttgaataatattaaccaagaatttgttgatattttccgtaattctagcgaaaataatgcgaaaagacacttacttttagctggttattgcactagtcttgatttaactagtgatgaattatatgttattccaaaagatgatagagtaatgatttctgttcattactacggtccatctacatttaccattcttgaagaagatgctgattggggaaaagctgcatactcttggggtacagaaaaagaaattaattaccttgttgatgaacttaaaaaaataaaaaagaactttattgataaaggtattccaataattgttggtgaatatggtactgctataactaataaggaaccagctagtgttattagatggttgaaaactgttgctaaaactacttcctcctttggtatggttccatgtctttgggatgctggacaatactttgatcgtgaaaaattagttttcaagaatcctgcaattggcgaattatttaaaca

SEQ ID NO: 13804 - DNA, 114 bp, Piromyces finnis
  (Trans)glycosidases
atatgatgatccagagagtattggatacaaagctaaatttgttcttgaaaatggctttgctggtatgatggtttgggaattagaaaatgatactgatgatttcgaaatattgac

SEQ ID NO: 13805 - DNA, 102 bp, Piromyces finnis
  (Trans)glycosidases
tgatgatccagagagtattggatacaaagctaaatttgttcttgaaaatggctttgctggtatgatggtttgggaattagaaaatgatactgatgatttcga

SEQ ID NO: 13806 - DNA, 36 bp, Piromyces finnis
  (Trans)glycosidases
tcgcaatgaaatattattatcaagttacaacacttc

SEQ ID NO: 13807 - DNA, 99 bp, Piromyces finnis
  (Trans)glycosidases
tgatccagagagtattggatacaaagctaaatttgttcttgaaaatggctttgctggtatgatggtttgggaattagaaaatgatactgatgatttcga

SEQ ID NO: 13808 - DNA, 684 bp, Piromyces finnis
  (Trans)glycosidases
ttttagtgaatggagatattcaagttacccagttagccgtatagacttttcaaaatttacccatcttaactatgcttttgctgtcattgacccaaatacatatgcattaactggttatgaaggttggattttaaatgaagtagttacagctgctcataatcaagatgtaaaagttcttatgtcagttggtggttggtatggaagtcgttattttactaaaatgacatcttctgaaaataatatgaaaaaatttgctgaaagttgtaaaaatcttattgatacctatcacattgatggtatcgatattgattgggaatatccaggaagagaaggtgcttgcaataacccggattatgccaatgataccgataattatttaaaacttttaaaaatattacgtgaatatattggtaatgaaaatataatttctgcagctgtcagtattactccatttgaaaaaaatggtcagccaataacaaatcttgctccatatgctgaatattttgattttattaacattatgggctatgacttcgcaggtagttggtcgtctgttacttctcatcatgctgctttatatgacccagaagctggtgatatattgtctatttcctcaggagttaataattggttaaatggtcaatttcctgcagacaaaattgttattggtgttccaacttatgg

SEQ ID NO: 13809 - DNA, 936 bp, Piromyces finnis
  (Trans)glycosidases
aaaacttcaatatttgggtgtgaatgaatccagtggtgaatttggtgaaggtaatttaccaggtgtttacaataaacattatatttatccagatgttaaagccatcgaaactactatcgaacaaggtatgaacgctttccgtatttgtaacagatgggaacgtttacagcatgaattatttggtgaatttaatgaattcgatatcactgaatttaaaaaggttgttgatgctactactgctaagggtgccattgctattattgatccacataactatgctcgttacaacaataaacttattggttctgaagatgttccaattgaagctttcgttgacttctggactagacttgctgaaattttcaaagataatgaaaatgtttggttcggtttagttaatgaaccacacgatatggaaactgatgattggttcaaggcagctcgtgctgctgttgatggtattcgttccactggtgctaagaacaacattttaattccaggtaacggttggactggagcttggagttggggtaaggaagcttggtatggtgaagctaatgctgatgttgccttaagatatttctcatctgaagatgaaaatattctttttgaagttcaccaatactttgataaagattactctggtacaggtgatcaatgtgttcaacgcccatgtcaaaatctctttaaagaatttgttgaatggcttaagaccaacaatttaaagggatggattggagaaattggttcataccttactgatgaatgccgtgaatgtgttcaagaatccattgaatatctccaagaaaacaatgaatatgttcttggtactttatggtgggcagcaggtccatggtggggacataatgctatgtctattgaaccaaatgccgaaaaagcattcccaggacaaatggcatggttaaagccatattt

SEQ ID NO: 13810 - DNA, 936 bp, Piromyces finnis; identical to SEQ ID NO: 13809
  (Trans)glycosidases

SEQ ID NO: 13811 - DNA, 960 bp, Piromyces finnis
  (Trans)glycosidases
tgtcattcaacaagttagaccagatttttactatggtgttgccactacaaagtcattcttttctaacccaaaatacaaagatatcatttctacttacaacttacatactggtggtaatgaatgtaaattctacactattcaaggtactcaaactttcaatactaaacaatgtgatgattcaattgcttttgctaagaaattcggtgctaaattccgtggacataatcttttctggccagccaactctccagattggttcaaaaattacagtgatgatattgaagaagttaaagcttattatcttgactatgttgccaaggttttagaccattacaaagatgaagaagatatcatctactgggatgttgttaatgaatccgtcactgatgattctactatcgataagtataagttacgttatggttctgatagaagtaatgaattcaagggttgggatacttacactgaagatattttcactcttgctcgtgaacatactaatccaaatgttaaattaatttacaatgattataatgctgaaaacaacaacggtaacttcaatggtaaaactggtgctgtttacaagtatattaaggaaatgaaagaaaagggtattccaattgatggtgtaggtttacaaatgcacatttcttgtaactacactccaaactacgaacaactcactgaattaattgatatgtacaaagaaatcggtgttgaagttcatgttactgaaattgatgtcagtatgaagaattgtaaaactcatgaccaacaaagaaaattatatatggatgttttcagagcttgttttgataatgaaaactgtaaggtttttactgtttggggtgcttatgatactgaatcatggattggtgcttcaaacgttccattaccatttgatgatgatatgtatccaaaggatatctactttgatatgttagaatatgttatgaaaca

SEQ ID NO: 13812 - DNA, 927 bp, Piromyces finnis
  (Trans)glycosidases
ctatgctaaagactttagaattggtgttgctgctaacacaatgagattcaataatcaagcttacaatgaagccttaaaggctttcaactacatggttgctgaaaatggttgtaagttatctggtattcaacaaagacaaggtaactacgattttagtgattgtgataatcactataagaaggctaaggaattaggtatggctttccgtggtcatgctcttatctggcacgcatacatgccatcttggtttgaaaatgctaatgcttcaaccttaaagaatgccattgttgaacatgttaccaaggttcttcaacactacgaaggtaaaattgatacttgggatgttgtcaatgaagctattgatgacagttcaaatggtaacggttggaagatgcgtaactccttcctttatcaaaaggttccaaactttgttgatcttgcttttgaaactgcccgtaaggtttctccaaatactaagctcttctacaacgattacaatactgaaggtatttacggaaaaactgaatccgttttccaattcgttaaggacatgaaatctcgtggtattccaattgatggtgttggtattcaatatcacgtttctgttgacagtcaaccacaatacaacaagattgatgatttaatttctcgttactgtggtcttggtcttgaagttcacattactgaacttgatgttaagtgtggtagccaatgttcttcatctaatgttgaatccaagcaagctactgtctttactaatgctttaaaggcttgtcttaacaattcttgttgtactggttatcttgtttggggtgttggtgatagcgatagttggttaggtgctaacgaaaagggtttacttttcaacagtaactaccaaccaaaatctcaatacacagctgttcttaatgtcttaaaggaaaccaa

SEQ ID NO: 13813 - DNA, 927 bp, Piromyces finnis; identical to SEQ ID NO: 13812
  (Trans)glycosidases

SEQ ID NO: 13814 - DNA, 204 bp, Piromyces finnis
  (Trans)glycosidases
taatgttgaatccaagcaagctactgtctttactaatgctttaaaggcttgtcttaacaattcttgttgtactggttatcttgtttggggtgttggtgatagcgatagttggttaggtgctaacgaaaagggtttacttttcaacagtaactaccaaccaaaatctcaatacacagctgttcttaatgtcttaaaggaaaccaa

SEQ ID NO: 13815 - DNA, 204 bp, Piromyces finnis; identical to SEQ ID NO: 13814
  (Trans)glycosidases

SEQ ID NO: 13816 - DNA, 201 bp, Piromyces finnis
  (Trans)glycosidases
tgttgaatccaagcaagctactgtctttactaatgctttaaaggcttgtcttaacaattcttgttgtactggttatcttgtttggggtgttggtgatagcgatagttggttaggtgctaacgaaaagggtttacttttcaacagtaactaccaaccaaaatctcaatacacagctgttcttaatgtcttaaaggaaaccaa

SEQ ID NO: 13817 - DNA, 906 bp, Piromyces finnis; identical to SEQ ID NO: 13786
  (Trans)glycosidases

SEQ ID NO: 13818 - DNA, 555 bp, Piromyces finnis
  1-PHOSPHATIDYLINOSITOL PHOSPHODIESTERASE-RELATED PROTEIN
tacaaggatcaatcaaattaatattcctggtactcatgatagtggaacatatgctgtagattggcattcttttcctattataaatggctttagaagacaatggggaagaactcaatctttagatatatatcaacaattaatgcatggaattagatatttagatataagacttgaaactaatccaaaaaaacaaatatatcttactcacgataaatttgattgtattaataaaaaaactaatgatttgtactatttaagtaatgtatttgatgaagctattaattttttacattataatccaagtgaaactgttattatgcatttaaaatgtgataattgtcatttccataagtataacaaagatggtagtatgaaagaaaaaggtgatttaaaagaggaagaattttatgaagcaattgctaatcttagtataaataattctgatagaccatatgaaaaattttataaagattatttttatcaagataataaaagtaatgagttatttccaactcttggaaaagcaagaggtacaataattatttatacacgtgg

SEQ ID NO: 13819 - DNA, 582 bp, Piromyces finnis
  1-PHOSPHATIDYLINOSITOL PHOSPHODIESTERASE-RELATED PROTEIN
taattggatgagtaaatatcttaataatacaaggatcaatcaaattaatattcctggtactcatgatagtggaacatatgctgtagattggcattcttttcctattataaatggctttagaagacaatggggaagaactcaatctttagatatatatcaacaattaatgcatggaattagatatttagatataagacttgaaactaatccaaaaaaacaaatatatcttactcacgataaatttgattgtattaataaaaaaactaatgatttgtactatttaagtaatgtatttgatgaagctattaattttttacattataatccaagtgaaactgttattatgcatttaaaatgtgataattgtcatttccataagtataacaaagatggtagtatgaaagaaaaaggtgatttaaaagaggaagaattttatgaagcaattgctaatcttagtataaataattctgatagaccatatgaaaaattttataaagattatttttatcaagataataaaagtaatgagttatttccaactcttggaaaagcaagaggtacaataattatttatacacgtgg

SEQ ID NO: 13820 - DNA, 370 bp, Neocallimastix californiae
  4-PPantetheinyl_Trfase_SF
aattggtgttgatattgaattagttaccgaggttccaattaccaatgaaaacttccttgaaagaaatttcactaaggaagaaattaagtactgtatgagtagaccagatccacaatctagctttgctggtagatggagtgctaaggaagctgttattaaggcagtatcttctcgtgctacttctaaggtttggactaaaggtgaagctgccccacttattgatattgaaattttacctggtgaatcaggtgccccagtggttaaattttataatgatgctgaaaaagctgttaaagatgctggtattaacaatgttaaagttactatttctcattctggtggtttctcttgtgctatggctatggctgaa

SEQ ID NO: 13821 - DNA, 369 bp, Neocallimastix californiae
  4-PPantetheinyl_Trfase_SF
tattggtgttgatattgaattagttactgaaattccaattaataatgaaaatttcattgaaaggaactttacaaaggaagaaattaaatattgtatgagtagaccagatccacaatctagttttgctggtagatggagtgctaaggaagctgttgttaaggctgtttcttctcattcctcctctaaagtttggactaaaggtgaagctgccccactcattgatattgaaatcttaccaggtgaatcaggtgctcctgttgtccaatttcataatgatgctgaaaaagctgttaaagaagccggtgttaaaagtgttaatgttactatttctcattctggtggtttctcttgtgctatggctaccgctaa

SEQ ID NO: 13822 - DNA, 369 bp, Anaeromyces robustus
  4-PPantetheinyl_Trfase_SF
tgttggtatagatattgctcttatctctgaattaaatgttgataatgaaggatttattgaacgtaatttcactaataatgaaattcaatattgtgaagctaaaccagatagacgttctagttttgctggtaaatgggccgctaaagaagctgttataaaggctatttcttcttattccttagaagctcaaaaaatatgggaaggtgctggtgctccattaaaggatattgaagttgttattgctgaatctggagctccaaaagttcttttaagtccaactttaaatgaaaaggttaaatctgttggtgttaatgatgttaaggttactattagtcattccggtcaatttgctgttgctatggcctatgc

SEQ ID NO: 13823 - DNA, 367 bp, Anaeromyces robustus
  4-PPantetheinyl_Trfase_SF
tattggtgttgatgttgaattagttagtgaaattccaattactaatgaaactttcttagaaagaaatttcacaaaggatgaaattacttattgtatgagtagaccagatccacaatctagttttgctggtagatggtctgctaaggaagctgttataaaggctgtttcttctcgtgctacttcaaaagtttggactaaaggtgaagctgccccacttgtagatattgaaattttaccaggtgaatcaggtgccccagttgttaaattccataatgatgctgaaaaggctgttaaagatgccggtattaaagatgttaaagttaccatttctcattctggtggtttctcttgtgctatggctattgct

SEQ ID NO: 13824 - DNA, 370 bp, Piromyces finnis
  4-PPantetheinyl_Trfase_SF
tattggtgttgatgttgaattagtaactgaaattccaatttccaatcaaaatttccttgaaagaaactttactccaaaggaaattgaatactgtatgagtagaccagacccacaatctagctttgctggtagatggtccgctaaggaagctgttatcaaggctgtttcttctcgttccacttctaaggtttggactaaaggtgaagccgcaccattagtagatattgaaattttaccaggtgaatccggtgctccagttgttgaattccatggagatgctgaaaaggctgttaaagaagctggaattaatagtgtaaaagtaactatttctcattctggtggtttctcttgcgctatggctatggctgaa

SEQ ID NO: 13825 - DNA, 369 bp, Piromyces finnis
  4-PPantetheinyl_Trfase_SF
tgttggtgttgatgttgctttaatttctgaaataaatattgaaaatgaaagtttcgtagaacgcaactttacttcaactgaaataaattactgtaagagcaaaccagatgctcgctctagctttgccggtagatgggctgctaaggaagccgttattaaggctatttcctcatattcattagaagctcaaaagatctgggaaggtgctggtgctccattaaaggacattgaagttgttatggctgaatctggtgctccaaaggttcttttaagtcaagaattaaaagacaagattaagtctgttggtgttaatgatgttaaggttactatcagccactctggtcaattcgctattgctatggcttatgc

SEQ ID NO: 13826 - DNA, 370 bp, Piromyces finnis; identical to SEQ ID NO: 13824
  4-PPantetheinyl_Trfase_SF

SEQ ID NO: 13827 - DNA, 369 bp, Piromyces finnis; identical to SEQ ID NO: 13825
  4-PPantetheinyl_Trfase_SF

SEQ ID NO: 13828 - DNA, 369 bp, Neocallimastix californiae
  4'-phosphopantetheinyl transferase
aattggtgttgatattgaattagttaccgaggttccaattaccaatgaaaacttccttgaaagaaatttcactaaggaagaaattaagtactgtatgagtagaccagatccacaatctagctttgctggtagatggagtgctaaggaagctgttattaaggcagtatcttctcgtgctacttctaaggtttggactaaaggtgaagctgccccacttattgatattgaaattttacctggtgaatcaggtgccccagtggttaaattttataatgatgctgaaaaagctgttaaagatgctggtattaacaatgttaaagttactatttctcattctggtggtttctcttgtgctatggctatggctga

SEQ ID NO: 13829 - DNA, 366 bp, Neocallimastix californiae
  4'-phosphopantetheinyl transferase
tattggtgttgatattgaattagttactgaaattccaattaataatgaaaatttcattgaaaggaactttacaaaggaagaaattaaatattgtatgagtagaccagatccacaatctagttttgctggtagatggagtgctaaggaagctgttgttaaggctgtttcttctcattcctcctctaaagtttggactaaaggtgaagctgccccactcattgatattgaaatcttaccaggtgaatcaggtgctcctgttgtccaatttcataatgatgctgaaaaagctgttaaagaagccggtgttaaaagtgttaatgttactatttctcattctggtggtttctcttgtgctatggctaccgc

SEQ ID NO: 13830 - DNA, 381 bp, Anaeromyces robustus
  4'-phosphopantetheinyl transferase
gggtaatggtgttggtatagatattgctcttatctctgaattaaatgttgataatgaaggatttattgaacgtaatttcactaataatgaaattcaatattgtgaagctaaaccagatagacgttctagttttgctggtaaatgggccgctaaagaagctgttataaaggctatttcttcttattccttagaagctcaaaaaatatgggaaggtgctggtgctccattaaaggatattgaagttgttattgctgaatctggagctccaaaagttcttttaagtccaactttaaatgaaaaggttaaatctgttggtgttaatgatgttaaggttactattagtcattccggtcaatttgctgttgctatggcctatgctaa

SEQ ID NO: 13831 - DNA, 366 bp, Anaeromyces robustus
  4'-phosphopantetheinyl transferase
tattggtgttgatgttgaattagttagtgaaattccaattactaatgaaactttcttagaaagaaatttcacaaaggatgaaattacttattgtatgagtagaccagatccacaatctagttttgctggtagatggtctgctaaggaagctgttataaaggctgtttcttctcgtgctacttcaaaagtttggactaaaggtgaagctgccccacttgtagatattgaaattttaccaggtgaatcaggtgccccagttgttaaattccataatgatgctgaaaaggctgttaaagatgccggtattaaagatgttaaagttaccatttctcattctggtggtttctcttgtgctatggctattgc

SEQ ID NO: 13832 - DNA, 369 bp, Piromyces finnis
  4'-phosphopantetheinyl transferase
tattggtgttgatgttgaattagtaactgaaattccaatttccaatcaaaatttccttgaaagaaactttactccaaaggaaattgaatactgtatgagtagaccagacccacaatctagctttgctggtagatggtccgctaaggaagctgttatcaaggctgtttcttctcgttccacttctaaggtttggactaaaggtgaagccgcaccattagtagatattgaaattttaccaggtgaatccggtgctccagttgttgaattccatggagatgctgaaaaggctgttaaagaagctggaattaatagtgtaaaagtaactatttctcattctggtggtttctcttgcgctatggctatggctga

SEQ ID NO: 13833 - DNA, 372 bp, Piromyces finnis
  4'-phosphopantetheinyl transferase
tgttggtgttgatgttgctttaatttctgaaataaatattgaaaatgaaagtttcgtagaacgcaactttacttcaactgaaataaattactgtaagagcaaaccagatgctcgctctagctttgccggtagatgggctgctaaggaagccgttattaaggctatttcctcatattcattagaagctcaaaagatctgggaaggtgctggtgctccattaaaggacattgaagttgttatggctgaatctggtgctccaaaggttcttttaagtcaagaattaaaagacaagattaagtctgttggtgttaatgatgttaaggttactatcagccactctggtcaattcgctattgctatggcttatgctaa

SEQ ID NO: 13834 - DNA, 369 bp, Piromyces finnis; identical to SEQ ID NO: 13832
  4'-phosphopantetheinyl transferase

SEQ ID NO: 13835 - DNA, 372 bp, Piromyces finnis; identical to SEQ ID NO: 13833
  4'-phosphopantetheinyl transferase

SEQ ID NO: 13836 - DNA, 207 bp, Neocallimastix californiae
  6-blade_b-propeller_TolB-like
aatttatgatttcgatgaaagttcaattttcgatggttcacaagctactgatattacatttaataaggatggttcagtaacttatgtagctaatgctgctggttccggtggtggtattgtcttctatattaaaaaagataaatcagttattaatctttcaaactatgattccgttgatattgaattagtatttagtccagttaatgg

SEQ ID NO: 13837 - DNA, 48 bp, Neocallimastix californiae
  6hp_glycosidase
ggaacttcaacaagcctatggtacttgggatatctacgccatgcactg

SEQ ID NO: 13838 - DNA, 267 bp, Neocallimastix californiae
  6hp_glycosidase
tgctgatgaatatgctcaacgtgccattgaacattacaatgttgttactggtaatggttcatactcttctgaatatttctcaccagaaaatgttccataccactcaattgaaactatgatggttgaagctccagatcatggtcacgaatctgtctctgaaacttactccttctgggtttggttagaagctgttaacggtaagcttactggtaactatgatggtgttgaaaccgcctggagttacttagaaaagcatcttattccaga

SEQ ID NO: 13839 - DNA, 60 bp, Neocallimastix californiae
  6hp_glycosidase
ttaccacagattctggggtcaaaccgaaattatggttgctaacggtcttatctccattta

SEQ ID NO: 13840 - DNA, 948 bp, Neocallimastix californiae
  6hp_glycosidase
tccagatgctgatgctcgtgctattcaagctgcttacttcggttacatctgggctgaagaagacggtcaagatctttcttctgttgcttctaaggctgctaagcttggtgattacttacgttactctcactacgataaatacttcaagaagattggtaactgtattgactaccaacgttgtgctgctggttctggtaagaactctgctcactaccttatctcttggtacttcgcctggggtggaggtttacaaggtgactgggcttggagaattagttcttcccacactcacagtggttaccaaaacccattagctgcttggattctttctactgaatctgccttcaagccaaagggttccactgctgttaaggattggtctacttccctcgatcgtcaattagaattattcagatggttacaatctgctgaaggttgtattgctggtggtgccactaactcatggcaaggtcactacgcccaaccaccaagtgacattactaccttctacggtatgtactacgattggcaaccagtttaccacgacccaccatccaacaactggactggtatgcaaggttggggtatggaacgtgtctgttccctttactacctttccggtaacgaaaaggctggtaaggtttgtcaagaatgggctaaatggattaaagcaaacactcgtgttaacggtggtgaagttgtccatgctaccaacttagaatggactggtaacccagatgaatggaagtcctccaacttcaacaagaatggtcttaacgcttcccttcacggtaccgtttcttctgaaggtactgatcttggttccattgcctctatgatcaaggctttaatgtgggtctccttaaaggatggtgatactgaaggtcttcaacttgttcttgatgttatggatgccattgaaaactacaaggatgatcttggttatgc

SEQ ID NO: 13841 - DNA, 60 bp, Neocallimastix californiae
  6hp_glycosidase
ttaccacagattctggggtcaaactgaaattatggttgctaacggtcttatctccatcta

SEQ ID NO: 13842 - DNA, 267 bp, Neocallimastix californiae
  6hp_glycosidase
tgctgctgattacgctgaacgtgctattgaacattacaacaaggttactggtaatggttcctatcaatctgaatatttctctccagaaaatgttccataccactccattgaaactatgatggttgaagctccagatcaaggtcacgaatctgtatctgaaacttactccttctgggtttggttagaagctgttaacggtaaacttactggtaattacgaaggtgttgaaactgcttggagtttcttagaaaagcatcttattccaga

SEQ ID NO: 13843 - DNA, 48 bp, Neocallimastix californiae; identical to SEQ ID NO: 13837
  6hp_glycosidase

SEQ ID NO: 13844 - DNA, 948 bp, Neocallimastix californiae
  6hp_glycosidase
tccagatgctgatgctcgtgctattcaagctgcttacttcggttacatctgggctgaagaagacggtcaagatctttcttctgttgcttctaaggctgctaagcttggtgattacttacgttactctcactacgataaatacttcaagaagattggtaactgtattgactaccaacgttgtgctgctggttctggtaagaactctgctcactaccttatctcttggtacttcgcctggggtggaggtttacaaggtgactgggcttggagaattagttcttcccacactcacagtggttaccaaaacccattagctgcttggattctttctactgaatctgccttcaagccaaagggttccactgctgttaaggattggtctacttccctcgatcgtcaattagaattattcagatggttacaatctgctgaaggttgtattgctggtggtgccactaactcatggcaaggtcactacgcccaaccaccaagtgacattactaccttctacggtatgtactacgattggcaaccagtttaccacgacccaccatccaacaactggactggtatgcaaggttggggtatggaacgtgtctgttccctttactacctttccggtaacgaaaaggctggtaaggtttgtcaagaatgggctaaatggattaagcaaaacactcgtgttaacggtggtgaagttgtccacgctaccaacttagaatggtctggtaacccagatgaatggaatgcttccaactttgacaaatctggtcttaacgcttcccttcacggtaccgtttcttctgaaggtactgatcttggttccattgcctctatgatcaaggctttaatgtgggtctccttaaaggatggtgatactgaaggtcttcaacttgttcttgatgttatggatgccattgaaaactacaaggatgatcttggttatgc

SEQ ID NO: 13845 - DNA, 60 bp, Neocallimastix californiae
  6hp_glycosidase
ttaccacagattctggggacaaactgaaattatggttgctaacggtcttatctctattta

SEQ ID NO: 13846 - DNA, 405 bp, Neocallimastix californiae
  6hp_glycosidase
cgacccaccatccaacaactggactggtatgcaaggttggggtatggaacgtgtctgttccctttactacctttccggtaacgaaaaggctggtaaggtttgtcaagaatgggctaaatggattaagaaaaacactcgtgttaacggtggtgaaattgtccatgctaccaacttagcctggactggtaacccagatgaatggaagtcctccaacttcaacaagagtggtcttaacgcctcccttcacggtaccgtttcttctgaaggtactgatcttggttccattgcctctatgatcaaggctttaatgtgggtctccttaaaggatgaagatactgaaggtcttcaacttgttcttgatgttatggatgctatggaaaactacagggatgatcttggttatgc

SEQ ID NO: 13847 - DNA, 825 bp, Neocallimastix californiae
  6hp_glycosidase
ctctcactacgataaatacttcaagaagattggtaactgtattgactaccaacgttgtgctgctggttctggtaagaactctgctcactaccttatctcttggtacttcgcctggggtggaggtttacaaggtgactgggcttggagaattagttcttcccacactcacagtggttaccaaaacccattagctgcttggattctttctactgaatctgccttcaagccaaagggttccactgctgttaaggattggtctacttccctcgatcgtcaattagaattattcagatggttacaatctgctgaaggttgtattgctggtggtgccactaactcatggcaaggtcactacgcccaaccaccaagtgatattacctccttctacggtatgtactatgattggcaaccagtttaccacgacccaccatccaacaactggactggtatgcaaggttggggtatggaacgtgtctgttccctttactacctttccggtaacgaaaaggctggtaaggtttgtcaagaatgggctaaatggattaaagaaaccactcgtgttaacggtggtgaaattgtccatgctactaacttagaatggtctggtaatccagatgaatggaaatcttctaactttaacaagtccggtcttaatgcctcacttcatggtactgtttcttctgaaggtactgatcttggttctattgcctctattatcaagggtttgatgtgggtttctatgaaggatggagatgaagaaggtctccgacttgttcttgatgtcatggatgctattgaaaactacaaggatgaccttggttatgc

SEQ ID NO: 13848 - DNA, 60 bp, Neocallimastix californiae
  6hp_glycosidase
ttaccacagattctggggacaaactgaaattatggttgctaatggtcttatctctatcta

SEQ ID NO: 13849 - DNA, 60 bp, Neocallimastix californiae; identical to SEQ ID NO: 13845
  6hp_glycosidase

SEQ ID NO: 13850 - DNA, 420 bp, Neocallimastix californiae
  6hp_glycosidase
gcaaccagtttaccacgacccaccatccaacaactggactggtatgcaaggttggggtatggaacgtgtctgttccctttactacctttccggtaacgaaaaggctggtaaggtttgtcaagaatgggctaaatggattaagaaaaacactcgtgttaacggtggtgaaattgtccatgctaccaacttagcctggactggtaacccagatgaatggaagtcctccaacttcaacaagagtggtcttaacgcctcccttcacggtaccgtttcttctgaaggtactgatcttggttccattgcctctatgatcaaggctttaatgtgggtctccttaaaggatgaagatactgaaggtcttcaacttgttcttgatgttatggatgctatggaaaactacagggatgatcttggttatgc

SEQ ID NO: 13851 - DNA, 1317 bp, Neocallimastix californiae
  6hp_glycosidase
tcaagattatgctagacacattgaattatctcttcttttctacgaagctcaacgttctggtaaacttccagaagacaacagaatttactggagacatgatagtgaacttgaagctggtgctgatcatggtgttgatcttactggtggatattacgatgctggtgataatgctaagtttaatttcccagctgcttctactatgactcttttagcttggagtggtattgattatgctgaaggttacaaaaatgctggtcaatggaaatatattttagatgctgttcgttggggtgctgactactttattaaatgtcacactggtaaaactgaactttatgctcaagttggtgatggtaacactgatcattctttctggtatccaccagaatatgttcaatatgattacccatcattcaaagttactgctcaagaaccaggttctgaagtagctggtgaaacagctgctttcttagctgctgcatctattcttttcaaagatgaagatccatcatattctgctactttattaaagcactcaaaggaaatttatgacttcgctgataaatatcgtggtgattacactgttgctgttccagctgtcagtttttataacacttacagtggttatatggatgaattagcttggggtgccgcttggcttcttagagctactggtgatgaatcatatcttgataagtacaatgtcattgccaataaaaagtatgaatcttatgatccaaagaaattcactggtgctactggaccaatctcttgggatgataaaagacctggttgttatattttaatggctatgattactggtgatgaaaagcgtattaatgaagcttacagttactgtgatgccgttttaactcaaccacgtaccaaaggtggtttatggtatgatgatggtttatctatttggggttctaaccgttacgcttctaatgctgcatcaatgcttggtatgtttgcaaattatcttccaaagtctgacccaaagcgtgcaaaatatgttgaattcgttaaacaacaaactgattatattcttggtgataacccagctaagattaattatgttgttggtgctgaagccaattcaccaaaagctgttcaccaccgtggtgcttctggtgtatttgattctcaagataaggctgctaagccagatgaaaacatatatactttatggggtgctttagctggtggtccagataagaatgataagttcgttgatagccgtaaggactatcaaatgagtgaagttgctcttgattacaatgccgctttccaaatgaatcttgcattccttactaa

SEQ ID NO: 13852 - DNA, 1323 bp, Neocallimastix californiae
  6hp_glycosidase
tcaagattatgctagacacattgaattatcacttcttttctatgaagctcaacgttctggtaaacttccagaaaataatagaatttactggagacatgatagtttactcgatgctggtgctgataacaaggtcgatcttactggtggttattatgatgctggtgataatgtaaagtttaacttcccagctgctgctgccttaactcttcttgcatggagtggtattgactatgccgatggttataagaaagctggtcaatgggattaccttttagatgctgttaaatggggtgctgactatttccttaaatgtcacactggtaagaacgaactttatgttcaagttggtaagggtgcaactgatcatggtttttggtatccaccagaatatgttcaatacgaatatccatcctacaaaattacttcttctgcaccaggtagtgaagttgctggtgatactgcttcattcttagcagcatcttctattcttttcaaagatgttgattcatcttactcagccactttattaaagcacgctaaagaaatttatgattttgctgatacctatcgtggtgaatacattaaagctgttccagatgcccaaggattttactctaactggagtggttgtgatgatgaattagcttttggtgctttatggttatatagagctactaaagatgaaagttacatgaataagtttaagaaaattgctgatgcctcttatggtgaacaagatactaaagcttatggtacttgttctggaccaatttcatgggatgataagagaccaggtgcttatattttagctgctatgcttactggtgatgaaaagcgtaagagtaaagcttacagttactgtgatgctattttaactcaaccaaagactccaggaggtttatggtatgatgctaacctttctaagtggggttctaaccgttatgcttctaacgctgcagctatggttgctatgtttgccaattctcttccagcttctgattctaaacgttctaagtacgttgacttcgttcaaaagcaaactgattatattcttggtaataatccagcaaaggtaaactatgttgttggtgctgaagctaactctccaaaggctgttcaccatcgtgctgcttctggtacttatgattctcaagataaaaatgctaaaccaactgactacaatgtcttcactttatggggtgctttagctggtggtccaggttcaaaggatgaatacactgataccagaaagaactatgaaatgaatgaagttgctcttgattacaatgctgctttccaaatgaatcttgctttccttactaa

SEQ ID NO: 13853 - DNA, 1323 bp, Neocallimastix californiae
  6hp_glycosidase
acaagattatgctagacatattgaactttctttacttttctatgaagctcaacgttccggtaaacttccagaaaataaccgtatttactggagacatgatagtatgcttgatgccggtgctgataatggtgttgatcttactggtggttattatgatgctggtgataacgtaaagtttaatttcccagctgctgctgccttaactcttttagcttggagtggtgttgactatgctgatggttacaagaaagctggtcaatgggattatcttcttgatgctgttcgttggggtgctgactatttcataaaatgtcacactggcaaaaatgaactttatgctcaagttggtaggggtactaccgatcatggttactggtaccctccagaatatattcaatatgatcatccttcctacaaggttacagcttcatctccaggttctgaagtcgctggtgataccgcttcattcttagctgctacttcaattttattcaaggatgaagatccatcttattctaagaaatgtttacaacatgccactgaaatctatgatttcgctgatacctatcgtggtgattacactggttctattccagatgtttctggtttctactctacttggagtggttacaatgatgaattagcttttggtgccttatggctttacagagctactggtgatgaatcttactatgaaaaatttaagaaaattgctgatgccgaatatggtgcccaagattccaaggcttatggtacctgtactggtccaatttcttgggatgataaaagaccaggtgcttacgttcttgctgccatcattactggtgatgaagatcgtttaaagcaagcctactggtattgtgataatgttttaactcaaccaagaactaaaggtggtttatggtatgattctaatctttcaaagtgggcttctaaccgttacgcttctaatgctgctgctatgttagctatgatggctaattaccttccaaagggcgatgccagacgtgctaaatacgttgattttgtaaagagtcaaaccgattatattcttggtgataatccagctggtgttaactttgttgttggtgctgaagccaattcaccaaaggcagttcaccaccgtggtgcttccggtacctatgattcacaagatgtccatgccagaccaaccgattacaatatcttcactttatggggtgctttagctggtggtccaagtaaggatgatacctactctgataccagaaaggattatgaaatgaacgaagttgctcttgattacaatgctgccttccaaactaatcttgctttccttgttaa

SEQ ID NO: 13854 - DNA, 513 bp, Neocallimastix californiae
  6hp_glycosidase
cgctttaatgtatatggttactggtgaagacaaatacaaggaacaagctttcaatcacagtgatcttatggtcaactacaaaactactccaggtggtttatggttcgatactaatctttctgcttggggttctaaccgttatgctagtaacgctgcttataccgttgctatggttgcttctactatggatgccagtgacgctaagcgtaagcaatacgttaaatttattcagaagcaaatcgattatattcaaggagataatccagctaaggttgattatgttgttggtgctgatccaagttcaccaaaatctgttcaccaccgtggttcttctggtactatgaatgctatggctgaaccacctttcaatgttttcccactttatggtgctcttgctggtggtccagatggtaatgataagtacactgatgatcgtactaactataactctaatgaagttgctttagattataatgccgcttatactggtcttcttgctttcttaattcaaga

SEQ ID NO: 13855 - DNA, 1119 bp, Neocallimastix californiae
  6hp_glycosidase
tgcttactacactggtgattataccagtccattcaaaacttacttaggtaagactgatgaagaaattcaaaagaagttagatcaactttggaatcattactttaagggtaacaacaacagtaaagtattttatgaccaaggaaatgaaggttatattttagatgttaacaacaatgatgttcgttccgaaggtatgtcttatggtatgatgatctgtgtacaaactgatcacagagaagaatttgacaagatttggaattgggcaaagaaccacatgtggcataagagtggtagctgggatggttacttcgcttggaaaagaggatcaaatggttatggtggtgatgataattgtgcaccagatggtgaaatgtatttcatgatgtctcttctctttgctgctaaccgttggaataacaagcaatacatggatgatgctcaatacattttaaagagaatgtgggataacagccaacactctcttttcaacccaagatataatgttattaccttccaaccacaaggtaatgaaaataatttctctgatccatcttacgatttaccagcctttgttgatctcttctctcgttggtcaacaactaatcaaggcaaatggaaggccgctgcttctgctactcgtgaccatttatacaaatcttcaaacactaagtctggtttattcagtgattacaacaactttgatggtactccacattctgtaagttataacagtaatgctcaaaagtatatgtacgatgccatgcgttgtgctatgaactttggtatggattattatctctttggtgctgatgctaagcgtcaaactgaaatggctagacgtcttattgacttctttgaaaaagatggttaccaacatgctcgtttcaactgggatggttcaaacccatctgaacaatatactttaggtgaagttggtgctaatgcagttgctacctacgctttaatgggtgttaatggatacgaagacattattaagaagaacttaaagatggcttgggatggtgaaccaatgactggtcaataccgttactacgatggtttagtccactacttatctatgcttcatcttactggtagtttcaaaatctggaaaccagc

SEQ ID NO: 13856 - DNA, 948 bp, Neocallimastix californiae
  6hp_glycosidase
tccagatgctgatgctcgtgccattcaagctgcttacttcgcttacatttgggctgaagaagatggagttaatctttcatctgttgcttctaaagctgctaagcttggtgattacttacgttatgctcaatacgataagtacttcaagaaggtaggtaactgtgttggttatcaacaatgtcaagctggtcgtggtaagaattcagctcactatcttatttcatggtacttcgcttggggtggaggtttacaaggagattgggcttggagaattggttcatctcacactcacactggttaccaaaatccattagccgcttgggttctttctactcaatctgctttcaagccaaagtcttctactggtgctaaggattgggctacttctcttgaccgtcaattagaattattcagatggttacaatcagctgaaggttgtattgctggtggagccactaactcatggcaaggttcttatgctcaaccatccagtgatatcacatccttctatggtatgtggtatgattggcaaccagtttaccacgatccaccatccaacaactggactggtatgcaaggttggggtatggaacgtgtttgttctctctactacctttctggtaatgaaaaggctggaaagatttgtcaagaatgggccaaatgggttaagaacactactcgtgtcagtggtggtgaagttgtccatgctactaacttagaatggtcaggtaatccagatgaatggaattcttccaacttcaacaaatctaaccttaaccgttccctacacggtactgtttcttctgatggtattgatattggtaccattgcttctattatcaagggattaatgtgggtttctatgaaggatggagatcaagaaggtattaatctttctattgatgttatggatgctattgaaaattacaaggatgatcttggttatgg

SEQ ID NO: 13857 - DNA, 267 bp, Neocallimastix californiae
  6hp_glycosidase
ttccgatgaatacggtaatcgtgttactgaactttacaacaaagtaactggtaatggttcttacagttctgaatatttctcagctgaaaaggttccatatcactccgttgaaactcttatggttgaagctccagatcatggtcatgaatctgtatctgaaactttctctttctggatttggttagaagccgttaatggtaagattaccggtaactacgatggtgttgaagaagcttggagttacttagaaaagcacattattccaga

SEQ ID NO: 13858 - DNA, 60 bp, Neocallimastix californiae
  6hp_glycosidase
ttatcacagattctgggctcaaactgaaattgctgttgctaatggtcttatttctattta

SEQ ID NO: 13859 - DNA, 48 bp, Neocallimastix californiae
  6hp_glycosidase
ggaacttcaacaagcctatggtaattgggatatttacattatgcactg

SEQ ID NO: 13860 - DNA, 1302 bp, Neocallimastix californiae
  6hp_glycosidase
tgattacgctagaattttgaacttaaatttacgtttttatgaatgtaattggtctggtaaagctccagaacataaacaagtctattggagatatgattctgctttagaagatggagctgatgttggtttagatcttactggaggttattatgatgccggtgaccatgttaaatttaatttaccaatgtcttatgcaatgactatgttagcatggggtggtattgatttatatgataattatgttgcagctggtcaaattgattatttagttcaaattgtcaaccatggtgcagattattttgtaaagtgccatccagaaaaagaagtcatttatgcacaagttggtcttggtgatgttgaccattgtttctgggtaccaccagaattaatgactatggaaagaccagctgtttgtaaacttactccagaaaatggtgcttctgatgttactgctcaaatggcagctgctttagctagtgcctcaattttaaataagatggtaggaaatactgaaaagtctgaactttatttaaagcatgccattgaaatttatgactttgctgataaatatagagatgtttatggtaatccatgtccagaaggtgcttccttttatccatctgcatcttataaggatgaattagtttggggtgctgcatgggtttatcgtgcttctggagatgaaaaatactatgaaaaggctgattcttattacgattcacttggattatctggtcgtgttttaattggtccaatttcatgggatgatgcttcatcaggtattattttcttaatgtcaaagcctggttttggttctaattggaagagatatttaggtgaagctcaaacatacgttgatcaatatttaaatgataagagtgctcgtacagatgctggtatgttatggtatagtgctgtttctggttggggatctgctcgtcatgctatggctggtgtattcctttattgtattttcaatacttaccataaaccaactgatccaaaatactttaatttcattcaacaacaagccgattatattcttggtaataatccatttaatcgttcacttgttgttggttcaattccaggacatgatccattaaatgttcatcatcgtggttcccatggtggttattctccaatttcattaccagaacataatatgtacacattatatggtgcacttgctggtggtccacttcaagatgattcatgggatgatgatagaaataattatattactaatgaagtttcatgtgattataatgctggtgttactggtgttatggcataccttac

SEQ ID NO: 13861 - DNA, 270 bp, Neocallimastix californiae
  6hp_glycosidase
tgctaatgatgaatatgcacaacgtgctattaacacatataatactgttactggtaatggttcatacaaatcaagttatttctcaccagaagttgttccataccactctattgaaactcttatggttgaagctccagatcaaggtcacgaatctgtatctgaaactttttctttctgggtttggttagaagccgttaatggtaaacttacaggtgattactcgggtgttgaaaaagcatggtcttacctagaaaagcacatgattccaga

SEQ ID NO: 13862 - DNA, 948 bp, Neocallimastix californiae
  6hp_glycosidase
accagatgctgatgctcgtgctattcaaggtgcttactttgcttggctttgggctaaggaggatggtaaaaacctttcatcccttgcttctaaggctgctaagcttggtgattacttacgttactctcactatgataagtatttcaagaagattggtaactgtgttggctatcaacaatgtcaagctggatctggtaagaattcagctcactaccttatttcatggtacttctcatggggtggtggtttacaaggtgattggtcttggagaattggttcttctcacactcacagtggttaccaatctccattagctgcatggattctttctactgaatctgctttcaaaccaaagtctgcttctggtgctaaggattgggctacttctttagaacgtcaaatagaattattcagatggttacaaacttctgaaggttgtattgctggtggtgccaccaattcatggcaaggtcattacgctcaaccagatagctcaattacttccttctacggtatgtggtacgattggcaaccagtttaccacgacccaccatccaataactggactggtatgcaaggttggggtatggaacgtacttgttgttactattacctttctggtgatgaaaaagctggtcttgtttgtcagaactgggctaaatgggttaaggcaaatactcgtgttagtggtggtcaaattgttcatgctactaacctttcctgggaaggtagtccagatgaatggaattcttcaaacttcaacaaggctaatcttaacgcttcccttcatggtactgtttctgctgaaggtattgatcttggttcaattgcctcaattattaagggtttgatgtgggtctccatgaaggataatgatcaagaaggtattaaccttgttattgatgttatggatgctattgaaaactacaaggatgacgaaggttactg

SEQ ID NO: 13863 - DNA, 60 bp, Neocallimastix californiae
  6hp_glycosidase
ttaccacagattctggggtcaaactgaaattatggttgccaatggtcttatttctattta

SEQ ID NO: 13864 - DNA, 48 bp, Neocallimastix californiae
  6hp_glycosidase
ggaacttcaacaagcttatggtacttgggatatttatgctatgcactg

SEQ ID NO: 13865 - DNA, 60 bp, Neocallimastix californiae
  6hp_glycosidase
ttatcacagattctggggacaaacagaaattatggttgccaatggtcttatttctatcta

SEQ ID NO: 13866 - DNA, 948 bp, Neocallimastix californiae
  6hp_glycosidase
tccagatgctgatgctcgtgctattcaagctgcctactttggttatatttgggctaaagaagatggagttgatctttcttctgttgcttcaaaggctgctaagcttggtgattacttacgttactcacactacgataaatactttaagaagattggtaactgtattgattatcaacgttgtgctgctggtagcggtaagaactctgctcactaccttatctcatggtactttgcctggggtggaggtattcaaggtgactggtcatggagaattggttcttcccacacccacagtggttaccaaaatccattagctgcttgggttctttcaactgaatcagcctttaaaccaaagggatctactgccgtcaaggattggtcaacctctttagatcgtcaattagaattattcagatggttacaatctgctgaaggttgtattgctggtggagccaccaactcatggcaaggtcactatgctcaaccagatagtgatattaccactttctatggtatgttctacgactggcaaccagtttaccacgatccaccatccaacaattggactggtatgcaaggttggggtatggaacgtgtctgttccctttactacctttctggtaacgaaaaggctggaaagatttgtcaagaatgggctaagtgggttaaggaaaacactcgtgttattggtggtgaagttgttcatgccactaacttagaatggacaggtaatccagatgaatggaaatcttcaaactttaacaagaatggtcttaactctcaacttcatggtactgtttcttctgaaggtactgatcttggttcaattgcttctatcattaaggctttaatgtgggtttccttaaaggatgaagattctgaaggtctccgacttgttattgatgtaatggatgctattgaaaactacagagacgatcttggttacgc

SEQ ID NO: 13867 - DNA, 267 bp, Neocallimastix californiae
  6hp_glycosidase
atatgatgaatatagtcaacgtgctattgaacactataatattgttactggtaatggttcatatcaatctgaatatttctctccagaaaatgttccataccactcaattgaaactatgatggttgaagctccagatcatggtcatgaatctgtatctgaaacttactccttctgggtttggttagaagcagttcatggtaaacttactggtaactatgatggagtttccactgcttggagttacttagaaaagcatcttattccaga

SEQ ID NO: 13868 - DNA, 48 bp, Neocallimastix californiae
  6hp_glycosidase
ggaacttcaacaagcttatggtacttgggatatctatgctatgcactg

SEQ ID NO: 13869 - DNA, 60 bp, Neocallimastix californiae
  6hp_glycosidase
ttaccacagattctggggacaaacagaaattatggttgccaatggtcttatttctatcta

SEQ ID NO: 13870 - DNA, 426 bp, Neocallimastix californiae
  6hp_glycosidase
cgactggcaaccagtttaccacgatccaccatccaacaattggactggtatgcaaggttggggtatggaacgtgtctgttccctttactacctttctggtaacgaaaaggctggaaaggtttgtcaagaatgggctaagtgggttaagaaaaacactcgtgttaatggtggtgaagttgttcatgccactaacttagaatggacaggtaatccagatgaatggaaatcttcaaactttaacaagaatggtcttaactctcaacttcatggtactgtttcttctgaaggtactgatcttggttcaattgcttctatcattaaggctttaatgtgggtttccttaaaggatgaagattctgaaggtctccgacttgttattgatgtaatggatgctattgaaaactacagagacgatcttggttacgc

SEQ ID NO: 13871 - DNA, 267 bp, Neocallimastix californiae
  6hp_glycosidase
ttctgatgaatatgctcaaagagttattgatacttacaatgccgttactggtaatggaagttacaattctgattacttctcaccagaaaatgttccataccactcaattgaaaccatgatggttgaagctccagattacggtcatgaatctgtttctgaaacttattccttctgggtttggttagaagctattaatggtaagatgactggtgattacaagggtgttgaaactgcttggagtttcttagagaagcatcttattccaaa

SEQ ID NO: 13872 - DNA, 60 bp, Neocallimastix californiae
  6hp_glycosidase
ttaccacagattctgggctcaaactgaaattgctgttgctaatggtcttatctctattta

SEQ ID NO: 13873 - DNA, 48 bp, Neocallimastix californiae
  6hp_glycosidase
agaacttcaacaagcctatggtacttgggatatctacgctatgcactg

SEQ ID NO: 13874 - DNA, 948 bp, Neocallimastix californiae
  6hp_glycosidase
tccagatgctgattctcgtgctattcaagctgcttactttgcttacatctgggctaaagaagatggtcaaaatctttcctcccttgcttctaaggctgctaagcttggtgattacttacgttacgcccaatacgataaatacttcaagaagattggtaactgtatcggctatcaacaatgtcaagctggtcgtggcaaaaactctgctcactaccttatttcttggtacttctcttggggtggtggtctccaaggtgattggtcatggagaattggttcctctcacactcacaccggttaccaaaacccattagccgcctggattctttctactcaatctgctttcaagccaaagggttccactgctgttaaggattggacgacttccttagatcgtcaattagaattattcagatggttacaagctgccgaaggttgtattgctggtggtgccactaactcatggcaaggtcactacgctcaaccaccaagtgaaattacttccttctacggtatgtactacgattggcaaccagtttaccacgatccaccatccaacaactggactggtatgcaaggttggggtatggaacgtgtctgttctctttactacctttctggtaacgaaaaggctggaaaggtttgtcaagaatgggctaaatgggtcaagaacaatgttcgtgtcaacggtagcgaaattgttcatgccactaacttcgaatggtccggtaacccagatgaatggaaggcctccaactttaacaaatctggtcttaacgcttcccttcacggtgccgtttcctctgaaggtattgatcttggttctatcgcctctatcattaagggtttaatgtgggtttccatgaaggataatgatcaagaaggtattgatctttccgttcaagttatggatgccattgaacaatacaaggatcaatatggttatgg

SEQ ID NO: 13875 - DNA, 1170 bp, Neocallimastix californiae
  6hp_glycosidase
ttctttaattgaaagaactacttcattcattccatactggaataaagaaatgttcaaaggaacttggaactacattgatggtgttttcttaaatagtgttataaacttatataaaaagactaataatgaaaagtacaaagatttcttcatcaaatatgttaactactatgtttctgaagatggtacttttgttcattacactgctgatggagtaaagaccgtcgataatgaaatgggttgggttaatggtgaacttgataccgtttgtgaaagtaagattttatttgatgcctatgaaatgactggtgataaaagataccttactgcaattgaattcacctacaagaagcttatggaaatgccatactgttataattctccaaacttctggcataagaccttctatatcaatcaaatctggcttgatggtatgtatatgtacgctcctttcttagctagatatgctcttttaaaaaatgatctttcaattttagatgatattaagaaccaatacgctttcattcatgataatatgagagatgaaaatggtttataccaccatggtttcgatactaccaagactattttctggagtaaaaataatgatggtaagagtgaaaacttctggcttagaagtatgggttggtttgcagtttctcttgctgatatcttagaatattacccagaaggtgaaaacaaagaatacttaaagagtatcttagaagaattattaaatggtatattaccataccaagataagactactaagatgttctaccaagttattgatagaccagaagaaattcaattagttgacaaattttatttcagtaatcttaaaaactctaaatacggtaatattaatacctttgtttctaactatgttgaatctagtggatcttctatgcttgcttattctttcttaaaatatggtaaagtttaccagaatggtggtaactttgaagaaattggaaaagaaatatttgaagctgtttacaagcattcttacaagaacaacaccttatctgatatctgtattactgccggtcttggtccagaagttaagacttaccgtgatggtactttatcttactaccttgctgaagtagttggtgatgatgatgcaaaaggtgttggtccattcattatggctttcattgaatacaacta

SEQ ID NO: 13876 - DNA, 1179 bp, Neocallimastix californiae
  6hp_glycosidase
ttacgttgattctttaatcgaaagaactacatcattcattccatattggaacaaggaaagtttcaagggaaagtggaactacattgatggtgttttcttaaatagtgttgttaatttatataagaagactaataatgaaaagtacaaagaatttttcattaaatatattaattactatgttgcagaagatggtactttcgttcattacactgaagacggtgtaaagactgtcgataatgatttaggttgggttactggagaacttgatactgtttgtgaaagtaagattttattcgatgcttatgaaatgacaggtgataaaagatacctcactgctattgaatttacttaccaaaagcttatggaaatgccattatgttacaattcaccaaatttctggcataagactttctacatcaatcaaatttggcttgatggtatgtatatgtacgctccattcttagctagatatgctgttttaaagaatgatctttctattttagataatatcaaagaacaatatgctttcattcatgataacatgagagacgaaaacggtttataccatcatggtttcgataccactaaaactattttctggagtaaaaataatgatggtaagagtgaaaacttctggcttagaagtatgggttggtttgctgtatctcttgctgatatcctagaatactacccagaaggtgaaaataaagaatatttaaaaaatgttttagaagaattattaaatggtatattaccattccaagataaaactactaaaatgttctaccaagttattgacaaaccagaagaaattcaattagttgacaaattctatttcagtaatcttggtaattctaaatatggtgatattaatacttttgtttctaactatgttgaatctagtggttcttctatgtttgcatactccttcttaaagtatggaaaggtctatcaaaatggaggaaaatttgaagatattggtaaagaaatctttgaagctgtttatcaacactcctaccaaaaccacactttatccgacatttgtattactgctggtcttggtccagaagctaagacttatcgtgatggtactttatcatactatcttgctgaaaaagttggtgaagatgatgctaagggtgttggtccattccttatggctttcattgaatacaacta

SEQ ID NO: 13877 - DNA, 267 bp, Neocallimastix californiae
  6hp_glycosidase
tagtgataagtatgctcaacgtgttattgatacttacaatgctgttactggtaacggtaactataactctgaatatttctcaccagagaatgttccataccactctgttgaaaccatgatggttgaagctccagattatggtcatgaatccgtttctgaaacttattccttctgggtttggttagaagctattaatggtaagatgaccggtgattacaaaggagttgaaactgcttggagttacttagaaaaacatcttattccaga

SEQ ID NO: 13878 - DNA, 60 bp, Neocallimastix californiae
  6hp_glycosidase
ctaccacagattctgggctcaaactgaaatcgctgttgctaatggtcttatttctatcta

SEQ ID NO: 13879 - DNA, 48 bp, Neocallimastix californiae
  6hp_glycosidase
agaacttcaacaagcttatggtacttgggatatatatgctatgcattg

SEQ ID NO: 13880 - DNA, 948 bp, Neocallimastix californiae
  6hp_glycosidase
tccagatgctgatgctcgtgctattcaagctgcttacttcgcctacatttgggctaaggaagacggtacaaatcttagttctcttgcttctaaagctgctaaacttggtgattacttacgttactctcattatgataaatatttcaaaaaaattggtaactgtattggatatcaacaatgtcaagctggtcgtggtaagaattctgctcactatcttatttcttggtacttctcttggggtggtggtttacaaggtgattggtcttggagaattggttcttctcacactcacactggttaccaaaatccattagctgcttgggttctttctactgaatctgccttcaaaccaaagagttccactgctgttaaggattgggctacttctatggaccgtcaattagaattattcagatggttacaagcttctgaaggttgtattgcaggtggtgccacaaattcatggcaaggtcattacgctgaaccaccaagtgatataactaccttctatggtatgtactatgactggcaaccagtttaccacgatccaccatctaacaactggactggtatgcaaggttggggtatggaacgtgtctgttccctttactacctttctggtaatgaaaaggccggaaaggtttgccaagaatgggctaagtgggttaagaagaatgttcgtgttaatggtaatgaaattactcatgctactaacttctcctggtccggtaaccctgacgaatggaatccaagtaatttcaataaatctggtcttaatgcttcccttcatggtactgtttcttctgaaggtattgatattggttcccttgcctctattattaagggtttaatgtgggtttctatgaaggataaagatcaagaaggtattaacctttctataaaggttatggatgctattgaaaactatagagatgatcttggttattc

SEQ ID NO: 13881 - DNA, 1317 bp, Neocallimastix californiae
  6hp_glycosidase
acaagattatgcaagacacattgaattatctcttcttttttacgaagcccaacgttccggtaagcttccagaaaacaacagaatttactggagacatgatagtgaacttgaagctggtgctgataatggtgtcgatcttactggaggatattatgatgctggtgataatgcaaagttcaacttcccaggtgcagctactatgactcttttagcctggagtggtgttgattatgctgaaggttataaaaacgctggtcaatgggagtatttattagatgctgtccgttggggtgctgactactttatgaaatgtcacactggtaaaactgaactttatgctcaagttggtgatggtaacactgaccactctttctggtatcctcctgaatatgttcaatacgaatacccatcatttaaggttactgctgatgctccaggttccgaagttgcaggtgaaacagctgctttcttagctgctgcttctattcttttcaaggatgaagacccaacatactctgctactttattaaagcattcaaaggaaatatatgactttgctgataaatatcgtggtgattacactgttgctgttcctgcagtcagtttctataatacttacagtggttacatggatgaattagcttggggtgctgcttggcttcttagagccacaggtgatgaatcttatcttgaaaagtacaatgttattgccaataaaaaatatgaatcttatgatccaaagaaatttacaggttctactggaccaatctcttgggatgataagagaccaggttgttatattttaatagcaatgattacaggtgatgaaaaacgtattaatgaagcctacaattactgtgatgctgtattaactcaaccacgtactgctggtggtttatggtatgatgatggtttatctatttggggttctaaccgttacgcttcaaatgctgcttctatggttgctatgtttgctaactaccttccagaatcagatccaaagcgtgcaaagtatgttgaatttgttaagcaacaaactgattatattctcggtgataatccagctaaaattaactatgttgttggtgctgaagctaattcaccaaaatcggttcaccaccgtggtgcctctggtgtattcgattctcaagataaggctgctaaaccagatgaaaatatctatactttatggggtgctttagctggtggtccagataagaatgacaagttcgttgatagtcgtaaggattatcaaatgagtgaagttgctcttgattataatgcagctttccaaatgaatcttgctttccttactaa

SEQ ID NO: 13882 - DNA, 1302 bp, Neocallimastix californiae
  6hp_glycosidase
tgattatgcaagaattttaaatttaaatttacgtttctatgaatgtcagtggtcaggaaaagcaccagaacataaacaagtatattggagatatgattcagctttagaagatggcgcagatgttggtttagatcttactggaggtttctatgatgcaggtgatcatgtaaaattcaatttaccaatgtcttatgccatgacaatgttagcttggggtggaattgatttatatgataattatgtagctgctggtcaaattgattatttacttcaaatggttaaccatggagctgattattttgttagatgtcaccctgaaaaagaagttatctatgcccaggttggtgtaggcgatgttgatcattgcttttgggttcctccagaattaatgactatggaaagaccaactgtatgtaaacttactccagaaaatggtgcttctgatgttactggtcaaatggcagctgcattagctagtgcttctatattaaacaaaaagtatggtaacactgaaaaagctgaattatatttaaaacatgctattgaaatctttgactttgctgataagtacagagatgtttataataatccatgtcctgaaggtgcttccttctatccttctgcttcatataaggatgaattggtatggggtgctgcatgggtatatcgtgcctctggtgatgaaaagtattatcaaaaggcagatgaatattatgattctcttgctttatctggtcgtaatttaattggtccaattacatgggatgatgcttcatctggtattgtattcttgatgtctaaaccaggattcggttcaaattgggaaagatatttaggtgaagctcaacactatgttgaccagtatttaaatgataagggtgctcgtactgatggaggtatgttatggtatagttccgtttcaggttggggatctgctcgtcatgcaatggctggtactttcctttactgtatctttaatacctaccataagccaactgatccaaaatactttaatttcattcaagaacaagctgattatattcttggtaataatccatttaatcgttctcttgttgttggttctattccaggctatgaaccattgaatgttcaccatcgtggttctcatggaggttattcaccactttctccaccagaacacaatatgtatcctttatatggtgctcttgctggtggtccacttcaaaacgatttttgggatgatgatcgtaacaattatgttactaatgaagttgcttgtgattataatgctggtattactggtgttatggcctatcttac

SEQ ID NO: 13883 - DNA, 1311 bp, Neocallimastix californiae
  6hp_glycosidase
acaagattatgcccgtcaccttgaactttctatcctcttttatgaagctcaaagatctggaaaattaccagataacaatagaatttactggcgtggtgacagtatgttagaagctggttctgataataaagttgatttaactggtggttattatgatgctggtgataatataaaatttaactttcctcaggctagttctcttactcttttatcatggagtgctgtagagtggaaggatggttataaacaggctggtcaatgggaatatatgaaagatttaattaaatggggtatggattacttcattaagtgtcatactgataaatatgtcttatatggtcaagttggaaatgctaaattagatcataattcttgggtatcgccagaaaatatttcttatgattatccatcttacaagattactgactcttccccaggttccgatcttgcagctgaaacctctgctgctttagttgcagcttcaatggtttttagagatgaggatccaaattatgctgatcttttattaaaacatggtaaagaactttatgaatttgctgataaatatagaggttcatatgatgaatctataccagaagcaaatgactattatcattcaaatagttacaatgatgaacttgtttggggtgcagcttggttattcagagctacaggtgaagaatattataagtctaaggtagatgctatttgggattatccttatgacgaaaatgattctaataagttccttgattctaaaaatccaatttcatgggatgataaaaaggcttcatcatatactttaatggctatgattactggcgatcaaaaatatcttaaggaagctactactcacagtgatttaatggtaaatcatacaactacccctggaggattatggtataatgaaaatttatctgtatggggatcaaatagatatgcttctaatgctgcttttactgtagctatgatgacttctataatgaatgatgatgattctaaacgtcaagaatacattgatttcgttaagaaacaaacagattacattcttggtgacaatccagcaaaaatcgattatgtggttggtgctgcaccaaattcaccaaaggcagttcaccatcgtggtgcatcaggtactaaagatgtttatgaaaatccagatgagaatacatacgtcttatatggtgctcttgctggtggaccaggtccaaaggatgaatacaaagatattcgtgaggattatcaaaaaaatgaagtcgctttagattataatgctgccttccagggtcttttagccttccttattcaaga

SEQ ID NO: 13884 - DNA, 948 bp, Neocallimastix californiae
  6hp_glycosidase
tccagatgctgatgctcgtgctattcaagctgcttacttcggttacatgtgggctgaagaagatggtgttgatctttctgatctcgcttctaaggctgccaagcttggtgattacattcgttacgctcaatacgataaatacttcaagaagatcggtaactgtattggtcatgacagatgttctgctggtcgtggtaagaactctgctcactaccttatctcctggtacttcgcttggggtggtggtttacaaggtgactgggcttggagaattggttcttctcacactcacactggttaccaaaacccattagccgcttgggttctttctactcaatctgctttcaagccaaaatctagaactggtgctgacgattgggctacttctcttgaccgtcaattagaattattcagatggttacaagcttctgaaggttgtattgctggtggtgccactaactcatggcaaggtcactacgctcaaccaagcagtgatattactaccttctacggtatgtactatgactggcaaccagtttaccacgatccaccatcaaacaactggactggtatgcaaggttggggtatggaacgtgtctgttctctttactacatttctggtaatgaaaaggccggaactatctgtagagattgggccaaatgggttaagaacactgttcgtgttaatggtaatgaagttattcactccactaaccttgaatggtctggtaacccagatgaatggaacagcaacaacttcaacaagtctggtcgtaacagatcccttcacggtacctcatcttctgatggtctcgatcttggtactcttgcctctatcattaagggtttattatgggtttctgctaaggataatgatgccgaaggtattcaacttgttcttgatgttatgaatgctattgaacaatacagtgacgatcttggttacgc

SEQ ID NO: 13885 - DNA, 60 bp, Neocallimastix californiae
  6hp_glycosidase
ttatcacagattctgggctcaaactgaaattatggttgccaatggtcttatctctatctt

SEQ ID NO: 13886 - DNA, 48 bp, Neocallimastix californiae
  6hp_glycosidase
ggaacttcaacaagcttacaacacttgggatatctatgccatgcactg

SEQ ID NO: 13887 - DNA, 267 bp, Neocallimastix californiae
  6hp_glycosidase
tgctgatgcttatgctcaacgtgctattgatcattacaacaaaatgactaacggtggtcaatacaatactgattatttctcaccagaaactgttccatatcactcaattgaaactcttatggttgaagctccagatcatggtcacgaatctgtatctgaaacttactctttctggatctggttagaagctgttaacggtaaacttactggtaactacgacggtattaacactgcctggagttacttagaaaagcacatgattccaga

SEQ ID NO: 13888 - DNA, 267 bp, Neocallimastix californiae
  6hp_glycosidase
tagtgatgcctacgctcaacgtgctattgaacattacaacaaaatgactaacggtggtcaatacaatactgaatatttctcaccagaaaatgttccatatcactcaattgaaactcttatggttgaagctccagatcacggtcacgaatctgtatctgaaacttactccttctggatctggttagaagctgttaacggtaagcttactggtaactacgacggtattaacactgcctggagttacttagaaaagcacatgattccaga

SEQ ID NO: 13889 - DNA, 948 bp, Neocallimastix californiae
  6hp_glycosidase
tccagatgctgatgctcgtgctattcaagctgcttacttcggttacatttgggctgaagaagatggtgttgatctttctgatctcgcctctaaggctgccaagcttggtgattacttacgttactctcactatgataaatatttcaagaagatcggtaactgtgtcggatacgacaaatgttctgctggtcgtggtaagaactctgctcactaccttatctcctggtacttcgcttggggtggtggtttacaaggtgactgggcctggagaattggttcttctcacactcacactggttaccaaaacccattagctgcttggattctttctactcaatctgctttcaagccaaagggttctactgctgttaaggattggcaaacttctcttgaccgtcaattagaattaattagatggttacaagctactgaaggttgtattgctggtggtgccactaattcatggcaaggtcactatgctgaaccagacagtgatattactaccttctacggtatgtactatgactggcaaccagtttaccacgatccaccatcaaacaactggactggtatgcaaggttggggtatggaacgtacttgttctctttactacgtttctggtaatgaaaaggccggaactatctgtagagattgggccaaatgggttaaggaaactgttcgtgttagtggtggtcaagtaattcacgctactaaccttgaatggtctggtaacccagatgaatggaacaagaacaacttcaacaagtctggtgctaaccgttctcttcacggtactgtttctgctgaaggtcttgatcttggttcaattgcttctatcattaaggctttattatgggtttctgctaaggatggtgatgaagaaggtattgaccttgctattcaagttatggatgctattgaaaactacaaggatgatctcggttatgc

SEQ ID NO: 13890 - DNA, 48 bp, Neocallimastix californiae
  6hp_glycosidase
ggaacttcaacaagcttacagaacttgggatatctatgccatgcactg

SEQ ID NO: 13891 - DNA, 60 bp, Neocallimastix californiae
  6hp_glycosidase
ttaccacagattctggggtcaaactgaaattatggttgccaatggtcttatctctatctt

SEQ ID NO: 13892 - DNA, 948 bp, Neocallimastix californiae
  6hp_glycosidase
tccagatgctgatgctcgtgctattcaagctgcttacttcggttacatttgggctgaagaagatggtgttaacctttctgatctcgcctctaaggctgccaagcttggtgattacatgcgttacgctcaatacgataaatacttcaagaagatcggtaactgtattggtcacgacaaatgttctgctggtcgtggtaagaactctgctcactaccttatctcctggtacttcgcttggggtggtggtttacaaggtgactgggcctggagaattggttcttctcacactcacagtggttaccaaaacccattagccgcttgggttctttctactcaatctgctttcaagccaaagtctaaatctggtgctgacgattgggctacttctcttgaccgtcaattagaattattcagatggttacaagcttctgaaggttgtattgctggtggtgccactaactcatggcaaggtcactacgctaaaccaggtagtgatattactaccttctacggtatgtactatgactggcaaccagtttaccacgatccaccatcaaacaattggactggtatgcaaggttggggtatggaacgtgtctgttctctttactacgtttctggtaatgaaatggccggaactgtctgtagagattgggccaaatgggttaagaacactgttcgtgttagtggtggtcaagtagttcacgctactaaccttgaatggtctggtaacccagatgaatggaacaagagcaacttcaacaagtctggtcttaaccgttcccttcacggtactgtttctgctgaaggtcttgatcttggttcaattgcttctattattaagggtttattatgggtttctgctaaggatggtgatgaagaaggtattgacctttctctccaagttatggatgctattgaaaactacaaggatgatctcggttatgc

SEQ ID NO: 13893 - DNA, 60 bp, Neocallimastix californiae
  6hp_glycosidase
ataccacagattctggggtcaaactgaaattatggttgccaatggtcttatctctatctt

SEQ ID NO: 13894 - DNA, 54 bp, Neocallimastix californiae
  6hp_glycosidase
cgctaaggaacttcaacaagcttacaacacttgggatatgtacgctatgcactg

SEQ ID NO: 13895 - DNA, 60 bp, Neocallimastix californiae; identical to SEQ ID NO: 13893
  6hp_glycosidase

SEQ ID NO: 13896 - DNA, 945 bp, Neocallimastix californiae
  6hp_glycosidase
agatgctgatgctcgtgctattcaagctgcttacttcggttacatttgggctgaagaagatggtgttaacctttctgatctcgcctctaaggctgccaagcttggtgattacatgcgttacgctcaatacgataaatacttcaagaagatcggtaactgtattggtcacgacaaatgttctgctggtcgtggtaagaactctgctcactaccttatctcctggtacttcgcttggggtggtggtttacaaggtgactgggcctggagaattggttcttctcacactcacagtggttaccaaaacccattagccgcttgggttctttctactcaatctgctttcaagccaaagtctaaatctggtgctgacgattgggctacttctcttgaccgtcaattagaattattcagatggttacaagcttctgaaggttgtattgctggtggtgccactaactcatggcaaggtcactacgctaaaccaggtagtgatattactaccttctacggtatgtactatgactggcaaccagtttaccacgatccaccatcaaacaattggactggtatgcaaggttggggtatggaacgtgtctgttctctttactacgtttctggtaatgaaatggccggaactgtctgtagagattgggccaaatgggttaagaacactgttcgtgttagtggtggtcaagtagttcacgctactaaccttgaatggtctggtaacccagatgaatggaacaagagcaacttcaacaagtctggtcttaaccgttcccttcacggtactgtttctgctgaaggtcttgatcttggttcaattgcttctattattaagggtttattatgggtttctgctaaggatggtgatgaagaaggtattgacctttctctccaagttatggatgctattgaaaactacaaggatgatctcggttatgc

SEQ ID NO: 13897 - DNA, 1287 bp, Neocallimastix californiae
  6hp_glycosidase
tcaagattatgctagacatcttgaattaaacttcttattctatgaagctcaacgttctggtcctcttccaagtaccaaccgtattccatggagaggtgactctggtcttgaccatggttctgatgttggtgttgatcttactggtggttactatgatgccggtgataatgtaaagtttaacttcccacaagcattctctatgaccgctatctcttggatgggtattgaatttgctaagggtgttgaaatggctaatcaaactgaatacttaaaggataccgttaaatggggttgtgattacttattaaagtgtcatgaaaagggtaccgatgttttctacatgcaagttggtgatggtgatattgatcatcaatactggaaagcttatgaaaatattgactatccaactccaacttttttcgttgattctaaaaacccaggtactgaagttactggtgaaactgcagctgcctttgctgctgcttctattcttttcaaggatagtgatccagaatactctgctactcttttagatcaagcaaaggaatggtatgaatttgctgacaagtatcaattcgattattctcaatctgttccagcagctggatcatactacaagagttataatggttacaatgatgaactcgcttgggccgctatctggctttatcgtgcacttggtgatgaagcttacttagaaaaggctaagagtctagttgctaattacaaactcagtgaagttggtattgattgggatagtaagtaccagggtgtcattgttatccttgcccaacttggtgttaaagaatacgttgaaaaggttgaagcttgggttaaggatatctgtactaatggaaagttttctccaggtggtctttacattaacaaagatagtgaatggggttccaaccgccgtgctactgctatggctgccagtttaatttactatactcataaccttccagaaggtaatgaattacgtgaaatggctaagaaattcgctaaatcccaagctgattatattcaaggtgctaatccactcggtattgattatgttgttggtgctgatgaaacctctccacgttctgttcaccaccgtactgcttctggtgctgcttgtattgaatgtgatccagttcaaaatgttcacattatttacggtgccttagctggtggtccagatgttgaagataattaccttgatgacagagctgactataagaagaatgaagttgctcttgattacaatgtctgttatgctgctgttcttgcttatcttgttgaaga

SEQ ID NO: 13898 - DNA, 921 bp, Neocallimastix californiae
  6hp_glycosidase
ttcaaagtatgtttcaaaaataattgaaactatttattgggcttattgctggtcaaatgagcaaaaaaaaagaaaattcatggacactattttaaaaaaagttttaagaatgagtgattatatgttatattttataaatagtaacgaatcattacaagaatttaatgtagaatcaaaagatgatgacttaaattatcttgtatctcgctatttttcatggaaaggtgatatacatggaaaatggttaacaaagaaagtttcatcaaatattataggtattggaagccaaaatcctttagttgcttatatattatcgaacattaaggaatttaaatccgacaatgaagatattatattaaaatggaagaaaacgtacaaaaggcaaatagaatttattcgttggttacaaagttcagaaggagccattgttggaaatgctatttatatatcaagttctattgaaattaataaagtacccactttttataatctcgtgttttctaataattcaaatgaagaagaaaataatttatttagtactcaatgtttcgtttttgaaagtattgctgaactctattatattacaaaggataaagatattgagacaatcttatttaaatggttagattgggtattaacggttttccatttaacaagtgatagatcttttagaataccaaatagattatcatttgaaggtcaacctgaaaaatggataccaaatacgaaaattaaagatcataaaaataagcatttgaatgtaattatagaagactttaataatgatttaggggttgcggcatcattatcaaaaattttactttgggttggtaaaaaaataaataatgaagattatttaacacttggaagggaaattttagaaagacaagaaattttaaataaagatgaggatggttatgc

SEQ ID NO: 13899 - DNA, 69 bp, Neocallimastix californiae
  6hp_glycosidase
tagatatcatcgattttgggaacaatgtgaaattttatcggctcaaggactttactccctattatatac

SEQ ID NO: 13900 - DNA, 375 bp, Neocallimastix californiae
  6hp_glycosidase
aatttataaaaatcattataataaattaaatttacataattcaacatcttcattctataatttagactctatcccttatacaactttagaaactttatatatagatcaaacagtagattatggtcatataacaactataaaagaattttcatataaactttggatagaagcaatacaagggaaaatatcaggaaaatggaaatctttcgttaatgcttggaatatatttgaaatgaatatgattcctaaagaagaaaatcaaagaggaagttatatttattattcgaataatcataattcacagaataatcaagatacactatataaaagtttaaatgaatattatcaaacctggtcaatatatttaccgcatta

SEQ ID NO: 13901 - DNA, 1314 bp, Neocallimastix californiae
  6hp_glycosidase
acaagattatgctcgtcaccttgagctttccattcttttttatgaagctcaaagatctggtaaattaccagctaataacagaattttctggcgtcatgacagtatggttgatgctggtaaagataacaatgttgatttaactggtggttactatgatgctggtgataatgtaaagtttaactttccacaagcaagtgcattaactcttctcgcttggagtgctgttgattggaaagatggttacaaggaagctggtcaatggggatatatgaaagatttattaaagtggggtatggattatttcattaaatgccacaccagtaaatatgaattatacggtcaagttggtaatggtagtttagatcatggagcttgggttccaccagaggaaattgattatgaatatccatcatacaagattactgcttctgctccaggttcagatcttgctgctgaaacatctgcttctatggttgctgcttctatggctttcagagatgatgatccagaatatgcggatattttattaaagcatggtaaggaactttacgattttgctgaaaaataccaaggtacttacgataaatctattactgatgctaagggttattatcgttcctacagtggattcaatgatgaacttgtttggggtgccgcctggttatacagagctacaggtgataagacctataaggataaagttgataagatttgggatactccatatggtgatcttgatccagataagttcctcggttctggtggtccaatttcttgggatgataaaaaggctgctgcttatgccttaatggctcttactactggtgagagcaagtatgttgatgaatctactaagcacagtgaattaatggttaactacaaaactactccaggaggtttatggtatgatactaatttatctatgtggggttctaacagatatgcttccaatgctgcttttactgttgctatgttagctacatctatggatgctaatgacgctaagcgtaaggaatacgttaaattcattaagaagcaaattgattatattattggtgataatccagccaaggttgattacgttgttggtgccgacccaagttctccaaaggctgttcaccaccgtggtgcttccggttcaaagggtgctgataagggtccaagtgaaaatgtctttgttttatatggtgctctcgctggtggcccaggagctaatgataatttcaaggatgctcgtgataactatgaaatgaacgaagttgctttagattacaatgctgccttccaaggtcttttagccttccttattcaaga

SEQ ID NO: 13902 - DNA, 1314 bp, Neocallimastix californiae; identical to SEQ ID NO: 13901
  6hp_glycosidase

SEQ ID NO: 13903 - DNA, 60 bp, Neocallimastix californiae
  6hp_glycosidase
ttatcacagattctgggctcaaactgaaattgccgttgctaacggtcttatctctatcta

SEQ ID NO: 13904 - DNA, 948 bp, Neocallimastix californiae
  6hp_glycosidase
tccagatgctgatgctcgtgctattcaagctgcttatttcgcttatatttgggctgaagaagatggtcaaaatctttcctcccttgcttctaaggctgctaagcttggtgattacttacgttactctcactacgataaatactttaagaagattggtaactgtataggataccaacaatgtcaaggtggtcgtggtaagaactctgctcactaccttatttcctggtacttctcttggggtggtggtttacaaggtgactggtcttggagaattggttcatcccacactcacactggttaccaaaacccattagctgcttgggttctttctactcaagctgctttcaagccaaagggttcttctgctgtcaaggattggtcaacttccttagatcgtcaattagaattattcagatggttacaagctgctgaaggttgtattgctggtggtgctactaactcatggcaaggtcactacgctcaaccaccaagtgacattacctccttttacggtatgtactatgattggcaaccagtttaccatgatccaccatccaacaactggactggtatgcaaggttggggtatggaacgtgtctgttccctttacttcatttctggtaacgaaaaggccggtaaggtttgtcaagaatgggctaaatgggttaagaacaatgttcgtgttaatggtagtgaaattgttcacgctactaacttcgaatggtctggtaacccagatgaatggaagccttctaacttcaacaagtctggtcttaacgcttctcttcatggtaccgtttcctctgaaggtgttgatcttggttctcttgcctctatcatcaaaggtttaatgtgggtttccatgaaggataatgatcaagaaggtattgatctttccgttcaagttatggatgccattgaacaatacaaggataaatatggttatgg

SEQ ID NO: 13905 - DNA, 48 bp, Neocallimastix californiae
  6hp_glycosidase
ggaactccaacaagcttatggtacctgggatatctatgctatgcactg

SEQ ID NO: 13906 - DNA, 267 bp, Neocallimastix californiae
  6hp_glycosidase
ttctgacgaatacgctaaaagagttactgatacatacaatgctgttactggtaatggaagttacaattctgattacttctcaccagaaaatgttccataccactcaatcgaaactatgatggttgaagctccagattacggtcatgaatctgtttctgaaacttattccttctgggtttggttagaagctattaatggtaagatgaccggtaattacaagggtgttgaaactgcttggagttacttagaaaagcatcttattccaaa

SEQ ID NO: 13907 - DNA, 1323 bp, Neocallimastix californiae
  6hp_glycosidase
tcaagattatgctagacacattgaattatctcttcttttctacgaagctcaacgttctggtaaacttccagaaaataacagaatttattggagacatgatagtatgctcgatgccggttctgaccatggtgtcgatcttactggtggttattatgatgctggtgataatgtcaagttcaatttcccaggtgcagcttctttaactcttcttgcttggagtgctattgattatgctgatggttacaaaaaggctgaccaatggaaatacattttagatgctgtccgttggggagctgattactttgttaaatgtcacactggtaaaaatgaactttacgttcaagttggtgacggtcaaatcgatcatggttattggtacccaccagaatatattcaatacaagcattcatcttacaagattactgcttctgctccaggttctgaagttgctggtgataccgcttccttcttagcagcttcttctattcttttcaaggaggaaaatccaacttattctgctactttattaaagcatgctatagaaatttacgattttgctgataaatatcgtggtgaatatactaaggctgttccagatgctcaaggtttctatgctaattggagtggtttcttggatgaattagcatttggtgctttatggttatacagagctactggtgatgaaagttatatgcaaaaattctctactattgctgatgctaaatatggtgaacaagatagtaaggcttatggtatttcaactggtccaatctcatgggatgataagagaccaggagcttatattcttgctgctatggttactggtgaagaaaaacgtttacaacaagcctactggtattgtgatagtattttaactcaaccaaaaactagaggtggtttatggtatgatgctagtctttctcaatggggttctaaccgttatgcctctaatgctgctgctatgcttgctatgtttgccaattatcttccaaaatctgatccaaaacgttctaaatacgttgactttgtaaaaaaacaaaccgattatattcttggggataatccagctaagattaattacgtggttggtgctgaagctagttcaccaaaagccgttcatcatcgtgctgcttctggtacctatgattctcaagatactaatgccaaaccaaccgactataacatctttactttatggggtgctttagctggtggtccaggtccaaaggatgaatataccgattctagaaagaattatcaaatgaatgaagttgctcttgattataatgctggtttccaaatgaatcttgctttccttactaa

SEQ ID NO: 13908 - DNA, 240 bp, Neocallimastix californiae
  6hp_glycosidase
tcgtttcaactgggatggttctaacccatctgaacaatacactttaggtgaaactggtgctaatgctgtcgctactttcgctttaatgggtcttagtggatacgaaaatgttattaagaagaacttaaagatggcttgggatgctcaacttatgactggtagatatcgttattacgatggtttagttcactacttagctatgcttcaccttcttggtagtttcaagatctggaagccagc

SEQ ID NO: 13909 - DNA, 1122 bp, Neocallimastix californiae
  6hp_glycosidase
tggtgcttactacactggtgattacactagtcctttcaagacttacttaggtaaaactgatgctgaaattcaaggaaagttagatcaactttggaatcactattttaagggtgataacaacagtaaagtattttacgatagaggtaatgaaggttacattttagatgttaacaacaatgatgttcgttctgaaggtatgtcttatggtatgatgattgctgttcaaaccaaccacaaagaagaatttgacaaactttggaactgggctaagaaccacatgtggcacaaaggtggtggctgggatggttacttcgcctggcaacgtaacaccagtggtaatggtggtgatgataattgtgctccagatggtgaaatgtactttatgatgtcacttctctttgccgctaaccgttggaataacaaacaatatatggatgatgctcaatacatcattaagagaatgtgggataatccacaacacaaacttttcaaccaacaaaataacattattactttccaaccacaaggtactggtaacaatttctctgatccatcctacgatttaccagcctttgttgatcttatttctcgttggtctactaccaaccaaaatagatggaagtctgctgctcaagctactcgtgatcacttatacaaatcttctaacacaagatctggtttattcagtgattacaacaactttgatggtactccacactctgaaagttacaaccaaaatgcttccaagtacatgtacgatgctatgcgttgtgctatgaactttggtatggattactacttattcggtagtgatgccaaacgtgaaactgaaatggctaagcgtatcattgatttctttgaaaaagatggttacaaacatgctcgtttcaactgggatggttctggtgcttctgaacaatacactcaaggtgaaactggtgccaatgctgttgcttgtttcgctttaatgggtactcaaggttatgaaagtattattaagaagaacttacaaatggcttgggatgttaaaccaatgactggtcaataccgttactatgatggtttagttcactacttagctatgcttcaccttctcggtagtttcaagatttggaaaccagc

SEQ ID NO: 13910 - DNA, 591 bp, Neocallimastix californiae
  6hp_glycosidase
tgattatgcaagaattttaaatttaaatttacgtttctatgaatgtcaatggtctggaaaagccccagaacataaacaagtatactggagatatgattctgctttagatgacggagctgatgttggattggatcttactggaggtttctatgatgctggtgatcatgtaaaattcaatttaccaatgtcatatgctatgactatgttagcttggggtggtattgatttatatgacaattatgttgctgctggtcaactcgactatttacttcaaatggttaaccatggagcagattattttgttagatgtcacccagaaaaggaagttatttatgctcaagttggtcttggtgctattgatcattgtttctgggttccaccagaattaatgactatggaaagaccagcagcttgtaaacttacaccagataatggtgcttctgatgttactgctcaaatggcagctgcattagctagtgcctctatattaaataaaatgtatggtaataaagaaaaagctgaattatatttaaagcatgctattgaaatttatgactttgctgataagtacagagatgtctataataatcc

SEQ ID NO: 13911 - DNA, 60 bp, Anaeromyces robustus; identical to SEQ ID NO: 13885
  6hp_glycosidase

SEQ ID NO: 13912 - DNA, 768 bp, Anaeromyces robustus
  6hp_glycosidase
ttctgctggtcgtggtaagaactctgctcactaccttatctcctggtacttcgcttggggtggtggtttacaaggtgactgggcttggagaattggttcttctcacactcacactggttaccaaaacccattagccgcttgggttctttctactcaatctgctttcaagccaaaatctagaactggtgctgacgattgggctacttctcttgaccgtcaattagaattattcagatggttacaagcttctgaaggttgtattgctggtggtgccactaactcatggcaaggtcactacgctcaaccaagcagtgatattactaccttctacggtatgtactatgactggcaaccagtttaccacgatccaccatcaaacaactggactggtatgcaaggttggggtatggaacgtgtctgttctctttactacatttctggtaatgaaaaggccggaactatctgtagagattgggccaaatgggttaagaacactgttcgtgttaatggtaatgaagttattcactccactaaccttgaatggtctggtaacccagatgaatggaacagcaacaacttcaacaagtctggtcgtaacagatcccttcacggtacctcatcttctgatggtctcgatcttggtactcttgcctctatcattaagggtttattatgggtttctgctaaggataatgatgccgaaggtattcaacttgttcttgatgttatgaatgctattgaacaatacagtgacgatcttggttacgc

SEQ ID NO: 13913 - DNA, 60 bp, Anaeromyces robustus; identical to SEQ ID NO: 13891
  6hp_glycosidase

SEQ ID NO: 13914 - DNA, 777 bp, Anaeromyces robustus
  6hp_glycosidase
gaccaaatgttctgctggtcgtggtaagaactctgctcactaccttatctcctggtacttcgcttggggtggtggtttacaaggtgactgggcctggagaattggttcttctcacactcacactggttaccaaaacccattagctgcttggattctttctactcaatctgctttcaagccaaagggttctactgctgttaaggattggcaaacttctcttgaccgtcaattagaattaattagatggttacaagctactgaaggttgtattgctggtggtgccactaattcatggcaaggtcactatgctgaaccagacagtgatattactaccttctacggtatgtactatgactggcaaccagtttaccacgatccaccatcaaacaactggactggtatgcaaggttggggtatggaacgtacttgttctctttactacgtttctggtaatgaaaaggccggaactatctgtagagattgggccaaatgggttaaggaaactgttcgtgttagtggtggtcaagtaattcacgctactaaccttgaatggtctggtaacccagatgaatggaacaagaacaacttcaacaagtctggtgctaaccgttctcttcacggtactgtttctgctgaaggtcttgatcttggttcaattgcttctatcattaaggctttattatgggtttctgctaaggatggtgatgaagaaggtattgaccttgctattcaagttatggatgctattgaaaactacaaggatgatctcggttatgc

SEQ ID NO: 13915 - DNA, 312 bp, Anaeromyces robustus
  6hp_glycosidase
taaatacgttgactttgtaaaaaaacaaaccgattatattcttggggataatccagctaagattaattacgtggttggtgctgaagctagttcaccaaaagccgttcatcatcgtgctgcttctggtacctatgattctcaagatactaatgccaaaccaaccgactataacatctttactttatggggtgctttagctggtggtccaggtccaaaggatgaatataccgattctagaaagaattatcaaatgaatgaagttgctcttgattataatgctggtttccaaatgaatcttgctttccttactaa

SEQ ID NO: 13916 - DNA, 1122 bp, Anaeromyces robustus; identical to SEQ ID NO: 13909
  6hp_glycosidase

SEQ ID NO: 13917 - DNA, 114 bp, Anaeromyces robustus
  6hp_glycosidase
tggtccaggtgctagagatgattacaaggatgatcgtaccaattataattctaatgaagttgctttagattataatgctgcttacactggtcttcttgctttcttaattcaaga

SEQ ID NO: 13918 - DNA, 1314 bp, Anaeromyces robustus
  6hp_glycosidase
acaagattacgcccgtcaccttgaactttctattcttttctatgaagctcaaagatctggtaaattaccagctaataacagaatcttctggcgtcatgacagtatggttgatgccggtaaagacaacaatgttgatttaactggtggttactatgatgctggtgataatgtaaaattcaatttcccacaagccagtgctcttactcttcttgcttggagtgctgttgaatggaaagatggttataaagaagctggtcaatgggaatacatgaaagatttacttaagtggggtatggattattttgttaaatgtcacactggtaaaactgaattatatggtcaagttggtaatggtagtcttgatcatggtgcttgggttccaccagaggatattgattataagtatccatcttataagattactgcttctgctccaggttctgatcttgctggtgaaactgctgctgcattagttgcttcttctttagcattcagagaagatgatccagaatatgctgatctcttattaaaacatggtaaggaaatttatgattttgccgataaatatagaggttcatatgataaatctattgaagatgctaagggttactaccgttcatatagtggttatatggatgaacttgtttggggtgctgcttggttatataaggctactggtgacgaaacatataagaaaaaggttgatgccatttgggattatccatacggtgatcttgatccagataagttccttggatcaactggcccaatttcttgggatgataagaaggcttcctcctatgctttaatggctatgattactggtgaagataaatatgtcaaagaatctactactcacagtgatttaatggttaattataaaactactccaggtggtttatggtatgatactaatttatctatgtggggttctaacagatatgcttctaatgctgctttcactgttgctatgttagcttcttctatggatcctaatgattcaaaacgtaagcaatatgttaagtttgttcaaaagcaaattgattatattattggtaacaatccagcaaaggttgattacgttgttggtgctgatccaagctcaccaaaggctgttcatcatcgtggtgcttcaggttctaagggagctgataaaggtccagatgaaaacgtattcgtcttatatggtgctcttgctggtggtccaggtgcaagagatgattataaggatactcgtaataattatgaaatgaatgaagtagctttagattacaatgctgccttccaaggtcttttagctttccttgttaaaga

SEQ ID NO: 13919 - DNA, 1323 bp, Anaeromyces robustus
  6hp_glycosidase
tcaagattacgcaagacatattgaactttctttacttttctatgaagctcaacgttcaggtaaacttccagaaaacaaccgtatttactggagacacgacagtttacttgatgctggtgctgataatggtgttgatcttactggtggttattatgatgctggtgataatgtcaagtttaacttcccagctgctgccactttaactcttttagcttggagtggtattgattatgctcaaggttataaagaagctggtcaatgggattatcttcttgatgctgttcgttggggtgctgattatttcatgaaatgtcacactggtaaaaacgaactttatgttcaagttggttctggtagagttgatcacgcttactggtatccacctgaatatgttaactatgatcatccatcattcaagattactgcttcagctccaggttctgaagttgctggtgacactgcttctttcttagctgctgcttctattttattcaaggatgttgattcatcatattctcaaaaatgtttaaaacatgctaaagaaatttacgatttcgctgatacttaccgtggtgaatacactaaagctgttgaagatgctcaacaattctatgctaattggagtggtttccttgatgaattagcttttggtgctttatggctttacagagctactggtgatgaatcttaccataataaatttaagaaaattgctgatgattcttacggtgaacaagatactaaagcttatggtatttgtactggtccaatttcatgggatgataagagaccaggttcttacattcttgctgccatgattactggtgaagaaaaacgtttacaacaagcttattggtattgtgatgaagttttaactcaaccaaaaactccaggtggtttatggtataatgataacctttctaaatggggttctaaccgttatgcttctaatgccgctgctatgttaggtatgttcgctaattaccttccaaagagtgatccaaaacgttctaaatatattgattttgttaagagtcaaaccaattatattcttggtgataatccagctaaggttaactatgttgttggtgccgaagctaattcaccaaaggctgttcatcaccgtggttcttctggtacttacgattctcaagataataatgctaaaccaaccgattacaatatttacactttatggggtgctttagctggtggtccaggaaaatctgatgattattctgatactagaaagaattatgaaatgaatgaagttgctcttgattacaatgctgcattccaaatgaatcttgctcttcttgttaa

SEQ ID NO: 13920 - DNA, 951 bp, Anaeromyces robustus
  6hp_glycosidase
tgattatgcaagaattttaaatttaaatttacgtttctatgaatgtcaatggtctggaaaagccccagaacataaacaagtatactggagatatgattctgctttagatgacggagctgatgttggattggatcttactggaggtttctatgatgctggtgatcatgtaaaattcaatttaccaatgtcatatgctatgactatgttagcttggggtggtattgatttatatgacaattatgttgctgctggtcaactcgactatttacttcaaatggttaaccatggagcagattattttgttagatgtcacccagaaaaggaagttatttatgctcaagttggtcttggtgctattgatcattgtttctgggttccaccagaattaatgactatggaaagaccagcagcttgtaaacttacaccagataatggtgcttctgatgttactgctcaaatggcagctgcattagctagtgcctctatattaaataaaatgtatggtaataaagaaaaagctgaattatatttaaagcatgctattgaaatttatgactttgctgataagtacagagatgtctataataatccatgcccagaaggtgcttccttctacccatctgcttcttataaggatgaattagtctggggtgctgcttgggtttaccgtgcatcaggtgatgaaaaatactataaaaaagctgatgaatattatgattctcttgctttatctggacgtaatttaattggaccaattacatgggatgatgcttcatctggtattgttttcttaatgtcaaaaccaggttttggttctaactgggaaagatacttaggcgaagctcaacattatgttgatcaatacttaaatgatatgggtgctcgtactgatggaggtatgttatggtacagttccgtttctggttggggatctgctcgtcatgctatggc

SEQ ID NO: 13921 - DNA, 1326 bp, Anaeromyces robustus
  6hp_glycosidase
acaagattatgctagacatattgaactttctttacttttctacgaagctcaacgttctggtaaacttccagaaaataatcgtatttattggagattcgatagtcaacttgatgctggtgctgatcatggtgttgatcttactggtggttattatgatgctggtgataatgtaaagttcaatttcccagctgcagcagcattaactttattagcttggagtggtgttgattatgctgatggttataaaaaagctggtcaatgggattatttccttgatgctattcgttggggtgctgactattttatgaaatgtcacactggtaaaaatgaattatatttccaagtcggtgacggtaaaattgaccacacttattggtatccaccagaatatactgtctatgaacatccatcattaaaacttactacttccaaaccaggttctgaagtagctagtgatacagcttcatttttagctgctacctatatgatatttaaagatattgatccaacttacgctaaaaaatgtttacaacattcaaaagaaatttatgaatttgctgacaagtatcgtggtgattattcaaaatcatttggtaattatgtcaatgatttctataaaaattggggtacaattaatgatgaattagctttcggtgctttatggctttatagagctactggtgatgaatcttatttagctaaatataaggttattgctgatgcttcatatgatagtcgtgatgaaagtgcctatccaaattgtagtggtccaatttcatgggatgataaaagaccaggtgcctatgttcttggtgctattgttactggtgaagataaatatttagataaagctatcagctattgtgatgctgtattaactcaaccaaaaactcgtggtggtctttggtataataataacctttctaaatggggttcaaatcgttatgcttctaatgctgcttctatgttaggtatgttagctaattatcttccaaaggatcatccaaaacgttcaaaatatattgattttgttaaaagtcaaactaattatattcttggtgataatccagctaaagttaattttgttgttggtgctgaaaagaattcaccaaaggctgtacatcaccgtggtgcttctggtacttatgattctcaagatactaatgctaaaccaactgatcataatgtttacactatttggggtgctttagctggaggtccaggtaaggatgattcttataccgacacaagaaagaattatgaaatgaatgaagttgcccttgattataatgctgctttccaaatgaatcttgctttacttgttaa

SEQ ID NO: 13922 - DNA, 108 bp, Anaeromyces robustus
  6hp_glycosidase
aggtgctagagatgattacaaggatgatcgtaccaattataattctaatgaagttgctttagattataatgctgcttacactggtcttcttgctttcttaattcaaga

SEQ ID NO: 13923 - DNA, 1302 bp, Anaeromyces robustus
  6hp_glycosidase
tgattatgctagaattttaaatttgaatttacgtttttatgaatgtaattggtctggtaaagctccagaacataaacaagtctattggagatatgactctgccttagaagatggtgctgatgttggcttagatcttactggaggtttttatgatgctggtgatcatgtcaaatttaatcttccaatgtcttatgctatgactatgttagcatggggtggtattgatttatatgaaaattatgtcgctgctggacaaatcgactatttagttcaaattgttaaccatggtgcagattactttgttaagtgtcatccagaaaaggaagttatttacgctcaagttggtcttggtgatgttgatcactgtttctgggttccaccagaattaatggaaatggaaagaccagctgtatgtaaacttactccagaaaatggtgcttctgatgttactgcacaaatggctgcagctttagcttcagcttctatcttaaataaaaaagttggaaatactgaaaaagctgaactttacttaaaacacgctattgaaatttatgactttgctgataaatacagagatgtttatggtaatccatgtccagaaggtgcttcattctatccatctgcttcatacaaggatgaattagtttggggtgctgcttgggtttaccgtgcttctggtgatgaaaaatattatgataaggctgatgaatattatgattctcttggtttatctggtcgtgttttaattggaccaatttcatgggatgatgcttcttcaggtattatcttcttaatgtcaaaaccaggttttggtaagaactgggaaagatatttaaatgaagctcaaatttatgttgatcaatacttaaatgataaaggatctcgtactgatgctggtatgttatggtacagttccgtatctggttggggatctgctcgtcatgctatggccggtgttttcctttattgtatatttaatacttaccacaaaccagaagatccaaaatactttaactttattcaacaacaagctgattacattcttggtaataatccatttaatcgttctcttgttgttggttctattccaggtcatgatccattaaatgttcaccatcgtggttctcatggtggttattcaccaatttcaccaccagaacataacatgtacactttatatggtgcccttgctggtggtccacttcaagatgattcatgggatgatgatagaaacaactatattactaatgaagtttcttgtgattataatgctggtattactggtgttatggcctatcttac

SEQ ID NO: 13924 - DNA, 948 bp, Anaeromyces robustus
  6hp_glycosidase
tccagatgctgatgctcgtgctattcaagctgcttactttggatatatttgggctaaggaagatggacaagatctttctgctgttgctgctaaagctgctaagcttggtgattatatgcgttatgctcaatatgataaatatttcaagaagattggtaattgtattggttataataaatgtgctgctggtagtggtaaaaattctgctcactaccttatttcttggtacttcgcttggggtggtggtttacaaggtgattgggcttggagaattagttcttcccacactcacagtggttaccaaaatccattagctgcttgggtactttcttctgaaccagctttcaaaccaaaatctagtactggtgctgaggattgggcaacatctcttgatcgtcaattagaattattcagatggttacaatcttctgaaggttgtattgctggtggtgccactaactcatggcaaggtcactatgctcaaccagatagttcaattactactttctatggtatgttctatgattggcaaccagtttatcacgatccaccatccaacaattggtctggtatgcaaggttggggtatggaacgtgtttgttcattatattaccttagtggtgatgaaagagctggtaaagtttgtcaagaatgggctaaatgggttaaaaagaatgttcgtgttagtaatggagaaattactcactgtactaatattaaatgggaaggtaatccagatgaatggaattcttctaactttaataaagctaaccttaatgcttcacttcacggtacttcctcttctgaaggtacagatcttggtaccgttgcttcaattattaaaggtttactctgggtttccttaaaagataatgaccaagaaggtattgatcttgttattgatgtaatggatgctatggaaaattacaaggatagtcttggttatgc

SEQ ID NO: 13925 - DNA, 60 bp, Anaeromyces robustus
  6hp_glycosidase
atatcacagattctgggctcaaactgaaattatggttgctaatggtattctttccattta

SEQ ID NO: 13926 - DNA, 48 bp, Anaeromyces robustus
  6hp_glycosidase
agaacttcaacaagcctatggtaattgggatatgtatgctatgcactg

SEQ ID NO: 13927 - DNA, 270 bp, Anaeromyces robustus
  6hp_glycosidase
cgctgatgatcaatatgcaaaacgtgctactgaacattacaatattattacaggtaatggttcttactcctcaaaatatttctcatcagaaaaagttccatatcactctgttgaaactcttatggtagaagctccagatcatggtcacgaatctgtatctgaaacttattctttctggatttggttagaagctgttaatggtaaacttacaggtaattatgaaggtgttgatactgcttggtcttacttagaaaagcatcttattccaga

SEQ ID NO: 13928 - DNA, 48 bp, Anaeromyces robustus
  6hp_glycosidase
agaacttcaagtcacctatggtacatgggatatgtattctctacattg

SEQ ID NO: 13929 - DNA, 951 bp, Anaeromyces robustus
  6hp_glycosidase
tcctgatgctgatgctcgtgctattcaagctacctattttgcttatttatgggctaaagaagatggtatcaatcttccatattctattattttaagagctacaagacttggtgattatttacgttattctcattatgataaatattttaaaaaaattggtgattgttttaattataaattatgtacaccaggttccggtaaaaattcagcacattatcttatatcatgggcttattcttggggtggaggtataatgggagattggacttggagaagaggttcttcttatattcatagtggttatcaaaatccattagttgcttggatattttctactcaatcagcttttaaattaaaatcttccactggtaataaagattggtcggtttccttggatcgtcaattagaatttatgagatggttacaaactcctgaaggttgtattgctggaggtgcaacaaattcatgggaaggacaatataatacaccacctcaaaatataaccaatttttatggtatgtattatgattggcaaccggtttatcataatccatcctcaaataattggataggtatgcaagctcgaagtatagaacgagtttgttctttgtattatctttctggaaatcaaaaagctgaattaatatgtcaaacatgggtagaatggattaaaaaaaatatacaaattcatgattatgaaattattcatgctacaaaacttacatgggaaggtaatccagatgattgggattcatctagtttttataaaagtggcattaatacctctcttcatggtacagtttttgaaatgggatttgatcttggttctatggcttctattgttaaaagtcttttatgggtatcgatgaaagataatgatcaagaaggacttgatcttgctattcaaattatggatattattgaaaattataaggatgatttgggttatgc

SEQ ID NO: 13930 - DNA, 288 bp, Anaeromyces robustus
  6hp_glycosidase
taatgatgagtatgctcaacgtgttattgaacagtacgaaaaattaaccaataatggtacttatgatacagattatttttcaaaagataattatttaccgttttattccattgaaactcttattgttgaagaggataatagtttttccagattagattatggtcacttatctacttctgaaactttatcttattggatttggttagaagctgttaatggtaaaattactggtaattatgaaggtgtagattgggcttggagtgtcatggaaaaatttttaattcccta

SEQ ID NO: 13931 - DNA, 63 bp, Anaeromyces robustus
  6hp_glycosidase
tacttatcatagattttgggttcaagctgaaattatgattgctaatggacttctttccattta

SEQ ID NO: 13932 - DNA, 69 bp, Anaeromyces robustus
  6hp_glycosidase
taaataccatagattttgggaacaatgtgaaattttattagcacaaggtctttattctcaatattatac

SEQ ID NO: 13933 - DNA, 828 bp, Anaeromyces robustus
  6hp_glycosidase
tttaaataaaattacaaaaatgagtgattatatgttatattttataaataatgatgcttcattacaatcttttaattctgactcaacggatgaaaataaaaattatctattatcacgttacttttcttggaaaggaagtatacatggaaaatggttaacaaagaaaataatttccaatataattggtattggaagtcaaaatccatttgttgcatatattttatcaaatgtcaaagaatttaattcagaaaatcctaattctgtaaataaatggaaaaaatcatataaaaggcaaattgaatttattcgttggttacaaagttcggaaggagcaatagtaggaaacgcaaaatatccttctaatattgatgatataaatcataaatcttctttttatgatcttatatttacttcatcaaatgaagaagaaaatgatttatttagtactcaatgctttgtttttgaaagtattgctgaactttattatattactaaagataaagatattgaaataattttatttaaatggcttgattgggtattatctgtttttcatttaacaagtgatagatcatttagaattccaaataaattatcatttgaaggtcatccggaaaaatggaaaccaaatacaagtattgaagatcatgaaaatgataatttaaatgttattgttgaagattacaataataatataggggttgcagcatcattatcaaaaattctattattggttggtaaaaaaaataataatgatgattatttaactttaggaagagatatattagaaaaaattgaattaataaataaagatgaatatggatatgc

SEQ ID NO: 13934 - DNA, 1287 bp, Anaeromyces robustus
  6hp_glycosidase
ccaagattatgctagacatcttgaattaaatttcttattctatgaagcccaacgttctggtcatcttccagccaataatcgtattccatggagaagtgactctggtcttgaccatggtgctgataatggtgtagatcttactggtggttattatgatgctggtgataatgttaaattcaatttcccacaagcattctctatgactgctattgcttggtatggtcttgaattcgctaaaggtgttgaaatggctggtcaaactgaatatttaaaggataccgttaaatggggttgtgattatttattaaaatgtcataaaaagggtacagatgttttctatatgcaagttggtgatggtgatattgatcatctttattggaaggctgttgaagatattgattatccaactccatccttctatgttgattctaaaaacccaggtactgaagttactggtgaaactgctgctgcttttgctgctgcttctcttcttttcaaagaaagtgacccagaatattctgctactcttttagatcaagctgttgaatggtttaattttgctaatacttatagatttgattattctgtttctgttccaaaggttgctagttactataagagttggggtggttacaaggatgaacttgcctgggctgctatatggctttacaaagctcttggtgaagaaaaatacttagaattagctaaggatcttgttaaagattataaacttggtgaactcggttttgattgggatagtaaataccaaagtactattgttatccttgctcaacttggtgttaaggaatatgttgaaaaagttgaaaattgggttagagaaatttgtactaagggtaaattatctccaggtggtctttacattaataaagatagtgaatggggatcctgtcgtcgtgctacttctatggctgctagtttaattttctatactcatactcttccagaaggtaatgaattacgtgaaatggctaagaagtttgctcaatctcaagctgattatgttcaaggtaataatccacttggtattgatttcgttgttggtgctgatgcttcttcaccacgttctgttcatcatcgtactgcttctggtgctgattgtattgaatgtgatccagttgaaaatgctcatattatttatggtgctttagctggtggtccagatgaaaatgatcaatatgaagatattagagctgattaccaaaagaatgaagttgctcttgattataatgtttgttatgctgctgtttgtgcctatcttattgaaga

SEQ ID NO: 13935 - DNA, 69 bp, Piromyces finnis
  6hp_glycosidase
taaatatcacagattttgggaacaatgtgaaatattattagcacaaggtctttactcacaatattacac

SEQ ID NO: 13936 - DNA, 375 bp, Piromyces finnis
  6hp_glycosidase
aatatatcaaaatcattatgataaattaaatataaataattcttcctctatatactacaatgctgattcaataccatattctactttagaaaccctatatatagatcaaaatgtagattatggtcatttaacaacattaaaggaaatttcatataaactatggatagaagcattacaaggaaaaatttcaggaaaatggaaaccttttgttaatgcatggaacatatttgaaaataatatgataccaaaggatgaaagtcaaaaaggaaatagtaaatactattcaacaacaaataattcaataaatacaaaggattcactttataaagaattatatgaacaatatcaaacctggtctctatatttaccacataa

SEQ ID NO: 13937 - DNA, 930 bp, Piromyces finnis
  6hp_glycosidase
tagtgattctcgttacatttcaaaaataatagaatcggtttatagggcttattgctggtcaactgagcaaaaaaagaataaatttatgaaaccaatacttaaaaaaatcataaaaatgagtgattatatgttatattttattaatagtgatgattcgctacaatcatttgattccgaatcaaatgaagacaataagaattatttattatctcgatacttttcatggaaaggcagtatggaaggaaagtggttagaaaaagaagttactacagatattattggtattggaagtcaaaatccattaattgcttatgtcttatcaaatgataaaaacttcaattcagaaaaccctgaatttgtatcaaaatggaagaaatcataccaaagacaaattgaatttatacgatggttacaaagttctgaaggagctattgttggtgtagctcaatacccttcaaatcataatttaagctcaaaaaaaatgccttccttttataatttaatattctcaaaaaattttgaagttgaagaaaataatttatttggtactcaatgttatgtttttgagagtcttgctgaactttattatattactaaagataaggatattgagattataataacaaaatggttagattgggttttatccgtttttcatttaacaagtgatcgattatttaaaattccaaataagctaacctttgaaggacaaccaaaagattggaatcaaaaggatggtataaagaatcacaaaaatgataaattaaatgttatcgttgaagactataacaatagtattggtgttgctgcctcattgtcaaaaatcttattattaattggaaaaaaaaataataatgaagattatctaacgcttggtagagatattttagaaagaatagaaatatcaagtaaagatagtcaaggttattc

SEQ ID NO: 13938 - DNA, 1326 bp, Piromyces finnis
  6hp_glycosidase
tcaagattatgctagacatcttgaattatcacttcttttctatgaagctcaacgttctggtaaacttccagaaaataacagaatttactggagacatgatagtttagtcgatgctggtgctgataatggagttgatcttagcggtggttattatgatgctggtgataatgctaaatttaatttcccaggtgctgctacaatgacccttttagcttggagtggtattgattatgctgaaggttacaaggaagctggtcaatggaaatatcttcttgatgcagttcgttggggagctgattacttcatgaagtgtcacactggtaagaacgaactttatgctcaagttggtaagggtactactgatcactcatactggtacccaccagaatatgcttcctacgatcacccatcattcaagctcacagcttcagctccaggtaccgaagtttcagccgatactgcctcattcttagctgcttcatacctcttattcaaggatgaagatccatcctatgcctccaagtgtttacaacactccaaggaaatctatgactttgccgatacttaccgtggtgattacattggatcaattccagatgtttcaggtttctactccacctggagtggttacaatgatgaattagcctttggtgccttatggctttacagagccactggtagcgaaagttacatgaagaaattcgaagccattgctgatgcagtttatggagctcaagatactaaggcttacggtacttgtactggaccaatttcatgggatgataagagaccaggtgcttatattcttgccgctattattactggtgatgaaaagcgtatgaaacaagcttcttggtattgtgataatgtcttaacacaaccaaaaactccaggaggtttatggtatgatgccaacctttctaagtgggcttctaaccgttatgcttcaaatgctgctgctatggttgctatgtatgctaactatcttccaagttctgattctaagcgttctaaatatgtagattttgttaagaagcaaactgattatattcttggtgataatccagctaagattaattacgttgttggtgctgaagccaactcaccaaaggccgttcaccatcgtggtgcttctggtacttatgattctcaagatactaatgccaagccaactgattacaacatctttactttatggggtgctttagctggtggtccaggtccagatgatgaatacactgattctagaaagaattatgaaatgaacgaagttgcacttgattacaatgctgctttccaaatgaatcttgctttccttacacaaga

SEQ ID NO: 13939 - DNA, 1320 bp, Piromyces finnis
  6hp_glycosidase
tcaagattatgctagacatcttgaattatcacttcttttctatgaagctcaacgttctggtaaacttccagaaaataacagaatttactggagacatgatagtttagtcgatgctggtgctgataatggagttgatcttagcggtggttattatgatgctggtgataatgctaaatttaatttcccaggtgctgctacaatgacccttttagcttggagtggtattgattatgctgaaggttataagagtgctggacaatgggaatatattttagatgctgttcgttggggtgctgattatttcatgaaatgtcacactggtaaaaatgaactttatgctcaagttggtgatggtaatactgaccatgctttttggtatccaccagaatatgtaaaatatgattacccatcatttaaagttactgctgaaaaaccaggttctgaagttgctggtgaaactgctgcatttttagctgctgcttccattctttttaaggatgaagattcttcttattctgccaaattattaaagcatgctaaggaaatttatgaatttgctgatacttatcgtggagattatactggtgctattccaggagttgttagtttctacagtacctatagtggttataatgatgaattagcttggggtgctgcttggcttcttagagctacaggtgatgaatcttatcttaataaatacaatgttatcgcaaataaaaagtatgaatcttatgatccaaagaaattttcaggtgctactggaccaatctcttgggatgataagagaccaggttgctatattttaattgctatggttactggtgatgaaaatcgtatcaaggaagcttacaattattgtgatgctgtattaacacaaccaaaaactccaggtggtttatggtatgatgatggtttatctatgtggggttctaatcgttatgcatcaaatgctgcctccatgttagctatgtttgcaaactatcttccaaaatctgatccaaaacgtgctaagtatgttgaatttgttcaacaacaaactaattatattcttggtgacaacccagctaaaattaattacgttgttggtgctgaagccaactcaccaaaagctgttcaccatcgtggttcttctggtgtcttcgattcacaagataaagctgcaaaaccagatgaaaacatttacacattatggggtgctttagccggtggtccagatgaaactgattcttacattgatactcgtagtaactttagaaccaatgaagtagctcttgattacaatgctgctttccaaatgaatcttgctttcctcgtaaa

SEQ ID NO: 13940 - DNA, 1326 bp, Piromyces finnis
  6hp_glycosidase
tcaagattatgctagacacattgaattatctcttcttttctatgaagctcaacgttctggtaaacttccagaaaataacagagtttactggagacatgatagtttacttgatgctggtgccgataatggtgttgatcttaccggtggttattatgatgctggtgataatgttaagttcaacttcccaggtgctgctgccttaactcttcttgcttggagtggtattgattatgctgatggttacaaagaagctggtcaatgggattatatattagatgcagttcgttggggtgctgattactttgtcaagtgtcacactggaaagaatgaactctacgttcaagtaggtaagggtgctactgatcatggtttctggtatccaccagaatatgttcaatatgatcatccatcttacaaaattactgctgctgctccaggttccgaagttgctggtgatactgcttctttcttagctgctgcctctattcttttcaaggatattgattcttcatattcttctaatttattaaaacatgctattgaaatatatgattttgctgattcttaccgtggtgaatacattaaggctgttccagatgctcaaggtttctactctaactggagtggttacaatgatgaattagcctttggtgctttatggttatacagagctactggtgaaagtaagtatatggataaattcagtaaaattgctgatgcttcttacggtgaacaagatactaaggcttatggtacatgtactggtccaatttcatgggatgataagagaccaggtgcttatattcttgccgctattattactggtgatgaaaagcgtatgaaacaagcttcttggtattgtgataatgtcttaacacaaccaaaaactccaggaggtttatggtatgatgccaacctttctaagtgggcttctaaccgttatgcttcaaatgctgctgctatggttgctatgtatgctaactatcttccaagttctgattctaagcgttctaaatatgtagattttgttaagaagcaaactgattatattcttggtgataatccagctaagattaattacgttgttggtgctgaagccaactcaccaaaggccgttcaccatcgtggtgcttctggtacttatgattctcaagatactaatgccaagccaactgattacaacatctttactttatggggtgctttagctggtggtccaggtccagatgatgaatacactgattctagaaagaattatgaaatgaacgaagttgcacttgattacaatgctgctttccaaatgaatcttgctttccttacacaaga

SEQ ID NO: 13941 - DNA, 1323 bp, Piromyces finnis
  6hp_glycosidase
tcaagattatgctagacatcttgaattatcacttcttttctatgaagctcaacgttctggtaaacttccagaaaataacagaatttactggagacatgatagtttagtcgatgctggtgctgataatggagttgatcttagcggtggttattatgatgctggtgataatgctaaatttaatttcccaggtgctgctacaatgacccttttagcttggagtggtattgattatgctgaaggttacaaggaagctggtcaatggaaatatcttcttgatgcagttcgttggggagctgattacttcatgaagtgtcacactggtaagaacgaactttatgctcaagttggtaagggtactactgatcactcatactggtacccaccagaatatgcttcctacgatcacccatcattcaagctcacagcttcagctccaggtaccgaagtttcagccgatactgcctcattcttagctgcttcatacctcttattcaaggatgaagatccatcctatgcctccaagtgtttacaacactccaaggaaatctatgactttgccgatacttaccgtggtgattacattggatcaattccagatgtttcaggtttctactccacctggagtggttacaatgatgaattagcctttggtgccttatggctttacagagccactggtagcgaaagttacatgaagaaattcgaagccattgctgatgcagtttatggagctcaagatactaaggcttacggtacttgtactggaccaatttcatgggatgataagagaccaggtgcttatattcttgccgctattattactggtgatgaaaagcgtatgaaacaagcttcttggtattgtgataatgtcttaacacaaccaaaaactccaggaggtttatggtatgatgccaacctttctaagtgggcttctaaccgttatgcttcaaatgctgctgctatggttgctatgtatgctaactatcttccaagttctgattctaagcgttctaaatatgtagattttgttaagaagcaaactgattatattcttggtgataatccagctaagattaattacgttgttggtgctgaagccaactcaccaaaggccgttcaccatcgtggtgcttctggtacttatgattctcaagatactaatgccaagccaactgattacaacatctttactttatggggtgctttagctggtggtccaggtccagatgatgaatacactgattctagaaagaattatgaaatgaacgaagttgcacttgattacaatgctgctttccaaatgaatcttgctttcctcgtaaa

SEQ ID NO: 13942 - DNA, 1323 bp, Piromyces finnis
  6hp_glycosidase
tcaagattatgctagacatcttgaattatcacttcttttctatgaagctcaacgttctggtaaacttccagaaaataacagaatttactggagacatgatagtttagtcgatgctggtgctgataatggagttgatcttagcggtggttattatgatgctggtgataatgctaaatttaatttcccaggtgctgctacaatgacccttttagcttggagtggtattgattatgctgaaggttataagagtgctggacaatgggaatatattttagatgctgttcgttggggtgctgattatttcatgaaatgtcacactggtaaaaatgaactttatgctcaagttggtgatggtaatactgaccatgctttttggtatccaccagaatatgtaaaatatgattacccatcatttaaagttactgctgaaaaaccaggttctgaagttgctggtgaaactgctgcatttttagctgctgcttccattctttttaaggatgaagattcttcttattctgccaaattattaaagcatgctaaggaaatttatgaatttgctgatacttatcgtggagattatactggtgctattccaggagttgttagtttctacagtacctatagtggttataatgatgaattagcttggggtgctgcttggcttcttagagctacaggtgatgaatcttatcttaataaatacaatgttatcgcaaataaaaagtatgaatcttatgatccaaagaaattttcaggtgctactggaccaatctcttgggatgataagagaccaggttgctatattttaattgctatggttactggtgatgaaaatcgtatcaaggaagcttacaattattgtgatgctgtattaacacaaccaaaaactccaggtggtttatggtatgatgatggtttatctatgtggggttctaatcgttatgcatcaaatgctgcctccatgttagctatgtttgcaaactatcttccaaaatctgatccaaaacgtgctaagtatgttgaatttgttcaacaacaaactaattatattcttggtgacaacccagctaaaattaattacgttgttggtgctgaagccaactcaccaaaagctgttcaccatcgtggttcttctggtgtcttcgattcacaagataaagctgcaaaaccagatgaaaacatttacacattatggggtgctttagccggtggtccagatgaaactgattcttacattgatactcgtagtaactttagaaccaatgaagtagctcttgattacaatgctgctttccaaatgaatcttgctttccttacacaaga

SEQ ID NO: 13943 - DNA, 1323 bp, Piromyces finnis
  6hp_glycosidase
tcaagattatgctagacacattgaattatctcttcttttctatgaagctcaacgttctggtaaacttccagaaaataacagagtttactggagacatgatagtttacttgatgctggtgccgataatggtgttgatcttaccggtggttattatgatgctggtgataatgttaagttcaacttcccaggtgctgctgccttaactcttcttgcttggagtggtattgattatgctgatggttacaaagaagctggtcaatgggattatatattagatgcagttcgttggggtgctgattactttgtcaagtgtcacactggaaagaatgaactctacgttcaagtaggtaagggtgctactgatcatggtttctggtatccaccagaatatgttcaatatgatcatccatcttacaaaattactgctgctgctccaggttccgaagttgctggtgatactgcttctttcttagctgctgcctctattcttttcaaggatattgattcttcatattcttctaatttattaaaacatgctattgaaatatatgattttgctgattcttaccgtggtgaatacattaaggctgttccagatgctcaaggtttctactctaactggagtggttacaatgatgaattagcctttggtgctttatggttatacagagctactggtgaaagtaagtatatggataaattcagtaaaattgctgatgcttcttacggtgaacaagatactaaggcttatggtacatgtactggtccaatttcatgggatgataagagaccaggtgcttatattcttgccgctattattactggtgatgaaaagcgtatgaaacaagcttcttggtattgtgataatgtcttaacacaaccaaaaactccaggaggtttatggtatgatgccaacctttctaagtgggcttctaaccgttatgcttcaaatgctgctgctatggttgctatgtatgctaactatcttccaagttctgattctaagcgttctaaatatgtagattttgttaagaagcaaactgattatattcttggtgataatccagctaagattaattacgttgttggtgctgaagccaactcaccaaaggccgttcaccatcgtggtgcttctggtacttatgattctcaagatactaatgccaagccaactgattacaacatctttactttatggggtgctttagctggtggtccaggtccagatgatgaatacactgattctagaaagaattatgaaatgaacgaagttgcacttgattacaatgctgctttccaaatgaatcttgctttcctcgtaaa

SEQ ID NO: 13944 - DNA, 1311 bp, Piromyces finnis
  6hp_glycosidase
ccaagattacgctcgtcaccttgaactttctattcttttctatgaagctcaaagatctggtaaattaccagctaacaacagaattttctggcgtcatgacagtatggttgatgctggtaaagataacaaggttgatttaactggtggttactacgatgctggtgataacgttaaattcaatttcccacaagctagtgctcttactcttcttgcttggggtgcctacaaatggaaggatggttacaaggaagctggtcaatgggattacatgaaggatttacttaagtggggtatggattacttcattagatgccacactgacaagtacgtcttatacggtcaagttggtaatggtagtttagatcacggtgcttgggttgctccagaagatattgactacgaatacccatcttacaagattactgcttccgctccaggttctgatcttgctgctgaaacttctgcctctatggttgctgcttctttagctttcagagatgaagacccaacctatgctgatactttattaaagcatggtagagaactttatgaatttgctgaaaagtaccaaggtacttacgataaatctattactgatgccaagggttactaccgttcttacagtggttttaatgatgaacttgtttggggtgctgctatgttatacgctgccactggtgaacaaacttacaaggacaaggtcgataagatttggaacactccatacggtgaacttgatccagatagattccttggttctactggtccaatttcttgggatgataagaaggctgctgcttacgctttaatggccatcactactggtgaaagcaaatatattgaagaatccactagacacagtgatttaatggttaattacccaactactccaggtggtttatggtacgatactaacttatctatgtgggcttctaacagatatgctgctaatgctgctttcactgttgctatgttagctacctctatggatgctaatgactctaagcgtaaggaatatgttgcttttgttaagaagcaaattgattacattcttggtgataacccagctaaggttgattacgttgttggtgctgacccaagttctccaaaggctgttcaccaccgtggtgcttctggttcaaagggtgctgacaagggtccagatgaaaacgttttcattttatatggtgctcttgctggtggtccaggtgccaaggataattacaaggatgctcgtaacaactatgaaatgaacgaagtcgccttagattacaatgctgccttccaaggtcttttagccttccttatcac

SEQ ID NO: 13945 - DNA, 915 bp, Piromyces finnis
  6hp_glycosidase
tttaaaacttactacaggtgctccaggttctgaagttgctggtgatactgcttcatttttagctgctacttacattattttcaaggatatagatccttcttatgccaaaaaatgtttacaacattctaaggaaatttatgaatttgctgatacctatcgtggtgattattcaaaatcttttggtgattatgtcaatagtttctataagaattggggtactatttatgatgaattagcttttggtgctttatggctttacagagctacaaatgatgaatcttacttaaaaaagtataaagcaattgctgatgcttcctacgatactagagatgaaaatgcctatggtaattgtaagggtccaatttcatgggatgataagagaccaggtggttatgtacttggtgctatcgttactggtgaagaaaaatatattgaaaaagctttaagttattgtgatatggtattaactcaaccaagaactccaggtggtttatggtatgatagtaacctttccaaatggggttctaaccgttatgcttctaatgctgcatccatggtagctatgatggcagatttccttccaaaggatgatgctagacgtgcaaagtatgttgatttcgttaaaagtcaaacagattatattcttggtgataatccagctggtgttaactatgttgttggagctgaagaaaattcaccaaaggctgttcaccaccgtgctgcctcaggtacttatgattctcaagatcgtaatgccaaaccaaatgatcataatgtttacactatttggggtgctttagctggtggtccagcaaaggatgattcctacgaagataccagaaagaattatgaaatgaatgaagttgctcttgattataatgctgctttccaaatgaatcttgctttccttgttaa

SEQ ID NO: 13946 - DNA, 126 bp, Piromyces finnis
  6hp_glycosidase
tgctcttgctggtggtccagatgctaatgataaatatactgatgatcgtaccaactataattccaatgaagttgctttagattataatgctgcttatactggtcttcttgcctttttaattcaaga

SEQ ID NO: 13947 - DNA, 126 bp, Piromyces finnis
  6hp_glycosidase
tgctcttgctggtggtccagatggtaatgataagtacactgatgaccgtaccaattacaactccaatgaagtcgctttagattataacgctgcttacactggtcttcttgccttcttaattcaaga

SEQ ID NO: 13948 - DNA, 1195 bp, Piromyces finnis
  6hp_glycosidase
tgattatgctagaattttaaatttaaatttacgtttctatgaatgtcaatggtctggaaaagctccagaaaataaacaagtctattggagatatgattctgccttagaagatggtgctgatgttggtttagatcttactggaggtttttatgatgctggtgatcatgtaaagtttaatttaccaatgtcttatgctatgactatgttggcttggggtggtattgatttatatgataattatgttgctgctggtcaaattgattacttaattcaaatggtaaatcatgctgctgactattttgttagatgtcatccagaaaaggaagttatttatgctcaagttggtcttggtgatgtagatcattgtttctgggttccacctgaattaatggaaatggaaagaccagctgtttgtaagcttactccagagaatggtgcttctgatgtaactgcacaaatggctgctgcattagctagtgcatcaattttaaataagaaatatggtaatgaggaaaaagctgaactttatttaaagcatgctattgaaatttacgattttgctgataaatacagagatgtatatggtaatccttgtccagaaggtgcatctttctatccatctgcttcttataaagatgaattagtttggggtgctgcttgggtttaccgtgcatctggagatgagaaatactatgaaaaggctgattcatattatgattctcttggtttatctggtcgtgtattaattggtccaatttcttgggatgatgcttcatcaggtattattttcttaatgtcaaagccaggatttggttcaaactggaaaagatatttaggtgaagctcagacttatgttgatcaatacttaaatgataaatcagctcgtaccgatgctggtatgttatggtatagtgctgtttctggttggggatctgctcgtcatgctatggctggtacattcctttactgtattttcaatacttatcataacccaactgatccaaaatactttaatttcattcaacaacaagctgattatattcttggtaataatccatttgatcgttcacttgtagttggttctattccaggtcatgatccacttaatgttcatcaccgtggttctcatggaggttattcaccaatttctccaccagaacacaacatgtatactttatatggtgctcttgctggt

SEQ ID NO: 13949 - DNA, 1195 bp, Piromyces finnis
  6hp_glycosidase
tgattatgctagaatcttaaatttgaatttacgtttttatgaatgtaattggtctggtaaagctccagaacataaacaggtttattggagatatgattcagcattagaagatggtgcagatgttggattagatttaactggaggttactatgatgctggtgatcatgttaaatttaatttaccaatgtcatatgcaatgactatgttagcttggggtggtattgatttatatgataattatgttgctgctggtcaaattgattatttagttcaaatcgttaatcatggagcagattactttgttaaatgccatccagaaaaagaagttatttatgctcaagttggtcttggtgatgtagatcattgtttctgggttccacctgaattaatggaaatggaaagaccagctgtttgtaagcttactccagagaatggtgcttctgatgtaactgcacaaatggctgctgcattagctagtgcatcaattttaaataagaaatatggtaatgaggaaaaagctgaactttatttaaagcatgctattgaaatttacgattttgctgataaatacagagatgtatatggtaatccttgtccagaaggtgcatctttctatccatctgcttcttataaagatgaattagtttggggtgctgcttgggtttaccgtgcatctggagatgagaaatactatgaaaaggctgattcatattatgattctcttggtttatctggtcgtgtattaattggtccaatttcttgggatgatgcttcatcaggtattattttcttaatgtcaaagccaggatttggttcaaactggaaaagatatttaggtgaagctcagacttatgttgatcaatacttaaatgataaatcagctcgtaccgatgctggtatgttatggtatagtgctgtttctggttggggatctgctcgtcatgctatggctggtacattcctttactgtattttcaatacttatcataacccaactgatccaaaatactttaatttcattcaacaacaagctgattatattcttggtaataatccatttgatcgttcacttgtagttggttctattccaggtcatgatccacttaatgttcatcaccgtggttctcatggaggttattcaccaatttctccaccagaacacaacatgtatactttatatggtgctcttgctggt

SEQ ID NO: 13950 - DNA, 345 bp, Piromyces finnis
  6hp_glycosidase
catgtactacctttctggtaacgaaaaggctggtcttgtctgtaagaactgggctcaatgggttaaggacactactcgtgttaacggtggtgaagttatccacgctactaacttaggttgggatggtaatccagatgaatggaaggcctctaacttcaataagtctggtcttaacaaatctcttcacggtactgttacttctgaaggtcttgatcttggttccattgcctctattatgaagggattaatgtgggtttctatgaaggatggtgatgaagaaggtctttctcttgctgtttctgtcatggatgccattgaaaactacaaggatgatcttggttacgc

SEQ ID NO: 13951 - DNA, 60 bp, Piromyces finnis
  6hp_glycosidase
ttaccacagattctggggtcaaaccgaaattatggttgccaatggtcttattgccattta

SEQ ID NO: 13952 - DNA, 270 bp, Piromyces finnis
  6hp_glycosidase
tgctagcgatgaatacggtagacgtgttactgatctttacgatgttatgactggtaatggttcttacagttctgaatacttctctgctgaaaaggttccataccactctgttgaaactcttatggttgaagctccagatcatggtcacgaatctgtctctgaaaccttctctttctggatttggttagaagctgttaacggtaagatcactggtaactacgatggtgtcgaagaagcctggaactacttagaaaagcacattattccaga

SEQ ID NO: 13953 - DNA, 60 bp, Piromyces finnis; identical to SEQ ID NO: 13951
  6hp_glycosidase

(The sequence listing continues in the following parts.)

What is claimed is:

1. An engineered organism, wherein the organism expresses the ScaA protein of *Piromyces finnis* comprising SEQ ID NO: 27325.

2. The engineered organism of claim 1, wherein the organism is selected from the group consisting of *Saccharomyces cerevisiae*, *Zymomonas mobilis*, *Escherichia coli*, *Clostridium thermocellum*, and an anaerobic fungal species.

3. The engineered organism of claim 1, wherein the organism expresses a synthetic cellulosome, comprising
the ScaA protein of *Piromyces finnis* comprising SEQ ID NO: 27325;
one or more catalytic enzymes capable of digesting lignocellulosic biomass; and
one or more carbohydrate-binding elements.

4. An engineered organism, wherein the organism expresses the ScaA protein of *Piromyces finnis* comprising SEQ ID NO: 27326.

5. The engineered organism of claim 4, wherein the organism is selected from the group consisting of *Saccharomyces cerevisiae*, *Zymomonas mobilis*, *Escherichia coli*, *Clostridium thermocellum*, and an anaerobic fungal species.

6. The engineered organism of claim 4, wherein the organism expresses a synthetic cellulosome, comprising
the ScaA protein of *Piromyces finnis* comprising SEQ ID NO: 27326;
one or more catalytic enzymes capable of digesting lignocellulosic biomass; and
one or more carbohydrate-binding elements.

7. An engineered organism, wherein the organism expresses the ScaA protein of *Piromyces finnis* comprising SEQ ID NO: 27327.

8. The engineered organism of claim 7, wherein the organism is selected from the group consisting of *Saccharomyces cerevisiae*, *Zymomonas mobilis*, *Escherichia coli*, *Clostridium thermocellum*, and an anaerobic fungal species.

9. The engineered organism of claim 7, wherein the organism expresses a synthetic cellulosome, comprising
the ScaA protein of *Piromyces finnis* comprising SEQ ID NO: 27327;
one or more catalytic enzymes capable of digesting lignocellulosic biomass; and
one or more carbohydrate-binding elements.

* * * * *